United States Patent 6,812,339 (POLYMORPHISMS IN KNOWN GENES ASSOCIATED WITH HUMAN DISEASE, METHODS OF DETECTION AND USES THEREOF) - sequence listing, part 65

SEQ ID NO: 16191 - DNA, 155617 bp, Human
tactgcatgtaattgacacagcatgcaaagtggattgtttgccacgtggtaagtaagcccttaataaatggcaagacgttaagggatttgcccaagatacacttgtaaaacagcctacaaggaccagaaaccaaggaagatttcagactccgaatcccatgcttttctactaccctgcttcctagaacactgagttaattaaactactaatttgatgaacgaccttgagcaaaatacttcactgagtcagtttactcatctgtaaaatgagggacttgatttagataatgcctaacgtcctttcagagtctattccagctacattagatgttttatccggtgttgcagggttgacgttcaggtccgtgatatgtccaagatctgtataatcataagccgtgcacatggcaatgaattttattccgacactcgtatttcgttcaatatttagttctgtgtgcacactcagctgttgcctgtctttagtctgcctaccagcgccttgtgaagggaagacccacacctagctttatttatttatatcctggcttgttcccgaaaggatttaaggcggcgagtgacactctaagtcccctaacggtgtcacacagtgcgattaagaaatcctctttggatgaaatcataccgtagaaaatcgccgatgagtgagatgctaactaattaatgtcttttacccaactcttaaaaataaaaactaatgcacctagcaagaagtcctggaagcatacagtgctggctctccctccagctctgacgctgtcccacccgttgtcaacggtcactcgaatgcccttcttagactagccaaaattgtcgccgctccagtaccagctggaccaagatcccaccccaccccttcgctgcccctcatcacccaagtttcctgattgggaaggggcccgaagaacctttctcacatttctattttattggctggcacggctgtcagtaatctctccttcccgccttctagcctagcgcgtttcgtggaccccttggtttctgcgacaagccgcttacgtttgcctgagccgtgttgccggggaccagcgacctttcacccctcccttcccacaggagcgccccggcccccgcccccgccccaaccgccggcgcgcgtcctcaccgcgcacgcgctcccctcgcgcgcgcacacgctcgcgcacacacgctccctcgcccccgcccgcggagttccccctcacccctcagccgccccgccggctgaagcatcggcgctgggaggcggcggcgctgctgagaggcagggacccgagcgcgaagtgtgtgggagtctacgaactcaacccctctctaccctcccctcacagccacccccctccctccccgccagccccccccaacaagcgggagaaataatgagcgagaccgggcggcagcagcagcagcgccgagcagcccaggcaacggcagaaccgctccggcagcggcggcggcggcagcaccagcagcgggagcgagcgcaacgctagcgcggcgcggggaccgccgcgctccttcccggctcctgccctcctctgccgctcgctcctctctcggcatccacctccttcccctcctcctgctcattcactctttccctcactctcccctcctcctcggcttctccccgcgccccgccagccctcgcgctctcccactccctctgcctgtcctccccggtcccctcctcccgctcattcactcgcccctctcccttctccactctctccccctgtctcctttcttcttcttctttcaccctccgtctctcacaccccctccattcccctgtctcctttctgacactgcactgcagctgctcctcagccctgccccctccccagtgagaacaaaccagcaacattgctttttttcctaaagagatttatattgatccgattaaaaaaaaaaaaccttaagaaaccccaaacgcaaaaaaaaaaaaaaaaaaaaaaagaaaaaagaaaagaaaaagccaaaacaaaagggagaaccttctcccggtagcagcggcaggaactgcaaacatgatggcggcagctcccatccagcagaacgggacccacactggggttcccatagacctggacccgccggactcgcggaaaaggccgctggaagccccccctgaagccggcagcaccaagaggaccaatacgggcggtgggtatcgcttccacctccccgctggccccatcccccgccgcccgcccctgcctccctccctcgccgtcctccctccctccttccctccctccctcccgcggcccggacacctccagcccgaacccggcggcccctgcgcccctgccccgcgccccctcccctgcacctgccccgcgcctaggtgtccccgacacatttccatttctgtgtttatcattcatcaaaatggcgaccagtttttcggaatagacctatctttccatttaatcggtccagaggttgaccatgtaaatatcctagacctgggcaagaaggtccattcaggaggaggaggaggatgaccccggagtgaggtgatggccgcccgaagatgcgcgctgcgtttaacagtctgataaaataaataaataaatggcacttgggtagcggattgcgaatgattggggcgccggagagtttttcctctctccatcctcttgctttgggccacaagtagtatgcaaaatcttgatgagtgcatgcccttaccgcacttagattgtcggtgcaaatatttcattgatttgtcttcaggggggtgcatacgagggtgggggtgtctggaacggtgacttgttagttaacatcctgcgcttccttggaagatgagttttaacgggaccgatatcgcttcttcatttgcactggaatcatcttaacaatgcacccaatgcatcgaagcagaggtgaatttatctccagcatatgcattgtagacggatgggggtcttttgagtggcacaccacaacatttggaacattcattcacattaagaaagctggatttaccggggtgtctcctgtataagatgtgatcaagttgacggaaattaaagtttgtggagttggcttaattttctaaaacgtttcattttatttttcctggttcttccaccccctttccgttttaaaagttgtgattattttgggaaaggaacattacctgttttgtcacttttaagcctatttaatataaatgactcctaagctttttagtattggcagaattcttcttaaggtcctttaattaatgagcttaaacgagatcacggtagactaagaagtgctaaagaaatgcactaggattagttagatttgccagtccaccacactgagttatttcctggcagttattgaagacttggaatacaccccacagtttgggtggattatttggtaggagaatggttgttttgcggactttaagtaggatataggcaatggctaattgtagtccttatgtgtctgctaatgacaaataaatatagctcatcactatttacagtcctgggcttttcttcttttttaatatgttaagtgaaggtttgtcatcttataaacctctgaagttttgttaaagggtcagttcatttcattttgccacagatagaattggaagatttccatgtttggaataacaactggaatttagtcatcagtttttacagtgctgcaaaataatagaatatgtttatattttaattccaagcttgaaagtataaatcctataaaatgggaaacattttgtacctgtttgtttttcaatgtaattggcttattttcattctcaaaaaatgtttaacttcatatttcctgcagttatatacccagtgctttagttgctgtttttctctcttgagggtggagaggggatacaaagtttgaaatactgtgttaaccgagtatatttctttgcatttttcagaagacggccagtattttctaaaggttctcatacctagttatgctgctggatctataattgggaagggaggacagacaattgttcagttgcaaaaagaaactggagccaccatcaagctgtctaagtccaaagatttttacccaggtaggtgcaatggtgaagagattgtttgatgagctccccacaggaaagaaagatctacttgtgttgtgtgctgtcttgaaagaatttttaaacaatactggagactttatttagatattgctttataggaatatattgtggaaaaattttcagattatttctattgttgattatgcctttttcctataattgttgtaccgtgtatgtgaattagaccagttgcaagatgattcgggtatttctgaataattcttattagcaaaaaaactcaaaaatttaaagatagaaacctggacagctggcatcaggaaatagggttcttctgaagttttcagacatcattgtaatgacaattagcttagagtgaattcagaagaggggggtagggaggcttcttaaagaatggaccatttacttctgaatccattatgtacctctttctgcttcattgctttgtttgttggccttggagtgaagtaaagaggacaagtgttgcctcttcagattttttaaatattgcagttttaatgcaattgatataaggaaatttatactgttatgcaagaagtaaaataatgcttcagaattcatgttaacttaagagctaaatttgattaaatatgttgacagttagtgtagtacagtaacctactggaatatgggaagtttccttggtggtataaattttttgtttttcactttcaagtatgcctttttaagtgttaaatagttctgcatgtccatctttttctatttttttcttacattttgctaatcactatatgtattttaggtttaagggaaaagtctctgtaattgagtagtagatttcctagataaaacattatcagctgatttgcttttatttaaatctagctttctgtgatttttttaaaggttattttatctttatggctgtcaaaaacgttaattcagtgctgagggaaccaatactgctttaatttttttcttcctggtggaaaagaaaagctgatttgctttcagtgatctaattcagtaagagttctttaatacagcaaagacatctggcatgaatgtaagcagaacatttggaggacttctttttcatagccaatcacttggtattagaaatggaccattatactggataagaaggttttagaatggttgaaactatcatttagttttacaaattaaatgtagtattttttgtaaacattaaacttattaaactaaaaggtaatatattagacacgatgttcctctaaagtttgtttcctatgagtgtagttttgcagatggctttccttgtctctgaaactttccttatgcattaagaaagtttgctaacatattcacattcatatgtttaaaaggtatattatgataaaaaaaatcaatgtggaattgtgaaaacccttagtacaaataaaagcactcaaaagagcttgattgcagaattaataacgtgatagttctaggaaaagagctgcaatggtaaattaaattcactgtcaatagatgaaaatgaaatagcttttttgcattatacatgaggtggtatcagatgtgcagggatgttacagaaaattggtgtttatcaaggatattccaaatagtaaattaaatgccttttcatttgaatatagtttattttcagtgggttggaaagggtgcactgagaattagatcttttgtttttagtccacttagttgtacattttttgcttattacattgaaattgattattttatttatagttctgaggcatgttatttgtatagagcaagaatatctgttggaaaaaaatggaaagctggaatgcgttgaataaaattttgtgtgtgtggtgacgtaacctgatcaaatgtgagttgaaatgttggataaaagaagtctatactttaccggtaacaggtggaaaccaatcacacagtatgggatcaattttaaggataaaataaagcctcgtagtttataagaagcttaaagaattctgaacagtttgtattaaaatacaattttaactggattattacctgtttggacagataatctctttgcttcagatagacattaattttaatagtctttctcttcgcacttgaccacaagtcttcagaataattttaagatcccggtattcttcaacatagcctctgagcgcttttcagtttctcttactcagatgtacgtaagggacacttaccttgtacatctcagatgagctaaattataaactgtgatcatatcatcaagttataaagaatttcttagaggattaatgaaatcatttggaagcccgtttttgtgtctttcatacatatatgaagttcttaaagctatatatatgtatatttatgactgtcataatctactggaacaaatatgcctaatgtttatttcatgaagccccttttctgtttctcatttggtaagagcatatttggggaaaagtctactttagttgtataacctaatggattttctcaaattacccaagtttttaagcagaatgtaattgtgtttgtaaggtttagttaaaatactagtgtgttttcggaaactttcttcaggatgtgtaacacagaatacagacacactcgggacattttaatacattttaactcaaacgataggtactttaaagaaattatagccaatataatttccttgtatgcttatttgtttttcttatttcttttgaaaatatcttaagcaaccctgcctttatgagtaatttttaaaattatggttgaaatgaaaaaacatttttgtacactaattgagaatttgtacagctggatattgcattgcatttttcaatgtcgtgtattaaataacaaacttgagaaaattgtgtgatgaggaattgtaaaatgtattcttcaattactgcaatcagataaaatgatctacaagtagatcatttttgctgtactacgtaatccatttatctgttttacaaaatcaaatcttacagagtactgacttaattctggtggtttaggaatatacctttttttttttcttacatgattagagcaagccaatttgatttacttatatatctttttataactaggttatagcaagttaccttgtagtaaaaaacagctttcttggtttgaggaatatattattgtatgccttttcagagtgacgatagtttatttttattcttttatttggcataaggatatgtttagtttttgttaataatcatattggttttatctgtaaaaattatttaatggatggttcaggtaggtaatccgaaaagcttactgcatgcattattggttggaaatgataacggatgtatgcaataaatattttcgtgtattccttagattttagaacatatcatagtatacttatttttattctattatatggtattcgttacatcagtcaaacagaatccttcattatagtgttggaatctgtctattttacactgttttaatatttgtcattataaaactagtatcacatttaataaaaatatttccttttatggttcttaatttaaaatttgaaattattatttgtacattcattatatttcaatttttcttactttccaaattgggtggtgcttttttaaaaaaaacacaaaccattatacatttttttaaatcataaaagagcagaatgtaagtgaaatttttttgtagggaaggaaagacccaacattgcttttattttgaaaaggggaaaatatagtggccaaattaaactttagaactggaattgtataattatgataattttttgcaaatcagaggagataatgaatttaaaacattatttctgtttacatcattgaaggaagagtattatgatattggtagtacatatgaatgtgaatctcttacagcttctaaaagttgcagtctgtactttgatcttagatgcaaagaatattggacatttgttggaatatatattttaaggcaaaattagtgataaatagaactgtaacaagtacagaaaataaaatggtataatttccaacattgttgggtgggtttaataggatagttatcattacactaggttatactttggattttagtgttatcaaagagttgctgacacaaagtgtttttccttgaatcttaaagttgtaatgtttatttgacacactacctattgttagggttacttttatcttttatctctatatctacagttgaaggagaaacataatcttttacttaaacattagtatctctgaaaatttgctgtattttggtttaattttttttaatactttattttcttactttaagcaataggaaatcttaacatatgaaggaacattactggcatagcgcaatctgtattaacattacagtttccaaaagatacaattttattcgtatcttgtgtatgcagatgttttgtggggtttttagaaagatgaattagcactaaaaattttagctgtacattttatttgattcctttttgtatcattttgatgttgacagagtaagttataagacatcattaatttatagtgttggtgttttcatgaatcatatacataatgctactttgaaatttgctttttgatgctttctgggctttggaaaaacagctcatttaaaatttgtgtcactgtaatgaaatatatctacaacattgccttgcaaatactaccccaaaggatttcaggaatagtttaaacatgttggtgatatagttcaatacttatgtattgaagatgtttcatacagcaagaggaaaaatgatctgtgtcttgaaaatgctaaggagtatgtgatatcactaaaaacctgactgacaaccatcagtgaaaaacttatgtattttatgttgtattgtttgggagttttttgctctggcttcagagaattaattttttaaaaaattattaactgacacaaatgacatttattgactacatattatgctacttgttaactaaatttcagcacctaataaatatttttgaccatagaatttttaactgtggagtctcagttttgtccagttcagtggagctatattttaaaacacaacttttatgagtaagttctgcttttcaaaataaaactggggggacgaaggtgggagatttgtgcttgattgccatctcatttccatctttggatactgctttagcataaagttaaacaacatctgcagagatctgactgacaaacatctctctgggactcatcattgcagcctgcagcaggtgcattcagctttgcagtcttttccaaaaagaggttagtttgttttaacatttatcagtagaccagtgggagcaagtgactagagagaagaggttagttgtcacttgttcagtactggaatactacaggtaattggactggactggtgggaactgcaacagtgtgtatctcacattgcactgcagctgctatggagcttaattaacctgaccctcagagactgaagtgtcatggtataaaacgcaacatgcaaggaatgaagtagtgcttttcaatactttctgatgcttgggttgatgaaatttccatattcttcattttattctttaaagatatggcatcagctttcctacgtctttaatatggaaatattttcaactacattgatttttcatgaaactgatagaatgtacataaaacaaggatagggtctttaggtatagaaataacaaaaaaataaccttaagtgagaagcatttacatttcactatgccaccagtacatatgtaaaacatgagtgagtggaaataagtggaagtacttggtagttcttcttaaaatattatctcagattaacatttatttttcataggaagttaaaacattataaaatttaagttgtatctttttagaatattgatggctttggcaagtacactttgcagagtagtttgaagtgttccaacaaacaggacaggtgtagcatattaaaaatatttttaagattttgaacttaattttactgaaatgtttcccacatttaattacaagtaaattaaaatttagtcaaaatctcaaaaaattactgtgtcatttatttctgttgtttttaatttctcaatctgtttgaagtattgactttgagtatgcgtctgtgacatatatacaagtttcttgtgtgttctaatagtattcccagtgaatacagatatgttatcacagtcctgttcattaatcagcccttaaatagacaatatattcaaaggtaaaaatacatttaaacgaaatctggcaaagtctgtactatcttaaaataatttggaatgtaaaaaccatttgaagtctttgtaaagcagttttatagctttgaattttctattaaatttactaatctgaattttttggtatccattgaatataatttattatttaccaaagagtagttaagttttggagtttgcacaggttttttttctatttttttgttttgtaaactatgtatttttcctgaaggaatatttaccagtattggtaataactgtttcatactgaagatactgcttgagaagaaaataatttttactttaattatgaatagttggaatttattggtaattatagctgttaaaagaaataagattaaagctatgctatctagaggtcaagagattcattccagtactttaaaacataaattattttattctcttttgacatgattgactatttttaatcaattcttatcaatataaaaatactttaaaatttcacatatatacttttaccgtgatttttaaatttttgtttaataagacattgaataagaacaaacattttaagactgcaaagtaaaaaagataattatttacactgatcaactttttgagatattttcagtattttccaagtttcacaccactgtatggatatccaaatcttgatcatgaaaacacctactatctccactccatcattgattctttgctgcttcctgcagggcctgtcatagcattgttgacaggaagagatgaaaaatgaaattaatgtcttgaggtttttaacagcaaaatgattaaggtaagattatttggtgtggaaaataaaacatttttgtccatttttcaatgaattttattcaataggttatatttaaaattgatgttatatttttcttttttatttcaagacctattttatgtcttactgatgttcaatatatttctaatttctgataaactgtattgcagactcaataatttaaaaattttagatggtagtgtttttttttttaccttccttgtgaaactgagcatacatttcgaagttctgtggaagaacttttcagttcattttaaagatgtttgagaatagttatactctcatggctccataattttactcacagtgtaagttttcagagaagtttgttaattaaaaagatttcaaatcctgcatttcttctaggatatgacagaagtttacttagtttacttagttctaaaaaatcattctgattttaaagaagattgtcttcatttaaattgttaataatttgctgctgtagaaaatacactggactgagactgtattttaagatctaatctaggggggaagggcagaatagaaccaatagtagtgcatttcagtaacacagaatagtaggtaatagggtacctactattttaaaaaaaaacatgtttttgttttctttttatgttgctaaatattttagaagaactgtagctttttaattttggtcatattaattcttgaaatacctggttttgaagtggttagtgttggaggtaagtaagctcttactggtagagctcattcacatacttagtccttaattattctttggataacccatgtttttatttttctatgatgttgatttctttaaaaagtggtgaaggtaattttttttgaaacttggtttcattcttaagtgtgaagtctgcctggaagctgtctcttgttaattattatgcatatttatcagatgcttcctgtaaacgctggtgtaggcagctatttggtaatcattacttagaattattacaatgtatcttttctccattcgaggaatataggcatactttgctttaccctgagaaattttgctttgctcttttctccttagatttttgtttttttttttttttatatattttagatccctgttaaagatttaggacaacacttaggaatagctaagagactttttatttaaaagatttggagaaatcatagagttgtggaaatagatcaaagtgatgaagttcagatgatctcttctaaaactttcatttaacagttgagaaaaccaaggtaccaagagattaagtgatttacctaaggtttctctaatgccagtaattgtcctgtagctttgaaatgtgttttctgaatttgtggtgcaattgtggtaggtacttcattctcttgttttgttctactttttttttccctcccttctggatgtgactctgaggaagtaagtccttacctcctctctctcctagtcttaaaatgaatatatgttctttaaaaaaaaaaaaaaaactgagatgatggcccagtggttattttgccattattattattattttagttcatgtgctacactgaaggaacataggcaggatgctctttggtcattaacaaatttcttttagaaaaggatatcataggttatattgcctggagcatgtagcctggtcattttctctctttccttaattatactgtttgaaagtggcagtgtttttatggtgattagatttctgcagcattgttatttttcttcatttgtactttttttctttcttgctttcatcattccttagctatacttctacattttaatttttggttagagtattgacttattaaaaaagtaggctaagttaaattttgttttcaagaattattttaataatatatgtatttttcatgtttttatgacttttataaaaactcctgtaagtatagtgtatttgggtgaatattcataacatttggttcaacagataaataccatgattaaaaaataagcatgaggctaattgtaaggcaacgtagtaaaaatgtagctgtattgtccagtaattattaatttgaaaacatcactgttttctcctttttggctattcatttcattaaattggtctactcagttaattagaattctgatactattttcattgtgttataggcttaaggactatgttctaatataatcataaaagtacttaatgtgattttgaagacttttccttctacagtgttaaattaaaacaaaaactcttttgtgatagtctttactcacatcagttgagtaattggattaaggtccactgatgtgggggaatttatggcatccttcttgcctgctgtgtgtttaacatacagcgcaattgtttaatcataggtggcactggaaatttaaatgaatgtatgaatgaatgactgaatgaaccatttgagatttcttctgtgaagtgctcatggaataccaatacagtggatatagaaggcagtccatctttagtttttcattacacttctagtttactttaataatgaatttagaaatttaaatgaacaagaaatgcatagaagtgttagggtaggtattggctaggtacagtggagtatgacaggggaattttgcgttctgtttagcatgctatcctgtgtgaaagaaactgaaatccaatattatggagagtatgttaaagccacctctgaaatgaagaccacctttaaaataacttaagcaatatgagtttaagaattagttattaataaagtatattaaaagtatatatatattacaagattttatagctgtatcacattgtagtttatttatggccacatggccatatgttcagtaaggaaaaagaccaatcatgatttttcttgagtactaaccatcaaattaaagtgatatattagaagtatgcttactaagtgttttgtttataatatattttaatatcttcttccccaactatagtggggaagttaacatgtgactttgttgggggaggttacattgttacattgagaaactggacaatttacttttctaatgtgccaagaaaaataaaaaataccagctgtatagtagagtggaacttatttgcttatagtttgactaacttaaatatcaaggtattagtatgttactttatttgaaattaaaattttagggaagatattgagtttgggatatttcggagtctttacatactttgtaaatatatgcaatttaaagagatacatgaaataagagtgtttttcttgtattaatacattgtttgatttttatcatagtaaaccagtgaaacatctaagatttaatagatagcactctttcatgccttgtgattagtcttccacatttttgtaaattttatttatattttaaaaagtaatggagaacagtgggttaaaataaccatatcatagtgtttcttgtctgtttccccgtgcccttctttgccacggattttaagtattatgaacattagtgggctttgttggggttagaactaagtatacaatgccctaaaatcttagatggataccaggttacaagtttgataactgtataatggagaattatatctagaagttgaaattatctctgttagtgtcagagtcttgggaggaggggttagatttcgaagaagacttcgaagaggagctgacagggttttggggactgaattttaatttgcttggtgaacaaaagtggaaagtcatttaaggcatatatagacataaagatgtgcaaaaattctgttatattcaggggtctaaaagtagtttggtattgattggataaaaagtggatattgctgttggtgtgggggtcagtggtggtaggaggcactatagatatctgtacaggtaagagacaatctagtgcatatgaaaaagaagaaaagactggctgaaaaatattcttcctagatatattcgttagcaagaatattttttaaatctacatctgctgtgtgtctgtaaaatgactgacagtggtactgtaattaaaaaatatatatttatgtaaatatagtgacacttatagtctggcggatggattgcccagttgttcaaaagtataattgagtatacgattggattctggctttctgcttaggaaatagaaatagaattttataaagacccaatttacttagaaaggaaaaggcaaagggaaagatggggcaactagaaatacagaaaagagatgttaagaaatgtgagttgtgtttaaccagttatgtgccaagtatggaagaaaaaaaaggtggaggacagttagtgaatgacagatttctatgaagaatgttttgctatatgtggggaagatctttaactaatttgcttttgattcatagcagttcagatcatatacaagaagaaatgtttcttgtttcttaaattcattcaatatgtaggcctttcttgctttcttagcatatgaaaatatatacttatttttaattggataaacatgagtgatttatacaatatatgtgtgtgtgtgtgtgtgtgtgtgtgtgtgaatttgatgctgttcaaacgctaaagttaggtatattgtcaaaacattgttaagctatgtcagtgaaaattaaaacttactatttattagtggattctctgttatgtaatttttttgcttgaatttttgttgattattgagataaagcgggatttttcatcatttataagtatttcacataagaatcaatcttaattaatacccttatcaaattcagatgaatttttaaaagtctgaaaaatatgatactgttttttcatttagaaaatgagattaaaaatctatcttgcattttatactgatttgtgcaattattggctacttgtgtagagaaacattaaaaaattgaacagctgaagtgacattaagcaacagatggggatttaaaataaaaatattcactgtgtaatctttatttaagtgctattcataattcagtaataccagttgtgtaactcaaggttgaattcaatataaaaaaggaagcataagaaaagtcccatttccttaaaattgatatctgtattatggtatgatttcatgatttgtttataaagtgagaaataatctagctaagagttgcatacatgtttttttgcaggtcaaattcaattctttttgagaaaaattttgaagaaattttgaattatttccaaataatatttatttgaatttaacatattttactgtttctgcctttaaaatgatattctattttgtattttagcttatcttctcaactgaaaatttgaaaccatgctttctttacagtagtattttaaactaattgttctgaagcgtatacctattctgtttaaggaaaggtatgttcctctcaaagctttatcacactttcagctatgctggtgtatttgacatcttgtttaaaaactagaatgtctctgcatacgaacacccaaactgtgataatgagctagatatgccatatgtggcactttaggttggcatatatctgaaatggcatgtttaatgtactgtattactaggattagtaattttacagtggaaggctgctacttttatgatatagtctcctgctgctgggcttataagtctgatggactctttactcaaaacctgttttttaatttctgtaaaaatctttttactattgaaattatctgcataagatctatctggctgattgacttattatctgaagtttgtcaagattagtgagaagtaaaaaacatatatagtttgataggtttataaatgtaaatagtaattatgtatattttgttaaggaataataatgctaacatatttagtattgccagcaatggtttagtaaagtacataattgagaattgttcacaatatttttatttttagaaaaaagtgcataggaaaagctttgaggttctatggagtcttggcagtgaagccattaaaaagcaaactgcaataaataatgttcttttatgacagaatgctcaactttaaattcatattccagttctcatggacataatattcattttttatttttaaaattatgcttttatccaagggttttactgaagcaccttcaaatcagtcaggagattgcgttaaaaataagtagatactgcattgcaatgaggataatttagataatttaaatttaaggtataagtaaagaatgtaaacattttttgactacttaaaatatgcagaataagtacaatttcgggtttgggaaatgtttcaactagcagttatctgaattctatatcttttgcaatttctgtgttttaaaaagccagactctgaatttcattatgttttcatttaaactgactctatcacagttaatagaaaatgggattgtgttgtttttaaattctttagactatacaactaaaagttacttgttgatcagttatggcttaatgagaccttacatttctataggattttaattcttaaaacatcagtgtaggtagaagtttttgtcttcattttacagatgaagaatataagatagtgaaaggtaaaattatttgtgatatgtcaagttaataatgaacctgtttattttctgttattgtgtaacagcattctgttattttgtatttgcatcaaattgtgtataaatttgagttcagaaatggagtattcaaaatttaagtaagatttatcaaactgccacatttgcccatcactgggagataatatttctgataggttatacatttttttccaattcatatgtaaatcctacaaaaattttgccattgaaaggaaaatagtaataactaagcaacatggaaacatacaaaagttattttttcagctgaccagacttgtgtatatatatagaaccttgatatctttctattttcctattttcatattgacattaggtcattaagatagtttgaaattgcttacatgaaatgtaaactttgagattgtttacatgaaatgattcaattgccttcatttggccctgtaagattttgtttctcactttttaaattatatataatgtctactttcaagatttgttgaattatagatttaaggttagaaaactctggtcagatcactgtgatatagtactcagtttaataaaaaattttatgaggaaaatatgcaatggatattatacaatgtagtttattaagcaattatcacatcagttcagtacttcttaacgcctctgtggaagtacgacgaatacaagacttctagagaacatgtggtgtcagaccagagtttgaatcccagctctgccacttactaggtgtactattttaatcagtcatttaatcttcttgtacctccagttttttatctgcgtaatgtagtatctgtacctctttcataattataactttaggtactaaaaaggaaaactgtaaaagcatgtcacataataaatatttggtgtataataagcttattatgaccctatcatttttcacctcctttctatgcttgtttcatttaataatactaaatttatagcagagattttaatgtagaataaattacattaatgtggccctaaaaaggacaacatttatataaggatttttaacaattgaagtgtttttttcataattgttgtaaaaatgcaggtgatagaatgccaaagctctgacctatcctcatcccacacctttaagataattaatataaataatttcttatatatttttaaacattctattttaaaatagcagttattgtttttagtggtaattataagtgatcatcgtttttatagataagaatgagttttccgcaaaccacctatgttgattaatgggtttatggagcttctaaatactgtaaggtgtctttccagtctcagctttgtgggtatttttgttgcatagcctaaataagtgttctataatacccctgaagatatgcagagctttttttatttgtttatgtttttgcctatatagtggagaagaaaactaggcatgtgaatttgtaatattaaagcaaattataataatctcatgtgaaacatatggatttatttgttttataactcattaaaattaacttaattagcctctgtcttcatccttgtatatgcaaatacaaaacattaaaaatcattgattagagtcttaattgggatttaacaggaataaatcaggtggcatatagaatatttaatattgtctttcatgatctttttcaggatactaagacttctgaattttttttcctactagcaaaaatgaaagtcataatgcattaaatgatgaagctaaatgtttaataatatagatgataattcataaggcttattttaaagcttttttttttgctgttagtaagatttttttagctggtgcagtgcagtggtgcacacctttcatctcagctacttgggaggctgagatggtagaattgcttgaacccaggagtttgggaatagcctgggcaatatagtgagaccccatctctaaaaataatttaattttgcagtataattatttatgaaaaaataagtaaataaaagtaatttaatttttttaagttttaagatattggctctgtcaaggtcttaaatattttaactcatgttcttgcagcctccataaaggatctaagaaattttagtagtgtaattctactaaacgtatctttcagaggccactttttttattcctttccattccttagcaagtattttccatgagtcattacacatattcttgattgccattacgctaaaattgttttttatgatttgtttgtattttgtcttaattattgtataaacttaattctgtattcagatacttcatatagtaaattaaatattacttacatactaaatattttaagtttcatgtaatactattgcaagatcaactaactgtaagtatgatttttgttttgcgtgactgtgacctggaggacaataaatttaataagattatactgattcttagattgctttgtggaagaaataaaatctttgtatttgtaatagtgtaaattcagttttatatttggaagggtacacctttgaatatataagaatacgatggctgggcaccatggctcatgcctgcaatcccagcatttgggaggccgaggcaggcagatcacgaggtcaacagattgggaccatcctggccaacacggtgaaaccccgtctctacttaaaatacaaaaattggctgggcttgatggcgcgcgcctgtagtcccacctactcgggaggctgaggcgggagagtcacttgaacctgggaggcggaggttccagtgagccaagatcactccactgcactccagcctggcaacagagtgagactctgtctcaaaaaaaaaaaaaaaaaaaaaaagaataccacctgctatggaaaaaaaaaaataaagaaactgagaaactttgttaaagaccatttaattccagaatgattaaatagacttcatctttatggtaatggatttattcttacatctttaaaatctgtagagatgatgacagtgaagtctgattggagtgagggttaaattatatgttgtcagtgtatagacgatgaatctgtgttagtctgtattagggatgactaaaggttatcactgtctttattaatattagggtgtggttttgagtgtgaactctgacattaacccagatttccttctcatttgtaatattttttacttttctttggaattaaagctacacaatatatgatgatattaagtcccaattctgaaagctctttcatgatcttccttgatgatcttattttctatttcactgagagaattctaaaaatttcataagctcctaccaccagatctacctacctaagtatatgagtatctgaatacttttactattttgttaaactatgtgcctagcaaaggcctacctctactttttttctatattccattccattccatcttacctacttagatatcatttagcaattctttctccactttcctgcagtatcaagttcttgccctactggaaattatttttacctacaaatacactgttctttctcccacttaaaaaaaaaaagtgtgtttctttttatcccacttcctgttctggtaattatggcattaacggtaaaattcttcaaatttgttgcccatacttgtgctatctccatttcctctcttttcatttctcttttgaagctattccaattaggactttgacccaacctttcactgaaactactcatgttaaagtcactggtagcttctatactttttattcagtggtcagttctcagtcctcctttttatataaccatcagcagcatttgacacagtgatcactgtctcctttttgaaacatttcattttgcttctggtacacctttatctcattggttgcagccgtatatttcttttgctgtttttttttttctcatttccttggacttctttttttctgtccgtggttactcccttggtgatccaatccagtatcatggatttaaataaccatctgttctttgatgactaccaaatgtttgtgtccattgtggacctttcatctgaactctacactgatgatgcagctgcctgctttatatcacttctatgtctaatatgtatgttagaattaaatatgattttaaatattctgatctttctcttgaccccctcagatcaacttctctcagtcttctccatcttaattgcagcttcatcttttcagggtctgaggacagaaatatttgagtcatctttaccttctctctttctgttgaacttcagatccaatctgtcacaattctgattatatttaagatacttgccttaaaggaaagccatatattcaagccaaaagaagataacagaaacaaaagtaaatgttacagaaatgcactctgctatgtgtaggcaggtaaagaattaacataaagatatggttggctgtgaattcagtattaaaactctggtgaatgacaaaaaaaagtagcctgtcttagttacttggttgaccagactaagctcacaaactatttacaatttcaaagataattcactgggaaatctagattcatgtttaattttgtgttatagggaaccctgtaggaaatttatatttaagaaatatcagtatcgatatatccattatagtagcataattatttttatacctaggggaattgagttttaaagaataagcatgaatatgtatcatggaatgttatttaaccttaaaaaaggagatacagtgctgacgtttgcaatagtatgaatgcatctggagtatattatgccaaatgaaataagccagacacagatagataggtactgtgtgaccttatttgtatgtggaatctagaaaaatgtagaatacctagaaatggagaatagaatagtggttaccagggtggggaggggaaatgggaagagtaggtcaaaaggtacaaacatgcagctatgtagtatgaataagtctagagatctaatgtacaatatgaggatatagttaatattgtgttgtatactaaaatgtactaagagagtagattttacatgctcttatcacaccaaaaaagtagctgtggaaagtgatagataatttatctgactgtagtaatcatttcactatgtatatgcgtatcaaaacatcatgttttacaccttaagtatatacaataataaaaaaaggaggcaagaggagtaagaaagttctgaataatacctgttcattagattatataaaaataaaatctatcattgttagaagacacagttagcttaaaatgtataccttatcaggtggtatgtgtatatatatatacacacacacagacacacacattgtgaatgataaatatgtattgaaccatttagaatattgtgctaaatcaataattcatctatttgaggattataccttaaggaaattatatacttaaaaatgtattatcaaaatggtcaatatttgcctgtaaaatattttgagatactgtacatttatgcctgtcagctgggagtttcctcattttagtatccgtaaaaattattctggttgatagagttcatttataatcatttcactatgtatatgcgtatcaaaacatcatgttttacaccttaagtatatacagtaataaaaaaggaagcaagaggagtaagaaagttctgaataatacctgttcatcagattatataaaaataaaatctatcattcttagaagacacagttagcttaaaatgtataccatatcaggtggtatatatatatatacacacacattgtagatgataagtatatattgaaccatttagaatattgtgctaaatcaataattcatctatttgaggattataccttaaggaaattatatacctaaaaatgtattatcaaaatggtcaatatttgcctgtaaaatattttgagatactgtacatttatgcctgtcagctgcgagtttcctcattttagtctccataaaaattattctggttgatagagttcatttatctgttttaatttaaatctcttaggcttaactgtactacttaatgtttttttcattctgtactcaattattaaaaacatttatcttattttccacataagcagaaaaaatgagttgttatagatttaataaaatatttgaaataattatataataacaattttgactttttttctaatcatgcattttatcactatgtcttactggtaaatgatatttaatctctgtaaatgttctgccagaataagacaaaataaatctgtaggcttgttgatatatgtgataaagtagaggagatttgtttaatcactgttgtgaaaaaggaaaactgtagtagttgtggcttcctggattataaggacaagaacttgtgtatgcttttgatttcatttttaacattaaaatttaagtatatggctcaatattaaagcttaaaatctgtgacttaaaacattttatttttcgtggttattaattacatagttatttcttaaatcatcccttagtgttgacttatggaagatgatgtgggtttgctaaaagctttcttatgtattattttggaaatatctatattatattttcacataactgatagagacagattttgtgtagatttatctcactgcaagctccttttcaccacattgtattatgaagtaaaaaatttctttgaaagtactttccccaattcttgtttataaagttcatcacattgggctagattatgaatggacgtttagtcagtgtcaagcaatttgaacttttatttatcttaaattgaattacatacattttaaaaggactgtctaaatctgcagttattacatgttaaaacctatattgatgtcaaaactcctaaacagtagtacgtgtttgcagttttaagagaattatttacttataatttacctagaagatatcccacaatatgattttttcaacataaaaagacagtataggctgggctcagtggctcacgcctgtaatcccagcactttgggaggctgagaggcaggaggattgtgggagaccaggagtttcagaccagcctgggcaacagagtgagactctgtctctacaaaaaaaaaatttttttaaattagtgggcatagtggtgtgagcctgtattcctagctactctggagactgtcataggatgatcacatgagcccaggtgttaagggtgcagtgagcgtgatctcaccgacggagcaagaccctatctctaaaacaaacaaaaagggtggagggagacaatatgaatgagtagtccattaacttaaaacatttgaaattaaggttttatgataacactttaattttaagtaaccactcatttatgcccctctatttaaagcggaaacctaaagctatttgttaataaaatactgttttacattaagatgtcatgggagagaaggatatatggggaaattaacagaattaagttattttaaattaagtatgaatgacatttccaaggtagcagtgaatgctttacaatatacactaataattttattatttttcccaattttatgatactcgtttctatttctgagaatctttaaaaatgtgtaatcttggctgggcgtggtggctcacgcctgtaatcccagcactttgggaggccgagggggcgggggggggggggtggatcacgaggtcaggagttcaagaccagcctggccaagatggtgaaaccccgtctctactgaaaatacaaaaattagccaggcgtggtaacaggtgcctgtaatcccagctgcttgggatgctgaggcaggagaatcgcttgagcccagttggcagaggttgcagtgagctgagattgtgccactgcactccagcctgggtgacagagggagactctgtctcaaaaaaaaaaaaaaaaaaaagtgtaatctttgctttcttgagctgttagtattgaagataaaatgtaagatctcatgtggctcagccttatgtttttattgtcttgcactttgtgtacttttgctgtggggttgctgagcatccttagataaagactgaaatcaggccagttgattctgctactcagtctaacatatcttttcagttgagccagctctgttgctgttatccttttgtttatttctgattagctttacattttgtgcctctttaaacttttttcatctttttcaacccagaaactcaccccaacagatttatactctgtaaatgtacttgcttcacagtttatttaggtcatctttaaggacctccctcaacttccttttatacttcaaattataatttaatttcacctttaatccttgtctacatatatagaatgagaattctctattctttttaggaatcatttatcatgcccccctttatctttttcagattcttatctcattcttttggatcttttaaattttttcatgagatctttctctttggctttataatatgttcagttcttattttatacaaaattaccaaaagctaaatcctttctttaattctggtaatacctgtggtcactttctctcccttttacataccaacaaaattttttgaaagggtagtctactgagtttctttttttctcagcattttattactcctggttatccaactctttcagagttcatggtatctttattagttgcttaattaactgaactatctttttcagtcatgtaaccatcatcctcttttaattttctaaagcattcaatattagtaactattcttcctccattggcttatttgacattgtatgatccagtttctctcattatttctctaactgtactatctcagacatttttatggatttcttttgtttcttgaaatcatcacgtaaatgttagggttacattcgattctgtccttggccccgtagatccctttagctttaattactccctttatgtagatcatgcttaagtcatatgttcagctcaaaactgttttgatcttttgttttatgtacactttattatatttaatgtatttcaaaataaatgtgattgtttataccttacataaagtctttctgtaaattaccttaccctaaaagtacacataatatgttcacataatttggcatgttacttcttccacaggtatttggttatgtatctgtattatttttttaaacgtacagacacacatacacacacacacacacacacacacacacacacacacacacacacacactgcggttccttatataaggctgaggtttcagcttatatgatcatccaggaagtctttgctgatcacctcaatctggttgagggacccttcctttgttcttgtgacacatcctatatttttaatgcttcttgtaattacaaatcttttctagctcactagactataagtgctacaaaaatgatgaagaccatgtcacctttattgacattgtacccttaatacttttatagggtcttccacatagtagatgctcaatctgtatgtactgcgtatatgaataatcgagtagataaataactcagtgtcaaaaaatgtattctcttaaatttataaacttgcctttctctgtgtttcctgttttatttattggcaccagtgattttcaagttatccaaactggaaaaattggttaattttgatcttgttcccttttctattctctgtttattctataattgttgccaattcttgtctgttttactcacaacatgtaccttgaattaatcttcccctttatgttcttgatgttttccctaaggtgggttgtttcacttacaactgtactttatatagactctaccagagtagcagagaataatattgtggtgtatttcataacatcccattcattttgattattaaacaaaaacaaacctttagtacagggtaatatgatatatgaatctcatatctaatttaaagctgttccccatctcagcaatagtcaggctttggggcctaagaacttgaaacttggaagctgttgtagtctatgctttcaccttctttatttatatttaagtagggttgtatagatgatttctaagatgtctctctcctcccccaattctgattctaggtttagggaccagatagaaggaaatgggcaaaactttctttttacttaactaggcttgtaataatattctattgagttttgatgcctctgtgatttacactggccattaatgccttcttctatgtgacagttgtccaaatggtagctctctcataggttgcatgctttacatctgtgatggactctgctgaggtcttctactacacagttaaaacctgatgtgagatattcttagttaactctgttgtaggccctctgtgttctagccacgtgggtagacagtttcctggggttgctggagcctcctcgctcttgtggacatcttttttaaggtaggcccatgtgactcatatcatatggtgctagaggtaactgcgtcattgtcatgtcatgtgtttttcctgttatttctctttattgttttttctgcccacttaggaacagagaacatcgttaagtctgatatctaagtattaatttaagccagagtgaaaagatagtatcttctcgtgagtactctcagtatataggaatcatgctcttggcttgcagcaccttaggggaggaatacttccaaaagagactggctggcctcaattttttttcagttctttttagaacgtgaggacacttaattcctcctttttctcttttctgggtcctagtttctaaatcctaggtaacaggaaaagtgtcattaaacatcatatatatatatatattttaatccatattatttaattcaaaatattttaatccatattatttaacctgtaaaccaaagtaacacatcaccaattattgctcttcaccagcctttgtaagtgaagtctgtggattcatagtaaagagagaacagactttgtgattcttgcagctgtgcatgtatgtgaacagtgggttaaacgagaaaaaatacttttcttagacctatttataatatatgaaagaaacatttcatagaattttggaaaattaaacaaagggaaatataacagatataccttaaacttaatagagtaaaggttggtttggaatactttattaggggtgaattatctgtgtaatataaaatttatggaagattctgcttcagcatattacagtattatagcagtgcttcatgacctattaaaagataattcaggaaatgattgacctaccagagtagtttatgtgttgttttaggaacaattgccttctgcaacttttatctattggttttaaatatatgcatatatacatgtgtgtatacatatacatatgtatacacatacagtacacatacacatatgtatacacatacacatatacaaatgtgttatatagatgctagataaccctttttgttttctccttaatctgttcacatgagatattcatattgacaactgcaattttgccattgatgggatttttaatactataaccacagcagttgaggatggattactttgttcagttgagttttttttttttaatttcatagtttatacattttatttattcatttattttctgagttggagtctcactccgttgcccaggctggagtgcagtggcgcgatcatggctcactgcaacctctgcctcccgggttcaagctgttttcctgactcagcctctcaagtatctgggatgacaggtgcccaccaccactgccggctaatttttgtatttttagtagagacagggtttcaccatgttggccaggctgatctcgaacgcctgacctcaggtgatctgcctgcttctgcttcccaaggtattgggattacaggcatgagacactgcatccggccttagtttatacttttatttgaataagcagatggtttccttctattaactttcttagcatttacttttagagaccctttaaggcaaagagccagaaatggaagatacagaattatcatctagcaaaagcactgaccccttgtttaagaatgcattgaatcagaacttcaaaattatttaggttttgttttatttatgatagtgaaagtgaagatcataatataaactaaggaatagtatgctgttgaagaagtaaagatttgaaagaagctagcactgattcttttcaactagaaatttgttttagactgtgctctcaagtttatagaagttgaaattgggtgtgattatttgtcaataatgggccacttttgcttctttgattatgccactttgaagtttttgataaattgtatatatagatctaaggattacctaattgctttctgtggtaaacagaattttctagataaagcaagtaagatttcaagaaacatgtaattttaaaaaattacattggaaacttttcttaacgtatcattcacatctacttctttgtttttgttaatattttaatggtctggtttgttgccaagaaatatttaataagccacagataaatgcatattgtaaatcagatttttaaataattcaaatttgctgctcctatttaatcaaaatgtttgtgttttgaggaggaaaatgggaaataaatgaattaaaatacattatgatattctgtattcaaaatactttacaaggttcattaattgcagttatattttttaaatctagaagtgctgtttgaccctttctcggattttttttactgtaaatgttcaaacctcttatgaaatgtgttaagaatacttattttaaaatactctatctgacagttctgctctgtgttgtttctgctggttctcactcttgccaccatgcttccttgtgtgtttggtgaatgtttgttaagttttcttagcaatttacctgagggaattttttgaatcctaggataaaggtggtttccttcagagtggcttggctttgcgtttagttgtcatttatagttgggaacaacttgaatctaaattcttggcttgagattattttaaccaccaggtatgaattcatgctgaaaatctgcttgaaggcaaacttggggttatgaattcccagataattttttcctgccttctaagtgcatgttaggaattgtcagaggatcagggcgtattttactcttacaatgacagcatagctggttaaagttagtatttactggggattctcatcaggctgcccacctggaacaggaagttcaatagacaaaagatcatattaccttggtttatcaaaagacttcaaggtaaatgtccccttacatgctctagttgctcttccaggttcctgcatttatttaggttttattagtttctggtcagctaacagatgccattgaagaatgtgtttttaatatttttctgtgacatagttgtttcaggcaggagaattggctgggtttccttgcttatactgtcagacataaaaaagcatgttaggttttttgtttgtttacaaaattttcttattttccccagctaccctggaaatatatacgtctattataaccatttcagaaataaggtaagctgaccaaaatcatgcagttggtgaaaaggttgatgtgtactcaagtctgtctgactccagagtccatgctgtacattgtatagcactgcctctatggggtttaaattcttctctcataaatacttgagttcccgggtagtgttcattttgtatatgaatgactgtgtatataaagaaatggaattctaggttactacctgataggaattttgagaaagaagatctaataacagttactacattgtaaagagtagttagcaatatgtgttaaaaacctactgtaaaacattttctgttttacctaaatctctcttattatcttaatatattggcctaccttttcccaagatcccagcagttcccaagattcccttttcattgttatcttttccttgattttatcctttatcagtcctatcagtatttttgtttggttgggaggtatcacacagtaaatatcaagaaactcttcagatgttttaaatacaggcagaaatgactataatattggttaagctttgtaaaggtgcagcagttcagagagctttgttgataaccaaatggaaaaactattttttaaaagcataactagtttatcttgagcaataaaaaagttgcttaaaatgttatcagatcgttagcatattgagatgactatttcagatttaatgtatttgaggaaatggaaagttaatgaagcagaagactagaaatgaaacaggtgcagaagaataactatatgaaaaatggaggtgatattattgttctccagattgggatgctctaaccactgtcaaactatttaaatcaagtaagacagtcgggtacagtgactcatgcctataattccagcaatttgagagcttgaggcaggaggatcgcttgagtccaggagttcgagaccagcctgggtaacatagcaagaccttgtctctacaaaaaataaacagaattatttggtgaggtcacgcgtgcctgtagtcccagctacttgggaggctgaggtaggggaatcgtttgagcccaggaggtcggggctgcagtgagccaagattgcgccactgcattccagcttgggtgacagagcaaaaccctgtctcaaaaaaaaaaaaaaaaaaaaaaattaaacaagacacttaaatgttataggataatacatataacagaaactataaatttttctgaaggcagtttttatgaattacaattaaatttgattatactctacattatttttataggatttaaaaatttaaacccaaagtatatgctttaatatattggtttttggattataatttggcatcattttgcacagtttttagggaaaggtgagtttgattgaaggcaagtgtttttatggaaaatgaaagttatttcttccattttcatgttttttatgtgctcatcctatgtaaaaggtatttccaagtagttttgaagatattaacggtattcccagcttctagctttttgcaggggagggggagaaaaattgaatgtttatctaaggattgatttcttaaggaagattttaaaaagtagcatttagccttttaaaaatgggtaaatgcatttatttttgctgtgttctaacatagtaatatgttttccttataatgatgacttccgtttttccacaatttttattgatgacagaaattgccattgtcaacaagaaatgccaagtgagaaagaagattatggtgggttctgtttcttagcacatgttattttacttttagttttacaatttttgcatctgtagccttggccatattatgggatttatcgccttattagttgagaggtagggtaatagatgataaggaagatgtagtgaaatagtaataatgataataataatagttaactaatgaacatttactattttcaaagccatattcaacacactgtgtatatgttatttacttctttcaaaaactttatgaagaaggatgtattcttaaagatagacaactgaagcacaaaaaattaaatcactttccaaggtactcacttacaatcattggagccaaactagtatatatgtatatatgtatataaatatactctgtgtatgcttgattattaatggtaactattattttgatgacaataaattaaaacgaatttgaagttagtgataagttagttttgttaatagcgttaaataagtatgacatttccttagaaattgtgactggtgttatgtacgatatcttttagtaaccttgaacggtgcttgaactcttttgtcattgcatttctaagattttgctaagctgttatgttatgcattccttatagcattttatagtcttttattttacaacgactctgaaggaatatttcatcattcatataattttagtatccaaattatattttcatccctttgtttgccatgaaacatactcctgcctatctttcaattgcatcatgttctctttctttctcctcatttaaatacccttaaaacaaacatagatcacttttctgaatcactatatttttttctgtatgaaagcccattttgtaaagtatttatttaagaacgccattcagtttgcattctcttgcttttttcttttgtcacattttcagcactaatcaaggattaaagaagattaaaaagaaaactaataaatgagagaatgtggtggtactggtgttagcttatccatttgttggtgatttgcttgtattttatgtaattagtttgattccacacaatatcatttagtctatagtatggcacagtgctaatggctagattacaaaaataagtgaaccatggtccatctttttcttgtctatcaagtttgttgccactttttggctgtcatatcacaccgaattttttgtctttttacgtggaagccaagaaatgacagactgcatacacaaaaaacgaaaaatggtgaaagaaaaggagagagagtggtggactgtagaattagggaatacactgggacagcagtgggtacaagagaacagaagagtcatctgagggacacgaaagaatgtctttatgactttgaaggatgggatgggcgatagacttctaggcactgtgagataccagaaatccattaagtcataggataattccacagggtctcttttgggggctgatgataactcaaatacctacctgtatttcaaaaagggtaacattttgttcttacaaaactgcaggagtataaaagtacagtgagtgtagataggaagtgaagtcaagcagctattgtgtttttctttctgagacgaagaccaactacaaaagtgaattctctcagcatggtctttttcaaatttacaggactcctgttgacttcaatagctcttaagttttatcttgtactctctacacctgtagctactttcccacacagagtcattactgctcatcatggtgatgaaccagattcatcaagatatgtttgaattgtattcattacattttaagaagttaggtatatgtgtgatacattttagaaagatttccacaaatgtatttaaactttgggtagagtacttaaaggtttaagtgtatctttttatctcacagaaacactaaatgagacttaccagttggacatatttttacaactaaaaaagtccttaaccatattgtttatatattatatagtaaaatagggttggttattgccaatttcaaaggttttgaagtgaggcagaactgggtttgaatttctgtcttgtctcttgcaaactctgtgaattttgtacaagttccttgatctctgttttacaatttcctgatataaaaatggatatgttaatttgtctatcgcgaggagcagtaactagtgatggtgtatgtaaaacctttaacagtactgtataatatttaaaaactcagtttctggagccttctgccacttagtatccacatgaactccagcaagctacttaacctgtgtttctgccccttagtatccacatgaactccagcaagccagttaacctgtgcttccattttttcatgtgtaaagtagggataataactgtacccacctcatgggattgttgtgaggactgaattaatacatatgtataaagcaattggaatagtgcctgatgcgttgtaagtgctattatgctgttagtaccgttagctacaagttcatcaaatctgaagtaccatggtttgtaagatccacaatttttatgaaatggtgaagttatgtacgtcaggccctatgaggtcctgaagtgttttccagataattaaagacaatatgttgtgttcaataggtttataatacatatagtagagcaaaacactaaagaccatgggttctggaactaaattgccagggttaaaatttccactcccacttattaacttgtcttgctatacacactttattttctcatctgtaaaatgatgaaaataatagtgcatacatcacagagttgaagtttatatgtaagactagaagaaactagttcagatacaacctgaaaaccaccggatgaaggcttttttaggtctaaagttatttgagttttttgtatataaacagaataaatctctgaaaacgctcataaagcccatacttgggcttaggctagagcttatactgtttctccagtgctagatcctctatttcctgaatccaatgcttgcttttactttttttaatcctttgttttatagaaatatatttttcacatgcatcctaacaaaggagtcatagaagcttgcatagttgaatatgtcatcattctcacatttaattgaatataagcttatgtatataattgtaggctgaaaataattttgcctcagaattatgaaggcattctgttctgttctctcattttactattctgtatcactgatcatagggctatgttgatctggatttgtcttctgattttcttattttccttctcttttttcattaaaaaaatcttaaaattgtagttattcagggacttactaaactttttctttcattgaatgtttcagttattttcattttctaaaagttcttactgtttctctgattttttacttcccctgcccccattattactgttttttttttttaatgtgacatattgttcttattttgtggttgtaaccatcagttctaatgtctgtgaagatgttaattgttttgccttaaggttgcttctgctctttgtattgtatttcctctgagtttccttccttccttccttccttctttctttcttctggttttagtcttttgtgttggagacgttttgtcaaagctttggcttaatgtggtgctacatatttggttgaaagctgtgtgtctgctagcaagacttgttgcttagatagcttcattagtgtgatcatgcaaaaagctagggattctgtatgacggtagctatatgtctgttatctgagttcttaaactttcactactggattttcagatattctttctgcatggtgtatatctgcctgccaatatttaggaaccgcttctgtccattttaaccttgtcccttgactcctctctgttttgcctggtagttgtagttcaggaacatttctgggtcaagatacctaatattctgaacttcaagggggagaaaagaagagaatatgtaaagtagggtagtaaacctatgtgccaaaatgttctgtatatagatttttagagttccctcagtattcagcgctaacattatcgctgtctttctggggtttcattaggcaaattatcttgctgttgatattagcattctctgttacctagttttcagcttcctctctgtgcagagtgtgttcctagttattctgcttcaatttttcattttccaaaacgatgttgaatttcttgtttgctgttgtttccctcacccttctccttgtctttctgcttttatactattttgccattttagtgatgtttcagaagggagtggagtttaatatgtgtgctcatctgccatacttagcagcaaaaacaacagctagctagcatttgtggagtgccttactatatgctagactttttctaagtgcttttgtatagattttcatttgatactcaaaccaatcccattaaacgcatactactgttatccttattatacaaatgaggaagcagaataagtaactgaccaatttcacagggctagtaagtgacagaaagatttgaatccaggaactgcttgtggaacctgaggtcttgatacttttagtttattaatatggaccagaagcctacaatacatacttctttagacatctgagttacttaaactaatatgacaccttaaaaatgacttccaataaggcaagtcactagattttcatataaccaaaacaaaaacctagcagcttataaatattcagcatacacaaatacatggaaattataacttatagagtgaagagtaatttttctggtaacagaacaaaactttaatataaacgattatcacttaacaccattctcctaaatatttttttaaaagaattggcatttactgactgaactaggacatagtgttctaacacactaggaatgattaaaatcagaaaactaatatgttttagttgatcttagaattttttttgtttaaaaatttgagagtaggagaaatataatatttgtttagaagtattaaacattataaatagacaaaacttttatttctttaagaaacattctagccaaatacttgaaatttaaaatataaatttagttataatttgtgtcattttaccagtttaaaaaaactatgttcaatacagtttgttttatgataatagtaagtcacctctgttttgtgtaatttttctattcttctctttccttagtgtagatagaaacctattgccttcctgctgaggatataatttctgaatctagacgatgtgctgtcagcacagtgaagcaggaaattattctcctgtgtcagctgctgctgttaaagaataaagaagttttgtgataggatgcatttctgttacctctactcacaaatcttatatgacatgcaaatagatttcaaaatcaagagagttcaaagtatttagtaacaaaagatctaaaaattccaagtgtattttaaaatgctgtgctttttatgtttcaatgttagtagtcctcaaacttattcagcttattcaagtaatagggcaggggtccctaaccctgctctggtccggtctgtggcctgctaagaactgggccacacagcaggaggtgagctgtggggccagctagcattaccacctgagctccgcctcctgtcagatcagcagtggcgttagaatctcataggacggaaaccctatcatgaactgagcacgcgaaggatctaggttgcacactccttatgagaatccaactaatgcctgatgttctgaggtagaacagtttcatcccaaaaccatccccccaccctgtaccatgttgtcttctgctgtaatagagcatttggaaattatattcttcaggacactggacatgttagtatattaaattcaacattggttaaagcagcagcagtaataataatagttatatgaaatttactgtgagccagagatggttaaaactacatgcttttcatgtatcagctgaattagttcacaataaatatatgaggaaaagatggcacaaagattaatttgcccacattgtgtgtgtgtattcctttttatatgtaaatgtgtgtgtatggtatgtatatatgtttatgtgtgtaaatatatatatttctaatatctatgcaattagagtcagggatgagatttccttacattccatccccaaagtctgtccttacaactaccacgttaggctaatagaattttatacaaaatctgatagattctattatagtataggcaactggtgggagttatcacatattgaaaattagataaaaatctcaaaacgaggcaattttatcccttaagctaattcttctattaattgaggaagactgctgttacttgatttttatccccaaaagcctcaggaaattatagaacaccactttgacagtttctttatgtgacatagacagaaagtaaatttatattttcttattcaataaaggcttcattttactaaatttatacaattactgatttcagtaacacatttccacaactttgtggtagatcaactataatctttttcctttgagaaaattatttaaagacatgtattattaaatatgacaaatcatagacatttttttaaagagtgctaaaaaattcatgtacctttcaggcatccttaaagtagggagatagtcttagagtcatgatatcagtttggtgtgtgatctgtctttaaacattatattttaattgatatatagtagatgtgcatatttacaaattatacaaaatgtattaaattacaataatttattacaataatttaatacatacaatgtaatatattacaataatttaatacattttgtataatttgtaaagatcatatcagtgtaattaggatattcacctccttaaatatttatctttctttatgctagaaatattcaaactattcttttgtaattagtttgaaatatacaaaaggttactaaagtcactctactgatgtatcaaacactatcaaactgtatatttgtacccattaatcaacctctttttatccctccactcaacccttcccagcctctgataaccagcagtctactctctgtcttcatgagatccacggttgtagctctcacatatgagtgagaacatgcaatatttgttttttctgtgcttggcttatttcacttaccataatgactaccagttctatccatgttgctgcaaatgacaggatttcattctttgttattgttgaataaacttccatgtgtatgtggtatagaatctatcttgaatatcattcattgatatttgtatttgtaaatgtcaacagcaattaataataagaggatctcatataaaaaaacctgtctacatcattttagaatggcattaacctttacagttatcccatttttataaatggtggttaaataacattctcagaattatactaaccagtattcaataaacgatgacggtaagaataaattccacatttgttggattcccaaacggactttaacgagactctttaatgtggctaccagtatattttatatttttctaaacttgattactatttctctttttaggaaagatgcattatagccatagaagtgacaaaggaaaattaaataggaacattatatacagtagtgatcgtaccaggagtatggatgaatctacatgcttcagagaaataatcgcaactttttttttaactttaaagggtagaaaactactactttcttgttgaaaatttatctcaaagttaatataaaatgatcttctccctataagttttcttttgcatccaagcgaggtgcatgatatgtaggcaaggaggggaaattatccttgtgttcttctaatcagaagtgttctgttttactttgctcaaacaatattaccttattccatcctaatataattatgtaggctagagtattttagaatgatataagtatggtttgaatatttttaaaaatataaccttacgtatcaatattgttatgtctaaggcattatctggctttctgaaatgaaaatagtattttgttaaatgttgcaaaatgacctgtctaaaccatttttaaaaataactttcctatatagaaattatacttttattgagttttatgtcatagtttgtcatagagtatgtcatggattattgactattactgagaaaacagtatttttgcactttaattttttagtttacttctatttccatgtaattatcctaaatcctttgcttcctgaccttcttagtagaagagctacttttctttaattaatggactgttttttagagcagttttaagtttacagaaaaaattgagcagaaagtccaaagtgttgccatgtatttctttttgccccaactccctctgctcctaacacagtttttcttactattaacaacttattattaactactttgtttagccatccacctgtgttgaaggacatctttacttccaagtttggacaattagtgtggtacagttggtacaattgatgagccaaaatggagatattcttattaactgaagtctataatgtatcttgggattcattcattacgttgtacatttttatatgttttcatatatatatatataagatttgtaaaaagaaaacctccctgttttctacctgtccatttccccttttttccctccgaggcacccttggtaaccactgacatttactgtctctatagttttgccttttccagatcatcatttaattggaatcatacagtaggcagcctttttagattgacctttttttttttttcatttaacaagatgcgtttaaggttcctctttgtctttttatggcatgttagctcatgtcttttaatcgtgaaataatattccattgtatggatgtatcactgtttttttatccatccacctgtattgtagggcatctttgcttccatgtttgaacagtcattaataaagctgctgtaaacttttgtgtgcaagttttcgtgtaggcatatgtttttaattaattttttgtaaataccaaggagcatgattgctgtattgtatgttaaaagtatgcttagttttgtaagaaacagttaaactgtcttccaaaatggctgtagtgggctgagcatggtggctcatgcctgtaatcccagcactttgggaggcagaggttggcagatagcttgagctcaggagtccaggactagcctgggcatcatggcgaaaccccgtctccacagaaaatacaaaaaaaaaaaaaaaattagccagtcatggtagcatgtgcctgtagtccctgctacttgggaggctgaggtgggaggattgcttgtgaccgggaggatgtcgaggctgcagtgagcagcctgcactcaagcctgggcaacaaggagagactgtcacaaaaatcaaaatggctctactattttgcattcccaccagcaatttccttctgttgttccgcaacctccccaacatatggtgatgtcagcgttttggattttagctgttctaataggtgtgtaatatggtatcttattgttgttttaattttcacttccctaaggagatactatgtccccacaaaattgatgtgttaaagtcttaaaccccagtacctcagaatgtgaccttatttggagatgtaatcaagttaagggaaggttattgcagtaagtttgaatccattatgactggtatccttataagaggagaaatgtgtacagagatgtgcatgcagagagaatgccatgggaatatgggctgccatctacaagccaaggagagaggcttggaaagatacatcctcaaaagaaatcacccctgacaacaccttattccctcttacaacctccagtacttaagccacccagtttgtagtactttgttataacagtcctgatatacataagatattgagcatcttttcgtacgcttttttgacatcattttatctgtttaatgaggtgtcttttcagaccttttgtccgtcttttctaattgttgaattgtgagtgcttttttgatattttagatactagtactttatgaggtatgtgtttttccctatctgtggcttaccttttcattttcttaatagtgttttccacagagcagaagttttaattttaatgaagtccggctgatcaattttgttcttacatggatctgcttttggtgtatctaaaacatcattatcaagcacaaggtcaccctgattttatcctatgttatcttctaggagttgtagagttttatctttggtgtattttgagttaatttttgtgaaaggtttatgatttgtatttagattagttttttattttattttttattttttggcatgtggatgtcgagttgttccaacactatttgctgaaacaaactatcattgcggtattgaattacctcctctctttagtgaaaaatcagttgactatgttgatgtgggtttgtttctgggctttctttatttctgttctgtccattgatcaagttgtctgttattttaccagtaccacattgtcttgattactattgttttgtaaagttttgagttggatagtgtcagtcttctagctttgttcttttcctttaatattctgggccttttgctttttttgtataaatctttagaatcagttaattgatatctgccaaataactcactggacttttgatgggtattgcattgcatctatagatcaagtagggaagatctgacatgttaacaacagtgagtcttcctctctgagtacatgaaataggtcatttacttagatcgtctttgatttctttcattggaatattgtggttcttctcacatagcacatgaacatattttgttagttttatattgaactttttctatttttttggtgttagaacaaccactttttgcacaattgtaagaaacgttaacataagtcttagaactagccccaataattgtgtgataacaaattacggtagcagattatttattcctggttgacataagtgataactgttgttgaattaaatattacttatgctagaaaagcttagaggtatttcatcacaacttgattgttttcaagttatgtaggttgatattattaactaacagtgaattaacgtgttagtttggatgaattgagtttccatgatttttcttacactttaaaatttacttgtaactgatatttctttctacatcctgtgagaaagtagagtagaaaaaacgtataaatttagaacttagttttgtaatttttgactcacactttctcttcagtgtgttgtacctctgagaaggaatgactgataaaatatgtgttgaatatacatgtcataatttaggatgatgagtgattgttaaatgaatgagaacattacatgaacagttataaacatcaatgtaataggattctgtattctcaaaagtgtgacatttaaaaagagacaaggccatgcataatttaatcatgtaaaatactgataccttaatttatttaaaaggaattgcctgatttttaagagaatgcccattaaattttaatttaactattaaatgcctggagagagcatgattccatttaggggaagattctgttattaaactataagtcagagcaaagtattctctacaattgtattttaggttactgcaacatgaatattgaaagtgttcctataaaacaagaatccatctaaactcttttttctttcttttttagtctttccttctgtagagcctttttgatctacaagcttctaagtttggtgtcttatttaggagatattatgttttagcttctgtaaaacctagtattttctacaaatgcacgaaacatattcatgttatttaattgcttaatattactgtttacaaatagacaaatatttctgtagcttttatacgcaaggaaaacgctaagaaatctccacaaaatagccatagttaggtaattgctggttgttcctaagaataataaataagaatgtggtaatttaggtattcagcctagtattcatagaatgttttagagaaatgaatagtcaaaatcactacctcattggtactaaccattttataatacagtatgaattgggatggtgaattaagtgggaatgggaacatggagtggttttatttttctccagtgtgaccttttttgtttatgattagtcaaatcactcttttttgtttcttttactcttctcaagatgatgtcatagatttctgagcacttcaatttaatctgactttaatgtagtaaagtcagtttaacttgaatttaacctcatagccaacctataactcaatttctcttctttcagtcaatatgacttggacttttctaggagattatagagtgttggaagaggttgaagtctagtcattctctttgctcaatccagtgagtggagaatgatctgttttgttttgtttttttttctcatatacctatttctcctcctgtgtgctgatgaagtaaggggaaaggtggaaagggaaaaggctttcttatgtaagtagtaccttttgttccctttttttctgtttgtgctccactgcctcacactgactagtcctccctccctccctccctcccttccttccttctttctttttcttccttttctttctttttcttccttttctttctttttttttttttcacccgtgctggaatgcagtggtgcagtcttggctcagtgcagcctctgcctcccaggttgaagtaattcacctgcctcagcctcctgagcagctgggattacaggtgcatgccaccatgcccagccagtttttttgtatttgtagtagaaacggggtttcaccatgtaggccaggctgatattgaaccggggcctcaagtgatccgcccacctcagccctgcaaagtgctgggattacaggtttgagccacctggcccggcctagtcctccttctatgaggacgggagaggagtactagctctctgatgaggtacatgtacaaaactttggtggggagcatgggggttgtttttggagtgtcataccaaccatttctgaattgtctttttctattctttctcaatttctacctctccactatattcatagcctctggctgcttgagtccccatcaactggaggctcaagtccagctactttcacattcactacactctttgcttttgcagagagggagtccaattatctgtaccttgtcttccaactccatgtcttttctccctctcttcaaataggcacagagaagggaagtgggcatgggataataagcaactctaacacacaagcagaggtccaactgagaggtgagataccagtcttcccttcttactaatcttttagatgaactctcgcttgatttggactctcagcaacagcactattcagctacattaagtcagtgaagcaaactctgatgattgcctcatgatggggacaggagaaggcacttctggataaggaagaactaaggaaggtaaagatgtttaagttatggaggtggagttggctctcatttgtttaagtctgtcttccaaatataaaatacttgatagatgcctttgttcttagccttcggttctaattgccagcccctgggcgattggaaaagtgctacctgatatctcattatgttcttttacctgtcttgcctagtagttttattcttcctagctacagtgaagttcattccactacagctgctgttgtaacccttttaaacaggttatatcattccctcagtcaaaatactgtaatggctttctaaaacagtaaaaacaaaaaacaaacccaaagtccttattatggcttggaaggccccaggtgatctgactgcaggttaagtttttgatcgcatgttcctatctcagagctttgctatcattctaccatctgccatctgtatgtggtattctaaaaccccagagagtagagtcacttcattcattcattatttaagtaatgctgcttccttagtattctctgaatacatttaaaatagtatatttgttctcttcccatcacttgctttatttttggtttatacactaattttcataccttaaattgtatatttaatagttagttatatcacttacattaacatgattctcaagagggcaggacattgacttctttgttcaccactttactcagtgcctaaaatagttcctgacccataggaaacaatggattttttgttgttgagtgaataaatgaattaatgaattctagctattagattcaatctttagaaaatatatttgacttatcctacattatttacttttccagtgttctacatagtataattttaatttttatcacttttattatttctaactgcatattcccattatcatcaccccagttgaatcatccatacctctaattgattttctatgctgttagaattatttttttataaaatacttacttaaatgccactattggggtaaaacattcgaaaattccttaacataattggtcctgtgcctattcttcttctctccgtggttcttacatgaactctattccactcacatccttttcattgcagtattctgaatgctaaactatgcttctctttacttctgtgcctttttacataaaacctactgctatatatttttcactgtgtgaatacattaatggaacttctactatgagaagagtagaaaacactctttacatttgaagtagttaggaaccacccatatagttgttgtatgctattaatttatatgtattagcaagtctttttcctcactgagtatctttaggatttgttaagaatttacttgtcattttataaatgagtatttaagtcaccacagtcttgaggagcatacactgttttataatactgttttgtaatattgtgaattattttaaaggtgagaataatctttttctttttggaggatatgtatgtatgaatggttattatatctttatatctacagaaaaatacctaaaaggagtagagaaaatgatacatacaaataaaagtattatgtgcattactttttaaaaaaatgtgatcccttgctagattcttcaaatttagattttttgtttgtatactgttatataaataaaagactgataaatgaaatgacattatttatataaaaatcaaagcaaaatgtttattatatctgactctattccaagtaagtacagtgtgtgagaagggaccagtgtggctttttgagaaatgcagaatccataggtatgtggcaggattctaaaacttatacttaacatttttattttgaaaataatgcagaaatgcatagtttgtgatatcgatctattttagaagacatggctaaatcaaaaataatattatgaaattacgtagcagtaaacaaaggtggaatcccaaagttatttgaggtagctcttttgaacaattattactattactggtaataataggccaggtattatatcatgtgtctggtatgcattaattcattttgtagttggactatcccttcaagttactattattcattttacatgagaagaaacagctgctcatttacacatttaattttagaaggattaattctgcttgttcagttgggtttcttgagtataattcatcaaagtttcttaaactacatgagaggttacagagccctttaaaacctaacaaaatcttatggcccatttcccctgaaaatgtatgtatggactcatgtatttttattttagtatgcagtttcctagaattcctagatttcttaaatttcatatgtggactctagattgggaatctctggtctatgtcttttaaaataaagagccacatcttgtcacttaaggaaaataatatatatttacactgtgctttattatagaaagaatttaagaaagctgaaaggaaattgtcagctatctctaactccactgagtatatgccaaatcaaataaattctatttaattaggaagtgagattcagaaaagtttgacttatggtatgctaatggtcaggtttgttggactttgtcacaaagcaccctcagtctgtttcagaaagaaacctaggtgtgaatattttgaataatgtaaagttacctcttcagagtagtatatacatagtagctgtgcctagagctaggagatgagatagtaccttacagccttttgattcagtgatatttctcagagaataattattgaatttgattttctgattccatcaaagataaattgtgtggacaggttgttgtagtaaaagcagaatgtggtaataattttctgtactaatgagctaaagtgatctcaaacttggttgattcattctttatatgggctaaggatgaagactgtgtttagggtctatcttaatttgattttggagaagaaaagttgtctttttataaaacatcagtagttgttgaggactaatttcaaaaaattctttttcaaatataaagtaattcggaatttcagaataactttttaaaaatcccttttagatattttatggtacttgtgcttcagttttgatgtcttacctattttgtttttttctcccttgaattctcatctgaaccaaaaaataattagctgagcagaataaagaatcttgttgtatatgtttgcccggttttaggtaaatttctgtagaaataatgttataaatcaatataagtatttgggttttattttttaacatatacgttttaacatttggtttattgttattttgtgaattgagtaagtatatttctatgtttcctgcaaccattcttagcattcaatttttaaatgaatgacagcccatctgtgtaggtctcttgtgactgagtgatgtattctgttttgctgtggcaaagttttcagacagccactttgttcttatatattttcattttctatagtacttttcatccctgtatgtatgtacaggagtcacttcacccaccaccgaattgcagccacttctgaggtggaacgcagcaactgtttaacagcgcactttcccctaggtgctgacagctgcagaagaaattgtacatggtgctgtacagaaggtatttctccactgtgccatctgcagagtgaaactgactaggagtactacatagactgtaagtttcttgtgtacctgccctagactggaaagcccaataagagaaaataacaaataactgggaaacatcatctaaaagtgtattgaggtcagttaaacttagtgctgctctccctggctctaaattttattttaaggtcttctgattggtacaaaattaaataacaaatagatggatgcactcctttttattctaaaagcaaatgaaactaaaatgcttttatcaatattcttcactttgaatggaacttaatcatattgtttttaaatatttttaagtaaccaaatcaatattataagatttcagagccatgttcttaaaatagcaaaaaaaaaaaaaaaaaacttgtaattcaacaggaacgtcttaattaaccttgcttccagtgttttatgtcttggttttaatactttcttttggagttttgcaacaaagccagtttatgatgaactagttttgattcttaggattagaaacaccaattttgacttcttttttatttttatttttaatttttctgagatgaggtctctctctgtcacccagtctggaggatggtgatgtgatcatggctcactgcagcctcaacctcttgggcttaagcgatcttcctgcctcagccttgcaagtatcaaagatagcctcccagctatcaaagtagctggaagctggcactacaggcatgcgctaccacaactggctagtttttttcttttttctttttactttctgtagagatagggtctcactgtttgagactaacctgatctcaaactcctgacctcaagcgatcctcctgccttggtctcctgaagtgctgggattataggtgtgagccactgtgctctgctcaatttttttttttctttaacatttggggaaaaaagtggggaagagaaggaacagtaaatatttgaatttctgcttactgtagttttagtctctcccatttaattatttaatgagattttcttttgtaaaagcacttttataagagtgctgtctttagtaatagtttggcatgtttatgccttataaaatagagaaatatcattagaaacagctgtgtctgttgttacacaacatgataaggaatgttatattttgttattttagggtttttttttagtcaatagtatgacattttatctcttttctgctacatttatagactgttctatgtgaagaaattagaatctcaaacttcacagagtcttaatcatattaaatatggtgtcatttggtttaggtaactttaaattatgtgtcataagttaaattataatgtgcacatatctatgtttatatattcttagtcaaagcagataaaaaataacttcattctacagtttgtttacttgtaaaatgaggtaggtagaagaaatgattttctagggacattttaagtgttttccttttaattcagggttagtagtgtatgtatttagaattgtaccttaccaagatatttgggcttaagtgactttattctaattagaatattatttgtgttaattaaatgctgagtgataatgttttagaatcaatagagggggtcggatttcctacaaagatttttaattatctatctaattttgtagtgtagataactccattgttatgaaatataatctttggacaatacagcacagttcttagtatcttattcatcatggaagcataaagtgagtaagaataaaaggctttacttacactgagtggaaatttacttaaaggttaccaaaaactcatattgtaatgaggcttaccctctttacttgcatagatttagtatttcatttaatagtcaaagcactaaagaagtaaatgtcaatacttaaaaatttacagtttacacgtaatatacctatgtatctctagccaagagagtatttttatcaatatatgaaatattcgaattgctataattgattctttggcactttctacagtgtaattgtaagtattacttaatcccattcattttatttactgaagtcatcagtatttgacagaatagattatatgttttatatactaaattttggttgaaaaggcacaaactatacctgctttgtgtgtcctggtatctatttttaaattatacaagttattttttatattttagactttatgtagatgatagaagtttggcaacttacttgattcaatatttagccatatgaatcttgtattttattatacccatagtgtatgggatttgaaaaagaatcagatgggaactttttattgaatatatttctgtattattgaatttaatgaaaatatactgcttgtgtaatcaaaaataaactgtcggtgtttcagttaaattaattttttggaacatttgtttagtttatttagagatgatcaccatttcataaaacagatacctcttatctctattggtgattttcaaagggccttcctcatactgtgaaaggccagaattgtgggcaggattattacttaattagcactcacttaataattttggaattcagaaataaattataggttatgaataattaaactttaaggaaatacttatttttcatcctttctcattataattttctatttgtaataggaaaaatgaagcaaatgcataaattatatgaattttaatttaatttaatttaattttatttttttgagatggagtctcgctgtatccccaggctggagtgcaatggcacgatctcggctcactgcagcctctgcctcgcgggttcaaatgattctcctgcctcagcctcctgagtagctgggactacaggcatgtgccaccacacccagctaattttttctatttgtagtagagatggggtttcaccatgttagccaggatggtcttgatctcctgacctcgtgatcctcccatcttggcctcccaaagtgctgggattacaggtgtgagccactgcacccggccaagttatatgaatttttcagtacttatgtatgaatgataaatacttagacctcttgtgataatgtcctggcaacatctagctttccattagaggctttaagaagagatactagaaccagctgaagaaatagtgaaattggtgagaaaataggaaactatatggcaatatatttttcattgcagaatttattcaatttaaactaattttaaagaacatacattttaaagtagaattttagtccataattttaaattctcagatgttctcagttttacaaaatactcttttaaattaggtacatatttttatatccctctcaaatagataattttttaaaaattatttttcttatcagatttatctgaacaaattttatttgttagagagacgaaacaccttcagatgttttactgtaagcaatagggagatgatttttcaatgtaggattaggtggacaattctttttatcctaagtggtcaatatttgagttacttcatttgataatcaagctttagtattttatacaccatttcttattatccaaaatataatttatattcctagactaatatatggaatttgaatttaaatgttttagaattaaaaatgaaaaatgtttttttctaaatggtttccaatagattaatggagatataatactcatatctttgcttttcttattttatatatcaaatgatttctgcttatttttataaattttgcagttatttttcaatataaattgaattcattgaaaattttaaatgtataagtttgcgtaaaagactactgatgccagaaacctcattatctttaattaatcttaactgaattaagcatttattactttaaaatttttctgtaattctgaaatttctatatgtcttgtgggtaaatgtgtgtgtgtatatatgtgtatataatctttctaatgtattttctgaagtgtgatctcgaatccttactgccactttgtagctattaatcaagtgtaaattgcttaacaactttaaggttgttttttaaatctgttaattgggaatcatttcacctacctcacagggttgttgtgaggaaaaaacaataaaacatatgtgaaagagtgcttagcatataatagatgtgcagtgtatgaaaatgagtgttaccaaaccttcagtggcccccattgtcctcaggataaaatccaaattctgtgtcatggtgtgtgttctggctcacccttatgtcttcagccccatttctttccttgaaaactgcacatattgatttattgatactgtagtctttatagttcccaggatatatcatgctttcttttggcctttattggaatgcaccattcttttaaactactcactttcccctttatccctaggctactatcctctgtataactcaacctcatctgtcaggctttgctttctatttcttcttcactaagatgtcttctgtcccttcttcctcacttatatattttcttggatgatccttctgtgtttattcttttcagcaattattgcatgtaatgtaactgcctttgtacttgtctgtttcctctactagatgtaaagtcagagagggtggagcctgtcttatttgccattttcctccactacttaagagtttctgtaactcaggaaatatttgaacattttataagtagatgtgttccctaaacaaattcacaacatatataatatgagtgctactccttaagtaaagcaatttggattctatatttataaaatgtatttcaggtcccacaataatcataacaaaatgatggccatacaattggtcttctttgcccaccatttatcactctaacgggtttattagaagagatagactcattcagggtgcaagcagagagttactttattctctctagtcactttacatgcagttccattctgaatattatgttttctgctccttgataaaatgctgtttaagtgctgttatttgcatctctactctattcttgcttctctgctgctgcttgctttttttcttctcaatttttttctttctctctctcattctttcattccttcttttctcactctggcattttaaaatagactaaattttcaaataatgaagaaaatgtttaatgaattaaagttttaaattctcctccaatataaaatgtcttttctacatcaaccttgctcaaagagggtttaaaaacctgaataaggaaggaaataggttggtcagctagtaggctgttgcattaatttttttttttttttaaccttatgttttcaccctcctcactgtgcatcacctaggttttctgaagttcagggattagaagtagggaagaactaattggtagtaaaagtatgttggaagtcttaatggattcttctcttgcttttctggattcatcaaagacttctagtatttggagataacccaactatagttccttgatgcggttgacactttatttgtctggttttgactaccctgcttagtttctgactttctggtttatctctgtcctctttgttttggagttaccttgtttttcttttttctttttttatagtcctttaggtaagttcctttaaaaatggattaatgttttcctaggggttatctgtcccatgggaaaatatatttctttactccaccaacctactaaagtactggccaattctaaagtagtagcccagactgagggcatgagtctttaattagttaccactccttgagtgccctatattctagatcatagactaaattctgagtgcatcacggtgctacttccttctcaatcaatctataagctgccttccctcagtatatgtttatagtttttatttgaaaggtgagctaaagatagcctgagcaatttttggccacattcttaccaactgtagcctagatgatctgtcacctcatttctagtacattgaacttgttctcagctttggatcattggctgaaactgagacaacaagaaaattctcattttaatatcctgttacactaccattgtggcattgaggccataatgggaagcttgcttttctatgaatgtccatccatttctgtaattccatgccttgtcttatgctgttctgtcattttgggatgtcttttctacctttttttccttcggtattctacccagtcttcaatgtccaagttaagtaaagtctttattggtcttggcagttagaataaatatttctctctagtgtgttctcattaatactttgtttcatgtgttattatattacttatagatgtgtctgtctctctgaccagattatgagacagattttgagacagccactgacttacttattgatgaacttcttattgcctagctcctgttatgtgtttgggacattatatgcttaattaatgaatctcttctgaacactcagattgaagtttataaaattgttaagtaattaatacttctatctccttatttatttttctccttgttccaaaaaaagtttgagggatcaacagttagtttctatgccttttatcatattttttgctttttgaatttttaatttttatggatacctaatagttgtacatatgtatggggaatatgtgaaattttgatgcattcatacaatgcgtaacgatcaaatcaggacaattgggatatccatcacctcaagcacttatcgtttctttgtgttaggagcattccaattccactcttctagttattttgaaatatatgattattactttttaactcagtggtgtttatttattcttaggcaaatttattttaggttttagttctggtttgggctaaattaattttctcccattttcctttgacttctttatttttctttctctttaaatttcagtctctgtagctaactatgataaataaagataattagatattccaagtagcttcaagttgcaagtaaaaataactaattaatttaattaaatagctgtaatgatctgtcaccccattactactttttttttttttttttgccattacaaaattttctgtttcctttttaaattcttcagggtttcagattccatctttagatatggtcagaaatgatgaaagacaagttattggtcataaaaagggttggttgtaaaagaataatattcctataatagaaaattaaattgttatatttattgggagtaaagttctgtttcattcagacattatcctgttattttgagtgattaccctaaataagttgtctcaatttgaaatgcagcaccgaatttctgccattcctcaagagaataataatgcagtctttttataataatgcagtctttattactgaaatttagtcaaaagtagaattatttaatacatatagtcaggcaaataagtaaaaattagataaccaagaaatccaaaaagcattttaagtagagaaaattgaaaaattacctctatttaaaaattctttttcctggaaagttccagatgagtacagatggtatactaagaaaagagaaagcatattttcccttcaaatcacattgttaaaggctgaaagatgataaatcaacttgccatataatagcccagtgatcttttttcttccttattttcatgttgttggaaatatgaagtttttaatagatatgtttaccttacctaatgacttgcaccaatatgactggtgacattttaatatttaattttgataattttatctgttagcacttattggcttaggaatcttagtgaatggatattctgacctttacattaggttaaatgatatagatggcagatctcagaatcagctcaataaggtgccagatattataatatataatatatatgattacttgtgtgcagtcatacttcttatagcaataacattttgtgtattttcataagaagaaacaaactacaaaatatggccaagtgagtctcagttttaggtatcaagaaacactgtttatccctgtgattttccctgctcctcaacccttgcaataattcaaacattctatttacaacatcagtaaaatacatttttcttgtattttccactgagtttaaggtgaacatcgacttaggatggaactttgagattaggaagaacaaaattctgtttttctgtttttgaaagcatactcggggaaactaaaatgcaatagactttttggcatgcatctagtatgtatcaattataaaataggaaaagtgatgcctaaaaatataatttcctaaaatatgccacctgaagtatatttcttttaaatacttgtttttccctttgtttccttataaatggctcattctgtttttgaattgtaagattgtataggactttagaaaccctcttttagtgggtccagttaaaaagtaagtgattaactgtaaattttttcatataccttgttctttatttcataactaatcctggattgtgttcctatacaaaataccttactcatgttacagggaaagtgcaaataagaaaacagccatcaattgatacttggtttttatgcgtctctttgcaactccaacttcacattttcccactgtgctttaaagtatgacagattcagcatgcctgaaaacccaaatcagaagttccctattctcattctaccttccaaccccaatcattctttgcttatgtcttcaccatatacttgtgactgtttcctctccttttacttaaatatcatccaattttttttctggatcctaaatattttgcctttaagatttgtattgaatcagtatggcttattctatctctgttgataaaactctagctcattacttaccacaagaagtgataagtttttaaaaataggtttgtgtactagttttaccactgtatttccttaagagtggaaagcacgtattgttcacctttgtgctttccatggaggatattctcataaatcatttctgagttcactcaactaattgtgaagtagttgattcctggtatttaagtcttaaaaatattgaatggattgctgaaagtcagatcagtgccacagtttaaaattaatctcacattattccaacttgatgatactcttattagtgttaccaccaggaaagtaccttaaatgaattctgaataattattaagaacacttggtttgctactaatgtgaaaacaaattttacttatagtatgctagtacatgctggtttgtaggcttttactataatttagatgaactgagttgtctttttgtttccatttttaaaaatatggttacatgccattttgaggaaataattgtggcaaaagtcatctaattcagcagcccccgacctttttggcaccagggactggttttgtggaagacgatttttccctgagggggatggtttcaggatgaaactgctccacctcagatcatcaggcattagattctcatgggaagcacgcagcctagatccctgcatgggcagttcataatagggtttgcactcctgtgagaatctaatgccccagttgatctgacaggaggcagagctcaggtggtaatgcttaatgcttgctcacctgtggctcacctcctttgtgtggtcaggctcctaataggtcagggaaggggtgtgggggaagtggggatggctgattggggacccctgatttaattgtttaggtctctttttttacattagtctctttgtggttccttcagagataaaatacaaatgggaaacaagcttccttggaaatgttacaaaagacttaaacccaactactattctgagggtggatctgatttatgctagtaagaggacacaatggcctcctaagaggagtaactctgcagcaggctatttttgcttcttgtgctagaactttagagatagcttgttttttttttcctttgcctcttattattatagtctttgaagataatcactagtttctgaaaaattttattacaaaagtactgtcattcatatcagactgaatttgaatatatgcttatccttgcttttgaaatgtttagttaaattatttgagttgtcagtgttatataaaaataacattttaaatgcagtctcttaaaaatattatttcagtctataactttgaatgctttgattaatataatcctgttttcttcccatttctctcctctttttcttttagtatctatgtgtatatatctttatctacatctatcatctatctataaaggcatatacacatatatatacataagagctcttaattttataaatccactttttatattctgatgtctcagttattttcttggaaaagaacttttcaagtcagtttaattttattttgtcttatttagaaacaaaatctgaagcctgtatgttttgttttccagatttgtctgtatttatattaacgttggtgtgtgttgctttcatattataactatcacaagttttgtggcatttagtgaacctaatgtaatttacattctgttatttgtataatctgttattcttattcatcattcattcattcatttcttcattcagtgtttatttagtaatactgtgtacccggcactgtcctgcatgctggggatacaggaagtctctatgttcgtggagtttgtattcttgtaaaagaagagggagatgtgtaacccaaatagagaattttagagaggcataaatacaatgtaagaaataagggcatggtataaaatatcttgggggtatattttagctaggatataggagaaggatcatttgagttgaactctaaaggatgaggacgacgaaagtcacattctagtcatcaggaatagtaaagaaaaacgtccttggatcagaatgagcttagcatgctcagagaaaagaaagaaatgctgtgtgggttggctatccttcagaaagagaatgtggcaggagttgaggtctttaagataatgtacaggccagatcagtaagtcatagtgaggagttaaaattttaccataattacaatttgaagacattggatagttgaatgttacgaactgattaacactgaggaaattagtttacctgctgtgcagaagatgaacaagggaaaggagtggggggcaagagcattattagggggttattgctgtggtcccagctagaaattatggtgtcttggtgtaagtcttgtagtagtagaaatggtgagaggaaagatgttttggaggagcactattagaatttgtaaatggattagaaatggggtaatcaaaagtatcaaacataattaaacattaaatattctttggaaatacaatttaatcgacataaacttttccatggtaaaaatgtagtataattttttaaattacacatctatttttgattattagttttttccttagttttgctaaaataaatgacatcatgtcattttctcacctctctgccattgaatgtaacaatgatttttgatggcttgtcagtttgaaaggtagaaaattgtatcttgctattttactttgtttgtctttgattactacttagattcaaattttaatgtgtgtattaaccaactgtatttttcagttgtggattatttctagtcttgattgtttgggggatattgggtattttctttattgatttgaaaggccttattaatttcctgagataatctaaaagttccaacttgatttggctctgagtctttctgattctcttatgtcagtttccccctgccgtttatgctgtagacaatctggacacttctcagccaagcaagttttgtattgcctcttagcttttgcacttgttctccatttctggatccctcttcctctacatcttcactcatgactgtgagagaaggttcatcattcatgttccagttcaaatgtcatatccatagaggagctattcccagtttcctaatataatatcccttcttacatctttcacattctatcacattactgtctctgttttgttttctttgttctctcctcatagtcttttaaggtcttcacagcacttatcactgtctgaacttatttattacttacttattgcctgttctttccactaagaatgaaagaaccatggggacaggcatctaatctgatttgtttactgctgtactgtatggggctattgttgggcatatggtgggtaataaatacatattgtggagtggatgatataagggcattaaccatttgttataatcttatacttgtgttctttccctttttgccaattgtctctcatttttgcttatggctttttatatgtagaattttgcactttaatagaatcaaaacaatgaagcttttgaaatttaaaaaaactttccatttgagatcttccatttaccaatattctaatttgaaatgtttttgaatatagagttatcatttatttttgtgaattagggaaagtatttgaagataaaaaatagctcataagtttatttctagtttgattacatattttataacatagaaattatatataatttttttgtttttcttcacttaatattttaccatgtgcatgtttaaataatatacccttcatttttcacaagcatgattttaaaaatttctacactatttcatcttaggcatttgatatatttatcaatcctttattatatatttgtttcagtcttttttgctaatatacatttaacacagggcatattattgtatttaagttattgtgttcatttataatacctccattatgataaattctgaaacataaagtagtggatttcctgagtcattaggagtatagtatacacagtattttaagacattgagtattcattgccaaattatgctccagaaaaattaaatcagtttactctcctagtagtagtgtatgtatgtgtgtgtttatgaaatgttctaattcctgatattgtgtgcttttaaaaacttggcccattcctctccatgaatgccctctccctctaaaactttctcgaaaaactattagaatgtttgtcacatacaaaattaaaaaatttttacatagtaaagtctgttatctttcccccccttttttccattttgtgtttttgcttaaaataacttttcttatttgaaggttatgaatatgctcacttatggtttgatcttattttttatgttatatgcctctaatttatatagaatttaagatttggggggttttgagagtagaagttctcgctttattttttccaaatagtaatctagttatgccagctatatctttttaaattttttttaattttttaacatttttatggctacatattaggtgtatatatttatggagcacatgaaatgttttgatacaggcatgcaatctgaaaaaagtcgcatcattagcaagggggtatccttcccctcaagcatttatcctttgtgttacaaataatacaattacatttttaaagttattttaaaatatacagttaagatattgttgactatagtagccctattatactatcaaatagtaggtcttattcgttctattttttttttttgtacccatttaacatcccgccttctccccaaccgcccaccacccttccgagcctctggtaaccatcctctactttatctgtccatagttcaataaatttgatttttagatcccacaaataagtgagagcatgcagtctttgtcgttctatgcctgtcttatttcacttaacataatcatctccagttccagccatgttactgcaaatgactggacctcattctttttatggctaaatactccattgtgtatatgtaccacatttttttttttttttttgagacggagtctcgctttgttgcccaggctggagtgcagtggagtgatctcggctcactgcaagctctgcctcccaggttcacaccattctcctgcctcagccacctgagtagctgggactacaggcgcccaccaccacgcccggctaattttttgttgttgttgtttttgttttttgtatttttagtagagacgggttttcaccgcgttaaccaggatggttttgatctccaggcctcgtgatctgcccatctcgccctcccaaagtgctgggattacaggcgtgagccaccacgcccggcctatgtaccacattttctttatccagtcatctgtttctgctgatagtaatttttgaataatcatatatactataatcatgctaaatttttttgcttaatttttacatatgccagggttttttgagaaagggctatttattctggtccactgttacattaatccttatttgatgtattgttttttagtctctctgtattgtaaagtatctactagaataataattccctggccctattgtcctttattttaaaaactattctggtatattgctacatttctttttctctacaaacttaaaattattttgccactttatccttcctaaataaaccatatccgtttttattttagtgaagtcacattgaaagtattaactgtttgcataagatattcttgtaatatccaggatttcttataagaactgagattttttaaaaattattttctgtctcagtaaagcttttttctacacagatatctaaatatgtcacttaaggcaattactagttgtttatttcatgtaatattattcctggttgctcttttagtatttcttaatttacatatttagctgattattatgcttctgtagtctattagtttcctgtgatcactataacaattaacattaattttgtgtcctaaaataatgcagatttattctgtttcagttctgatggccaaaagttcaaaatcagccttactgggttaaaatcaagcctcaacaggtctggttcctttggaggcactagggaagaatccctttccttgtcatttctacctttccttgactctcagccccttttaagaatcactccatccttttgcttttgtcatcacattttctacttccttttttaaccttcttgtctccctcttgtgattatatttagggctcactcagataatccatgataatctccccatcagaagatccttaatttaggcacatctgtaggtctcctttgccatataaagtgacattcccaggttctagggattagggtgtgtgtattatgtgagtgacctttattcagcctgcccatatagaataattattaattttatactattttatttccattgattttattgaacattatgttaagtattgttgctttcagttcattttctacccagttataaaatctccatgtgattatatgtttttttatttttatagtagtaattttatacctgtttctatttcatattttattacttctttcaattttaatgcaaatgccaaaaatgttttccttcatgatattttctgttgttttcagacgggtattttttcctaatcatagagaagtaatttgtttcttgctctttaacagtcatcttggacaaacatgtttaacatacatcttggacatatgttttgttgtatttatgtactaccaaatattagcccacacttgcatttctgtattaagctgtatttaactatagtatatcagtttttcaatatacagatggatttaagttgcttatatttagttatgatttttaacgtcttcattcatacatttgtgtatggctgagtttgtgtgtgactttcttttccattttgattatcagagttatgctagttattagtaaagtgaatttaaagacattctatttttcctctatagactagtttatattcagtattgaatactttttgtagcatgaaaattctctttgcatttatagtttgaaatatcacatacagcagtctgagcacagagcttatttgaatatatttatttgataggcctttttcatttcttggctatttttgagtgaattttgataatttacattgttctcagagagttgtccactctatcaagattttacaggactatttgttgcatacctgctatgtattaagcattgtgctaggtgctgtgcatgcaaagataagaatttcctaggattcttaatctcaggaagcatgtagtgagagaagttaattttcttagggtagagacataagaaatagaaaagaagaaattaacatctaaacagaacttctgataacgatttcctcatgaatacaggcagcatgtacaaagtcataaaaatggttgaatacatgaacaattgagacatttacaagtagatcattacagcttgagtttaggtattggtcaggaaagagtaatgtatacaaattagaagctgtattatggattattcctgaatttgtaccttttcctataaacattgatagactgttaataatgttcattctgggtttatcatcagtatattcacattttaaaagattattctgatggcaatagggagggctttactgaaggaagtgggagtggttaatgctggaaccacttacccattgcattaccgcaaaatgcataagtggctcctaagcgagggctacaaatagagatagaaatgaaggaaagactatatataaacaaatgctaaagaaatagaccaaagattagtttactgattggatacggtagatgagggagaagtcaagacgacttctaacttcctgtcagttgtattagaacaaaatgttttccttgtctttatttcagacgtgatagctctgatttcatttgaaagacttattatattctacacagactgtatcattaacatgaaaatgtgaataggaatatcaatgtcaggatcacatttttagttagaaaccaaagttatctattatagacaatatatctaatagctaggagagaaaaaatagacattctaataagatttctgaaccatatagcatggtgatctaaaaatcacattttatttatgatgtttttagtacatcttcacttggaaaaatgaaataaagaattttatagtaaaagagtttagacatactatttgaaatttgtttgaagttgtttctcaccaaatatattccaggcattcataagatatggatatcaaaatgaaataccctctgccctcaaaaggtacaaaagtctcgtaaaacatgtcttataaaggtgattttcaagtatctgcccattacatacatcagtaatacaagctcatgcaactgccaccatagtcaagctatggtatatttccatcatgccaaaaaatttcattgtgccccttgccagaccatccttcccatccatcctcacttcaacattccttccttaaccccctcctgccataggcaatcagtgatctgttttctgtcactatagatttgacttttccagagtttcatttatatagaagcatacattatgtagccttgtgtctagtttcttttgctctgaatcatgtttctgagattcatccctgattttgcatgtgtaatttattcctttttattgttgaggagtagtcattgtctaggtgtgtgtatacacagtttatttatctattaatggaccttaagtcgtttctagttcttgactattaggaataaaattgctatgaatatttgagtacaagtctttgtgcagagttatgctttcgtttatcttgggtaaatacttaggaatggtatatctgagtcatatggaatattcaactctgtgaaaaaccaccaggaggggttgtgtcattttacattcctgccactatttcatgagctctccaattagtccagatccttaccatgactgtactttgtggtgtcagtctttttaaaattttagccattgtaatttgcgtaattgtatctcattgtgattttaatttttgttttcttagtgggttttcatgtgctttgtgaccattgctttattttcttttgtcaactcttcaaacctttggttgtctctattggattgtttttctactaatcagttagaagagttctttaaatattcaggatacaagtcctttgtcagatatatgtgttgtgaatattttctcctgtgttgttctgtgtcgtggtttaccttttcatttatttgtttgtgtccttccaggagcagaaatttttaattttcatgaagtccagtttgtaaacgctttttaaaaacctgtcttactttttgcatattaagaaatgcttgcaaatgtcagattttctcctacaagttttgttttgttttgttttgttttgttttgagacggagtttcgctgttgttgcttaggctggagtgcaatggcgcgatctcggctcacggcaacctccaccacctgggttcaagcaattctcctgtctcagcctcctgagtagctgggattacaggcatgtgccaccacacccagctaattttgtatttttagtagagacggggtttgttcatgttggtcaggctgatctcaaactcccgacctcaggtgatctgcctgcctcagcctcccaaagtgctgggattacaggcgtgagccaccgcgcccagcctctcctagaggttttatagcttaatttttatggttagatctatggttcattttgaggtcatgttacatattgtgtgaaaacaaatttgatcaataagtatgcttaattaagggaaatctaaaattgctatcatcacacatttgacagactctaaataaagaaggagtagatggatttttttctgctgaagttaatttagtactgacttatgtatgaaatactgctctagtttttgtacccatccaacaaataaaacatgccttgtaaaataatgactttcctattagtagtgggtttaggtggagactgctaacattctgtatagaatgaatgtacatattaatgtctcttcacagtacttgtcacatgcaaaatattcagtaagtgttgtttttggttgttaatgttcattattgttaatgtcattcgtattgttataattattatatttaggattcttgccttgaggaattttagaaaggatgatatttagatgaaataggtttggtttctgtaatttatttacttaatacttacacatagtagtcatactttttatgttttttttctgccctcccaacccctcacacacataagaaacttaattgttaatgggttctaatacataagtaataggaagcagtgtttttagcatcctttgaatgatctcctttgtttgcatggataattcctgaatacttttttgaaaagttcaagaacagtagatgtagaataaacagcgcaagtaacattttacctacgcttccagtcttttcccagagataagtattatagatctgatctgtttgctttcagataattatctatacatttatactgatatatatttatttatatataggcacatttgtaggtgtatttttctttgtaagcctaaatgaacatattatacttgcttttttaatcttaacagaatgtttgataaatctttccgggttgatactttcttcattcatttttactgctgtatattatttaataggatgaatataccataacttatttttcaagcatgcagcaggtagacaagtgcgaggccaagcctaactgacagaatcagctggtaaaggtaaaatgagtcacttttaggctgggcgcgtggctcacgcctgtaatcgcagcactttggaaggccgaggcaggcggatcatgaggtcaggagatcgagaccatcctggctaacatgtgaaaccccgtctctgctaaaaatacaaaaaattagccaggcgtggtggcgggtgcttgtagtcccagctactcgggaggctgaggcaggagaatggcgtgaacccgggaggcggagcttgcagtgagccgagatcgcgccactgctctccagcctgggcgacagagtgaaaaaaaaatgagccatttttagattcagatagtttattatttacatagacagcaaaaggaggggaagctaaaagtatcacatctccaggtcctcatcacatacaggaaaaggacaacatgaaaaacaaaaggctgcatgactgaagtgtgagtcctaggattccccattgctgaagactcaattctagagtacagctaaatacttttatagtgtgccactataccctaaggggttgaagattaggaagagtgaggcaaaaacttcatacctcattagaacctgggagaccatgagaaactgtttgtgatagtctcccattctctcattttccagaggatcacgaaccattctgctaagatacagattacctgcatttaaagccattcactgtgtggcctataagtatacattcaccattgctggagcatcatgatagagccattcccctacaactccaacccttgacctttcccatatcaggtaacaattcctcaaaggcataaccacttcggctgggcgtggtgactcatgcctgtaatcccagcactttgggagacagaagtgggcagatcacctgcagtcaggagttcaagaccagcctggccaacatgatgaaaccccgtctctactaaaaatacaaaaattagctgggcatggtggtgggcgcttgtaatcccagctacttgggaggctgaggccggagaaatgcttgaatctgggaggtggaagttgctgtgagccgagattacaccactgcactccagcctgggtgacagagcgagattctgtctaaaaagaaaaaaaaggaaaaaaaaaaaagcataaccacttcattagatactacacttaattgtacttttaggggctgagagcaaatatgcctcctagtagggtgatcgggtgtacttgttggatagaccttagccaagctcctcatccagagccaagccattcacgtcataaattgagaatgcagcaagtggtgttggcaatcacacatatctcacttcagctggccgggaggaactccagggcttcctagacttttcatcaccactggaccagagagtttagagtggtcagctttaatatgtgaagaatatacaaaagagtttgtctttccttaagtattagaagaagaccacagggcaccaacaatagtaggattcggctaaagggaatcataacagtgtcccgaaaattaatcttgttatgtggcttgttcactcctgcaatcagcagctttccttagattaagattcttcattggtcaacagttgagctgaaagcagtagtctgggtaatactggctcggtggctaagagctgagaaatattaatgtttcttctacccaccctgggtgtgccggtgtctaaggtattcttttttctacagccagggttactgtcttcccacagccatgtgtttcagtccctgcagcatgatcagtccctgcagcaattgtttcactctttttctaatccaccctctaccttacccatactatatggcctggagttggccctacgtggcttagcagtttcttcattatatacaatatgcattgtaccatcttagaacatcttttgctccttgaaatgtaggccacattggagataccataggagttgtgacctcatattcatcatcattatcatgattatccctaactgcctaaacctagtaagcataacaggacagtaaaagagtcaacaggttagagtcttccaaccccagtactttactacttgaaaattccagcaccctgattttccagggatacagtatgtgaggaagtggtgtgagaaagattaaccatgtgtttttggtcttttatagcaagtctgggccttctcccttcccctcaaacctcataattaaacattctgtttagctgaaagggacccttctggggaattgccacacttagaacccagactgcttttcttaagtgtgtatgcctctgggagccaagccgtttttaggctctagttaccttttttagtttcttctttgagaatctattctgtctttcattgtacctcttgcctgaagatgatatgggacataaaaggtccagtgaatgtctcaaatatctgctcactgctgggtagttttactctaaaggccacactattgtctgattgggtacatttgagaaatcgacatgtgtgaaatagtccgtctgtctttgaatagtatggcctctctactgtgtggatagagatgacaatggacaacctaggaaggtgtctactgctgtcagtgccaagtagtatccttaagaactatatggtctacttgacagacatgtctggtacccctagctataggctccagagttccctttgctacttaactgtgtagttgatagtcaagagcacacatatccttgaccttacgtgttagagaatcactaaggtttttttttttttatttgtttgttttgttttgtttttggcggtatcctgaattggagatgggttaccatgctctgggcaatgatgtattcaggtgactgtggtctctaccaaggcagtgcaagtctgatcagcttattgattctggtgatgctcatcctcaaagggtactttcccatgggcatcaacatgaatcatgaacaagaaatgtgagacttgtacagcctgcaactataacgctcatctccacagaaactggaacgaggtcatctaaattgtcccactgccaggcttcagaccacacagctagcccattgactcctggtatcagtcattgaaaatataacagactttgggggtgttttccagggaaagcaccatagctcatgacttcacctagtgagcagagttctcttttccatgcacagttttaaacagttttccttggggccacacagctgcagtggcccagagcacctcattggactttaccttaggtgattcttctgtgagctagacccaggcatcctcaggatgcccaaagttctgaagtctccaggatgtccaagattctggtacagactcttgcatttgggatggccgtattttgggagttattagccactttttcacatagctgatgtgcctatgattttctttaataacatacacatcactggtttatcatgcatttgcaagaccacattgccttaagaagtagatttgcccataaattattttggaccacttgaaggtagcaggtattggtgaaaaataacgacaaattgtttttagctcttatccccttgattctaaattcaaggcaaaactgaaacatgcaatttaccacccagtattagtgtttctttcagataaaatgtagctaattatgaaggaataaaatgatgatatggttcatatgctgataaagtgagtattttttttattttctaacattaaaatttagcaaacctgtcttttaaaaaaatctccaagatttttgtaaacagcgctgggcttttaaataaataaaagtatattttgtctagttttatagatctctccatctaaaaagaaaatagtgccaaggagttttttatttccttctctgaaaagacatggagtgtttatgcaggtttccaagcaacatcagccttgaaattataagaatgactgaatactcaggaaagcaaccaatccaaatttgtaagacttttggaattcagtaattgatgaaaaacagaaccatgttagtcatcaataaattacaccagtttgcagatttaaaaacatattcttatatttaacatttctcaaatttaagttatgtttacttaatatatctggggtgatttcctcaatactgccaaatgagtttaatctcttatttattagcgtattgagagactttccattgagtacattataaattagcaagcagttctttaaaattgaacttttacttaaataagcaacagtagaaaaagaaagtaaaaattatataatatttccaatatataacataagctaaaactaccaggtggaaagaattttgtcttataacttaaagctatttaataacacatttgattttagaatctcaagtaaaagaatgtgtattattggccatactactatatttaaaatgatccctgacgcccctcaagacaaatatattaattttttactttgtgggatagagatcagaaaaagagtagagatgaaaatactggagaaacaatgcaggagatatttatgaggtgagaatgtcaagaaacttgtaaagggagaatactataatgacccctgaagagagagctttagaccagttgaatattagaggttgccacgtggctattcatccactaataaatacaagaaattactaaaatggaagcccctggaaatatgttttgaggaaggtgagaatgtggacctattataaatgggtgaatatgatttctttctcattaagttcataaataactttcagacatgtaacagtttatgaagtgtgccgtagtcatttagtataagttttatacacaaaagtgtttttactaagactgtcacaggttcttttgtgaatcttgtttgtttttcctcattgtaaatactgcaatagaacatttgtgtcttaacataaggcaataaatgaccttaagaaccttcacttttatatagaaagtggaggaaaagttggcagagtaatttgttgattatagataaaagctcttgtaggaattggccacatctgttttattgtttgcagctgagacattcaacacaaaataagttggctggtaataaaagtacaataattgctaatgtaaaacagacagatgtttttcttattacatagcactggacagatgtatttgggtaagagttgaaatttttaacaaaattaagctggtcttgatcctcagaatttgaatgttttactctgaaatcatgttttgttaaaccatgtaaatattttatctttcccaagaagtatatgtgaaattatttttgtttttggaatttctgaactatagttttgaatacacatggaactagttgcagttaattacattttgggccgtagtatttctgataaggagataattacaaaactgctacccagattgtaataccctgttccacattgtaaaatattgatacctttaaaaaattttatgttgttttaatacttcctccatattcaaatttttaccttttatgaagtgattacttgagttatgcccttgggggctcttcttgactctaccgtatatggaaaaccacattaaagagaaaatcttcacatcattgactccttcacattttgcatgggaagaaaagagttccaaatacaacttgaagaacttactgaatattctgacattctttgttattaatcctggaagatgacctaatatagactgctaggtcatgttggctacttttgataaggtgattgaagaaagccctctgtatctccctatgatgtgacagatctaaaatatgcggacattttaatgttgagtagaattcatattattactatataattatttataataatattaaagcattagtggaacatatcatttgagccatttgtcttgtggattacattgttctatgtgaacttacaagaaaactcttttgcctgcatccacaaatacaagtaaaggtcttcctgcagtgtgacttacagtcatcatttaagaagttaattggtcttactctccaaagatatttgatcccgcaggcaccagatccacaaacaggttggcttccatcctgttctagctaatcaaactgttatagctaggttttagaaaacctccttggttatttttggggtaattagttgtatccatactcaaacacaggggttggtgaattttgttcagtaagccaaatcttaccactgcctgattttgcccagcccacaaagctaaaaattgttttaaaatcttcaagtgggccaggcgtggtggctcccgcctataattggagcactttgggaggccaaggcgggcagatcacgaggtcaggagatcgaggccatcccggctaacacggtgaaaccccgtcactactaaaaatacaaaaaaattagctgggcatggtgtcgggcgcctgtagtcccagctactcaggaggctgaggcaggagaatggcgtgaacccgggaggcggagcttgcagtgagctgagattgtgccactgcacaccagcctgggcgacagagcgagagtccgtctcaaaaaaaaaaaaaaaaaaaatcttcaagtggatagggaaaaaaaagaaaaaaaaaagaatgatatatcaaggaatgtgaaaattatatgcaattcaaatttctctgcccataaataaaaatgtattagtatacaaccatactgattgtttatgactgtttttacattacaatggcagttgagtagttgcaacagagatcgcatatggaggtcttactactttacattgcttctcaatcttagtgacactgtaatgtctcggcaatgtttgccataccatggaattgtacttacgtgttattagcagtacatattcatcatgtcaaaacaagaagagaagagaatgtgagcttctaatgttatggttttaaggaaccatgcagtgtgaattactttgttataaataaggtggcacagtattgtgttatgcagtaacactatagctgcactaaaataataaatgttgacattaccagattacacactcattgcagcattaccaacacacgagaaagcaatggtcagaagcattttaaataaaacatcttattcacaaaaataaaaaatgaggctgcaaccacagtgagtttctgagtaactaatttgttggccaagtaaggaaagtcatttcccagtggtgagtaagttaaaacctatccagagaaaataaactttactgaaggagctaatgccaggttgtttattcaaagaactaatgtgactgagggaaaacttctatgaatagtctgcttggaacaactacggatgagaatattttcagctgagttaagaaaacactaatttaggacaactagaagtagaatctaatgagatgagttgaagctaatggtggcaaaaatatttgtgatattaggagcataataatttgtgtaattagttacagaaatttatgaaacttgtgaaatctgtggttattcatagtaatattattcaccaagtaccttgtggaatatatttgagtctatcatgttattgaaccagtagtatcaatagtaaacttcactcaatttcacagagtgtcagttctgtgaatttttgtcagaaatagaagatgaatattctgacttgccctactatatagcagttcaataatttaaccataataaagcctattgcaatgtagctaagaccaagatggatttttttttctgaatgaaaataacgaatctgactctaacccacatttatcaacattaaatggctacgaaaattagctttttgtgtagacttgataacgtttacaatgaattcaacccagtgttaccaggccaacagcatttacttgcaaaacttaaacttcagtgaagtcatgttaacaatagtttttgaatcacaggttacacttcctgttgtctcaaaaattaaaacaaaatctccaaccctacacaaatttgcagcagatgtattttatgagttcaaactatagttccagcagcatatttcagacctcagtgcagttcaaaagaaatttccatatttcaaaatccatttatctgtgcagttgagcttctgcctaatcttcaattgacagtgattactctgcaatataatggcctgctaaaagcaaatattaagagaaaaatctattataattctatagatgcctcccaagtgatggacatgaccctaaaatattatatgcacattgatatgaatattgatatcaatatttggcagtaactatcttgtgaaagacatttcattttcaaaaataaaatacataagatttcattctagatcagtattaacaggtgaacaattgcaatagatttaatgataaggaacactgactttgaactctaattaaggaaaatgttatacttcatctttctccttagtagatctgtttgctgttcttggttgttagtagcagtattatttgaattttgtcaatataaaaattgcagaaatttattttctcttgtataaactcctacataatacccttgatttaacctcttggcctgcaaaacataaaatatttactttctgaacctatatattaataggaaaagtttgctgacctctgttctaacatatctacttttacaactaaattgttcgatattttcatactattatatctttgattacttatcttttacaataaaaagataaagagtaaattttaagaactaagtttacaaagaatgaaatatatttatacgatgatcaattaaccaaatcctaaacaaagacaaatctgttataaaaggaaaagcaccagtctattagttttctcataccatttaaaaacaaacaaaacctaatgctcagttaaaaaacacaaaggcaaacaatattgtaatagagttcgtgagtctgttttgtttctttctgttttgtaatagcaattaaacgatctaaaattttttaaaactgcatgtcactttttaaattaacttgaatttttactttgagtttactgataatgcataattttcatgtattgttagagtaatatgtccagtaaactcattgtaaggtatgaaatatattaacatgtcagttttcaacctaattctgctgggaaatttacaaagcatgtcactttttctttacaccttttctgcttgtgacctaaaatagtcatgctgaactacctcaaatgagcattgattttcaaattgtactctttggaaagttattatttttgactgatttatcaaatctactttaggaccatacttttattttattttttgatatggatagaatttaccaaatctgatgttagactttggtgttctctaccagagagctctaacatcaacattgtcaaatatgcttgaggattggatgacaggggattaagagttgtacattatggcgttatacagtgtttgagctagaaaagttgataaacttatatagcatttcagtttttcagataagaaattttgtgccttggtcctgattatctagctaattatttttaaaatgagaattaaaactctggccatgtaagtctcattccattaaattcagtcgatcttcattattcttggattccataattgcaaatttgtcccctcactaaaatttatttaaaaccccaaaattagtactcacaagtgctttgcaatcattaacaagcatgtgcatagtgataaaaagaatttgagtcacctgacatattttcatagcttaggtccggcaatgcgatgtcctgccatcttgttttgacaagtgtccttttcagtttattagtgccacggcttaattttgtgctttttgttgttgacttcgttgcttaaaatggcccccaagtgcagtgctgaagtgctgtctaaattggtgtttctaagtgccagaaggaaatgatgtgccctatggagaaaatatagtaatttctcagtatacatcagggattggtttcagcaccttcgtggataccaaaatctaagcatactgaagtcccccagtccaccctggggagcctgcatgtaggaatagctggccctccatatatgggttttgcatcctgtgaatactgtgttttcatctgtgtttatgtagaaagaaatgcaccataagtgaatctattcagtttaaatatgttattgaaaggtcaactttacatgaattaggtgatcctcacacaggcatatttacaaggccgttggccatgagttaaatgttaatgtatcaacaatatatgttaaataaggtgtttttaaatgtaaccagaagttcatagggacctaaccctgtatttcccctagaaataatgttcactatttgttaattcagtgtttgtggcaacttaatagatcataactaccttgaataatgcaaaccaactgcacgtgtatatcaacagaaaatgtaccccattcttcattatttcttgcattatttaacataacttttttctgtgatcacactgataggaatataaattaagaaaaaaatttcttctacttgtagaaaatttatttttctctcttatattttcactaattatctggtcctctcaaagtcatgcagcttttgtttttcccagtcataggattataaagaatacacaggaagagaaattgtcatgcaaatccattataattaccaaaaaaacaattcaaagtacatgttaggaagatacattctattttagtttatcatttcaagagttacttatgattcctgtttctctttcaattattttaccttgttttttctacttcttttgcataggtgttaacagtctaattctacgaaaacaaatttacatggcatcactaacctaagaaccactacatcaaatccggaatcctttttatgaatttcaaagccctttataatctggccctactctacctattcttagtttgtgctgttgattctctaatgcatatcttgccattacagtgattatacccttactgtgtatcctcacttgctctgtacatactcacctttcccattgctcacagtgcctcccaataactttaataatctaactcagtttagttcacaggttgtactgtgattgtttcatttgtgagtgtaacttaatacattattgtcagatcattattaaaggcattgacaaaatatttctaaaattatacattatatagttatattggaggaaatataaatttgaaatacatttcaaaaatactaatttcacgagaagagatttgagtaaatgttttccatttaaaatagaatctcaaaggggaaaatgttttttataggttaatttatccagtacaaaattttgataaagattatttcagttttgaacccaggtatttccttctgaagcaactctatagtaccatagaatgttagatttggaacaaaaatgaaaaagtatataatttagtaatcacattttacacatgaaaaatcgtcgtaatagttccttattgccaaatacaatttaaaaactagagatcatttgtatcccaaacatcagagtcatgcaaatatagccatgtaacaaacctgcatatgtaccccctgaatctaaaataaaagttgaaactaaaatgaggaataagttctggtgttctattgcagaatagggttactatggttaacaatattgtatatttcaaaataactggaatagaggatttcgaatattctcactacaaagaaatgataaatgtgtgaagtgatatgctaaataccctcatttggtttttatatagtgtgtatatgtattgaagcatcacactatacctcattaatatgtacaattagtatgtgtcaattcagagtgaaacttaaaaataagatttagactttttaaagcaagaaatgtgaaatttcaaatgatttgtcgtagcattaaagtgataaggtgttattgataaaagagggctacgtaaaacaagctaatatctttggtctaatttataataataatggcaatacttttaaaatgcttttaccataattattgtatttatatataagtgtactaaactacagaaaacttagataacatagaaaactatggaaaagaaacattactcattatcccaacacagtgtttgtgaaaatgaaatactttttcagaagtagagtaagcaatttatatttaaaatactttcttcatcttgaacagggacatttaaggataatataatatccttaaatattttattacaaaataactctatgatttatcttccctttgaaatgaattatttggcataaataaagtattggacctgtacttatatcatgtttatgatagagattaaaatttggaagtccaattaactgtagtctcatttgtagtttgcatttcatcagaatagttggtgtttttccaattctgcttccagcccagattttgtatacttcttccaacaagtatatttcttcagaatttaaaacaatttcatattatctttattctgaaattcaggaagaggaaactgatagtttgtaaacctcttgtggttcaaaggatgtccttgttggaaatggtgatttacatatgactatgccatggcatggtatatataattcatttatggatatattcttcagatatttactgtttgtgataagattaatttttaaattttatctggaaagtggcaaatggcaaaattgttatttataataaaattaataaaattgttaaagtatcttaacattcttaaagtacatagtccatttagtcttctcaacatatagtttgtattctatctactatattatacagactctcttaattaatacttatttcaacaaatatttaatgaacacttattacatgttcaggtacctgaaataaaacagtaaaacagaatctgtgaaagttcctgcctctatcagtttacattctagtggccaagaaaagtaataagcaagcaattactagcattatttcaggaggaaaagaagctttgtaggcagattggtcagtaaaggcctgtccgaggagcggtattttgtgaggaaataagtcatggtgttaggtggaaaagagcattctagcaaaaagagccaggtacttcaagaaggctggtgtagcagcagcagaatgagcaagggaagagtattaagaggcaaagttggctgggtgtggtggctcacacctgtaatcccagcattttgggaggccgaggcaggcggatcacaaggtcaggagatcgaggctatcctggctaacacagtgaaaccccgtctctactaaaaatacaaaaaattagtcgggcatggtggcacatacctgtagtcccagctactcggaaggctgaggcaggagaatcgcttgaacctggaaggtggaggttgcagtgagccaagatcgtgccactgcactttagcctgggcaacagagcgagactccatctccaaaaaaaaaaaaaaaaaagaggcaaagtcagagagctaggcagtggccagaacatgaaggccattgtaggccataataaggaatttggactttattcttcttcatttctttaacacataattaaagacaaccacagctagatgatttacattacaaagtcccattgagacagtgtgctgttgctgcaaggataaataagtagaccaatggaaagaaaaaacactgttcaatagagcctaaatacaaacaaaaatatatatagtcagttcctttaggccaaatgttaccttatactgtagttgtgaaagcatagtctgagttaattgagtagccaaataggaaatatgtaaacaaatttgtatcttggctcctacctgacactgttctcaaaaatcagtcacagatggattgcagatctaaatgccaatggaaagaaaacatagctgttggggaaaagaaaaaccacatagaatatctttatgatcttaaattaggcaaacattaaagtggtacataaaagctctaaccataaaggggaaaaaaaacaataaattgggccacatgaaaatccagaacttctgctcatcaagacaccattaacagtgaatagacaagtcacaaagtgagagcatatacttgcaatacagtatgcatagaatgccttcaaatcaataaggaaaaaatataacccaataaaaaattggccaaacaactgaacaggaatttcacaaaagaggatatcctaatggccgataaacactcaataccgttacaaatatattattcattagggaaatgcagattaaaaccataacatgataccactgttcatccacctgaataactaaagtgaaaaagactgacaatactttgttggcaagaatgtggattaactctcataaacaggtggaaggattggaagtggataaaataactttagaaactaatcattttggagcatcctataaagttgaacatacgtttgtgttcttgaaaatttaagatatacacttatgattttgtacttttttatgtatacatgtatacatacctcagtaagtgttaaaatagcaaataacataatttgtagaaatgtatgaatgtaagaatggaaatgtataggcattctaaaatatttcaagcgtagatcactatgatctatttttctttacagataaagtaatacaataattgtagttgaaaagtcaataacgtaaccagtacttgcttttcctttcatcctttttctttaccatgctttttagtaggcataggatacatgtccaaaatcttgtatttttgtaaaaatgtaaagtaaccatgatagactatagatactgataagttttgtaagttaaaagtttgcacagtaatctttgagtctggtcttttattaaacaaagtatttggagtctctgtttgcatatattatgaacaaattgattagtatagtatgtattatgtgcctgacaattgacgactactagtgaatgtaagaaaataaagtttatattgtgcaattgttatcaactttgagtaatgcacatataataagtgttttagaaaatttcctgtatagaacccatttttgaaaattttaaacttaggtaattttttttctttatataaatacaagctcagagcaatcatattgcacaattccaggttacacattacagtcattgttaactggaaccctaaacagaggccctgtgaacctgcgaattttcaaaagtaatcaacctaataatggaataaggaataaaatgagaatttctcttgaaatagttttcatggttcaatatagtaaatgtcataattattgtccacttttgttctttgttggccatttttggactacactttagaagtttgtagagacactggaagaaagaataagtatatagtggataagataaagcaggaaagttattagatgtaggtaaaaagataaatattaaaataatgaaattgtatattaaggtaggtagaatgatagaagaaaatgaaagaaatatactattgggatgtgggtttactttgaaggtaaggacaaatataatagcaaattgatatataaaacaaatgtatatagtttttagtgtgtttgtctcaattcatatgtatttttaattaaaggaatacattttcatcagtaaaagctcatttgaaatatttaaactttgaagaaaaaatgaaataaatcaaggctgtttttatgtagcaaggccgtactggtataataccagtttatatatttctctggcagtttgaatttgatccagtgttcctttaggaggagaaaaaggcaaagtactacttctgtcaactgtctgaagaactgcacacattcctttactgagaagaatgaaccttaagcattacgtacttaaaaatatgtaatgtcttattttaaaatgtttaacatctttatattatattaacaagttaatgcctctatgttgaggaattccattcctccctttaatctgaacactttgttataattatatgaaatattaacattcatattaatatttggtattctgtgagaatacagatttaccataactatgaacatgtagatcagtttttcctcaaggataggaggtacacatggatggtagatacatttaatagagttgatttttttgtctgaagcttttttaaaaatgacaagataaaagataatgtgagagtcaaatctatatattgtgcctatacttacattgacataaatttttaactatatgattttgatataatttggttaagtatttatctaatgttaaatgtgatcaatcctgattccatgaactttcaaatgtaaaacaattttcttgcactttaaaaataagttattgacattcatattaacttagagatatcttttaacatttaattctctttttgaatgttacattcataaattattaaaataacttggctaaaagcaatgcaacaatattataatacactattttattaatgaatgttagctattcgaaaagagttactatgtgcaaatgctacctattgtgtatttttaaagtataaatagtattagcatattacacataatttgtttggatttgtaatttttagaacaatagctggtgaaattaaagttacttttaataatagtttcatttctagttcccaattaatgttcggttgagaatacttttcatttgttttagtattaatatttatcagtatttttatctgtttttttattaaataaaatttacaggaggtaatttagaattttaaaacatttttaaaatattgtactttctttcattgtatttttaaaaattttataagtagcatttattttatattcattcattgttcagaagcactgacattttcttctggatttattgccatttgcacaactgtttccatgacagcagattttctcttgcatacttccagatgatttagaaaatcagattattttaattatgttaataattttttaacatattgccaattgtttatcaggtatccctacttaatttcaaagcattgcatgtaatgccagttgtagcatttcagacatatctttttcatactcttatttctagaaaattactaattttgcataatttttctaagaaatttaatgaaaatccataaattgaatatctttcattcaagcttacagaattaatttgagcctattacattcattttaaaacaaaataataaaatgccctttctgctaaatgctgaatcgcttttataagaacattataggatcattttgtgttaattgttaaaatatagaaggcaaagtgcataaagcattgttgtaaatttcccaatgtcttttaatggttttgtggatgaaaagtttacaccaatctataatgtttagcagttggcaaagtatgtatatacatttctagatgttgaaggcagtagacatttaatattaagacatttaaaaagtattttttatacacttgaaaattaattgcaggtaacagtaacctgaaaggagaaacaatagatccttttatattatagttctcttgaacatgaggtgactatatttaaaaatgtattgattaccttcttatgatatgtaaattggaagttgtgcgttttgtagcacttcaagtaaagttttataatatttgcatatatttttctacttttcaaattatgccacatgtatagccagtgaagccacaatttgaagaactaatttgctattgcaaaatttatttattattatgtcataatctttgcgtgcatactacaactatttataatatctaaagcttttagtgtgggtaatatattcaagcaatgagatggtttgactagtgtcttttttgtaattaacattacataatttaaaacattgcaatttaagagtttaattgaagtcacagatgttttaatattatattacaattgttgaagctaactagaaatgtgtgtggttgtgttttaataaaactgtattcacaaaaacaggtggtgagttgtatttggcctgcagcctttagttgactgacccctgctttaaactattccctcagaatcacctcccttatcccaagttttacttactcctttgtagttagaagtactaatgtgaaaaagtatgaaaagcattcttcaacaattcaagtaataggaccagttttgcttagctcataaacttgattttaaaagcagtttaaaagaagtcttaattaaatatttttgagtaattcaggaataaatatatagcttttcagtgagacagatttaaagcaaaatatatactcttattcaagcattaatgtattctttttaaaggtttctttacattatatagcagtatttcccagaatatggtctgtggaatcatagttggaatgaaatcttccatgaaaaagtgttctatctagtttagcaagtttgaaatttgaaaaatgcttaacataatagttttcccaagaatccatgatgtatattattgtactaaatgttcagagggtcaataaacacttttgtttaatgatatttcggtcagtatttactagactacctagactatgaaagggtctttcaatcaaaatctcaatttcctctctccctcccactcttcgtctccctgcctacccaacacaccttaaaactttgggaaactcttctttttttttttcttttgagacacagtctcactctgtcaccaggctggagtgcagtggtgctatctcggcttagtgcaacctctgcctcccaggttcaagcgattctcctgcctcagcctcccgagtagctgggactgcaggcatgcaccaccacgcccagctaatttttgtatttttagtagagacagggtttcaccatgttggccaggatgaccttgtgatctgcccgcctcagcctcccatagtgctgggattacaggcatgagtcaccgcgcccggccaggaagctcttctttaaattaataccctatctgcaaatttttagatgattaaactaaaatctaaggagtgtttaacgatataatgagaatagatgcattgtatgttttggctattgattgaattttaggttaatatgaaaaatattcaaataggtattttttctctatgttagtatatttaactacttcatcaaataatctgaaataatttttttttagtataaaaaatattaatttgacctcatgtacatgtggggaacttagccatgcctgttgcacagccttgtatgtattagcaaccattttgttagaagataaaagtgaaccttaaaaagaattttcccaattattcaacaatatcgatcatctcaaatgtgccagatactgtgctaaatggtagtttcatggggctacagttaactgaatgtgtatttgcagcatagtatggtaattacttttcgacttgtttactttggaaagattttcttaaataatctgtttattgaattgttaaaccaacagtaaccagtctggtttgtccatttatcattatccaccaatgagaaatattatttgaatattatgttaattttaaaaatgtaattttatctaaatttttaccatcttattaatgaaaatataaaatagatttataataactctgacaggtagtctttaattttatgtttgagtgaagaggagaaaccaaaaagtttttgtgatgaactacagtgtttaaagccttttgtccacatgcccattttgcctttagtttgttgttaatgttgttcagataaagcagtgaaacactttctctaccatgactcttcgtttagattttttcaccttctccataatctttatttgtcttttaatgccatccaccatccccaaccctcagtacttctcattttctctctacaaagtatgtgggagccttttaaaagagagtatgtatccttgacctttgcaacttttaagtttcctttatcaagaatttcattttaatcttccccttttattttatgcatgttgtttattattacttattaacccagacccttctgaagtttatttgtacccaggacattatgtttggaaacaatagatagttttatcttctattgttttaccgtttaacattctataaacaataaccaagaccactgagggaggctaactagattataaatggatcatgagctacttgaaggcaggggccattatgtgcttagcttatatttcttgtgtgtgctgtgtagaaggaagtcaataaaataaataatgacttaatgaatccaccgtaaagccaaaatgatgtatttttcctgtattcctcttctttcagtatttctgaagtccccttttttccatttctccaatatttttcctgccttctattggtacatgttttctcaagatctagccttgactctattctcttatgtctgtactgtgtactctgaatgaaagcccatattggccaggcgcggtggctcatgcctataatcccgacactttgggaggctgaggcgggcatatcacccgaggtcaggagtttgagaccaacctaaccaacatggtgaaaccccatctctactaaaaagacaaaattagatgggcctggtggcatatgcctgtaatctcagctactcaggaggctgaggcaggagaatcacttgaacccaggaggcagaggttgcagtgagcccagatcatgccattgcactccagcctaggtaataagagcaaaacactgtctcaagaaaaaaccccatatgcatgaataaaagccttcaactgccagcactaaaacaatgtctcctccatctttacatctagagaatgtatcaaatgtgcagtgtgcctaattaaacctaggcacattgtaaattttataaattttatctataaaatctctcttctgtcttgctctgtcaatcgcattacaatgatctaatcatgaagcttgagaactttggaggtaacttttaatcttccttttcattgcttctcatacttaattgctaacttttgacaattttatctttaaaatgtatttcaatcttttcactcccactaccactactctcattttcaatgagtcttacttaggatattcaatatttcataatcttatcaccaatctcattcctccatgtatcctatataactgtgattattccatactctggtttaaaacatttctttcattgtctagcattaaactcacacacattaatgtagtatttcaggctttctgcttactattctcttaaaaaatacatctacaaatatctaaaaatgtactcatctttgaagaaccagcctaatataaggcgatattctgtatgaattgtttcttgagatgtcttactttgaaagaggtgaaattctttcaaggtagagaaacactactgcagttagcaagccaccttagacatattctttgccacattcaatttaattttaactctctttgctttttttctttcctttatttaatatttactacaagttcattttatcctagatgggctagtttgcttatctattcatctttcatatatttaaacatatacacttctattaaattttttcttttattttaaaatttaaaattcatttttaaaatataaagattttttaaaatcatatgttactccatttatttattaattaaatttttagggttcttctgttttgtatgaaatacaagtgatttttaagcacagaatactctactaatcctttattgccttatagttttcatcaactctatgacagttctttccattacatggaatatgctatgtgtgcttaagtgtgtataatgtttacattgtctagtgtgaagtatgcttaagtgtatggggataaatggtgtgtgtgtgtgtgtgtgtgtgtatgtacatgtgaaaaatttctcttggtttaatgttggtatttatcaaatcgtaggatatagggttgttctattcttacataaaatcatcaattagagccttcctaattataaacattattattcaatatcatgaatatttatagaaatttgtgacctcaatcccagttccttttctttcttcaagaagctactgaaagcaagaacatacttactctttcacttttcaagaaataccaaactattttttacaacacttaggaaaattatatcctaattctataagaacattttactttatgctcaatctaaaaaatcaaaaatgttataaagaagttaatacaagaatggtgtattcatctttgagggagaaatcaataaccttatctcttgcaatcagtgccatattagttattaataaactaatgtgttagtaatgaaagtagtatgaacaacagcagttgctatgtctattcaaaaagtgcagaactctcaaatataatacatggtttctttgtaagtaatagaaaaactttagagatcactttttttactagaagcttttgctttttttcctcttctattgatataactcttatggtcttgtttaggacagaatttgtttattcttttcagcagcctgtttttttgttttgttttgtttttgtttttgttgtatgtttttgttttggtgaaaggagtggatatttatcaaggatgttttgagtggttttttaagatgaatttataattaaagtcatacacatttatgttttgattttgtttatggattttctggtgtaaaggttaacatgatgaacacatggctatagtaaggtggaaaaacagtaggaaacttgtactcttgctcagtctgttgcatgattatttagatacttacttgatctaacaaactaaagaacacagtgattttatatgaagtaaactaaggctatttgaaaatatgtgtttccaaagggtagaattcatgaaacacaataaaaataatgaaatatactgattaatcaaaactttttcagcatctattttactgactttcaaaatttgttttggacaacttcataaaaaacactctttataaaaccctcaacaaagctgggatggatttgtttggccacattaatatataaagtagcagctttatcgactgctagcaggaaacatgcctcaattatcaattctcatctataaactactatgataagattttcagaaatcagccatgccatttaaaacctagttttgacattatttttttttttttacaatgagttgaatgtattacactgcagtatgctttagcaatcatcccaattaagtaggtgtgccctttatctgagtgttaagtggatttcttaatgttcgagaattgtgctaagtgcttgtttgttatagcataaaacaaatgctaatttatgataaattagtacttgaggaattttacatttctgctgctgttcaccttagcacatagcaaccaggatacaatccagtttaaaaataaaataatatggtttggatttaactgtgaaaattaaattcaggaaatttcaaataactattgaatgattaaataaaatcattctggaattttattttatttggtatcaaatatctgataccaatcatgtgttgatagtccttaaagaacagttgttggcctggcgcggtggctcatgcctgtaatcccagcactttgggaggcagaggcgggtggatcacctgaggtcaggagtttgagaccagcctggccaacatgatgaatccccgtctctactaaaaatacaaaaattagctgggcgtggtggcaggtgcctgtagtcccagctacttgggaggctgatacaggagaatcccttgaacccgagaggcagaggttgcagtgagccgagttcatgccactgcactccagcctgggtaacaaagagttaaactccatctcaaaaaaaaagaacagttgttggtctttctatctgcagaggccattcagatttaaggtctgcactgattaagattttcttgattggcgaagacaacactcatgaaagaagaagactatgattttactcttttactctggcaatgtggccttactttgactaagcatgaaaagattttgagcttcctgaagcaaatctgttccccaagtttgtcttagtgtcttactagggttgaatttacttctctttattaactccagatccaagcaataccactaaggtctgctggagtaattttacgccctggaagattacctagcctaattttaaaattctataaattcttaacttgggaaaatacctgtagctaaagaaagaatagtttatacaagtgttggtaatttagcatgggcctaagaatgagatttattttctaagacatgataagtaacattgcattattagaaggctctaattactatattctgtctcttttaacatatttttaactgatggtgctatttggttgtaatatttggtaatactagtgttttagataagcatctatttttatgtacaactggtttttaaattaatttctttaaatttcactaaatgtatcatttttaaggtttctaaatattttaatacaaatgaaataaggaaaatgagatttgttaaaggctgtttaaatttcaatcctgtttttctaaatgggttgtaaattacaaaatggaataaaatatttcaaacactatgttttaattatttacagtgttaccgttttatttgttaacatgtgttaatgaatctcaagtaacacatgattataataggaatatttttaaatgcagcttagcaaaaataagaaaaattagatcataccattcagagataattttaacattttcctacatagtgtatatattatcaggcatatatgtgtgtattatgtgtattattttaataaaatgggactgtgtttggtagaagtaaatcaaggaaaggtgttgtgttagtgcattttcacactgctataaacaactacctgagactgggtaatttattaaaaaatcggtttaattgactcacagttccacatggctggggagacttccggaaacttacagtcatggtgggaggctaaagggaagcaaggcacatctttacatggtgacaggagagagagagaagtgggaagagccacacacttagaaaacaaccagatctcacaagaactccactgtcagaacagcatgggggaaactgcccccatgatccaagcacctcccatgaggtccctcctctgacacatggggtttataattcgaggtgagatttgggtcgggccacagtaccaaaccatatcagccatcttcaatttaccgttgagctcattcaaaaattataaataggtaaacattgtgcagcattcatgttgcttcctttacatatgtaataatgttttggttctgtgtttatttttatatttgagctcattttttacctatctgaatgtgatttactacaggcctctctctggtatgcttttaactcatctgttttacctgagtatggctagctagctacccctagactctcaagacaaaatttctgccgtcactgccaccacctgagatcaaaggcccatgccctctgcttacttagcacaagttaaggaagagagagtgcaaaaaattaattcccttttccctttgtacacacatttcaaagaaccaccctatctcttcctctagaaaccctctctcagttatattttgtaagagcatgaactagcttgttttctgtgagtttggtgccatttttttttttttaacttactgtcgtttgttcattcagcagttacgtattggacacctactgtgtattgggcatacttcaaagcactgaagatatcacagtaaaaagtcatacaaggtcactgacctgaagggaagtgaaataattcaataaataatgtatagcataggtaagattttacaaaagcataatataggtgctctctagatcaaaagggaggctcatataacagaggactacctgctttagcagaacacccatctttcttatttaggaatgtttttataggttttgttctaatgagatagctttctcaggttttgagacaaaaagggaagagataaggatgttgaaatacctttactctcttgagctacatgtacttttaatatgctaaatatattggaaatttgattaattgaggtttctatatttacatattaaaagtgtgtatattgaaaatacaaagtggtcccattgctgaaatagacacgttaagtatacatttcatgggaaaaaccatctgttgaataattttatggtgtccagatgtacgctacatagtaaagttgtaggctgtgttgtggaccatgtggctcattggtttttacttgacatcagaaaagccagttgaaattctacaagcgaatggtacttgatagggtgctatttataaattatgaatgacttatacttttatctaaattttaaatggtatatataccttctaggaagttttgattcagaaaatgtcatgttttacaatgtcatattttgagtataaagagagatttatgattttattaaagaaaaatcagcttttctttacattattaaacattgagcaaatatttaagagatgttgttaaagaagcaccaaacataccagggcacttcatttttcggtttgtgcctgttgttctgttatgtaaattttttcatttcattcatcatgaacctctttccatgctgataagtaaagggctatgttataaatttaattttggtttatcgtgatgaatcagtttatttagctaacctctggatgttgaaccctaagtttaatttttatattttttgctattagaaaaaatagttatgaataactcagtatttccaactgtatacttttctaattgtttgcttgtgaattttaatttttttaaaaaaatgattactgggtcaaaaaacgtttggtacttaattgctaagttgccctctagaaagagcatgctaacttaccattccaatagaattgtactagagtatccattcctacatttccatcccaaacttttataattatttgccaatcagagctatatggtgatatttgatggaagtttggtttgattttttaatacaattgaaaatgaatatttttgcattggatgattacattagtcttttcccagtcctttcccttcttccacttcctttggctttcattcttcctttggtgtgattgtgccagggtatgtgtgcatgtgggtgtgtgcgtgagattcagtgaaattgttcatatacctagctcattttcttttggggttgatgtttacctttttcttaaggatttttaaaaacatttcatatattaaggaataaatactagattcaatctaacatttattacatatgttgcaagtttccccagtttcatcgtcgctttctccctttgttttggatctacagaaattataaagtatgtgtttgttaagtgctgtgtggagaacctatgtggaaaagaatcctcttaacacattgctggtaggagactaaaggaaaacaaacagacattgaaagaaatatgatttatgatccttgattgatcctcaattaggagaaaaaacaactatgaagaacattgtttaacatagcactttatgtagaaataaaagatttatcttatcctaaaatgtcatcttgagaactgtagcaaaaaacatgaaactagtgttatcattgtatgtatcatatttcaaataaggtgagaaaacaatggcacatttttattttttgagtttacttaggaaaaattataattgtcaaaatattttatttacaaaatccaattgtttatgtttgaactttgctgccaagtgaatttttaaaagtgaactagcacatcgttaactctccagtttctgcaatatagttaactataagtaggcttttttttttttttctggaaacatgttatgttgaaactcagttatatgcataacctgtaattagatttacatttttcatgaaagctgtatcctaagtatctgccttctctttaaaatatagtcttagcaagttaacgaaaatgctaatactatttaattctaactgttgtatatttaaatacaatgaaaaacagtaaaaaatggatttatatttttaaatttactatggctttaatagctggaattaattgcaaaagaacagctgcatctttagcaccacaggcttaaattaagatcccaaagtcccataggttttacattgcatgacatgttagcaagaaacttacaaatatagaaaggctcatgttctaagacagaacatgatccatataatatccatgattagtaaagcaaataaaattcagtccaacatcagggtctgtaaagaaaataaaatgatgagagctgagaaaaaaaagaaggaactagttagttcctcttacagtttcaataatatcccaaacaattcatttttatctgcggtatttaagaaatggatttgtttagttgattctgtttctcttagttgctaatgtgattattttaaatttctcattttgtttaatctgaagtatttatacatagtccttgctgaaactatttctcttgtagcacttaatgatagaaaatcctcagacatattagtttattccttatctttatttccataaatgagaaacttgagaaaagaatagtagaatactttgattcatagtaaatgggcactttgatttatgattgattattttaatagctgaaaagtcttagaagagcatagtaaatttttttctcctcaaaatagttattaatgtttaaaatcttttgtaccaaatataatttcagtcttcctggaagtttgccaaagcggaactttcaaaacaaaaaggacaataccttgattccttaccaataatgcctgtgtttttttcaaataatataacaatttttaaattacctttatagatgtattaatgagaagataaaataatatattatttctttatacttcatatgtattgccaacattcaaaacaaatctgttgattgcttcaaataaacacacttccagtgatttttttccttaaaaagaaataatagcttgtctgtataccagctattaattttgcttgttgcacacatatatttgaagatgagtttgtatatgtgttcatatgcagtcgaatccacatctaactcgtcttccctagcacctatgcaactgtatgccactatgttccctttatcttctgtggcccctgatgtactagtaaactaagaatgatattatcttagcaatgtcaaaatctcaagtaataaggatcctgcctaaccttaaggtgatattttatcttctttttctttttaacatcttgtttagttctacaaatagcactgaattgctaccttcgtaaaattatgaagtgagtacctcaagtacatttgatttgtgatgttttagttttggagaagatgctctataaaataatacttggtaagggtattaagaggtttgacatgcaaaaatgtggcatacataagtttgttgataaaaaactaaatatgtttattgtagcactttattttttaatctgctgatgagcactgtgaatcatttagagctgaggacataaatgcactttttttccctcaaaagtatttgaccagagatatctttttttcatacatcatattatatgacaaatattgtatagaacatacttagagaactgttaggcaaatatttgggagctttaatactttaaaaaatcttgtatcttcaacttatcttaaaacaaaatgattatataacacaattatatttcttactgtaaacaatactttctgcaatttctaaattttcttgaagtgataagttcagaattttatgaatatgatcatatttttccaacttttatctgtttttcttctgcatactgtgtattgcctgtgtatctccatttcttttcatattccccttgaactttttactcagctacactcttcttaaaagagacatcatagttctgacaatcctttttgtttctcttttttttttctcctgggaggtaggatactcttcttttaaatatgttttaaagtgacctttacacatgtagttctcttttcctgggatggccccttacctcaagagcttttgtgatttagaactctggttaagtgtgacccactcagtaagccgagcagtaagcttttcctgccatctatttattctttcatttaatctgttactaaatcacaaatatttagtaagtatttgacacatatgcacatgtgtgctaggctgctgtgagtgtaaagataagaatatgaatatgtaaacagctcacattcttgtgagctctacaggctagtgaacaggcaataattgctgttatgggacagtatagcatagtgggtacacagaaagaacacataatctagactgtggaaaccaggtaacacttctctggtaaactgataactggccaaagattggaaagataaatgggagttagcgaggtaaaaggatgaatgtgcaatcagaacacctaagaaaagtgtaaaaaacttggatagacataaatgaaaaccagtgtaattactaggaaactagccaggaagacactgataatatgtgttaggagaagttttatagtatttatagtattaacaaacatcacggctttaagaactctaagtctggactttgagaccacgctggaattgactgtggctaataagaaggctttctgctatgtacaaaacactttataagtcacacagattgagtttgttttttcatgccatagccatataacactacaatggaaagaaagccctacctaaattgccataagagagtaaattcccaacaaggttggatagattagttgtgtccctctcttccatatcagagaaatgtggaagtgcttaaagtccatatatattttctccagactgagtggtcaaagtccttgtaaaattttttacaggctacacactgatgttacccatagagtttctatatcactttcctgttttccttgaattacacataaagaacagtagcctatagcataaaagtttcttttcaatatggatacctccctgcattattaagtattagacacagaaggaaaaccaatttgctgcatcatacaaattcacattgttttatgtatacttttagactgttggtctctaattttattttttcttacccttatttgtgtttatttaaataaattttactatgtatagttaaggtatacgacataatgttatgagacatatataaaggtttttaaacagtgaaatggttactataatagagcaaattaacatatctgtcatttctcatagttactcatttcgccccctgtggcaagagcagctgtaatctcatttagcaaaagtcctgaaaacaatacactattattagctatagttttatgtagcacattagatagttcatcctacatatttgctactttgtatcatttgccctcatgtactcccaccctggaaactactgttttattctctatctctatatatttgacctttctttttttggtagattctacatatctaagtaagaatatgcagtatttgccttcctgtggctggcttatttcacttagcataatattctccaattccacccaagttgtggcaaatggcaggatgccttccttttaaatctgctttaaaatgtttataaggagactggaggtaaattttcaaaatgttaattcctttccaatcaatcaaagaaaatgttctttaatattctcagaaccaatgcttcagtacacttttgtaggtcttcctcagaaataagactctttgtgaagtagtcagacaaattcacttttaatgtcaaattgggttgtgtttgtttgtttctgtgataggtaagttaggtaatatattacacctgatactacatatacaaatgtctgtaatcatggcttaacagtaggaaaagactagaaatagttttactctaaatataattattttaatattatggtaatatggcattttctgaatattcttgtcagttgattatagatgtttataaaataacgggcttattagagatttactgagtagataaatgatataaggattaatactcagtaaataattaatatgttttttaatttacttagaaatatcccatattaacagccaggcacggtggctcacgcctgtaattccagcactttgggaggccgaggcaggcggatcacgaggttaggagatcgagaccatcctggctaacacagtgaaaccccctttctactaaaaatacaaaaaaaaaaaaattaactgggcgtggtggcgggcgcctgtagtcccagctactcgggaggctgaggcaggagaaaggcgtgaacccaggaggcagagcttgcagtgagctgagatcgcaccactacactccagcctgggtgacagagcaagactatatcccatattagcactttattttttaatctattagtagaatttttattcaacatcatgtatttcagaatttctacattaaaaagtcatgatcaatatagtaacagttctagtataaggtagtataatttggtctgataatttaattgataaagatatttatttcttttcttaacagtatatagttactagcattctagtagatgccattcctggtatgtctgggtttgatatgcagcagtattctaagaaagcctcagtttgtggtcagatttaatatttttttattacggtgactaagtttaattaggaagtttgatttgtactccttacttgactagttcaggaaatcagttcatttgaatctttttccatgcataattattctctggatttgggtatgtgatagaaaatatagtcagaagataattgaataaggaggcattgagctgatcctcagtccttgggtgtttctaaaaggatggatagacagaatcttttggaatagaaatgtatggtaggtatattcattaatacatttcagtaagggagcattatgtgataatccttagtaaatagaaaggtctaatcatgatctttgctttacctcaggccattgatatttcatatacattttccctcttcttttgacatttacgttggattttaatgcagtaattctggatttaaaaagcttgttataaattaccttgggcagtatggccattttcatgatattgattcttcctacccatgagcatggaatgttcttccatttgtttgtatcctcttttatttcattgagcagtggtttgtagttctccttgaagaggtccttcacgtcccttgtaaggtggattcctaggtattttattctcttagaagcaattgtgaatgggagttcactcatgatttggctctctgtttgtctgttattggtgtataagaatgcttgtgatttttgtacattgattttgtatcctgagactttgcagaagttgcttatcagcttatatagattcagtgccatccccatcaagctaccaatgactttcttcacagaattggaaaaaactacttcaaagttcatttggaaccaaaaaagagcccgcatcgccaagtcaatcctaagccaaaagaacaaagctggaggcatcacgctacctgactttaaactatactacaaggctacagtaaccaaaacagcatggtactggtaccaaaacagagatatagatcaatggaacagaacagagccctcagaaataacgccgcatatctacaactatctgatctttgacaaacctgagaaaaacaagcaatggggaaagggtttcctatttaataaatggtgctgggaaaactggctagccatatgtagaaagctgaaactggatcccatccttataccttatacaaaaatcaattcaagatggattaaagacttaaacgttagacctaaaaccataaacagcctggaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacccacagaatgggagaaaatttttgcaacctacgcatctgacaaagggctaatatccagaatctataatgaactgaaacaaatttacaagaaaaaaacaaccccatcaaaaagtgggcgaaggacatgaacagccacttctcaaaagaagacatttatgcagccaaaaaacacatgaaaaaatgctcaccatcactggtcgtcagagaaatgcaaatcaaaaccacaatgagatatcatctcacaccagttagaatggcaatcattaaaaagtcaggaaacaacaggtgctggagaggatgtggagaaataggaacactttgacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcacaagaacaaaaaaccaaacactgcatattctcactcataggtgggagttgaacaatgagaatacatggacacaggaaggggaacgtcacactctggggactgttgtggggtggggggagggggtagggatagcattgggtgatatacctaatgctagatgacgagttagtgggtgcagcgcaccagcatgtcacatgtatacatatgtaactaacctgcacattgtgcacatctaccctaaaacttaaagtataataaacaacaacaaaaaaaagcttgttataatagggctcatccaaggtcatagttttatttcattaaatgaatagttatttgttaacaacttgctaagtagtaggctggggatacacatgtgaacaaaacagtccaagttcctgttcatttggaccttttgttccaccagagagaggcaaacaatgaagtaagcaaattacaacaaacaagaatttcagaaaattgtaagggtcataaagaagcataaagtgatagtgatttgaaagaggctgtttatggctgttaagaaagtcttctctgataaggtattattgagctaagtcttttatgatgagaaaggggctgctatgggaaaagccagtggaacagtgttcccaggatggagatcagtgggaaaaaaaaggcctaagagagaataagtgtggcatgtcccaggaactaaaaaagacctaactccctggagtgaagaaaaagagagaaagagtaatatgagatggggactgacgagagctcagcagaggtcagatcttgatgggttttgaaagccatagtaaagggtttagacttaactcttaatatgagatgagaagccgttaagtttttaaacaggtaaattacataatatttacaggttcaaactattattctgagagaggagtggattgtagtggagcaaatagtgaaccaagatggacagtaattagcagaccattgtaatgaacatgtttagagcaaatagtgtctccgactagggaggtgttggtagagagagaaagagagagagagaatgaagtcagattatattttatggtatttacaaccatggggactaaatgaacatcatcctgggaagagagtagcaacacagaagccagaagaggaaactatttccataaggaggaagtggttaatggaagtcactacatgaaaaggaaaggtaaaatgccataatactatagcacttgatatttttcctcatggctacagtttaccagtatctctgtcattttgccttattgactgaaaactgatttaatgtctgcctctacacctatacatctgttcagcctttgcttccaaacactttgaagaaaagaggaaaggctatgacaactttaacaaagaagtggcaaagtggaccaaggaaaatagccaaaatttcatgcccctcccccaaaacctgggatttgagagagaagagaaagacaacagcttccctacctgctccataggacataaagagctaaggacacagtctaattttgcctaagagacaaagctaaaagaaacattcataaaagaggttttggatatgaggcatatgctcaaacttgaggtaaccaagagcactatgaagaaatttagagggacagggaaggatacagaattgggtgagattcagagatatatggattactatgaggataagagtctgatgatggctgaagaaacagacttctggtaacttcgatatgtagaaatatgaggaatagcagtctcttagaggaagatgggcagttagagttataatccagcttgttattttaagggtatgataccactgacctttcttttctgctccttgtaattatgtggtgagttttgatgggggaggagcaggggtagtgaaatactgaagtcactaaaggttaggggaagagttggctcaaatgaactaactgaaggatacccaagaacttgttcacagggggcagattaatgagtaggggcaggagatcaaaaactgcagggagagtatacaggaaaccaaagactcagagattcccctctaaaggaaaggccagatggtgacagagagccagtcatctgtcctcacttggattagaggctagtgagtgaccaggagtccaaggatctgtcttcaagtgtattagaagtcagaagacagtccagaggaagactgggtttgacactgtggatgattgtgtattcctgtgatagtgcatgaatatacctgacagggatcacactctgttacatccaggtaatatctactctgggattctgccagttgtcaggccttatctatagcattttaataattcagaataaaagagacaaggataggagagagacttatatgaaagaagaattggaattaacagaaatacattatggaaacatagatctgtaatattctgagacttgtatttttaaaactgtttgtaatggctaagtcagattttgttcatagtgtcacagaaacttacctgaattgtagttacctattttgacctgtactcaaacaggtgtctgacagatgtattatctattttcacatgtcactattagcccctataactcttaagatattctgatattctttaatttataattctataataattaatgttgaaaaaataggtaataagatactccattgtgtttcacatcagggcatacaaaaataatttttagcaaatgagttgagttgcagaatttctgagcagaatttctgagctttgccttcatacccaaagtcacattttttttctaaatatgttgtggtatgctgaagctatttacttatttttaattttaattttaattttttttttgagacagagcctcactctgtagcccaggctggagtgcagtggcacaatcccagctcactgaaacctccacctctcgagtaactgggattacaggtgcacacccccatgcctggctaatttttataatgtttagtagagatggggtttcaccatgttggccaggctggtcttgaactcctgacttcaagtgatctgcctacctcggcctcccaagtgttgggattacaggcgtgaaccaccgtgcccagccgctatttattttaactaagtgttttgttatttgttctcagcattatagtcataggatagctttaatgcgctggaaaaatatagattaccaggaaaaatatagattaccacagtgtattaatgataggtttgtaatttttttcgtgataaaacattacacattttttgttaaaatggtaaaaggaatttatggaaaagccgcagctaacatcacactcaatagtgaagactgaaagcttttcccatgataagaaacaagacatggatgcctgctttcaccactgttattaaacatttttctggtacttgtagccagaataattggacaagaaaacaaaaatggtatccaaattggaaaggaagaagtaccactatctctatttgcggatgacatcttcctgtatatacaaaactccagagaatcaagcaagccactagagctaataaattaagcaaagttttagaacaaacaaaaatcagttcctatacaccacagtgaacagtccaaaaaggaaattaagaaataaatttcgtttacagtagcatctaaaatagtaaaatgcctgcaaataaatttaaccaaggaggtacaaaactgaagacctaaggaaaggcatcccatttaatgggtgagtacacttaatgttgttaaaatatcagtactacccaaagtatacagactcgacttaattgctatcaaaattctaaatgtttttttttttttacagaaatgggaagcctgattctgaaaatgcatacggaattgcaaggttcctagaatagataaaacaatattgaaaaattacagagttgaggattcacacttcctgacttcaaaacttactgtaaagatacagtaaccaaaagagtctggtactgtcattaggaaagacaataattaatggagtctagaaataattccacataactatagccaattgatttttgacaagggtatcaagttcattcaatgggaagagaacaatctcttcaacaagtgttgttgggacacctggatttccacatgcaagagtggagttagaaccctcctcatatcatattaaaatatcaaaattaattcaaaatagatcaacaacctaaatataagagctaaaaccataaaactgtagaaggaaatgtagaaatagttctccatgaccttggatttgggaatggattattcagtaacaaaaatgggaacaaaaaataaattggacttcatcaaaattttaaaacttctgtgcatcaaaggacattattaacgtccattaccaaaggacattaacaaagacaacctacagaatgagagaaaatgtttgaaaataatttatacaataactttaatatccagaatatataaacaactcctaaaactcaacgaataaaaccccagtggctcatgcctgtaatcccagcacattgggaggtcaaggcagtgggatcacttgagtccagaatttggagaccagcttgggtaacattgcgagaccccatctcaaaaaaaatttttttaattaaaaaaaaattagccagatgtggccgggcacggtggctcacgcctgtaatcccagcactttgggaggccgaggcaggcggatcatgaggccaggagatcgaggccatcctggctaacacggtgaaaccccgtctctactaaaaatacaaaaaaattatccgggcgtggtggcgggcgcctgtagtcccagctacttgggaggctgaggcaggagaatggcgggaacccaggaggtggagcttgcagtgagccgagattgcgccactgcactccagcctgggcgacagagcgagactccgtctcaaaaaaaaaaaaaaaaaaaaaaaactagccagatgtgatggtgcgcacctgtagttcacctacttggggctgagctgggaggattgcttgagtccaggagtttgtggctgcagtaagcaatgatcacgctactgcactcacagttgggcaacacagtgagaccctgtctcatacacacaaaaagacaccatttgaaaagtgtgcaaatgatgtgaacagatatttctctaaagaaaatatacaaatgaacagtaagcacgtgcaaaaatgttcgacattattagtcattagtaaagtgcaaatcgaaactccaagatagctcttcacacctattaggatggctattactaaaaaataataataaatgttggctaagacttacagaaattggaacccttttacactgttgttggggatgtaaaatggtgccgcggcttgggacagtttatctgttcctcaaaaggctagaattaccatattagtcaacaattccactcctaggtttgtacacagaataattgagaacaagcactgaagcagatgctaccagtgttcattgcagcagtattcacaatagccaaaaggtgtaaacaacccacgtgtccaccaacaggtaaatggataaataaaatatggtatgtaacatgcaatggaatattgttacgctgtaataagggaatgaatttttgagatatgctacatcagtgcatcttgaaaatattatcctaagtaaaataagccagacaccaggcagatattgtgtgattccatttatacgaaatatctagaattttgacatagagacaaaaagtagattagaggtaactgggggatataggaaggaagggatggaaatttatttcttaatggttagagttacagtttgtgataatgaaaaacttttggaaagagatagtgagagtatatgtacaacatttgaatttaattaataccactgaattgtacacctaaagatgggtaaaaggaccagttttgtatgtagcacaatttttattttttatttatttattgagacagagtatcactctgttgcccaggctggagtgcagtggcatgatctctggtcactgtaacctgtgcctcgcaaattcaagtgattctccaccctcagcctcccaagtagctgggactacaggcgtgcaccactaaaaaataacaaaatttttttagtagagatggagttctcactgtgtagaccaggctggtctcaaactcctgacttcaggtcgtccactcgccttggtatatgtacagtttttaaattgccatttttctattatcttagcatcctaaaactataaaaaattaatacattttaatattaataataatataatacttttaaataatagattacatatacgcttaaatttctgttgtttttccgactatagtctactctcctatattacttctcccaccaagttaaacagtcaaaattctttatcctacctctacatttatttgatatagtgcatgtagtcagtgatatgatattcattgattattcactgatttaaataattcagtccttgaaatttcaacaaatgcaggccttgtcttcagttgaatttgtaggcttatgattaaaaaatggatcattctataaactctatatttttaaaaaatatgacataaagttactgcttaattttgtctaatgcattaatctatattaggtctcaaagttgacaactttgttacatgtcagaaattaatgtaagagacattaattttcttgctctcatctcgtaagcaatctctgattcgttaccatgctgcatgtccattgcaatgctgctccccttacctttacatgactctgattagctatgcattccaccactggtcacacttctgagtttcttagcttgagttggtatcacatgtttggtgcaaactgttttcccagctgggacatgtgatatcaaatcaagctttgcaaaagtgaattcctattaatacataaaggatagatagaagaatttcaagtgccatttttctcatagcaaaaatttaaaagtacaaattactgtcaaaaatggtggtattgagggggagtggagacaagtcagcaaatctctatttattatgtacatataaaatgtaattgcactttaataaaaatttgttatggcagttttatatttctgtaattgtggaaattaaaaggttatactattgacataactaggattgctatagtgatcctaaatttagcataaacctatgctgaggatgaatgaatcgtcatcatcttaactgttttttgcatggcctcaaaatttaaaaactagaaataaattgcaatatatttgagaataattgcagttgttatataaaattttcagatatatctgttttcagggttcttcagaagttagattcctcagctgtgcagatgctactttatgggaatagctagttaagtaaattagtattccatttgcatgatgagacagagaatgaatgaacgacaagctggacaacatctactttgccattcattctctcttcctaaggtctctgaagaatgaatatttttagatttttctgaaaaatatactctcatcctttgacttgatttgtgatattttaatgtgaaaacatgttgtataaacagaatcaggccttcactatgttgactttggattaagcatgttatatggccttttgcaaatttttgcagtttaaaagtagagagataattgtgtagagttaatcacctagagaagaaacccaattattactttacatcataagatgtcaattcctatgatttctttttttaaaagaccttttcttgaaatagtgtattttctcctcagtaattgtagggtaggaggaagtattatcaaatgtgcgtaactgtacagtggtataaaagctgcaattacaaattgaacttacttttaatggcaattttatcaagtacttttgttgatctgaaaacttgtcctaaaaaatcttactaatagcccacatagttattaaccatctcctgtggtggtctgttctctgcaagaagggtcaatcatttctttttatgacagatttggaataaatcttggagaaatgttaatggtattaagacaatgctttttaaagaaacatcaaagttacatgaaaataatttttccacaatcaactgaaacatatgcgattttcttaaatgtgttaaatttgctatctggcctaatattacattcttaggaggtatgtggtataatgataaaaaattgtttttgacaagacttttactgttctctgtgtttgctatatgtctttgcacagttgcttccatttccatacatgtaagttggagatatctgtcctgattattgtgaacattaaatgagattttatgtgtgtcaatcaattatactaacaatatataaatatatgtattataattcatatttatatatcttctgtaaatcacaaattggcttatgaagataaggaaggatgattactgttaaaagtcacttaaaagaatattctgagatgcatattgttaaattgcttcaaattttaagttattccgtatgcgtatagggacatagaaaggaaacaaaaggtctgtagttgtgagcttcagagaagacctttgaattgcttcatttcttgaaattggttaagtatatactttcccctgaaagaatgtactactacattgctgcgactagaaaacccttcaatgtccttcagtggagcttttgctgactcattatcttaaatactcataaatgagacttttgcttatgtaattatagcaataaatttggtaacctaagaaatgaatgtaaatcatctatttataaagacaatatgaaaagtgattatcatatatagactattatgggtgatttttattaaataaatggtaacatagtctgttgaaaggatactttgtgttttagttttaaaaattaagatgcttgtatagaattttaaatcttttaagaagaaagcattaaagtaatattttatctatttacactgaccccaaacttggaaataaagaaaaatgaaataaaaaatgatttcataaaggccacatattccctatggttgtcactaggaacaagaaaactacttggttttttttttgtttgtttggcttttttttttttttttttttttttttttttgagtctgtcacccaggctggagtgcagtggtgtgatctcggctcactgcaagctctgcctcccaggttcatgccattctcctgcctcagcctcccaagtagctaggactacaggtgcccaccaccacgcctggctaattttttgtatttttagtggagacggggtttcaccgtgttagccaggatggtcttgatctcctgacctcatgatccgcccgcctcagcctcccaaagtgttgggattacaagcgtgagccaccatgcccggcccggaacctacttgttaatagtttatataattttaacagtcttatttaactgtatattattaggttgctgaggactagaaacagcaaattataagagaagagcctgttataatcagatattttagcaaacagcaaaaataagtggcaaaaagaggaaaaatatgaaaactaaaagaatagataccactcacaaagcactgtttgtgtaagagtaaatagacagacatacctccaaatagcaaggaaatttaaatgtatttgaaaatatatattgcaagatatttcttgatatgatagaaactaaatgtttacttgcatgaaataaaaacatgttgatcacaatattagctatccaaaattagtaatttctctgcataataagtagcagttatctctataaattatctgtatatcatgttgttttaaatatcagcttttgcctgttagagttaattggtatttacattttcttaagttattttggaggccaaaattattgctatagattgtcatagaagtgttaataaattttctactacatttttgtattattgttttattttgtgatgtttcagtgtcactcatccaaccaaatgacttactctacactaacattaatatttcctaaataattatgtctgtattctttcataagatactgagttatatttccagtaggaatataaactgatgcattttcttttatatgaacagaatgttcactaattttcattatagatgacaattgaaactatgtggatcaaatcattagcatatgttcgttattctagaatagtcttactctggtttgaataatgtctcaggtatctaaacagttttttatagcactttagaccacaacaaaaaatatttttctccctaacaatattattttaggtagagttcattttcagagtttgtctatttttttctaccctaggaaaaagaaaaaaattgttaaattatccattatttctcctagtacctgtctcaaaaaacttttaccacgtgccctttttaaatgataaattataacttattatagtttttaaatcattttccgaaatatatctgctttttatgttcgttgaatgatcttataaaccgagagatttactggctttatagatattttgtagataaaaaaggccttagaaatcaatcacatgtatgtttcaaaatacagacaagaaattttagactcaggaagttgtttatttaaaaaaaaaatacttgttgagtatctgtagtgtgccaggcactcttctgggcactggagatacagtggtaaacatgacaaagtccctttcatactgttgtttttgtctctgctgagcctgtcattgtctctcagtgtttttcataacagttattttcttttactattctttctctgtgttttatttctcttatgtatagtgtctgtccacatgaactagaatatgagctccatgaaggcagggtttgttcgttttttttttcctgtttggtcattgctgtaccttcagcttctaatatgatacttatttagtagggactcaatacatttttatcaaatgagttaatgaactgagtaaaaaccatgagctaggagcatgtggcattctgaaagccaagtgaagtgtttttagaacagaatggtcacctactgacagcataaaatgctgctgacgaggcaaacaacatgaagacttgaagattagatttatccaggtacagctgtgatgaatgctttcagtagagttgtagaatctactagattcaaggagaaaaaaagccatattggagtatattcaggattgggtgatgaggaagtagaaagagagtatctataaaactcattcaaggaattttgagggataaggaaattgagctgcaactagaagaggggtatgaggtcaatgagaatttttaaatgtttttaaatgaaaattgtaagcatgtataaaatagaacaattaatttctttttgtttttttttttttttttttttttttcgagacggagtctcgcccaggctggagtgcagtggcgcgatcttggctcactgcaagctccgcctcacgggttcgcgtcattctcctgcctcagcctcctgagtagctgggactacaggtgcccgccaccatgcccggctatttttttttgtatttttagtagagatggggtttcaccgtgttagccaggatggcctcgatcttctggcctcatgatccgcctgcctcggtctcccaaagtgctgggattacaggtgtgagccaccgcacccggccaattaatttctttatacccttcatctatatcaacagtatcaagatttgtcatgcctaaaaagtttactccttttttgttgttgcagaaatattttgatgcaagttcagttacattttacctgtacatatttcagtattcatctcagaaaagaaaaaaaaatgacactttctgtaaactgatgccataatctcacatgttaaagttaacagtaattatttggtgccaaaactctgtccttgtcattgcctcaattttgtttcaagtgaaaattgtttaatttgggacccaaccaaattctgccttacatttagtcataacatattttaagtcttcttttgtctggagagtaatctcttctttattgacgaagctgcatcagttgtcttataaactatttttgtgtctttgcttccttatggtatcgtttattgttctgttttcagtattaatctatagtgctaaatgtttgattagatttaggttcaactacttttaggtacatcataattggttctgtgtgttttttattacatcacatcaagaagcatataatgtttggttttcatactcgtcatgctaatgttgatcattgaaatcagttggtaatacctgatgtttttattgaaaattttatattaacctttcatctgatgattttatccatttatgatctttaccaaacttaattttgtcattaggtttgcaaaagagtaattttctaactctatcaatgtctttaaaaattgtagaaattacaacatatttcctactgatgggaatattcaatagaaaaaaattatgatgtaagaaataactctaactggagaagcagtggacttggtaggtaagggggcacagggcccagtgcataagtgatggatcaccttaggtagaaacaggaactgtgtaactgacttacctaaacttatagtagcactgaatatattttattaaatttctgtgaaaacttttctattaaaactgataattgtatgtaattttagaaacctgtgcatttttagcatttaatactgtatgttaaatcaaaacttaaagtcattgtaaatgtcaatgcctgtatttgacattgccccttcttattatactttttgtgatttctttcttaaaagtgcagttttaaattaatggtctcttaagccgggcgtggtggctcacacctgtaatcctagcactttgggaggctgaggtgggcagatcacttgagctcagaagagcagcctatgccacatgtcgaaactctgtctctacaaaaaaatccaaaaaattagccaggcatggtggtgccttcctgtagtcccagctgcttggagggccaaggcatgaggatcactcttgagcccaggtggtcgaggctgcagtgagccaagatctcaccactgcactccagcctgagtgataaagtgagactctgtctcaaaaaaattaattaattaatggtatcttatatacctctatcttatacaaaatatgggcatgtacttttatgtaactggttttcacctctcgttgctagtgtgtttcaaagagaaataaatgctactgttaaataaaatgataaataacaggcagtttagtttagatactaattgagcctaaatcctttaaaatgacaaaaccagcaacttttatgatttataggctcattttttttaacacagtttgatcatacacctgacagtctcccttttttgtgactttctcctaaaaattacggttttgtgttttctgagtgaaaaggccataagttcagtagaagaatatgatagcatctcttctgaggattgtagcatttctgagtggtagatatagaatctccttttttctttcctttttttatgttaatagttctaatgcaaattatgtaatttaattttcaaacagtatgtactgcaattgtgaacctgtgaactattttcaattgtcccacagatgctaatatgtgaaatttagctttagacagtcataattctttatggctcagtaatttccactcactatctgttagtctctgcaatctgaaaagtataggggctactgtgtggtctgacatggtttgtattatcagaattttattgacagcatagatttataatctctttagttatttagagccatgtttttttttttttttttatctctatctaagttagactgttttggcatccacaaaagagcactctgtagttgtctccaaaaacaagaatgtaatctgatctgttttcatattgtctgctgacctggataagaacactttgtattagctacattgatcagttcctatcctttctagtcatttattggacacttaatacaaccttgtaaagactccctagagtatccccataaactagatcattttatgcaggaaccacaatatgtatatcaagatagacaagaatgagaaaagctgattaagagaaactggaaaaattaaacccacagactcacattatgtttttcaggctttatccacccttacaaatgaaagccatatacatggtctattgaaatgttttgtaaaatccaggaaacttagatttttatagatctgaattttcattgtttaaaatatgacaattttatttaggtatatctctaagtttttcttttatttctgcttctaattcctgtaatctaattctgtcttctagaagtattaatgatattcttttactattattttaatttcaaaactactagaaaattggtctgtgtgtcagaatctttaaagcagtataaactccttatgactttttaaatatttgtagtttcacaaatttgtccttcagaatgtattttaaaacattttacaaattaccttgaaattttgaaacagtagcaccaaaaggaaatatgttaggtaattgaaaatatttccattaattcaaaaactcttttataaattttaaaatcccattttttggaaaattttaacaactgtttagaaaagaaatacttatttcttagaagcaagttcatgtgttatgttgggtcactgagaagattacagtggaataccaggcttctacaataagcctgagaataatctgaaaaactaatttatttttattgccttaatgtatatctgtaaagtataaaataggtgatacgacctgtgtgttagacacaatttcaccttagtcttgtcttgcatcatatatttacattttattcacaagatattaaataaatactattaataatatctttaacaaatatttgtgaatttcaagtttcataaactatttaaatttcatgtttagtcctaatattctttttattaaaattatatcatcaataaagacagcactgattcatttatccaacaaatgtttacagtgtacctattgtgtgccagaagctattctaaactttgaggatactacagcacaaaacaaaacaaatttacactccacgtagagcttatattctagtgaaaaagtaaaaaaaaaaacaatgtaaaatatcgggtaacaagtgttgctatgattaaaggaagagcgtggtaagtgatggaacaacttgtaccatctatgttgttaccaccattattttcagactgtaatgtcctacaattctctggttttatgtcggtttttttccccctgaagagtaagctctttgaaaactgggtttatagatctttactggcatgttaccagtttctaaccctaagttcttttataagtactcaataagtatttgttatgtcaatgaatcagtgatatgttcacaacttctctggatctctgattgagctgcaatccaaatgccctttttgagaccaaaacaactagaacggaatttataaaaggaatcatgagaagagacatgtatatattacgtgtggttcaattaaatgttttacgttagagttctgcattttacatttttttggcgttatgatatcatcctttttcataatttttttaatgcaaagtgtggaatattttctgaaaatcaatgttttatccacaggtactactgagcgagtgtgcttgatccagggaacggttgaagcactgaatgcagttcatggattcattgcagaaaaaattcgagaaatgccccaaaatgtggccaagacagaaccagtcagcattctacaaccccagaccaccgttaatccagatcgcatcaaacaagtgagtgtttagttgagaaatcaaagagaaatatccacagcatagtataagttccttacaaaagaagccttaaagtgttagcataaaacttttattttaagcacacataaaacataccagagttgtcatttagttatttaaagactatcaaggtctcatccttagattgatcagttaatttattgatcaattgaattattcatttattagtgttacattgaggagcacttatgtgactcttagtgattgccctttttaaatttatagacacaaatttaatttataggaattgaatctgtttaaaattatatcactttttaaataaagtataagtatttcaatgatacattcaaaatttccaataccctatttttagtgatatttgtagttttcaggatagttattatgcatagaggctcctgttttgttaattttgttgtcatgttctcattttttatcaaaaaaatgtatagtaaatttatgtacctaccatacagtcctttgttacaaatcagttactgtgttttgtgtaacttatgtagtatttaaacatatgtcataaagggccaatgttcatttttaatgtacgagattttttgtaaaaaattttacttgggaaaaactgatgtgagtttttaagattgaataatgggtgacatgatgtagggggaaaatgacattatttcatgttaaataaggtggattcttccaccgtaaactcttttacgtctataaatttattatgttcataattattgtttctgcctttgcctttttataattagcgtcttaatttgtgacgtaattttactatcacagactatggcttcaaaagaaatgtattattcttcagtaattcacagaatatttaatttacagaatactcatgttcattgtaataaatttgaaatgtagctcaaagtcttattaatttcatgtttctgaatttaaaaagtattatactgaacagtgttatgaatcctataattttaccaatatatagataaatataatgttgaataatgaaatataaacatagaaattgataattaggcaatatattttcaaattatagactaatgtctaattttatactaattacttttttaaaaaaatccctttatgtttaaatcatgagtaggtagttgttattctatacaaaaatgttcatattataatctttgtcagtgtcaaatggttcagtttatacccttcataagtcttaaaagaagtatcccttaatgtatacatgggagaatataaatattttaaagctgtaaaatcagtggatattttatttttcacagtcatttatagttgtgtttattttttttaccctcagtgaatacaaagagtagtttgaagactgaattcttgaaagtaatactgtgactttaatcagagtttaaaagtagaagtgtagttaaagacttaggttaaaatcacctggggctaagagtttacagaataagcactgaagtataaggtctattggctttctgccttaatccagcctataagttcctccttttcttttgtaatttctgtgagaaaattcaaacatttagggatagaagccaatatcttgatttttttttaagtaaaacataaaatttagtagtatgataccattgacaatatgttcaggacggtgatatgaattattattattttttataagaataaatatctcataccaccaaataatggtctatgaatcattgttaaaattctaatttgctatatggcagtatgagatttacaggctatcatatatccagtgccagtatagatttatgaagactagaattttaaaatatttgctttatttttatttgcctttttggatgttatttaacttcaagataagtataaaaaataatagtgatttattgacttttgtgtatttgcatccatttgtaagacttgtaggtattcatggaattagaagtattgttggttatttaatattttcatgtaatcaataatgtatgtgacagtgtatcatttaaaaggatttattaaaaagacaacactaaatctaataagacattgtatttaacacttacatattttctttatattataaaagttgaaaattttacttgaaaaatctagtaaagcagtgaaatgtatttccaaaatattataaatcagtcagaccttttgctctaagtttgggattctctgactttctaggtatccaattttaccaacgtagtactctttgctggattattctctaaataataaatatataaatttaaatgaccttaattttacttctgaaaaattatgctgttattcagtataaaatagttatgtctaaaatcattttgcaatagaatagattaaaatacattttgtatgtttcttatgtatgttttaaactaagtaaattgaatgaaccaggtattttatccaattgaaaactgcccttattgactgagtgggttctcagacaagtataatttcttgggaaagtagtgcctgctggtctctcaggtctttcatatagtagaataatgaaatttagcacaatggccttatatataacttgatatattagatcttgtggaatatttaattcttaattcatatatgtattttttctaaaagctacatcagggaagaagtagttatggacatttaaagaattctcttgtatttaaaaaaaatcaaagtaagatatcaaaaatatttcatttaaccctaagagttttactgtcgtcatgataaattgacaaaaatagcacttgttaatttgtttgttcattattcatgggcatgaataattatgaatttactaaatgccttcttagtaagtagcaaaatatactaaactgtagcccttgcagaccagtttgtgagataagtacttaaaataacttataaaaattaaaattgtatttatataccaaaactacaatgtaaacaatatgctgtaaaaattcagaggcgtggccaggcactgtggctcacgcctgtaatcccagcactttgggagactgaggcgagcagatcacctgaggtcgggagtttgagaccagcctgaccaacatagagaaaccccatctctactaaaaatacaaaattagccgggtgtggtggcgcatgcctgtagtcccagctgctgggaggctgaggcaggagaatcgcttgaaccctggttgtggaggttgcagtgagccaagatcgcgccattgtactccagcctgggcaacaagagcgaagctctgtctcaaaaaaaaaaaaaaagaaaagaaaaaaattcagaggcgtgtaaaagaaatacaggtcagagtgacagttaatagtcttgtaaatagatgaaaacttgactggaccttgaagaatgtataggaatagcctaattagagtagaagaaagaaaaacacttattttaggaaggtgaaatgatgtgaatttggggagaagggtatcatatttgttgaatagtaaggagactgtattggcagaagtgggacatttatgttgcagtcgagagggaattaatgttagatagatgttagggagccagataatgaaaaaccttggatgtctaatcaaaggacatcctatggaatacagatttgccaaacattttcctaaagagcccttttaatttatctggaagattttgggggggaaaaaaaagaagtcacttatgctgtttgttctctcttgcattaaaaatccagacagactcttagggtgcttgtaggtacagctattcataggaaaagagaactgtgaattgactagttcagatgctggaagacagttcacatgttggaaagaggaagatatttgtcaaaaattaaaaactaaagatgacagttaaatatttaaatattttattcattttggtacagtatgtatacaaatgttacagtacacagatttatttaacagaactcaaaataggggattgggaaggtgattacttcagtaatgttacttcactagtaatagattttgaattacaattgagatttgttgttcgtcgctgttttcactttgcctataaataccagaggttcttgacagtctattactgcagacttgcttgaaagcaagctctgtttattacagtgtttattaataataatattctctggcccagcaaaactgtcatttgttaacaagaattcatctcataatttgtaatagtcacacttatttccaaaagcctagttatgtctacatttaattacctactgttaaattcttgattttttaaaaaactatattccaaaagatccactgttttaaaattgttaataattattctgcattaagtattttcacccttcagcgtctaaagaattattaaacagccattcaagtaatgtagataaaatatatattatgcttttccgtttgaaagaaaaaatggcactgaaaactgagtctgtccttcacattcattatttgaaaaatgtagaaaaaaatttttgtaggactgtgtgctttgttctaactaatatatcagtatataatgttatgtggatattcagttaattacatcttcatgatgtatatcagaaattttactaaaggatatttaacatgaaaccactaaactttaactctgtacagtaaatggatgtaaacagtttgcttataaaatgttaaggcaacaggccaggtgcagtggctcttgccagtaatctgagcacttttaggaggccaagacagaggattgcttgaagccaggagtttgagaccagcctgggcaacaaagcgagaccctgtctgtataaaataatgatgataataataatataataaaatattaaggaaataaacaacttgtacatttatattgcacattgaaatatttcttacggatttttgttttataagaaatctgtatggctttatctgtatggttgagaacaactatcacacctgttccattaatttaataatcttttacaagtattactttagtatatttacatttagctgtttatgagaacactttttctcctagtatttaaaaaacaatcaactgaaaggaaactttcgagggtatttttattgttataaattgaatttataaagcaggggtctttttgtgcttaaaagtatttatatgaataatagctgcaaaacttgtcacatctttatttcattacattttcattattttaataatttaaactaagaaaatatagagacaacttactgtaacatttcaacagtcttacaacttgaaacccaaacttacataatttttacttgtttattaaatatattaaaatgtaacctcttaacagattatgatgtttaccaaccaaaagtttaattatcttaggcacattgatattgtctagaaatttaaaatcattgattttattcctgtaggaaagaaacagcatcacaattattagggataattttgatgaatgtaagttctatcaattattaatacatgtccaatattttatatatatgccaagcaaaaagaaaggcaataaaaatcgacagattgtattaatctaagtgattacaaattctgagccattcgatattaaattttaattttaattaaaagttcaatttgcaattaaactttttctacatggttctttgcagttaagaccttgttgagaatttgtatccaagacaaggtggatgtcatattaaacctgtagtacttcagaattattttccattagatagtacttctaatggaaatagaagagctcaacacacatagaatcgtgcttctgtaggttaatcaacatggattctaacctgtattgggagaaatgatctctagatttaacacatacttagtcaccagactcattattaatctgagattagtactgaatagatttttacatgtatgttaactcctcccaggtatcctctgtagtaacagttgtaaccaatggtagaaaaataaaacctttactgttcaattcatagaacaatcatagcatggagtcattagcatatgtctcagcaaagtattgcatggaaaataaaatattagggaaatttttaatgattggaaatgaagtctctcttgagaaatagcaagaattaattataaaaaacaaaaatagaaaacaaaagatttaaaacttttttagaattttgaggatttactgattactatagctgtcctaccccttttttgtatgatttggtaaaaatcttggtttgactcactattgtaggtttcctagaagtacttaggttttaactttagaagaatcaggaattatttgaggagtggactatgtaaaacatggtatgatgttagaaacagtagtattttgttactggagggcagtgaattaaccagaagcctggaaatttcttattctttttttttatttttaactcttaatggctttattgtacgcaaattacaacttttgaaatgtcaaatgcaaaaatatgacttcaagtaatttcatctgcttttcctgacactgctgaacctttaaagttatgcttttgctcatatctgagtaattttgacaaatagatattaatataatataaaacataatgtccatatacaagtgtatcttcaatataaaaacctatcccatttcacctgtttagaaatattatctattgaggacgtaacataagcaatgctattttgcttagtgagcatatgacacttaaaaaaattctaaacatcttacacttttaaggtatttctgttagacataagaacttttttaaaaatcttaatgaattgttcaacatgtgtagatggccttatacaacatattatatatatatagtaagtgtatatgtttagaagtgaacaataaatatgattcctaatatttttgtgtttatttttaacacagctgatgatgctatattatactcttcatctatattaaatttactctttaagataaataataaaaatattatgatgatttgttagaatgctattagttacctgtttattaatatgaggttaatgtttacattttcagacgggccttaaatttattaaaaattaatattttagaagataatgtgatattaagaactcagaacttcaaatttaattgcttttaagtatggatccctaaattcatgtggaatcaacttgttggtgatgttcaacatattaagtaggtggataattttatgccaaagtaaacttcatttcaccacttcttcaaatctccgactgtattcatcgataggaaagtgactcttttggttttattcattgaacttcttgaattttttttttttttacatctcttttccccaagaaaacaagagggaaagaaatgaaactactattcatgaatatggtcaggatacttttagtactcatgtgaatttttatcagtcaccatcatgatttcaagtcatgaatttatttttacatgcttatgcatgcatctttacatgcattagttacttaattgatgttaaaatccattaaattcaaatgaataggagaaaaatttgttcataggattttgttctcgttatattacattttattttattttgttttatttaaataatcagtttaaggcttataaaggttgatttgctcctgaactgctttgtttcccagacattgccatcttccccaactaccaccaagtcctctccatctgatcccatgaccacctccagagctaatcaggtacagtatcatcctgtcatctacaccatacttttcacgggtgattgcctgcaaactggagaaaaagataatggtgggttaaggatttattcgttcattcacatatatgcaccatagtcagattccaaataacctaagaaagaaatatcaattatttctaaaattttatatgcatttttaattttagataacaaatactatattcagatattaaactactctaattttttattatttttccttaaaatttgactacctaatggagcactgaagcctatttattgaattggtatttttaatctcccttattgtatcttcctagaatttttcatatgtaagttaaggatatcatatatgtaaaaaaaaaaatgtataaattgagcaaaggtatatctttaaaagtgaatgcaattttatttgctttttatttgagacatgccttatgatgtaaacaactttcaactattgatgaaaagcatttctagcaatctaaaagaaactgaaaattggtatttgtggtaattttaatgtttaacaactcaggagatggtgttttcttagtattttaaaaaattctaagcattttcattgctctgctgacaaactttgcaagtagaatatattttattagtttgatttatgattgttttggtactatttgtaggtcattcttcaaaaatgtagttatttttgacaaatataagaagattatctaaaatatttgtgtaattcagagccatactgtactttaatttgacaatgttgaataatatatttattaaaattattaaacacatttttattttgtgtgagttgagcttcatttaggtgagaaatgttattttctttaatatttttgctttttttaataataaaaggctttatggggttatttaaatattaaatataagcttatctgtttaatatatttttcatatagttgactaacaaattattaactttgaactatatttgctaaatatattaaatgtggcttttgcgtattatctaatataagactatcagaactattttgctgatttttttatcctaatacttttgcaacctgaagaaagatttaaatataataactggaagcaaaactaacatttaggatgatattttatactacaggtttgattttcattttatgcaatagcgttcccttcaaacaaaagcattttataatgcaaacatttttaggcccagtaaagtggttagtaaagtacacatctgcagtgttgtaaaacccaacacttctctttgaaggaaatggtactacataaagtgacaaccaagcttgtattacaaatgcatgaagtttaaaagtatacttacatttttactctacataccttgtcttttactgagttttaattatatggtataaaaaccttttaggaaaacaactgattttgtgtttttaatatttcttttgtactttattgttcagtcttttccaaatgtaaacgtgacaaacacaatcacaatacaaataaaacgaatgatttttctcaaggtaaaaaaccttggatctagaaaagaaaacctccttaataattttgcctttgaagctaaatttgtattttctttcatttattcttatatgaacttgtgaatctttataaaatggtttctttaaaaggcaaattatatattttagtttactaatgttgtattttcaccctctagataaagtgctacatttacccttgccaaatctaaattttgctattttgaaataataagtcatttgtaattttatattctgtccactatactctgttatattgttacttatactctgttttcttctgttcttgtacaaagaagcataatatctcctggatatcatgaagcaagatataagagaagaacaaaacaaaatccgtaattcattgaaagaattgtaatcatcaatctttcatattattaatactttgtaattattttctccccaacagtattttccagtagattctaatcatgtggtagggcagaaggaaatgtgttttttgttgttcatttgtttcttgtcaatagtcctgattattttagctttgctatactgacttatatctggaagtatataaccaagataagaaaataggttttaatatgatcatcttaagctaattgtaatgaaaagaactaatggactgtcaatattcagaaaaccaaaaataaaaaatacggaaaactattcaaagagtaagtttgatctgcatttccaatatttaaaaatactttttattattttaaaaatgatgacatgtttcagtacataccgaattttactttattaaccttgagaccccttaacacgtttccgtaggtcagactgacagactctgactacagtgttgtcctataataatttccttcttaaaactgaaagactatatgagaagccttataaaatgatggcatggtggctcacacctgtaatttcaacactttggaaggccgaggcaggagaatcacttgaggccaggagtttgagaccatcctgggcaacataacatagccaagaccctgtctctaaaaatgtatacattttgaaaattaactgggcatggtggcacttgcctataatcctagctacctggaggctgaggcggaaggagtgcctgaggccaggagttcgaggctgcagtgagccatgatcatgccactgctctccagtcttgtgtgttaccttaagtctcagttttcccgtctgtgaaattcaaataatattgcctcataggattgacataagaaatgaagaacagttacctcttcctagaacagtgtcttgaatgtaataaacatcatataaatgttaggttatgtttatttaatttcttatctgtcaagtgctaatgaaaaagattattctttaacgtagtaaataataaagcaaatggcttattaaagcttttgagttttgcctttggaaagattctagtattagtattggctgttttttcaactctaaaatatttctgtaattaaagcctgtctgctttaaactactttacaattattttctagtaagaatactcagttacttgttgcctaaaaatacataaaattgctcttcttcccctactgaagaagaaacgttataagaactaacagttttacaacttgtatttctgtgcatgtgtttcatattgtaaggtacaagtttgatattcttctacacgtggagttttaaatatgaagcagatataaagatatagcaaatagatcaaattatttaaagcaacatgttttaactttcaaataaaacttaaacagaatcagtagcgttcaatcagttctaagttattaatactaagttactcagtcactccattaagattcaacaaaatggttttgttaatcagtggtaccaaaaattaaattttggttttaaccttagtccttgttagctctcctggaatttttctgaaatttcatgaaaagaataaaagaatgatttcagaaatatgtgtttataaacatttgtttatttactgataagtttgaaattataagcatttatcaaattgtataaaacacatgaaaataggtagctcatatatagtacccttactatggttgcagaaaaataaaaataaaaataattggtctcactttaaattcatgaccacaagtcacaaatggattcttaattctgtcatttgtaagctcattgactttcttattctcttattctctagatgactatttcacaacttctcctctcttttcaatcctgtattagttttctattgctgtataacaaattaccacaaacttagtggcttaagcaacacacatttattttcttataatttctgtaggtcaagagcccatgcatgacttaagccaggcaggctgagccctttgcttgtgacctcacagggctgcaatcagtgttggctgggctgcattctcacctgtaggtttgactaatatgcgtccctgttcatccaggttgttggcagcattcaatttttgtgagggtttttttttttttaacctgtttgactgagggccacaacttataactggctattggctacaggcaactctcagattctagaggccacccacagttgcctgccacacgtccctctccacaggaccttcaaaacttggctgtttgcttcttgcaaggccagtaggagaatctctccacattgtgtgccagcaaaaatggagtcttatatattgaaccaaatcacaggagtaacgttctcaccacctctaccctacaacataatttaatcatgctaatgacattgcatcacttttgccatattcttgtagtgagaagtaagtcatgtgtcccactcacactcaaggggagaagattgtacaggttgtaacaccagtgggtagagatcatggaagttttcaaagaattgtccctaccacaacccccacaatgtttcttgcttcttattctctcccggctaatgaccttacttcctttcctacttcactgagaagattgaagcaatcaaaagtaacttccacaaactcataccaacacatacttaatgaagcagcatttgtacccacatagtctgccttctcatcaattactataggtaaattttccctgctcttgtctaaaaccattcatttcagttgtccattaaacttcattcttcctttactcaagaacattcctgcagcaattctaccttctctctcctttttctgtcaagtttttgctctctacagaatcattcccatcagtgtgcaactgttttttctctcatcttagaaaaccaaacaaaactttcttaatgtcacttcccccaccagctaatgccctatttcttctactcctttgtagtaaaacttacaaagtattatctctactctctatttcccagtgtctgtattcccattcttaaatccacttcagtcaaatttttgcctccgccattccaccaaaactctttgccaaggacatcaatgatgagcactttgctaattccagtagtctgttcttagtctacatattactttatctaccaacagtatttgttaaaatttatcacttccacctccttggcatactttgtttacttggcttccaggatactacccacgtttgattttcctcctgcctggttccattttgcttcttctcagaatcctttgctagtttattctcttatttttatctacttaatggtgaagtgctccaggtctcaatacttgggaattcttctgagtcttctttctccattaccttggcttttatatgctgacatctgtgaaatttgtgtctccactgtgggacaaatgtactgttatcttagtccattttggtccattttgtgctgctgtaacagaatacctgtgatggtaatttataaagaacagaacattttttctcacagctctgaaggctgggaagtccaagatcaaggcactggcatctgatgagggctttcttgctgtgtcttgaaatcgcagaagacagaagtacaaaatggggatgaatgctgtgttcctacatggcagaagaggagaagagagaaaactcaactcctgaaagctcattttgtagtgttattaatcaagtcctcatgaattaaacacctcccaaaaggccccacctcccaaaactgttgcattgaggattaagtttccaacacatgaattttggaatggacaaaaacattttaaccatagcaaccatgaactaaagaagcttaatctttattattcctcacatgtgcagaattattacctaattttatgttcacaattttaaattttgttttcccaaagatgtcctctaaaattgtatatgcttcaggccccacataacttgtgttcacctttatctctggtccagttctcacagtaaaactccagactatgtccagttccccactcaggctttccacttacatacctaattgacatcttaaatacagtaagtccaaaaactacccctaacctgttccttttaaaataactcagttttttatttctttgctgccacctgaaatagtttaccgtttcgctgagtaaaagccaacatgtcaaaaatggccttagttaacttataagaaaaggcctttgccacataatctctttatttcctgccactggcctcctcactcatgttggcccaaccacattgacatttgttgccccttgcagacatcaggcataccctcacctcagtatttttctcttgcttttctctgcatgaaattctcttaccatagagatctgcttggctaacatcttcatcgctttctagtctattcaaaattcaccttctccataaggcttacctgacttccttatatggcaacctggcctcccccttccccccctgtactcctgattccctttatcgtgctgttttttaagcttttttccattgcctcatgaatactgtatacttggcttattatcatgtgtattgtgtattgtgtttcttactctctgagtaaagtaaattgcatgaggatagggtttttttctgttttattctctgatgtatgtgaagcactagcctggagcataataggtcctcagtaaatatttgttgaatgactagcgttagttgaaagaataggcttacaagtctatatgctctaaaattctttttttttacaatatttgaaatgaaattttgcatagaattctctctaacaatataaaccaactagaaaagaatacttatagttgaatgaagagattaagctaaaagaacatagccttcttggcttgatgtctattttatgccttacagtattcagagcacaatttgaaaaccagctgggcacttgtctcaaatacgaatattatcataattctccaacaaaatataaaaattagggccgggtgcagtggctcacgcctgtaatcccagcactttgggaggccgaggcgagtggatcacttgaagtcaggagttcaagaccagcctggccaacatggtgaaaccttctactaaaaatacaaaaattagctgggtgtggtggtgcacgcctttaatcccagctgctcaggaggctgagggaggagaattgcttgaacccgggaggcggaggttccagtgagctgagatcacgccattgcactccagcctgggcaacagagcaagactccatctcaaaaaaagaaaaattaatttgtatttctttcagcatatgtgtgagtagtgtattgtgtttgtgtgatatcaagataatgttcatcagaaatatataagaaggtcctagaaatatcgtgacatccattttttaatgaacttatttattttgttatgtctattagattttatgtgttttgcttatcactaggatgagagttatgaaattgctgatatttgattgtaatttcctgtggctcaacctagtatgtatcatatacatatcaaaattgcaaacattcttaggaataaattgaaccaaaaacactgaattcatattaagtaatatacaatttttatataaaggcctgaaacactcccttaatggatagacttactataattttcgtggggaagatttaatataggaatatcaatcctttttaaattaaaatataaatatattacaattttcatcatattcccatttttctggtttctgaggtaaaatgattttaatattcatatagaaacaaatccctgataattaccatcaatcagctaataaaagaaatatcaagaaactagtaatattgagatcagccagcattaaaatttactataaatgtgtcacaataaaagtggcgtacaaatagatgcaattggtaaatgaagtaaatagatatttctgaaatagatccaagtaaggtcatgtatcacggatatgttctgagaaaagtatcctaaacgatattgttgtgtgaacatcatagagtgtatttacatgaacctagatggtatagcccattacaatacacaacctgttgctcctaggctacaaacctatacagcatgttactgtactgaatgctgcaggcaactgtaacagtggtatttgtatatctaaagatatctaaacagaaaaggtaatgctttggctgctacatcactaggcagtaggaactttgcagctccattataatctcatgggaccaccatatatgtggcctgtcattgatgaaaatgtcacaatgcagcacatgactatatatgggaacttaatgtatgataaagaaaaagtgtgatctagggatttggagaactgtggtcttgagccataatacctggcttccaatcaaatctttgttacatccgaattttataatgtgtgaggccacatttttttattttgccatgcgtgttttctcattgtaaaatgtgactacctacctcgcagagttgtcatgacttttaaatgaacaaatacatgagaagtatttagaacactgcctggtccagagtaatgtataagtgtaattttaattcattattaaaaaggatgttttattttatgaatggtgctggtatattgactgtccacctgaaagaaaataaatttccacctcagacgatatgcagaaataaatcccaatgcattcaagattgaaactgtaagactatttgaaattatggtgtacgaaatcaaggatgacttaagcaaggaagaaatccaaaacataaaaagttaccagatttgagtatataaacatttattatttttggtatagcagaatatgccattaataagcaaaagaaaacagtacatttggaaaaaatatcttgaacacatgacagttaattcgtatcacggctatacaaagaactcctaggttcatatgaaaacccaatataaaaatgaaaagacaatttacagaggagggagtggaaatgtccaatacagatataaaaacatgtttaactcaccagtcatcagggaaattggaatcaacatcacacagttgcactactttatatcagatagacaaaactttatgtttgtgtataatacacatatcagaaattcaagacgtgtgtgtgtttataaatctaaagtgctggcaaagatacaagaaataaacatgctcatacaatgttgatacaagaaatgctacattacagcttttgagatctatcctgtaaaacttactgcaccaatacttagaaacaaataaaagaacgtatgtatgataaaagttggaaagcaatttcacccttaatcacaggagagtgattaaataaattctgatattgcagaatagtatctggtgaagctatttaaaatgctgagttagatctgcataaactagcctagaatattgtcatacaatatgaagaaaattaagttgctaagaaacatttggccctatctttaatagtcaaagaactttgttcatgtattattagagtgatgacaaggaatatgaaaatcactacatttcccttcttatatctctactttgtttttaaaatataacagaggatacaaaagataatggaaaacaaatccttatttcagttgtggtatatgcaatgttttaagggaaagaaggtaatttcccaagtggaaaattggttgtctttgacattacatatgctttaaagctacttggcgtcttgatttcctacttttttgatgctttattgaggtcaagaagactcactggggagaggcttcaggcctagaggaagcacttactgactggcaaagggagtggcaattgcttcatattttaaagttatgccgaattaaatgattgtgtaacatatgtaatatttttatttatccttttgagttaaaacatgaaaaatactcaactctagctttatatcaaaattacctatgtagattcttaattaatagacctattatgagattttgcatctatatttgaacagtcggataaaatatttcatgacgcctcttgaaatgtttgagaaacactatcacatgataagagcacattagtttataataaattgataattgtgtactatatgacactgtctcttttttttcaagtgttaattcattgagactttaccatgaaacaatatacatactttgtgatttgaaaaatactaaatttgtacaaaagttgaagggtaggtattagtttcagcattgagaatagttggtgtttactaattaatacaacttaaatctatgaagggttattatacaaaggatgattatccttttagatataattagtgaatgtgaaggcctgggacgttattgtatactgctgtagactataaacactatacgcttagggcacactgaatttacaaaaaaaaaatctttttgtcaataataaatttaccttagcttaatacttttgactattattaaatacagttagaggttctcttagagatttttatatgcagattacattaggagttttgtgggatgtttttgtttttgtttttttgagacggagtttcactcttgttgcccaggctggagtgcaatgatgcgatctcggctcacctgaacctcccactcccaggttcaagagattctcctgcctcagcctcctgagtagctgggatgacaggcatgagccaccatgcatgcctggcaaatttttttttttttttttttttagtaaagatgggctttctccatgttggtcaggctggtcttgaactctcgacctcaggtgatctgcccgcctcagcctcccaaagtgctcggattacaggcatgagccaccaagcccagcctacattaggagtttttaaggtcgtttagcaatattcttgccaaaaattatggatatgattaaataagtgcttcctgcccatactcattccattgcagacttctgagtttgctagtgtgctgtagtgtaggtagtctattatccacaccagtgacgggaatcggatctcccttagggcaagttaaatagtatgtggtgaagctatttaaaataccactgaaagcagcacaccagtaatgttttcaggttagtattttaacacaatatttggtaaatatcaggttatgtgacctcccaaaatcccttttaaatgtgtgattttatatgaagacgtttttaagtttatgaaacgcctaagactttaagattgaagaaagtggtacacatcaggggaaagagttaatgaaatagtcgctctgtaacattcctttttttacatcccatatatggctcaggcattggtaaaatgcatagaatcctgtgtctagtattggctcatactaggtagatttgcaagattctctggaccacttggtaggcaaaggtggtttctctgtttcatcaaagttttccctgcagccatagctgcagtaattcttgcacacaacatgttctcaagacagaacattatgcatgcctttatataaccaaaccacttaatgtctccttattccacaatgtgtagttatcttcttgctttgtgtgtgtgtgtatacagttcaatagaatttttcatttttcaagcaaagccatataaaattgaaaatatctaaaatagtaaaattggatagttatcaagtttattttaaacattttaatttttttaaagaatgcttagatacatgaatgtcttcacattattctctcagataaaagtaattttgcaaaactggggagtttgataccttctcgttttggaattaaaaaaagtgtttttccttgttttgacctcagaaatctataattgccctttttggttattagtttttctaattttttatcattgaatttttccggagacaataaattgatcatttttgtttattctgaacctaatgccatataattcattttattggtgtttggtttagctcatatttcttattcaattactctttaaaaatatttttgaaaaagaaaacgttcctttttattacctggcttcaaattgcttttagccaagtaacagaagtttaaaaattagtatattttatatatgatttatgaaatattataaatgaactatttcacccatatatatgaaaagaatatagttttgtgactaatagtacagtttgttaaatggcagatgtgtttcagtaatcttttaaatgttaatgtttatatggttatttatgtcaagtattaatgaaatactaatgtataacattttcattttcttaatgacagtcatttgggatagtaaataatcaacctcccattactagtaagatactgaaatatctttattttattttttaaaatggatgtagctggaggccaaattaatgcagaaacagaaagccaaatactgcttgttctccctaatgagagggaacttattttttaaaataagtattgcctttaggaaaactgttggtgaaattaaaataataagaaatatataattcacctaatcagtaaatataaaatacccataagcaactacaatttaataaatcatttcaaaaatatggcacatcagacttttaactaataatatttaattttaatggtaaaaatgacaataaaaaatgtataaaggtacaataaaaatccaaattgtgaaagttttccttataacttaattccctagttacataagtttaaatggagatggattttcaaacatagttgagacatttacttccaatgttacttagtttggttatgtcatagagtattaatccataaacaactcaaaattttaaaaagttctttattcctagattaactttattttcttacataaagtgttttttataaatgggcattcaggttaaatgcatgattttcatttaaaactatgattttgaattttcctacttaaaaattttaaaatattttctaaatgttcttttctgtcatttatcaactcactatttacagtcatgcatattttacagtcatttgcttaatgatgggaatatattcagaaaaatgcagcattaggtgtttctgtcattgtgcatacatcatggaatgtacttacacaaacctggaaggtatagcctaatacacacctaggcccttggtgtaacctattgcttctaagttacaaatctgtacagcatgttaccttactaaatactgtaggcagttgtaacacaatgttaactatttgtatatctaaatgtatcaaaacaaaaagcacattaaaagtattaaaaatacagaataaaagataaaaaatgatactcctgtatatatgatacgtgtataacatgtaatataatataatatactcctgtatagggaactaaccatgaatagaatttgctgaattctgttcattcacccagagctggaaattgctctgggtgagtcagtgattcagtagtgagtgaatgtgaaggtctgggacattactgtacactgctgtagactttatcaacactgtacacttagggcacactaattgtataaaaataaactttctttaataattagccttaggttagtataactttttgcttcgtatattttttaatgtttttactttttggctcttttgacttctaaacacttagcttaaaacactaacatgttgtccaaaaatatgttctttttccttattctgtacactgttttcttaattttgtttcctttcagcatttattttagatttgggggtatgtgtacaggttttttgcatgggtaatttgcatgtcgttgaggtttggtgtatgaatgatcccaaatagtgagcatagtgcccgataggtagtttttcaacccattccccctcccaacctctcccttctgggagtcccagtgtctattgttgccatctttatgtccatgtttactcagtgtttagttccctctcataagggagaacaagcagtatttggctttctgtttctgcattaatttggcctccagctacatccatgttgctgcaatggacataattttcttcctttttacaactgtatagtattccatagtgtatatataccacattttacttatccagtccaccattgatgggcatataggttgatcccatgtctttgctattttgaatagtgttgtgatgaacatactagtacatgtgtcttttatgtaaagtgatttattttcctttgtatatatatacccagtggtgagattgctgggtcaaatagtagctctgttttaagttctttgagaaatctccacactgctttccacagtggctgaactaatttacattcccaccagtaatatataaatgttcccttttctctgtaacctctccaatatctgtaattttctggctttttaataaccattctgagtggtgtcagatgatatctcattgtggatttgatttgcatttctctaacgattagtgatgttgaacattttttcatatgtatgttggccacatgtatgtcttcttttgaggcatgtctgttcatgtcctttgcccatttttaatggggttgtttgttgctttttttctatttagtttcttttcattttgttttaattttaaaactttttaattaaaagctaagacacaaaaactaagacatacattagcctactcctatacagggatggtatcatcagtgccactgtcttccctgtccacatcttgtcctactgaaagatctttgggggcactaatacacatggagctatcctctcctgtgatgacaatgtgttcttctggattacttcctgaaggacctgcctgaggctgtgttatctttaacttttcttttttaataagtaaatggagtacagtctagaataatgataagaagtatagtgtagtaaatatataagccagtaacagtcatttatcatcattatcaggttttatgtactgtacacaattgtatgtgcaatactctgtgtacaactagcagagcagtaggtttgtttacaccagcatcaccacaaacatatgagaaatgccttgtgataggacattaacaacggttacaatgtcgctaggtgacagaaatttttcagctccattataatcctgtaagatcaccattgaatacatggtctgtggttgaaccaaactttgttatttggtgcatgactgtatatacatttaaatattttgttatttttattataccactggactgtaaaacctatgaaaacagagatcttatcctttttatttacccctacatccccaacatttggaattatacctggcacgtagtagccactcaataaataattgtgcaataaattccagaaatgtgccaaaattattttttaattgttctgcttttggaggattcatttattctgcagcctaattttggacaattgttccatttccttttgttacactgcttttaaaaaataagacaaagtgtatatggtaagagaaaaaagctcatctgaaatgcaatctctattcctccctttctgttttacctgaatataattatatacttttacattatttaacccaaactacatatatatatatgtgtgtgtgtgtgtatatatttgtgtgtgtgtgtatatatatacattcaactttgcattgctattttctacatcattttataatttcatatagtgtagtgcctgcatactgtcctttgtatatgacatttagtgttttgacttataaacacttaccttaaaacactaatacattatgcagtgtactagtgttcattgtacagtgtactaatacattgtacaatgtcctctgttttggaaatttccccagaagaattgcataaggacagaaacaaagtgaaagatgatacccatttcaaaatttgatgaatactacaatatgatttgcaaaagacaatatatacggacacgaatgttttaaaaaagaaaaagataatagtttaccccctccctgatttatatttggtttattttttacttgatgatcagttttgctgctctaccttgaatatctttcaccattttagaaattaaatattttcatacttaattctttaattttcattatttaacaatttgcttcacttttacttccccctaaataatttcatctcttcctgtgactttaaatacaatttgtatgttaactcccacgtttcccctggcctccagacccataatcagccacttatttggcatcttcacttggatgactgataggcattttaagcttaaaatggataaaatagaaattcttccatcttcatctttcaccccttttccaccatctacttcaatgaacacagccctatttttatcttcgtaggtattttttactttttaattttaatgtttaatttacaacattaaattgaaaacattagttttcatttcaaatattcaaatatgttgaatacattttttgctaatcaaaattaagaactctgaacatatgtcttactatatgtgccctgaaagagctgggctaaaaagaggtgatttaaaataataatgatttcaaagagctttttgttaacttgacacatggatgatgaaggcttataagcctttcatcagtataacctcaatttagtaaaatctggtttagtaagcattaagaagacaataccccaaattattttcatttttaaataatgggctttcctgcaatagtttattattatatgaccttcatagttttttcatagttatttaacttctagtagttttcttttttgaagtaattatgtctagagtgctcatcatctcaacaggaatagtttgaagtgcttctcttctgttcctccttcacctagaaagcatagattttttttttctatttttcttattcctaagttatatccctccctgggatatagtgttgtatatctttaaattttgaataatgtttcaggagcaaagtgaaataatgtgttaaatggaaaaataagtaagttaaattttgtctttagaaaattgtctgggtaattcagtggggagttgaaggaagggttcattgaagaattttgaacagaattttctcataatgctaaaataaagactccttatcctcagtctcactaagttgcctgattttatagatgatgaaactaaagtcatttgagaaaggtcatatagcagagccagggtaagaccacgtatctattaatggccaattctatatttgtattatactacactatgctttagataggataaagtagtaagactggagaacagcacataatagaacatatagatgtagggagcaggagaagtcacagatagctcctaggtttaaaatctgagtgagcaatgggtgaaaggtaaaaatacatgagacaaggtggcatggtattttatgagagatattagacaatgctatgaaaactgttctgccttggatttggttatcaaaagtagattaaacaaactagtggaagttggaagaactgctttttaaattcttttggatacttctattcatgtaaatctgttgtacatattttatcaaatcagtcattcacacaggcagatttttatttatttgaagtctgtaatcgaaaggataccatttttcaatttgctttgttcaacaattcaatgtagattccccaaaatggcacatgtatctccactggatgctactaagtggagcctcagtatcctaaattgtaatacattgggaaaataaaaggcatttttctggttagattatatagtgtatatcatggtaaaaagtaaattaatctacatgtctttccttaccagaactatgatatcttgactattaagtttaagagataaaatgaaatgtcagtattttgataggcaaataatgcatgatataaaaagaatgtaaaaatattttcaaaggtactttttggtcagttacaaattatagaagccctcaaaattatagaaattatcataattcaattcaaatttctttaagcagaaaagggagttgtatttcctctgtgatggctttagacagggttagattcagatgccaaaaaatgcagtctcatttttatctgagttaacttcattttcagtcaggttcttcctcttctcataatagtggtaagatagccactagcaatgccaggctggtgttctactagatttgaaacacaaatatctctttatcgacaagtttcccaacttctcatgctcttgtttggccatcctgcgtcatgtgctcaaacccaaaccagtaaaggttatgggtgtgagtatagcaataggtcagacctgggtcatgtttttacttctaaagcaagcttgtgcaacctgtgccccaggatggctttgaatgtggcccaacacaaattcgtaaactttcttaaaacttttctgttttttttttctttgcattttttaaagttcttcagctatcattagtgtattttatgtgtagcttgagacaattcttccagtgtggcccagggaagccaaaaaattggacacccctgttctagagatattgaaagattgtcagccttatctgaggcacatacactaagaatgagaaagggtgttttccagaggaaaacaggggctctgttgccagaagaagaatgattggataccaactgaatgactgagtaaaataacaggtatccactgttgataggaattgctttgtaagtgtaatgtcatatgtgtgtagtaaatatggcagccctaaataaaataattcatactattaattgggagctctcaaattataatggaagttgttttgcatttacttcaatatgtggttttattaaatagtttatgatttttctgccatgataatgaagaaatatgatgcctataggtagtctcattcctttatagccataaaaccatcatgagttggagttcttatttgttgaaagagtaaatatatcttaatgtctgtttttaattagaaacatatcaatattaaaatcagtttatgtggtatttttaaaactcataggattgttatagaagttcttttgtgattgcaaatagagaaattgtaaatttattacttttttctgataacagttgatgctagcataattagtataattatattgttaatcttatctttttttggataaataacttgtgagtctagaataaggaaggtttaagtaaagattcttttaatttaaaagtagtagtattaagctgggtacagtggctcacacctataatcccagctactcaggaggctgaaccaggtggatcgcttcagcccaggagttcgaggctgcagtgagctatgattgtgtcactgtactccagcctgggtggcaaagggagacccccctctctaaaaataaataaataaataaatacatacatacatacatacatacatacatacatacatacatacataattgaagcagttcatcactgctaaaatgggtttagatttgaaacaggaactgtccaacaccgaaacaatagtgaccaaatttatggaaatacttggttgtgaaaaaagagtgtaaagaccattagggaaatatcttcatctctagaggattttcttacctattctttctttttccagttaaactttgtgtctcctttatagccttatatacttctgtgcagcacccttaagactcctgcactgatacacactcattttctacaactatctataacctctttaaaggcaggaacaatgtcatatatatcctttatctccagctttcaacacagggcttgggccattcagtaagcgtttataaatgattaggtagatgctagcaaatataatcataactctgaagggcaatctgatttgtaactgtcaagaacatatctgacttagttttatacatgttataccaaataattggtatgccgttgaagatcagttcttttctcccgattctttagaaataagaatatgtgtatttttctcagccagagcattagcagacttcaccagtgaaaatgaatccatgtatacagttagaatttgctatttgtcgtttcagttggaatttaaatactatcagtatacagacatttgctttggtaaatgcctttatctaagaagtaagagaaaataatctatcttacataattctctttgcttctcctctgttttttcccaccagtattcagttgtccaccatctcaaagcttccatgtttttctctctcacttttccttaactctggcccgacacttaaaatgtaaatataaaactactgtccttgtaatgttatttaactgaatttcagttttttgtctcaacttcttttcagagagtctgtttcttctctctgcccatattagattaatactgtgtgcaaataggtatggatatattttttaattattcagagaaaaaagacagtgtaaggcaaagaggattctcatgttcttttgtcaaaaataaaaattgggtgataaatgccttgtgtaagctattaagtatttacttttattaaattttgaaactttttatatttatgtttccattaattttctaaatttggtagtcttacacagaatagcctattgtctaaagttagaaaatgctatatattataattactaagatgcaaacattaagtctggtcttaagtcataacacatctttagttttttaatcttgccaacaaaacttggggccacatcaatatttgattaaacattgattgtggttgacagatttgttatttaagattctttgaaatggttaaacactaaaattcagaagatgagtattaactacataaaagcacctttaatataaagatagacattgtcatataattcttcaattttcaaaaatatggatatttttggaagatgtttactgtcattaaaagttaacactattttaaattatatattatttcaaagtttttgagtattggccgggcgtggttgtaatcccagcattttgggtggccgaggcaggcggatcacctgaggtcaggagtttgagaccagcctggacaacatatggtgaaaccccatctctactaaaagaatacaaaaattatctgggcatggtggcgcatgccttgtagtcccagctacttgcgaaactgaggcaggagaatcgcttgaacccgggaggcggaggttgcagtgagtcgagattgcaccactgcgctccagcctgggcaacagagcaagactccgtctctcaaaaataaataaataaataaataaaaataaaatgttgagtattgaaaagaaggaaaaatatattgtttttttattgttaaaaaagacaggctaatgttcaataatgtaagtgcaatgcccacatgtgcaagttgttttagataatagttttagagttaaaaagaaaaaaactgtgaaaaaacatatataatgtgagactgatgtgccatatagtagaaattaatatcttcacacatttcatagagtgaatgttataaaataataaaatttcattaccttttattaacagcctataattatccttttctgtacttttcttgtggttatcatgcaggaaaccattacactgaacaaaacaaaaatgattacttataatttaaaataacataggactagctcttttaaaagtcttggccgattaatacatttttcttcattaaaaatatgttaaagcactgcagtttgccagtccgtgatgttttcaatagtgttacaaaaaggttatcattttgaaaagaattgcttatccataaaaatacaatcatatttaacattcagatacttaaatccttaaaagtgcattttctcagtatttcatgtgtatgggataaaaataaagatgattgtaattcatctttataattggtatagtatataatcatagtttaactttctaattgtaacacattaacttttcagacaaataattttgtacaaaaagatgtctgtgagcaaaactaacaaatgttataaaaacacttcttggtctgtttcttgaaactgaatccacttaatcagggaatatgaagtttatgtttaacattcccaagaaaacttagactatttctcaaactttctaagttcttgaaaacttagactattttccataaaatgaaatgattgtattaataaattgtaatgaaacaaaattaaatttcttttattactgtaaattgtgtgcatggaaataaaatgaggtttgtgtgtgtgtgtgtgtgtgtgtgtattatatgtgtaaatatatttgtgaggtgacttggtttagaatttgcatttatactttctctgcttgctaccttccagaacaaaattgcctgaaatgcatggctgtatttctttaaaatattcttatccacatttgtgtttgaaagatagcattagagatgcttgctaaaaattagctaatgaaatccctcatagaatacctcaaacaactaaatgtcctgctcaaattttagcactttttttagcctgcccattttaatgtctggaacaaggaaagcaattacttcagtgctttgtcagtaacacaacaatcacaagttttgacctacccagtgagacataaaacattgtcatatgtgtcattatgctttcataatataattttaaatgttactatttacattttaattttagggatgatagaaaatgtcatattgatttgatatttcttataataatttttattgtgattaagtcaaaatatgctgatttttgtggctggatgtttcaatacaaataaagatgtctatgtgtggtcatattggattgaatattcatgtcactgcagtaatttttcagtatcctctgaaaatatggtagtaccatttggtaagatggtagtaagccctaattttaaaaatgtagcaatgatagccaaaaaagcgaataattagactaattattttacaaatatagatagtgcagctaggtaatataattcttaaatagggttaatctaccccaagccattgaaaaattaaaaattattaattatttagaaataactattatgaagttatatttcatatgtcagtttaaatgaaaatgctaataattttactgacctttatctctgaagacagtcatgaaacaagtaagctatctttaataacaaaaaaattactgggtgataaggaacatgaaattaatgttttgaagggactcaggcttgaactttcctactgttatctttattaactttgctttttaattctgcattctttgttttttaaatgttttagaacaaagcattttcttaaagttacaataggtgaagaatcatcaacagcatgtgatttttggagctatataaaaatgttacctttggtgtatagttatggtcccctcttgttaagatactgatttcttataaattctgttgcaaaattcacagtgactcaaggaaaaattttatttaataattttgacctgaaaattgagtttttcctttgaaaattctaattttacaagatagttatattaaagtgtgataaaagtcactttaaagttgtgatatttctgtttcataaattatgtttaattttcagtttattattttacttttctaggatagcaaagtaatataatgtatatgcacaaaacagaagtattatttatacgtattttttttaattacaggtaaagattatagttcccaacagcacagcaggtctgataatagggaagggaggtgctactgtgaaggctgtaatggagcagtcaggggcttgggtgcagctttcccagaaacctgatgggatcaacttgcaagagagggttgtcactgtgagtggagaacctgaacaaaaccgaaaagctgttgaacttatcatccagaagatacaagaggatccacaaagtggcagctgtctcaatatcagttatgccaatgtgacaggtccagtggcaaattccaatccaaccggatctccttatgcaaacactgctgaagtgttaccaactgctgcagcagctgcagggctattaggacatgctaaccttgctggcgttgcagcctttccagcagttttatctggcttcacaggcaatgacctggtggccatcacctctgcacttaatacattagccagctatggatataatctcaacactttaggtttaggtctcagtcaagcagcagcaacaggggctttggctgcagcagctgccagtgccaacccagcagcagcagcagccaatttattggccacctatgccagtgaagcctcagccagtggcagcacagctggtggtacggcggggacatttgcattaggtagcctggctgctgctactgctgcaaccaatggatattttggagctgcttctcccctagctgccagtgccattctaggaacagaaaagtccacagatggatccaaggatgtagttgaaatagcagtgccagaaaacttagttggtgcaatacttggcaaaggagggaaaacattagtggaataccaggagttgactggtgcaaggatacagatctccaaaaaaggagaattcgtacctggcacaaggaatcggaaggtaaccattactggaacaccagctgcaacacaggctgctcaatatttaattacacaaaggatcacatatgagcaaggagttcgggctgccaatcctcagaaagtgggttgagtgccccagttacacatcagattgttttaacccctcctttaccccattttcaagaaggatgtactgtactttgcagaagtgaagtttttctgttattaatatataattatgcaaatgaatgcgactatgttgacaatgtgtatatgtaaataatatgtgttttaccagatgtttcatagaaagaattttttcttgatctgttttgttctctatactttgcttgtgtatatttgtcagaggtgtttctagtgtaagatttaagcctgccattttaccagcattattgtagtttaatgattgaatgtagacagggatatgcgtatagttttcagtattagttctagataacactaaattaactactgttaggttgagtatggtggggtcagtgacctaaaatggagtgaggccaaagcactgtcctgtaagtcttacttcctgcttagggcacagtgaagtaggaaacaatattttgaaaataagttttaaatttaaaatgatcaaaaagcaatatagttgcataaaagcactgtaaaatatttaaaaggttaaaactgtggaaaattatattggtaagtttacagatcaataaaagcacctgttctccatctgaactagacaatggaaataatgctgcatgctggccatggcccattcttcatcatttgtaagttcaacaaaagttctcacatggagtcccacctcttcagaggtttgtacatttgtttttaagcactgaattcactactgatcccatcgcctggccagtagaacagtcattactccattaacatcctcactgtttagacacataactgtggtacagtgtattggaaattttataaacaaaagtgaaagtgccaacaaattattgatagctgataatgtttcattatctgcaactgcttgataagtatgttgcattttaagagcttataattgtgtataatttgttaacactagaaacctattagtattgtgaatgtagattttactgtgaagctatctgtgatttagctgtttgctcccatgatggagtctttgcagcatggcgctagcagccaatgcagtttctaatactcggtaatttgcatgttttgtggagcatttttatgtcaccaaccagacagtatttcctgcatgcttatttagaagaggcagcttatcttgagaggtagtgttatctacctttgtcaggctttttgacaggtcatttcagagtaagcctttgttcccaagacccaacaactgtcaccctcttctgtacctctcctgagtgccaactgtccaggccatttgacacaccatctgttaacctctgagtttgcccactcaaggccactcataggggcatccatccccaagcacctcctcatgctgtgcatgcagtcttaaattcaatggacaaaaataaaatgctggctacctctggatcatctggctgagcaactgaattacaaaagagaattacttccatctcaacttcaacccattgattacgtccatcctagcaagctaaatggcatcccagctgctcctttctgtgcaaccaattaaagaacaatgagtgtgatgctccatgtctgaatttcgtccagcctctctctgaactgtgatctttgtcctcatgaactttcccttttgttcattgaactatatggactcttcatttcatattgatttactgtgcaatttacttttggacattgagaacttgaaattatttcctgatcccttccccttccactattaataattcatttctgtcaaactgtaagagtagactcatttttttttttttagtttttaacattggactgttatttcatttagagttctctatctctaaatatttatttagagaatgattttaaaagggaatgatatgcttgtttaaatgaaagagaaaagctgtagtaaactgtgttaattggtaatgactatttatcgtcgatactctgtagctgtgtaagttttgacaaatagtgtatctcgtggaatcagtggttagcattgccgctattatatttactcattttatcattataaatgtgcttagttcatcatgtagcatcacttgtctcccgtctcattttttccttgcatgtcacaagtctcagatcatttataatacattaacagtaaataatatctatgtaaatttctttcaccatgctgtctcagagtcagcagtgaacaaaggcaaagattggggccccacttagtttgaaaaagggaaaggaagtgatctaggatgtgtactagaagcatttcaaatgttgggtctttaaaatgttttgttcagtcttagcaaatcttcgatcttttatttcaaaattccagtagtccactgtggagcccatgcatttcatctggaatttaatgttactttgaagccaaaccatttaaacaattatgtgtgttttattagctagtgttgctgaaaatgcacttagttcaattttaattgtaaatgggaattttaaacttttcctagttagcatggttatatgttagttaaaactgaaagctaaattgaagatattacattttaatttatggtgacagataagggtttgtatgcattatgtgtaaatcagcttcatgctgtttaaaaatttattctctgaaatttatagaccatgtagaattgatttgtgatgtgatgctttaatttattgcaagaaaattagtatggcttcaaactgccacaggtaggcatgtaacaatggctgttcagctgtactgatccaaaatggagaaaactgatgatacaagggccaaacatcttatgaaatgcaactatttatagacttgttttgctatagggaggctggtgaacacgctgaatacgaattacctcagttctgcagctttctatgtctttttaatgcattctgtttcagggtcactttcaatcaatatttcatttacttactgagattgaatgggcgctctgagacacagtgtgctgtttatcatacagattggacacctcattctagatccaagatcttttcctcaacactgggagctgtcctttcagcaccacaaaattactgcttgaagttgcattgcagtttttttgttttttttttgtttgtttgtttgtttgtttttttgtttttttctttatcactgggagcttttctttcagcaccacaacattgcacctagactttttaaacggctgccttcctctttgcactgaagaccaatttcgtctgcacttccagttattgctattacctgtaggactttcaatcctacttcacttcacccaccccactcctgaaacagttaaatgtatctatttctgtggaagtcattttctcattgaatgattagaaacaaagataaattctaacctgtaacggctcatttcgactcattgcttacaatagatctaagctcttttttctgcttattcgactccttccagcttcccatcacatctgtaacaaacttttaaaatgatattgccacaccaccatgcacaagcctacctgcacagtagagatagattattccatcgcattcagatggttaacagaggttagcaagtcctgtattatatatttatatcgctttctaagaaagtgcatattaatgtttactttaagaatgtgtaaatggtgctatcaagaatctgataaattttatccccgttttttgtgtaccacttctaatgtatgagatttatttttttattggaaaaaaataaacagtatgaaagcattaaattggtagattttagtaatttaacaatgaatggaatccctacgttacaggccctatgtttccttggaaattttaatggtggtaatagatttcaacaaaggtactgataatcatattccttttaatccattcttatatttcagtcttgatttatatgctgattcctcactgagtccttaagtaaagtttatttacttaataattttatttactgtaagtcttctccaagaagggaattcttgctttcgaaggcagcaattgagagatgaaaatataatttaataccccttacatcacaggcactatttgagactagttactctgttagtaggaga

SEQ ID NO: 16192 - DNA, 165841 bp, Human
aattaataaaaatttaaaatttcaggcttatatatattaaaaaggaaaaatatgtttatcctggcccatatattaccatggtccaggtaaaaattttgtccagcctctgccaaatgctaggattcttgcaaatcagggagtatatgtgttctcaaaatccattaaaaaataaatagactcctatatttttctctgacataatagtatggtgcaagcaatcagtaggattttaatgttgctgttttaaatatgttcgactatatttatacgttgaacactacaacatgtgttttccttttaaaattgtttttcatgctttttttttgttttgttttttttgagatggagtttcgctcttgttgcccaggctggagtgcagtggtgtgaagatctcggctcactgcaacctccacctcccaggttcaagtgattctcctgcctcagcctcctgagtagctgggatacaggcatgcgccactaagccaggctagttttatatttttagtagagatgggggtttcaccatgttggtcaggctggtctcgaactcctgacctcaggtgatctacgagcttcagcctcccaaagggctgggattacaggtgtgagccactgtgcccagcccatgctctatcttaatttatgttttcattcaattctatgtcatgagatttcagttatgctattatatattcttttaaaacaatgatttaatgtcttttcaagatgaaacccctattgtgtcattattgatgagtgctctaatgccctaggccatatcattcttaaggtgatccagtaagcagtggttgaggcaggaagtcaccaaatgactcaaatctaagaatgcaacactcctgtataaggccctgcctaccgcaggaaggcccattcccaccgtgctgtgtttaccatggtttcagtgaaaatgattaacactttttcacgtttaatagcatacaggtccacacaactatgtcattgcactggcttgttcacatatctgtgtactctttttctgtgaacttcttaagagcaagcaaactgtgcctttcttttttgagtcttcatagctacatgcttagtcacagtggtggattttaccacggagatgatgaaacttaagtagcagggcccttcacctgcatgaggctattccagggtcctgggtgaaactttagcagtgtaatcacatggtcgtacatgattgcaaaatttttaaaagcaagatattttaattagactgctacatggttttgtattttcgtttatattagtaattttattttcttcttgtcctgaaagaaggctctccaaatggacaattttggccccacaaaaccttgattgtcccctgttgacatgcaaggaacacttatttgcttttttcttgaataagtgaaagaagtaaaagggatgaggaggaatgaatattttattaattaatatattgtaacatttaaaattagcatgtctggcaaaaattttccttaagccactaacagaaaatgctaacatcatcacccttgtgtaatgtctgtgagtttacaagctcttatacaaatgtaacttcaattgaatctttgaaccaggccttccgttaaatgtaaccttcaattaaagtgaatgatatcaaaatgtttacaactgtgctatttgtagaaaagacttattatactcaatggttacagaggaaaagaaacctaaacacatgattgagtgacactcatgattgcattgtgtcaatactaggatgtcagctgaagccttctgatactgactccagtctttgcattacacggtgtttacaaatatatttaaataaatgaaaacttattctacaaacgaaaagcataaagtcacataggttaataatgttttcctcaaatgatgaacatttccaatttccttccctttctttcttctcctctcctcctctccccttccttcccctctccttccttctaattctttccttcttcttcttttctttcttgatgcaggtgtttaaaattatccaactgccatagagctaaattcttttttggaaaattgaaccgaacttctactgaatacaagatgaaaatgtggttgctggtcagtcatcttgtgataatatctattactacctgtttagcaggtaagaaatatcctttgtatattctacatatattatgtcaacataattgatatgcgtgtttattaaatgtattgtatgaagtaaaaattcttattttctcgacatctgggtcagataagtagataaatatgtatcaagggtgaccctatttcctttttaatttcaattaagatttcacaaaacattgtcaatcttgggtaatagtgtgctggtgaatgtttaaaatctagatctctggggagatccctggagtgtagcatttgtctattactggggagtaaattatcctaccatggccagtttcaacctgacatcatttaatgtggaactggaaagatgtgcaaccgctcaccagtctgtagtattttcaccaccctgatataagtaaccacaatggcaaagagaatataaaatatagtaaataaaagagagaaaacaatgggttttaagcatttattccctttgttcttagtataatttattcatttgtaaattaatacaatttttaatactggccatgtttaacaactgattcacaaaatttctgaaaattaataatcacttcttaagagctataagcagatgcaacacactactgaatcttacacaactcttttgccaatttgatcaatataatttaaaaaatggattaaagtaatctacagtgtgtgtagggacataagactaataaaacaattttgagagtacattcattttaggacaaagaaatattatatttctgtctttcaaaggcaagtgtgaagcattcagacctatttcctacaatgagaagcacatcatatctttatctgaaaaactgatataattacccaactagtacttattgagctaggtcatttagtacttattgagctaggtcattattatgaaagtattagaaaaattgaattctaacaaccaatttttctaatactttcatgataatgacctaacccagtagatacttgttgagtgactgttttgttcaagacataaatggtcctcatccttttgtatataaatccccattgatcactttaatgattaatctgacgggcatcattattaagaacataaaaaaatattattttattttggggaataatttttattatgctcactccaaaactcagaaaagatcatttcattagtacttaaggattttaatgacattgataaatatatattttataaccagggtaattatgcacacacacccacatacatagatgtaattacatgcataatatatttacatatatataatgtaaatataataaagaaaaaatttggtaaagtcattgtgaagtcttatttttgtgaataaaataaaataaaaattatcttattattactgaaaattcatacgaattctattgactgcaaacttcggtgctgcaactatcaatgtaaagataagaaataagtatctgcacagatgtgaagatacttcaacctttatagtaaagggccactactctcattccattgtctagcatctcagctatttaagtaatgtttgaaaccacaattcaaataattgcttcaggatcaaaattgttttttctttcatttttagagtttacatggtatagaagatatggtcatggaggtaagttgaccaaagagtagaccttgtaaacatcttttctctattgaatcatattttatctctgctttaaactattaactctctaaactttaaggcaaatggttaatgttagatcactatgaaattttgtaaggtggtctttctgagattataagcaaactgtttgttgaatgagtggatacatcataaacaaatatcctattagaggattgtagcaaatggaaaatattcaatttggctggctttttttcctgcatgctttgtaacaatgctatgcgactaaatttggaagcaatattttaaaatttgtaagccttgaacttatttttgaaagcctcttgctttgttgcaagggagataactaaagttagtgaaattggaatcttaagattcagttcaattaaaagtccacaggtattgcaaaatttattgtttaataatccttccagtttagagcctacttcaactaccaaacagatattgcagaaataaagtcagcatggtatactggaaaaaatacagagtctagagtaagaccagcctgaatttgcattttcagctcagtacttactagatgattttattatcttgcataaattatataacttctatgagtctcaactttccaatatgtaaaaatcacagaattgttgtgaggactaaaaaatgaattgcaatgataacttctagcataatgactggcaagtaggtgcttaatgagtgtagcaacactagtaacttacaaaagccattgcatgatggtaggagaatgaaaaatcatgaagaatcactgaacaaccagtgctagaacttgcatgccaaatcaaggttacccattgtattagtctgttttcacgctgttgataaagacatatcccagactgggaagaaaaagaagtttaattggacatacagttccacttggctggggaggcctcagaattacggcaggaggcgaaaggcactttttaatttatttatttatttatttttgagatggagtctcgctctgtcacccaggctggagtgcagcggcgcgatctcggctcactgcaagctccacctctgggattcacgccattctcctgcctcagcctcccgagtagctgggactacaggcacccgcaaccacgcccggctaattttttgtatttttagtagagacggggtttcaccatattagccaggatggtctcaatctcctgacctcgtgatccgcccgccttagcctcccaaagagctaggattacaggcgtgagccaccgtgcccggccgcaaaaggcacttcttacatggccgcagcaaaagaaaaatggggaagaagcaacagcggaaacccctgataaacccatcaggtcttgtgagacttattcactaagtattttttaaaaatagcctatggctgctttttccaattccttgacccatattctccttttaatctgctgcaatcagtgtttcccacgagcactcaacaaaaactgcctcattcatgtctctaatgtcacacattgtaagtccagtggtcaactctcaggcttcctacttaaccggctggcagcagtgctgcagttccaggtatcacacagagacataacaatgtcttgtaggcaaatagagcatgcttgttttttttcttgtatctatctacctttaaaaacaaggagacctttcccagaaaccttacactacatgtccagagttgggtcacacattcaccaacaagcccatcgctagcaagagtaatggcatcactccctgtcaacctttacgtctgagtcatgtgagggataggttgatccttgaactaagctgagctttgtcatgaaagtaaagggcagaagaggagctgattagtcaaccaacaatgtctgcgaattactcaggtgaattgaaattgagaattttctcacaaatgaaaaagttatatccaatatgtcatccagcatatataatagtttttaatgattattttacagcaacattagtagctagtgttcaaatatatgtattaaaacaaaaacattttaaatttgaaaaacaaagtacataaaagattataacaaaatcatcaaaaccaacttcactcaatgtctttaagaatatttttcttcttaatttttttttagattttgtgaaagcaatattgtattctattgagataagagagcaaatatgaataagttgcacataatctgtaatgtttagatatttaattaataactaaatcatttgacagcaaatattttagatgcttttttccacttgtagtctgcatttactttactttcagaaagaaaaaaaaaaacctgcagctattgtaggaccaacttacacccaggctaatctaaaatgaaaataagtatctttcattcctttgtaattcattgagaaaaagtatcttaaaaatgaaataaaatagcagtataatatatattttgtaagaattgggatatgaaataatatataatttatactttgtacatttagagttatgatatgactgtataatatccaaagctaatatttaaaaaaaaaaactatcttcattgcttagctgtagggaggacaggtagaacatttcatatatctttacagtacttgcaccaagatttcctgtatattttttcaactagactcacatcagtcagtaagaattattttcagtacatatttctatctctaaatatgattgacattttatagcagtcagtgacctgtctctattttgatctatggtcccacatagccccattaatcaaaatagactagagttagactgaaacaggccaagttctggaagtaggcccaccagcccagtcatgctatatattaggatgtagtaagacgtgaggtaggtgtcagaagatgcccagccaggtatgtaaaacagaatctagatgcttcagaggtgggtcacaggacaaggaagtagttcctctagagagatgtgacaggctccccttgggcaggtaaagccaagcaaggagaatttagttcacttaactttcatactaacctgactatattctttattctaataactgtatttctgcaagtttttgaggccaactccttactttgtatgtttagttataaaaaagtactgcaatgttacctattacccatgaccctaaaaaactggggcaccagagtgtttaaaggctaagcccatcttctgttatcagcaggaaatggttggcagtggagataggaagctgtaatatgtggaagaaggatgctttgtgacaatttaaatattatctcatttagagagtttcaagagagcttacaccactccccacccaataatcactgtaacactgtaaatgtaaaaatttccattttagtcttttgaaattttgatgccattacctttttctaacagatttttcctaggactcttcttacaacatgcttatgtaaaattgtgtttactaactaacagattgaggtgacatataatagactgggaagtggagtttgtctcaaaaagtatataaaatgaatacaaatatctctgaagtacaaatcataattttactttcaattcctggaagtaaaatagaatagcaatattatagtggatactctccacatagtggtaggtgaagtaatcccatttgagattatataagtgactaattatattaatggcgaaagtgagaatgaaagaacagtagcttttgcctctcatttacattagtaaatatgactgcaaatattcttacattatttatttctatcttagtctttttgatcacatttaagaaatgtacttatgtctgtaatagatttatgataatcacattatctggtaggaaataaatgtatttgcattaaaagcagatcaaaatagtgatatgaaatgttaaagcttcaattagcttgagaggtcatctataactttgtgctccttttaagaagaatctatctagtaaaaaaaaggaatgtattaaaaaataattttagtttttaaaaacacaatctctatctgtggtttgtttcttatgccttttaacctcataatacttccaaagcatcaaaatttgtcatctaagtgtttccatggctgtagaaaaaaatcaatagatgacagtattttctgtaggctgagaacataatgcttacattactggatcctttgctgagctttgtattgaaatatccctcaaaattcttctccctgcatctgagcaccctagttgagctagcgtggtcggaaactaaggtacagcctgcgagggagacatgaggatcatattcaagaggttcatgctgaacctggcaatgcaatacagatgcttgttttgagtaatgtttctttcaagggcccaaatatgttcctaaaataaaatatatacagtaatttctaaaccgtcaaacaaaatacattatgtgactcaggcttgaaaagtttagaaagcaagaagaatatagttatgaaataaaatccttaatagaaaaatgaatgtgacgtgaagtgtgtcctattctgctttttgttctaggaaagagcaaagggaaatatcttaactgcaatattctctcaatgtgaaaaataatttcagtattttcttggagattcgcttcttattttaatccttgaaagcttgcattgtctgttcctataaaggtcaaatataagtgggagtattgggaaatatatacatataatttgtgaaaagtattgtaactgagaagaaaaagtagcataaggcaccaatgttatccagtttggcctataaaattcactccaaaattgtatatcccctttgagggtttgctcattccttatatataggaataaccctatatacacactcagtataactttataggcatggcctcatcattattagtatgtgacattctataattttcaatgaaaattttccttgctagcacctttttctttttttaaaaatacatattattaagataaaaaagctacttaaaacatattctcagttttctgaaagctgaccaacttttatctcaaaagcataatataccttaaatgaaaggatacattatcaaaagaaatacttaagactactcatttcattaaaatatgaaaatctactaatctttacatagaaatatgttcatgtgaatttgtctttattgtatttgaaggcgccaagcagtactttcagtaatcaaagcaattctgaatgaccataactcaccttacttcaaagagataaaaaagcttcttttaaggaagcaaatgaaattataaattaaatttagaattctggacgatgaccctccatataatgacacttctagaagccactttagaagcagacactagacaggccagggctgtctgtttctacattggaagtacaattgtgtaactggtctttattaatgtaagcctgtacctctttgagatgagttcatattttaggaagtcatatttaatcactactatattccccattattaaatgagactgatatttagtttctaaaaaatctttccaatgtgctgcttgtagaatgcaagtcagagaaggttcaaaggaaaactcttaaccctgaagacctgagattctcttaacgatgtctttcactgagcagatcttttgattttaagaaaatccaacttaatcctttttttttctttgatagatcatgcttttggtgttgtgtctaaaaacttactgaagtacccaaagtcagatcaaggacagctaacacctatagtgtatcaaattgttgctcccaacatgaccatctgaaatttctatgctaccactgttgtaagaagtggaaactcaagatccaatccagtgcagattagtggccttatgtttaaagtgtatgcatacttgcaacacaaattcatttctccttaaatctccttacatgtatagccttctccattggtaataacatttacatcatcactaggcttgtcgcataaatatcgaagtacttagaagatctttatgaactttacactcccctaagcaatatttatttttagttttctaaatatttatgaacttagacttaaaataaattgttttaaaataattcacactaaagtcattatttatcaaggattatagtgggaatagaaattatcttaccttcaagaagagaatctagatatattgatttctctacttgtctttttaagcatttttatatgcattgagaagaaacaacaagatcttcaaaatggcaggtgaactaaattgctccagtcagaaaccctgtgcaattgggagagactcaaggaatagcttatgaaattgtccaactgagaagaaaaatagcgtatgatttttatcagagataagcacaaggtcatttctttcagaaatcagaaaatccagaccttccataaaaaatgaaagtcttcagtaatcaggattcaggattcatttctcattttttccctgctgtgctgttacaacctgaagagccagaaaatatcaggcatcttcagtaaaagtattagaagtgaagcagaaaacattatattcatttatggcttttacagcctcaagaaggatatggaactagagacaacctacaacacaactttcaaaattattagcagagagcatctctgtgactacctcatatttgtaatcttaataataattgtggtaggcacatggagtccttaggacatatgctcatgttcctttcttttctgaatgtacgagccctgtaaaacaaattgcttgcctaagacaataactagaaaagttcatggcaggagctaagtctcagttcctctcattcttctgattctgatccagctatttcctatctgaaataggatggtggttatggaatatgtctgaggtctataaactattgaataaaagtttcagcaaatttcaaccaagaatgaggcagctccctttgaaacattttgggttaacttttttattaaataaattaattcttcataccagtggtgggggcgggggggggggcagaactaacttgaggattttagtaaccatctatatgtacaataaaaatgtactgagtgtcccaaacaacacagtgctaatagcaccagagccaaaggagtgaaaacttggcttttggtttttagaagcttcatgattagttgaatagcttatatacataagaaacataaacaaaattttgaagagattggcaaattcatgagagtgtttttaaaattagcatttattcattgctgattataagctaggtacattgccatctttcatgaattgtctcaaaataattctgataataaccttttcaggtagattttattatccccattttataaagagtgatattgagctttggagagattaaataatttgtccaaaggcacactgataatgttactgaaacaagatttaaatgacataatgaaactatttgttcaaaaggaagctcgaacagcactctcatcttcaagtttagtgtcagagaagacaaaatatttgtgtgccattgtctttacctctctcttaaaaaacaactggaggagtgaaccatcgcttagattgggcagagacattccagtgacctgtaagaatattcgttctttctagccacacagatgattattaattcatttgaggcatatggctttgcactgtgctctctaaatgctgccgcagtggtggcatgtgaatgattttcttctcctcatcctgctatgaagtgtcactcttccctgccagggagaatagaccatgaggaataactgcttctcaacacggctgtttgtgataaattttaaaccagttgttcagatccaatatccgtgtaatttattgattgattgttctagatggtgctgagtgccaacgctagtcacatgtttagaaaaaaatcaacaaaaactggctcagaaaagagactgattttctcaacatcaagaagctctcctttgcattcagactcttgttcaaaaatcattaggctccttttgttttccagacaacccaggagaatgatgtacacagatgaaagacgtagccacctgttctcaagcatttgcaatctagcagaacagaaagttgtaccaagaatcatagcaagtgtattaagtaccataacctttatggggagctacaggaactcaaaagaggaccaataaaagccaggagagatgagaggttttggcttcctgttggaactaactatggctaggtcaccaaaggatcatgcaaattttgataggacaagaaaagtagaatgatgattctaggaaaaccgaaagcatatgcggaggctcaggggcatgaaagcacagcttgtttggggaagtggaaagtagttaagtttggcaacacatggtacatttggaaaaatgacaggagatgcacagaaaataattttaaatgaagaacctgatgtttggctcagtattatggaggcaaatatctttgttttgaattaaaatggagattctgtttctgatttttttcaagtaattttttttcaatgttctcaaattttctttgacttataaagcagtacaatgtaaaacaatttcatatttcttgtagtttctgaggaagacaaaggatttggaccaatttttgaagagcagccaatcaataccatttatccagaggaatcactggaaggaaaagtctcactcaactgtagggcacgagccagccctttcccggtttacaagtaatgtacctcgcttctcttttcagagtggagtgtcagagtaatgatcacagatcagcatctatgaacttgtacagatgtaatatagtgctttctgcaaattccatggacattaacaaaaatattggcatacaaactattaaaaaagttgcctaatgctcaaatagcagattttcttaaatatatgcaaataattctcttactattttttgcacagataatgttactggcatttgacattatccacttataaattgtataatggaaatcatgtttttaggcccatgaatggttacataaaattatgcataatttaaatatacagatttgaggataaaatgtttttgttatgtactggcctgcataactcatacctacagatatggataaatttttatattaagtacatttaaagatcttgcacaaataactgtagaaagcaccatatttttcaacagtctcatatctatattccacccaacacagcaaatttcttaaatgtctctacctataggaaaatctatataaacatacctcttactatttttctgggttacatatgtatgctatctaaaacaactttataaaaagcaacaatgagttttcctgcttcagatgggtcataaaagtatactaacagtttctcatctgatgcaaagaatgagatgcaaaaatcaaccaaatgccagtggatttaaatttcacctgtgcaatggttccatgaagacaaaacaagtgactgatggagaaattgggggctctagtgtgttaatgtcacctgacttaattgaaagttgtcactcaacaaagttaattttaatattttttccttgatacaaaagtaactttctattattataaaaagttcttacaaaagagaatatccctttccacccatttgattctaacagtactcagttttttcctgcctttggctataatcacaaaattattcttaagataaaattgtgaatttagatacaaaatcaccatcccattgaaattatttttatcgtttcaatttcatacatggaaatatgatataagtaggtattttataaattataaataacacatttgttctcaaaatatttgatgggctagacttatttccacccttaagccatatataatgagagcctatttgtcattgacatggaatagtagaactaataggatctgtagaggagatccaatccaagaaaattttacaggagaggaagctgaatcctgaataagtaaatttgcttgctcaagaactagtaaatcacagatccaagactgaaacacagtttttatgacttccaatgaggtatgcaattttttcattatttatctatctggatagattgatagaatcccaaaaactctttcagtgacacttatgctgtgacactctgttgttaacagtcacacaagggaccttagcaaatcagtctctaggctagaacagaggcaaccaaaagaaagggctgctctcagataacattctagaaacatggaaaaggctatgcttctccttgctgcccccatgcccccaccccacaggcacaataaaaagcaaagctttgctttgccagtaagtcaccaactgcctctctcaggttgcacccagcactgaaattcccactttgagtttggcctggttatccatacactaatagacagaactggagaagacagatagatgtttattcttgttatgaagacagtctgcatttgacaggaaaaaaaaaagtggggggaaagaacagaaaaaaaatcagctcatgatggaaatagtttgatggaaaagaacatttaaagtttttaaaatgtacataatttcaggacaaattatactaaccttggtaatcatccaatttttcattcatatagtagttatatatttgtagcatgttctgggacaacgtgctattcatagcaacatcctgagaggtacaacagggtactttacttctgacttataagccttgaggctttcattatcttgcccccatccccaaagaaacaagcattacaataaaaaagtattaaaagggattgtagcaatagtctatgtttctgaaactagaccagtgaacttcttcaaagacagaaaaaggtaatccttatatgatgtcacaagcacaatcagatccatgtggaggaaggtaagataataaacaaatatttggaaccaatataatgagggagaaattacaaaaattggagctgcccaacaaagaaacccactgtcttgacaagagctaagcaacttaacactagatggttcaggcagggacaatattgccatcacctgggggaagaggaaggctttattcattggattgtaatttagtaagttttaaaaatgcaaaatcacagttttctatacttgcttttaaattatctcctatactgcgaaaattgtaactaataatgttccagtaactttgatttgacaacagatattctaaagtcattaggacttttgggcatgattattactctaattagaagtggccaggaaatgagcgatgtggccacgagccactactacttgagcgatttgaccacagctctaggcttatgactttcctgaggacatggaactttaaaggataaaccctgataaagaatgattataaaattatacagttggttctcttagttgagaactattttctacatgcattcttttcatcatcacatcagaaagttagatccctgtttccagtctatttataacactatccctatcagttaatgctctgattatctgcagcatgtcttatattgttatgatattatgtggttggggagaaaaagaattgttcctctttttcactttattaaaagtaatcttagagtaatgagaaaagacataagtgaccactaactctaggctgaggaaaatccagatttacttgtatatttgtggctcggaataaatttttaaaaacccaactgacttttatcattttcaaattgtgtgactgacctctagtggtcagaatatgtcacttattgagcagaacccactgtcaattagtttgttttattgaaaaattactttgaaatttagagtcagatattgatattttgtattttatttatggtagaacaatgcttttaatactttatacagtatatctgcatatgtatgaatctaactggtgcatagatggctatcaattacatcccaagaaatcaatttatggagaaaaactcaacaaaatatttgtcacttgagatacctcacaaaaaaaagacaaaatacgtcatgtactttgatgtttccttgtctgtacttgagctaaattacaaattatggtcctagagactcagaatcatagagtacaaagaaataccacctgaatcatattcttaattgtctgacttcacatggagccgtacccaaattattttagaactgtgttagctccgtagagtttctaggtctcatgacctgtgatatgacctttgtgtctttttctcatagatggagaatgaataatggggacgttgatctcacaagtgatcgatacagtatggtaggaggaaaccttgttatcaacaaccctgacaaacagaaagatgctggaatatactactgtttagcatctaataactacgggatggtcagaagcactgaagcaaccctgagctttggatgtaagtaaactgtaacttttaaaaaagggcaagcgtgtttaggtgagttcagcaagaagaacaatcaggaaaggatagtgagaggaaggcatcatagatgaggtggatcttacaagatgagtggaccctaattgtgtaatggagacaacaaagcaccacaaggcatactatgaatgcacttgaaacagtgaaagatgatgttgtcaaataaaggaaggccagcgtctgaggatcttgaatgactctttaaaagttagcatcaggctgggcgcggtggctcacacctgtaatcccagcactttgggaggctgaggctggtggatcatgaggtcaggagatcgagaccatcctggccaacatggtgaaaccctgtctctacttaaaatacaaaaattagctgggcgttgtggtgcatgcctgtaatcccagctactcgggaggctgaggcaggagaattgatggaacctgggaggcggaggttgcagtaagccgagattgtgccactgcattccagcctgatgacagagcaagactctgccttaaaaaaaaaaaaaaaaaaaagacatcaatggaagcaacaagccatgtattatcaaaggggcactatcacccctaagggggtgaaaattgtcttttgggggaagaaaatgtcacatattgcaacataatgtctgtgactcttcaaagatcaacccaatatgacaatattgtattccctaatatttaacttctaatagtaggaataaatttaattatattttagttaatttattttaaatttaaattacatgaaacatttcttttaattagggctaataatgaaaaactgtgctaagctaaaaattagaggttgttttgaaagaaaattttacattgggagatgagttggaccaggtgatctccagtatgtgatttgtcagcacttaaatcttttgcaaaatgaattataggatgaaaacaatgttttaagaagtccttcatggtagggtttatcaggagggaatgagaaaggtccaggaagagaagtaagattaaattagtgtggtgagagtggaaatgtaaataatatacattaaccataaggaaagaattaacaggttgcattgcacaaaaggaaagaagactgtacattttttttccaagttatgtctagtcagagggtagaaacattctgttctcattaataatgggatgggagcaagaaaaaccaatttcaaggatggcaggaagcatttaaatggttgcttcacatgcagaggttattttgatattgagttatccaagttgaaatgtcaagtaagctattgaggatagggatggcattcaagtaagacaccaggcctagagaagtagatttgaaaagtcctctgcaaaaaagtaacacttagcatagatgaattttcagaggtatacactttatactgagaaaagtaacaattcaatgttataatttgggtgccgatcacaggttaggaacaggaagagaggcagaaaaaaatagaatgagtatcagtaaaacaaatgaagaactggaagaatatcaaggaatcaagtgaaatgtaagttccaaatacatagaaaagagtaaagaaaattagaactgaaacaaacccagaatttgagaaggagcaagagattggttactttcacgttccctaatgagggtcctgcctttcacccttattccttcccgatatccaagccctccctcaggaagagaaatacccttcaaatgagtccattcctctaagtcattccttcttacttactttctttggtaggtccctggtttgtctgatttcattgtatttccagataccctgactgagattctccctaagtctgaaacaaaagtcttcaggatatttgtgattttcagggttgtcagaattcttatgcaggctgctcccaatatccatagactttgagctcataacagaactttttaatagtctatacaaaatctcagcaatgtaagaacgaggagctgactttactaggcttcaccaaaccactgagaagtgctgtatctcacgaatgagttatttgctgaaaggtaaaattgatgaatgtctctctttctattgaccagagagtgaatgtttctctttttttctttcgtaattagatcttgatcctttcccacctgaggaacgtcctgaggtcagagtaaaagaagggaaaggaatggtgcttctctgtgaccccccataccattttccaggtaaacttaattcctctctgactattagcatctatgaaacaaaatggacaagtttccattttcttagtaataatgctacattattaataatcatggcttattattaattaaatgagactgaatatttgcataccttgtaatgtgtcactaattgttgtggacactttctttcttggctcagtcacctggctctagtcccaaggatctctaatcattttagtttataaacatatatatatatatatatagtattatgtcatcattaaagttcctattccatagggaaattctgttagattttctagaaaatattcctgaaatagaacagtaccaagaaaggatgtataatcaatcattttcttaacaagttagtatctatgaaatactgtgaactgtatgtaactaaaccctagaagggataaagacataataaattattaatctccttaggaataccaatcagcaagaataatcatctactttataaatggggctaaattaagtgtcatctgttatgaaattcaattttgaatctatgttttctgtaattttatatggctaagacaaaagccaccaaagtgctaattaaaagatgaattcctcatatactttcaccaattttcatttatttatcaaatatctctttgaaacaatatataaatacctgttttcacaatttaaaaatcatgtttctattcttttagttctaatattatgccttaaatttgactttaaacatctccatagagaatgaaacgtaacaggcttttaaactccatacaggattttgtgtgggatacatcaatctgatgtgtgtgtatgtacatatacacacacatatatttcacacaaaattatgttatatattccacatgaaattgtgtgtgtgtgtgtgtgtatatatatacacgtatatatacgtatatacgtatatatacatgtatatatatatatacgtgtatatatatatatacacatatatatatatagagagagagagttgtggttgtttacatatcaaatatttgtgattttctccacaataggagaaagatgattgcttgataaatacaggaggtacatataaaattcaaaattttctaacaccctttcaatgagaaaaacctttttcttaaggaactattgaaattatatatatatatatatatatatatatatgtatgtgtgtgtgtgtatatatatatatatatatatatgtatatatacatattttaaaaacctaccattttcatagtgtttcccacaaagtaatgaccaaaactatccagtgactacatttgaccatattcaatactggatggacttcactgcatcactcattgactcagaaaatctcttatgagtatttgttatacagcaggcacaatgtatgccacagaaatgcctcagtggagcaaaacaggaaaagctaccagccttcagaggtcttccacggggagagtcagacattaataagataaatggctaaaagacatgccatgttagatattgctaaataaggatagatagatagatagatagatagatagatagatagatagatagatagatataatgcagggaagtggggagagtaagtattgaggggaatgactgaactcaggaggagcatcactagaaggaaagttggaataaacacctgaaggaagtaaaggagctaacaatatgagtatccgagagaagagcatgccaggaagatgctgaggtcagactatggaagaccaaggaagccagggtggctgtcatagagtgaataaggcagagggtagtaagaaatgaaataagagaggtacaagagctgcattatggaggaccttatgatccataacaattattaatactttggcttttactttgaatgcgatttacattggtgggctttgagcagaggagacacatgacatgacttaagttatagaaaggtgactctggttactgttttaagaaaggacctggggaggacaaaggtggaaacaagagatctgtttggaggtattgcaatagtttaggtagcatatgatgggccagagtggtggcagtggaggtgggaagataaatccaagcatattctagataaaatagaatatactaaattctatatagaaatctaggtatactttggttaaattctagatatattttgaaggaaaagccaataggatttgcttgttgactttatgtggtatataagataaatacaagagttgagggtggcataaaagtttttgctgtgagatcctaaaagaatgaagttgccattacttcagctgaaggaatagatgtggacatgttaaatgtgaagcatctgttaagcttccaaacggaaatcaaggtggcagttctatatgtgtgtagatgtcgggggtgatggaatatcaatttatgattcatcattcaataagttgttttcaaaactatgggactgcaatgtgcttacctagacttctggggcaaaagcaagaagtgtcatatatctaccgataaaagcaacatttcttaagtatgtgctggcacttactgaaaaaataattttatggttatttattgtttaatccagtctataatccgaggaaaacagatagcttttgcaaagatgattgattttatcatctgtgtggggctaggaaagacacaaagaagatggtctgttgagtccttgaaagaactagatcagggcttagctcttgattgacaaagtcacatctcatccgtaagtcggagagtcagcgtggctattgctctggtgttggtacagcttattttggtgatggtgggtggggaaagaggtgagaacatcagttctgcctcccgtttgctgtatgacctcaggcaagtcacttcaccctattaggccttggatcccccatttaaaaatggcaagagccattcctacctttgttgtaacgattgctgacagattctaacaaattgcaattattgttttgtccaagtgaatggctttaaaaataagtaagatttgttaaataaatttagattaattatattgcaagtcccacaaatccaaaggccacatctatcttgtttagcagcacttggaaggtacttagattttgcaaaataagtaaattagagaatctacatcgggcattcagtcagttagaccagttgttctatagtccaagacttatgttcatacaacatcacgacaataacttctcggatttagcatttatcccttataaggatcaagtaccatcacttctttcattccttttcacacatctcttatgagtggggcacaggaaaatgtcttacattttagagaaactgagtaatagagtgactaactggcctgataaaaaagtcatactgagaattaaaattcaggtctctgtattcacataaccactgaggattcagattactctaaatgcattttgtgggcagtatctttcatacattctatagttacaaaagtcctttctctgtaaggaaatacaaaatttcttgacatttttggctttggtggtggggcagggggagtggggatttaatttttaacagaaatccttacaaaatttggatttacatttcaactgagaataggaaatattaattcagaatcagaaaagatcaaagtcttcttttaaatgtactatacatatcagcttggatgaaagactacttaatactcctttctgaatgtgatacttctttacttatcccaggagccctcatttaagaaatttaagcagctccctaaatattttcctatactaattatcctgtgaccctaaatcagcaagaagaaaacaaatgaaaagaattcaattattcacagatataagtgcctagaaatatatgttaaccgtaattctgagttagaggctaattatggtagtctaattttctgcctctttttatctgtattctgtttcttcaataataaacatatgctgctgcttctataatttgaaaaaatcaatgttgaaaaccaaaagaatataatcatattcactgcctgtcttgatgttgtattttgctggagaaaattacatagctaagctaaatataatgcccaggttattattcccaattatgtgaagcttatataatgtgcatctcttttagtttttcatagtcattgtgctttcacactctctttgaaagctttgctagccacgctgagttcccgaaagcaaaatagccatttgtcatgattattcatctttaaaagaagcctgagtgctgtgatttcttggtttttcaccattttacacctaaaatcctatctagtctgacctagagagattcccacttatattcttcccagtagaaattgtctttatgtgatcaagatgttttgaagggaatcatcattttttgacctaaaggtatgcattgcccattgtctccttgtgtatttgttgaatgactcctggggagtcattcatcaaaacagagaggaaagaaggaatagaaaactataggaaatgcagcaaattaaggaggaaattcagttttccatttaactagttagtgtgttcagccaaaggaatttcatgtgggtaagagttaccatatgatacatctcctaatatttaattaaaccagtaccatacttttccctgtttctgtggtttccctttttaatgtgaccacaataggttatgtaagctcatttctaactctataaaataggtgcacacacacacacacacaaaaaaaaaaagataaagcaataatatggtaagtaatcttaattatatttataaaatgcagtttggcagattaatcatggctttcgagttattagacatggattcaaaatcctatttcttcttaatagtcatgacattctaagcaagttatgtaacctcttcgagtttcacttagcccatcaatgaaatgaaagcaagaatataatagtttattaaataatagaaatagataaatagatgtaattgcttagtgtaatgcttatattcatgtgaaatatggtacatgtttaaaagtgtgcactgtttgtcttggctttctcctaacatttgctccacaatagcctttattagattaagtgatagcttgttactagcctctattaaattatgtaacaactttgggagaagcacttaatatttagaaggcaatattttctcctagatgatcttagctatcgctggcttctaaatgaatttcctgtatttatcacaatggataaacggcgatttgtgtctcagacaaatggcaatctctacattgcaaatgttgaggcttccgacaaaggcaattattcctgctttgtttccagtccttctattacaaagagcgtgttcagcaaattcatcccactcattccaatacctgaacgtaagtattttatttgttacactctgttttcgcaaggttatctacatatggtatacttaccgtaatgaaaagaaatatccagtgaagactagctgacttttcaggaaggacaatataaaaggggatgcatgttgaaggggccaaaggcttggtcctaagctttttgcgttgagaagatttagctaataaaattgctgtaagaaggttgagttcggatgagttgcctctagctcggaaaatacacaggggactgataccttagtccagttctagtgtattggttacagtggaaatcactgacatctactttttgttttgtggccattcctacttcttagtaagctcatgaagaaatcaaaggattggtagatcaaaacaaacaatagtaattgtagaattttttaagtcattttgattattttggtatttttaaggaactatttacatgatacaaataagtaaataaatggtcttttctaatctacataatcagcatgaggtgctaccctggtagcaccatggcagatgacactgacaatctgattggcctttccccaggctccaattgaactacttcccttttaaaaagcactgctgcttaagagaatcaaatcacagtatacttgcttactttacattatttctatccaagtccttctgctacattaatatcagcaaattcaagctcatgagagcataccagcttcagattaacagatttaggtttggctcctgcctttacccctaagcacagtgtgatgatgggaaaaatgctataataccattgaggttccatttttatttttctctgcaaggcaacactcacataattggtattcaaaaaatattgttgactttctggctcatttttcttttctcagttttaagagataatctcaccccctacttcatagactgaaaaggagccatcatgtaaaaattctcttgattttctttctactcttccccagaaatatacttgcaattcagcacttctatttattttcttactttttgtctccatagcagaaatatttctcccctcgctcaagctaagttctccagttgttccggttcacattccatttgtttcaattagaaacttcactacaacacttattttcttctttcctgaatcctcagattctgctctacctcattatctctgcatattctcttgtattcaatgcaattttgaattattatgaattcctatttgctaaatccaaaggacactttgaagtccttattctgtttgaactttgacactgcctcttctgcctttcatgaacttttctttcttcacttaatttcctgaactcttcatctcccttctgcctctctgacaaatttcatagaatattcttcacaaaatattcttctttcttatatttttctctaatcttttcctaggtattctcacccacttacacattttcaacagtatacctttgcaagagacttcaagttcacatctccgaaacttttcttgtgtttagatgtcaattcttcctatatcctggacttgtcccccagaaagctctcacagatgttaagctcaaagtgtcacaaatacatgtgttacttctctccaaaaccttccttttatttagcttatttagcaatacagtttcatttctaataactcaaggtagcattatttattatcaaatcccaatttccactgatcttcaggacagctaaccctgtggttcttaattagtaggtaagcacctggggagttttgggaataatgcaggacccagagatactgattcagcaggcctggaatatgacccaggaatccacaagttgaaccagtatcctaggtgattctgatgattgagcctttaatctacaccttgagaaacattgatccaaggagccgtcctgttgattctgcctctaaaatacaatttatatttactgtttcctttctgttttcactgtaactatgccctagtgttggccctcacctgttttgcctgaagtattgaaacagcctttttggacctctgagactgtcttctatatttctcctctccatgctccatcctttaaaaatgccagcaaggtcttccacttaaaccaaagataagatccatattacttctcttaccaagtcccaatggtagttacctgatacgatttggctgtgtcctcacccaaatctcacctcaccttgaattgtaataatcttcacttgtcaagggtggggccaggtggagataattgaatcatggggggctgtctcccccatactgttcttgtggtagtgaataagtctcatgagatctgatggttgtataaaggggagttcccctgcacatgctgtctcttgcccactgccatgtaagatttccctttgctcttccttaatcttccaccatgattatgaggcctacccagttatgcagaactgtgagtcaattaaacctctttcctttataaattacctagtttcagatatgtctctattagcaccatgagaacagactaatatattacctattgagaaaattcatctcaaaatattattttttcagtccttctagattgtgggttcaagctcatatacttcagcatcatttgagttcctagaccttttaaaattccttgcacactcctggagctttgtcgtaatatggtgtttgctcaagctaaactggtccaatttaaatgccatatttgcctcagagtgctatagcccttacctacttctaactaccgtcctcatcagtcactctttcaaagtacccattttgatttggcttatatatcattatttatttatttgtctctttagcattttacagtgtgtggtacacactcaatttgtgatcctaaacaatgcctttcacctttctaagcctgattttttctgtaagcctgaaggattaatacatctttcaggactgatgtgctaaataaatgaaataaagtgtctagtttgaagagtgctgtgttgtctgagtaaatgttttccttctttccctctctccttctctcttttcaatttgtttccctttgcctttatctctgtgggcatttcttcttttctccttagtttcttgccttgcgtctttcttttctactctcttctccttcttctctttccttctccctcattttctttctccaccttcctgagttccatgcagcactgatcacaatgtttgacacatatctgttgctcactaaagacaggattttttttagtaaattgagtcacaatggttatgcagctgtcagaacgagccaatattattgaaaatactgagaagttatactatattcatactgtgcataaacaaacaagtctatccattatgatatgacctgtacctgtacagagaaaagcttccatgttggagcagctctaatcctgtagaattaccatgtttaagaataactaatattgtgcctaataattagtggatatttgtgtttctcttaatattaggaacaacaaaaccatatcctgctgatattgtagttcagttcaaggatgtatatgcattgatgggccaaaatgtgaccttagaatgttttgcacttggaaagtaagtatactgacacttttattaatatatatagaaatagtaccattttaggaaataaataattgtttagctataaacataaagtaattgtcttttaagtgtgtgaaactttaacccttgtatcttctatttaaagtcctgttccggatatccgatggcggaaggttctagaaccaatgccaagcactgctgagattagcacctctggggctgttcttaagatcttcaatattcagctagaagatgaaggcatctatgaatgtgaggctgagaacattagaggaaaggataaacatcaagcaagaatttatgttcaaggtagatacattattttaattttgtataaatttcatcagtatcttatttagagccatttccatacatgaaaaactactatataatgattaatggttttaaaaacagtgatgcatgttacatcatggagaaagataaaatatttctcatatgtctaatgaagtcacaactatgagttatagaagttacgaacttattaccagttgaaccataggtaatagcaatagattgatagaagtgttattggtaattttcagaatatacacttaatgtagtttgtttactcattttatcactgtcttttttcagtatctttttatttatagaagaagctatgtgttatgacttagtttaagtcagtggtttgcaaacttaagcatgcatcaaaatcacatggagggcttgttaaaacagattgctgggccaaactctcagaatttttcattcagaggtctgttaggggctcatgaatttgtatttttaacaaattcccaaaggatgctgataatattggtcctggagtcacactttgagaaccactggtttaagaaatctttttttttttttttgacaaaattatcatggcacaaacctttgattttcacacattaaaataaacttacatttgggaagacagattttttttcaggccacactggaaactttccagactgaaataatttctataatgttccacaacatgaactttgcaggtcacaagtgaataaacatcgagggcttccacaatattattcgtttttaactctggctactgtcccatttcactttctcccgtctctcccaaaaaggaataaaaaatttgacagattcacgcattctctctaaaagtgttgtctccatctccagtttttcttctctcttaattgcactccaacatgatttgcatctctgcctctccacagaaacctttcttttcatgaccacagacttccatattgctaaagctaatgatcaattctcagttgtacttttttttgatctaacagcagtggttgccacagttggtccctcccttcttcatgattcactttctgcacttcatgtctgcaacctactttgttattaatttccttgtataatctttcattctccattgcctttcaactccatacttttctaacattggtgtgatcagggttccatctgtgaaccccatctccatttcagtcactccatttatgatcccactcgtgatcatggctttagacacactctgtaccctgaatgctctaacccaaacatttactctgaacttcagactcgtatgtccaatgccacagtaacattaatgcaatacatatcaagtctgcatgaaatggcctcctaaaaggaagaaaatactaggtaaggtcctttaaacttttgaaataaatccaccactttctactaggtttctaaagcttatagacctgtttttattcaacatattaagaaaactacactccaggttctcaacagagtaaaattttgaactgtctaatatctaaagccttagaagaaccaaggtgacagagcacatatttacagaaggtaatttaagagaaatattatttattctttactaatgcagcatactaagtattatctttaggtctgatcacatcactagaaggttacataattaagccatatatagactgtgtcaagccaattcaattattcattacatgatgtaatagaaaatgtctgtgttgtctttgtgaggccaagacaggaagggtgctgatattcctgtattatgtattgctaagattgtatacaaaataaaacctttctcccttacaatgaacatatccaccaatagtttaaaaaatatctccctatgttacaaatataatgatgagtgaaaacatgtactaaataagattatatatgctttaagatatataggtgtacatatgtctacatgtataatgtatacattataatgtataatgttgatggtatttggtgagataaaaatgttttctagtttttaaatttctagtattttattacttgttaaatgttttttataagatgcatatattgcttttgccataaaattaacacaagttcccagtttcaaagaaaattaaatattattctccactcaggattctttcttcctacttcctttttgtattaatttatttatctgcatttatttggactagataactgaaataatcaaaaagactgtcaaattgtttatttgcttgttctctaaaaatattttttctttggaaaatttttagcattttctcatttttatggatgtctctttagctatcaagtagatcagactaaagaatgagactgagatcaattttaccaatgcatggatttcaccaatcatggctactgtatatagtttctaatatggaaagagtatatttaggtgtccaagtcatttttctagcgccaaagtgagatgttaccgtggccactagctgaaagttccatcaaaatgaagataatgtatacctgagggagtgggaaaaatatctgagtctttatccaaaatgttaagagatggtatcatattgaattgagatgtaattctttaaaacctcaattatcattttgacagacttgaaaggtttatgttatgagcagaaaaaaatcagttattttagtaataattataactcagcttttcaacaaaacatgatttacaaatggaaaaataatggctgagttatagttacctcctgctgtaataatacaggatttgcgtaggttaagcctatgcaaagacaaggcctattactgagttcaggatgcatacactatctgatgtattctgcagaattaggttaactaaatgtaatatttatactctggagattatgatggatcttgagcccttcatttaacatttacaatgttccttactttttagcattccctgagtgggtagaacacatcaatgacacagaggtggacataggcagtgatctctactggccttgtgtggccacaggaaagcccatccctacaatccgatggttgaaaaatggatatgcggtatgtatgttcaagtgctttgctgttcctgagtccctgttcaagcagtgtttcagggtagtcctgggataaatttagcaggagagacaatacagaaagggcacttgggccctgaaatataaaagcttcctaaaaaagacaaaaactgaacataaagtatcttctttcagtttaaacaactttctgtaatcttactctaccttctctctctctctctccttatttttttcctttgttccacttttccaccctcttcctactcatccatctccaatacctgatattgtcctctttttcttgccactattttcctgtaccccacagagacagaggtaagagtgaagctctaagtcctacctttggccctggggacaagtagcagcagtgggattcttctctaccttcccactgtaatctcccagctggtccaagaggggaaaaggtggactctcagctctgtaggatgaatagaacaagagcctttgggcatggtaagtgggttttcctttcccatgccatgaaaatcccactcagttcatcttaggtaacagtgggggcagatgaacataatgtatctaaatgaaaagacaaccaaacccagacctaagtgaaagtatttctattaaagttcattgagaatatgtttcaattttattcttttcagtatcataaaggggaattaagactgtatgatgtgacttttgaaaatgccggaatgtatcagtgcatagctgaaaacacatatggagccatttatgcaaatgctgagttgaagatcttgggtcagtatcatttctaatttctgttaaacattgttaaagcaatatgtcatatcacacaaaatgtttattgagcctacacaaaatacccagtattgtgttaggtgtacaacatatgttggttgcttactgatttatttattgctaattatcataattcagactaacgaaacaatggaatagaatgaatctttgccacaacaaaagtcttcttcagagcatcagcagcagtggccatacctaggagcacattagaagtgcagaatcccaggctcaccccagacctactgaatggacactttaaaaagatacccagatgattttaatacaaagataattttgagaatgaccagaccagaggatgaagagtcaaaacccagatgaagatatgcttaggcctagaaaagcctccagaaagtacatagttacggatgattgtaatgtgttgaaatatatggatgaaatctgcttggagtctgccaagggaagaggagagtgagcagtggattaaatgtgtggatgctgaggaaagtctgagcatgacatcaatgaagtaaccttttttaagcctctgtattctgttctaataattattgctctgtacttggaggtaatgatgaactacaaatgatcatgtctccttaattagttgattagatccattattcccatagctgtttatagatagatcctgaaagcaggactccaattattttggcattttgcagggtgtttgcatacagatgatgctcagtaattgtataaagaaggagagactgcattgtttaatgaaaagtacatgctttggaaacagaaggacctagattcaaatgtgactcccacttattactacctgtggtacctttgccaaattaaataatcctaatagatttcaattttctcatttataaactgggaatagttcattcaacatgtggtttagaggattgactaggaccatatgtcagtgtgtataatgctggtcaattttttccagcctttcactttactttccttgtggaattgagtcaaagcaacagaattcagagttaattttaaggtaaatgtgtataaaacatttgattgaaattgaagttatttatttattgagacagggtctcacggtgttgcccagcctggagtgcagtgaggcgatcacgcttcactgcagccttgaccttctaggttcaggtgatcctccacctcagcctcctggatagctgggactacaggcatgcaccaacatgcccagctaatttttttgtattttaggtagagatggagttttgccgtgttacccagtctgctctcaaactcctgggtaagccatctgcccacctcagcctctgaaactgctgggattataggtgtgagccacccatgcctggattctaattaaagtttctaataatcaattcagttatcatcaagaattgtacatttgaattgggtgaattttataagtcaaagttattaaataaaagttacaaagcattaggtatagaatgcctattggtgacagctgatcatatttaccgagattaatcctttccattaactattaaggagaataaaagattctacaacacagaagcaatgtttaggctttacaaacagaaagagaaagataacaatttgttttctttttagcgttggctccaacttttgaaatgaatcctatgaagaaaaagatcctggctgctaaaggtggaagggtgataattgaatgcaaacctaaagctgcaccgaaaccaaagttttcatggagtaaagggacagagtggcttgtcaatagcagcaggtcagtgctgaaactagaaatccaattgcaaaatctgtttgaaaaagtttattttatagaagacttgtttatatgttaataatgaaaatgttttttgctctgaattttttttttcacagaagatcctgtagttctaagatggacagaaatacctatccctgtcagtatctattataatgaaggtttaattaacaggactctataatgtataaggaatttagaaaattgaagctcagaggtgtttttttgttgtcttgttgttataaattgcccaatgtcacacagctaataaacaatgggaaataaagtaggatctctctaacatatttttccccagtataggcatctggcatctatatccattcatattcaactgaattttgtgcagttagcctattaaatatttttgtagaaaaataaaaaggtgatttcaaagtgcaaataatctcttcctatctcaaaatgaacaagatgttatcatcatcttccttataaatggaccatctaccaatgttttggtggtttggggacaaaatgaaaaagcagtgtacaacttatatagattatttgtataaaagccacactgaatagtttatatgtatcctagaagaagtaatattgagtgcaaaaattatgacgaggagaaagccaggatgggaaatgggagggatgggatgtgtgggttggcttgagggtgtatgtgagggtgtatgtgagggtgtatgtgaatgtgagggcagcatgtacaaaggccctatggtgaggagtttagaatgtgtaagaaattgcagaaactgaaatcagtgtgatttgtctttagaggaaaatggaggagacttttaagagatgagacatagtaagccacatcataaatgacaaagttttctatgctaaggggcttgggcttcatctaagagtaatataaatctgtttaaagtcttaaacaagggaggacaaggatcacttttgtcatttgaaagactgttattactcagatgtagaaaatacattattttcttcacagtaacccaataaagtaacatgggaattatcatccatattttgatgtgtctaaagcttggtaaagttaaagtgaccttctgcaaaaatatattcatgctatctaaactagaacttgaagttgtaagacattgatataaattgagaatatgccagcacagccctcttattaggatgagcacaggcacggctgtttatggaatggggcaagagggcagggacatcaggggcttccctgaacacactgacttttaaagttaatatgtttgacctcagggttgttaagattttaacaaaatgatactacaagaagggttaaaggaaaagtccatttgttcaatttgccgctgaaacattaatggtcagacaatgagcaatgcagagaccatgatcaaagggcagctacatgtgtaggtgcttactccttccacagcctagagcagggcattccccaatggacaaaccattagttctcttccgtgataataaaatctttttctgattctgatgaagacccatgtcatggacctcttcaaccaaggatttcccagaactatgtttcatggacttgtttttcctaaatatcaatatgtgttcaaaaaaagaagagaaagatctagctcctgaaattttacaagtttgattgtgttctgatatttttaaagcctttgaaatcaaattgcattatttccttgattaaagagtctataaatctaatttttacttagtactttaacccattactatctcagtgtaaatactatttaatagtagatatagtattcatatgcaaatatatttgaattgtaaaataagatgtataaaaagctaaacataaaaattttggtgtctattttgaaaaagaatacacaaggactaactaaatattggtctttaagcataaatataatcttattcttctgaatataattataaacaacatttccacgtaactaagttatttctgtatctggttagtgcctaaagagtggtttatatgatatttggaagaagctatgtatcttgataaatagtaattaggttttcattttatgattttatttttggctcaaatgatatattttctgcagcagaatttctttgtaattagcagaattaagttagttgctaatttaaattcaatggattgctattagctctaaggtcacttttatttaaaccacttataggaagggatcttcattagtcttttctactccagaggttattctggagtaattttggtaccaataagtgaccaattggttaaagaccagattgttcctagtttgtttgacagctgatctatatcatagtatctggaaataaggataagatcttgagagtttagtctatattactttaagaataaagagaattattacaaaaaaatcaggttttctaaatatttttattaaaaagtaattttaatctcaaaggcaaagtacctgaaagtataaatgagacgaatgacacatggaattatgtataccctttaaagatggtaaaagatcaattgaaaactaacataagtaagctaaaaatattagcatgatttaagaaagaatcatcattgttttttccactgctacttcattataatttttgttgtgcttcttgaaaaataattaaatgaaagggatgtgggaacttggctgaggatttatactagagggtagtgagaaaaagtgtgacccattaatattggtactgtgttaatatgtgtcctccaagaagctgaagccaggaagattagctatgtaagaaattaattaatggcaatgcatgggagggaaaatagagaggaagctggtggaggcttggaaaagtattttactgagatacaggtctgatcccagatgaaggacagagggaaggaaggaaaaaagattgtgttgaaatgacttggactgcactgcacttctaagagtatggtcatgccactggaaagtcttccattcaaaaatgcatatcagaggagtttgctgtcttccaggagcaggcctggtttaaaattcctcccatggtcagtcattggctaagaacagcctgtggaatgtgtggctttgaataaacacagtgatggatttctgagtacggcgtctgggacagagaataaattacactcctcagagttggagagtggcatattctcagagcttccatgatcttaaataattacttttatcattatattattttgatacttcatttctccttcaacaacaaaaagtactctgaaatgagcttcaagtcaggactggattgttcaagaaaggaaaggaaatcctggactataatgttagcggaaattttgttattttcttatatgaagatttttatcagtaaggtagatagttttgcttcttttatcagactttgcccttaaaatggatatacgtttgcatgttttgtgcaaactttcaaagataatttagttttgaaaattatctatttaaagaaagtaaaaaatccaatgacaggcaattcaatatttaatctaagtgtgagtttctatacaataaaacttagtgagtttttagtgtccatcccctgaggaagaggctgacaggtagggaaatatgtgtagtatgaaagacttagtttctgttcaaagaagaatttcctaaatattaatttgttccagaagttgttactaaggaggttttaaaatattttttaaagtttctaaaaataaaatacatttatatttctctgtagccatggaaatggcaatctgtcctcacctcctagtctgaattgaagtcctgaggttacatttctgggagaccggggctcatttctttcaggcctatgactgatttcagcctgtcccatagtggaaggtcagttagaagactacggcaatagttcaagaaaaagatgaaagtggatttccaaaacaaaatgtcaatgatgagaaaaaatattataactaaaggctagaatttgtcatcttacaaaaatgtctgtggtcgcatgatttatatagaatgtaataattgaaaaatattagtgtttgtaatctaagacataataatgtattttactaaatcaggtttgtgaattatatatatttttatttcactagaatactcatttgggaagatggtagcttggaaatcaacaacattacaaggaatgatggaggtatctatacatgctttgcagaaaataacagagggaaagctaatagcactggaacccttgttatcacaggtaagttaatgtttgagggtgcttaatttctaatgtattaaaaaacatgattcagcactaagcatctaaacagtcaatgtatttgtaagtttctttttcaaaagaatttcaggcaagtttcttgcttgatgatattgttcttggaatttggaagtgaaaacatcttattattttgcacaaataaaaatatattggttattattttaatataccagataatattgtgtcttatatcttcttgaattgtgctttacatttaaaaatatatagatcctacgcgaattatattggccccaattaatgccgatatcacagttggagaaaacgccaccatgcagtgtgctgcgtcctttgatcctgccttggatctcacatttgtttggtccttcaatggctatgtgatcgattttaacaaagagaatattcactaccagaggaattttatggtatgtgttttaagtttcatcttattaacaccccagtgattcctatgtgtctgcattgaaagttctattactataatcacattttatatcatctttgtttttcatgagaccaaaaagcaggcaaaaaagctttctgtggttctccttatattaactgttgtactgctaaatctttctaaaatggctagccctgaggattttggtataaatattaatcaattaatattaattgggctttaggtatgatttcccccttaattttaatacaattgatgtgtattacatcagtatatatgtgcccttggttctagtgccttcctttttactttaaatgaagagcatagaacttaatctttgttataatgatgatcttaaagcatttatgttatgctttaagagtaagaaagagacaaaattatatatgttggagaatttggagaattagtttatgtgatttgaagagggttaaatggctatattttaagaattgaaaggtgttacattctacaagtcctatagttaaacatagtgatatagagagtcaaggtgtagaaagaaataaaatagagggaaaagactgagaagtaatgcaggcaaaacaacttgtgtaagaacattgttggtgtcttggtaggctgtctaggttacagtgtatttaaaaagtaaattaatcactggccctatcagcctcttctttagaaaagcaaacatttgtaagactaaggacatatttagaacataggcataattaggaaaacttttattttagaagtcagttattaatataaaaaagaagcacaaatgaactcagtaggacatttaggattgtttaagtcccataaaatctgaagattgatatgtacacattattatattatgctttcatattgtccagctatgtttttagctttagaagagttgtaatttaactgatctagctacaactgtacacctctagtaaacataccaatactctttcagtttctgaaccaaaattatactttaaagaataacaattgagaattggcagagaactgtaaattttgtattttgacattatataccatgtaatatattttccttatagatctgaaactattttgcacatgcccaaaattagtcaaattggcaccaaaatctccaatactttatttaaagtgtattttattttgcaagaaaagtaaatacaacttgggttttattcattttaaaggaaaaaagtaagctaaacagggatcttactttctcaaaaagtaggcttctgaatttgaaagaattatctttggtgttataaattgaataatttcaaaagtaaagtctagaagttccacaaccatagtttataaagtagtaactaatagctgcaatgaagtctatgtaaataaatttgcagacaaaaattgccctaaactgaaacttcatatttagagcttatttatattctttaaaatactaattacattgtgctggtacatgtaaataatgactgcaaaaagaaaatggaaaaaaaaaggaatttaaagagaaagaaaaatagatcccagtcccctttaaaaaaaaaaacaggaaaacaaagaaataactggaatactaattaggaaacaaataataaattagaccataaaaatgtaaaagaccttgtggccacttagtgcacactctcccttttcagatgatagctgcagagattcacatagttacccctccagctaatccagagcagagtcctgaccgcaggctcaccacctcaggtttcagttcattccatcaaataatgatctgacagtgggagcaaacctactcaactgactagataagcatcttaattgaatcagaatatcaaatgcacatgtttagcacttcatagatggacagatgcattcaattatctcgatttttaaaaagcctggataagaatcattttaaaataaatagttaaactgaattctatctttcaaaccaacacaagactaatgaagctatccctggcaccttccttctcttttaaggcaaactacaaagttaaacttcactggtcaatatgccatgcaaaatttaagtaaaaacgctataaatatttgatccaccttttggaagatagtcctaacagctattaattgcttctaggattgttaatagatcattctcagaattagtggctcctcctatgaaaatcttagtgaatatatatatgtctcttaaataatgatttggtattttatgtagttctcccaatatttcaacaattgaatagcatttgttcattaagaatatgtactaagcacatgccataagcagacacagttgtaggcactaggttaaataaaacactgaaatagacatggacaccagcccaaaataaaccaatgataccccaagagtttaagattcagatgtaaatgttttttggtagctattacagttaacaaaaccaacataattaacatgttctaacaattttcattgctaaaaactaatacaggaagttctgactaataataaaaaggaatagggaaatcaaattttaaactttttatttcaagaacctaagtttttattttccaatttagtttcaataataaattgaattcaataattaagtatgcactgattttagcttgctattcttgattttaaccactaaggggcaaccttgtataaggattcaaatttcacagcccggtgtaatttgggacttcttttccttcatgaaattaaacaaatgcatttgctcctacttatgaataaattgtgagattataggtgatttttaaatgtcttctttatattttttctaattaaagttatgtaattattaggaaaaatgtaactgtacatttttaaagatgtatatttcttttaagagtttaatgggaacaccaaaaaagcaaaaataacactgtctttgtatttagtaatcctactttatgtaaaactttgggattaatttattttttaatgtaactttcaattttaaggcagtaattgcacacctagtactgattatagaaaaacactaaggagttaaacatctaaaaatttcctgagtattatattaatatgtaataattgtcagatgttccactggaacttgaactcatgcatgggggatgttaaaaatacaagctcgaagcagaaatttaataaatctgaggctttgatacaataagatattaaagcagtttatctgccattcttttattttgttgatgttatatggcaaatgatcataaatgtttcaagtccaattataaagtggctcctgttttggctttctaattcaatagctacttaatgccttggagtaaatacaaaaggcagagccattttatttattcatttaatgtataacttttcttgttccagaaaagacttaagacaatctatcaaaaatatgaattttaaatatctcattttattcctctttcaaggtggcacctaacctgtagaatttttcagtagccctcaatttttgacattcactttgggtcattttctttcaactgtttaacaacattccctgcttagagccattaagttagttaattacatgagttccttaaaatttccagttttggagattgtcactatttcatatatatatatatatatacacacacacacacacacacacacacacacacacacacacacacacatatgtattactcttattacaaatacatgttaaatttgtaatactgtgggacattattgcctgtcttatatgaattcataaatatcacttgaattgttcagagattgtgtcacaaaccaacctgggctttaggcttcattttctcacctcttatgtggtgactctgatccagggattaaaattctctaagcctcagaatttccctctgtaaaacgtgattaatcattcacttacttcattcaggttacttcactgggtttgaaaaactagttacttcatgaaagagtgcatatagagacttggcacagcatctgagagtattggggacacgaataaagtatataagtggttattaatactttttataagagagcaatcatcccccattggaaattccagaagcttttgctagctagtttttctttctttctttttttttttttttttttttttgagccacagatctcatttttcacaatttaatacttgcactgcttgctgtgctggatacttagactgagaccaaaaaaaaaaaaaaaaaatctgggtatttcattgctgaaggcagtgaagaggtaataatagccaacatttattgtgggcttactgtttagacagaattgggttaaatgtttttcacatatttctcagttgatcttcacagaaatcctctgtggagtgcatattattgtgattttctcagttttcaaagtgaggaaagtgagtattagaaaagttgagtaactggtcccatgtaatcatacaagtcgctagaggctaacagaagatttgataccaggtggcctgactgccaaccctgtaatctccaccactttgattcatcttttggttaatgttcatgtctgtgtctatttaaataattctcccataagtatttgatgctctacaaggcaatactgttcaattcacattttattctctaatctggtttaatgaaccttgtatgctcactcagattgcccaaattacttcattctccctacactgttggccacctttgcaatacactgtaagtcatgtctacacagtttcaagtggtctaactatgaagttcctggcaattcctaatgatcccctgtagacaggtatgctaggtgtgtgtttgcaggtatgtgggtgtgcattttttctgagtgcataagcaataccattcaagagagaagaagacagatttctcacccaaacgttattttccttttttaaagaaaaattttattaaacatatcaaaaaaggtctttagattttacaaatatgtatttaaaactagatcatgctgtgatcttgtacagaaattttgtttctgcaagacaagaaaaaggagaggaaaaatgataaaacagaagtcaatttgtttttttttttgtttttttacaatttaatcttttatttttatttacattttatgtagaatgcttataactagaaagaaaggtttctttttttatatactttaagttttagggtacatgtgcacattgtgcaggtcacatatgtatacatgtgccatgctggtgcgctgcacccactaactcgtcatctagcattaggtatatctcccgatgctatccctaccccccctccccccaccccacaacagtccccagagtgtgatattccccttcctgtgtccatgtgatctcattgttcaatatttcattgtctctattcactattttggttgttgttgctgtttttgtgggttttcttcttttcttttctttcttttttttttttttttttttttttttgagacgtaggttagctcttgttgcccaggctggagtgcaatgacgcaatctcggctcactgcaacctctcccaggttcaagtaattctctggcctcagcctcccaagtagctgggattgcaggtgcctgccaccacacctgaccatttttttgtatttttagtagagatggggtttcaccatcttggccaggctggtctcgaactcctgacctcaggtgatccacccgcctcggcctcccaaagcactggggttacaggcatgagccaccgcacccggcctctattcactgttgaacaagaaggttaagattatccagaattatgtgggagaaaacgaggacggttgggcaataatccttggtaagaatcagattcgagccgaaaaaaattagagcaggataccaggcagccacagggagatcgtggaagccctgaagtattgtaactttggtcccatgtggagacatttttggttatcacaactgtagaggtgttgagagggtgtgtgtgtgtgtgtgtgtgtgtgtgtgtgtgtgtgtgtgtgtgtattgcatctatttagctattaaatatcctataatgcacaagacagattccaaaaacctagtattatctggcccaaattatcgatagaaccaagcttgagaaacgtcctcaagaaagatattaaaaaagagacttagcaatactgggactagccactgcaaggttttaagcatgatgtattggaaacaaagagatgttatattgttttgagcatctgagagtattggggacacgaataaaaagaaactagatttttcaaaatgcatatccaaaatagtttaagtagtagaggatgggttttatgtgcttcttgaatttaagactcttaaattttgatgagcagtggaaaagagggagaaatacataaaaagtatacaggctcctggcacagtcttgtgacacacaaaacatacaaaagcattcggccaatgtcaaattgctctatttttcttatcagtagttagttggaaaagagttaattagataattctatcatacttcattctgtatgaatatataacttttctgatcccctttttactaccttaataaacctttactgatacctaactgctatattttatttgctatttaccagtgttaaacgaaggaaggtatctatgttcctgggtgtgttttcagttgggctagcttcttttaagatcatcacacttcccatgtatagaccatgttagctgatgtcactctctagcctaacttctcatagtccttactaagcatttgttgataagaatgccaggtgaatggaattaagcatatatatatataagaatgccaggtgaatggaattaagcatatatatataatataatatataaaatgtccattctgatcacttttttctacaaagtggtccaagaagatttttagaactctaaagctaaggggaaccaacttgaaaaccatataaattaaatgatatatgagttgtatttcaactctaaaacataggttccaaatcaaaggcattgatgtttttgtccatcattcaaaatgcttaggagaaacctcaaagaaaatggtcttttgagttttcatttaaaatggccagctgatcaaaattggactcttcagctgtcattctcgttgtttattacatacaaaaatagccaaatttagagattttcaacacgtctactcttaatttatatgcaaacacactcttagtaattatcttagtaatcttagaaattatcctggacaacttgccttatttatttttttgtatgtccaatgacatcacttcactttaataagttgttttgtcattttatttatgtttttgactcaatcttaatattgatgcatttcttaaaataaccctaacaaaaactagataacattagagaattactgttaattatgttatgtgtgaaaatggttttgcatacaaaaattggcctagggtggtggtgcacacctgtaatcccagctactcgagaggctgaggcatgagaatcatttgaacccaggaggtggaggttgcagtgagcccagactgtgccactgcactccagcctgggtgaaagagtgagactttgtctcaaaatttaaaaaaaaaaaaaaaaaaaaaaaaaaagaagaaaaggaaaatggttttgtgattatgtaagaaaatgacctcaattttttgagattcaagctaatgtctttagaaattgctgatgagttgatgagttgagtagtattgatatcataatatccggaatttatttttcaagtgttcagtcctagacagaaagacagagatagtggacagagagaagtaaatatagagctagttagctagacaattagataaggcaaatatggcaaaaagtttacaattgttaatctagttggctggtttatagatggtgatagtactattctttctacttatgcttgaaaatttaaatagcaaaaaaataagtaaaataacaacatatcatatatgaagaagcaccacatctacttaccaaacactaaatccagttatctgatctattaagcactaccttggaaacagcttgacttggtgaaactagggctatatattacctatggagccttccacaagtagcttaatgtaaaatctcaaggtccttatttctaaaatgggaatattaatagtaaatctttgggtagtgttacttctggaactcagaagtgaaaaggagatagtcctagtttcattattagggctatgaaattataaatataattacataaattgaataagaaaatgtatgtaaagtagctagcacattgctagacatttaaaaaacattcagtaaattagatttggtaatagtaggagttcaatagtagtatcagtagtggcagtaacaatagaagttatattagccattttaatagtaataggagcagttttagtagtattaatagcgacactagtaatattagtggctatagttatagtagttttgtgtcttcctctgtaaaatacagctaaaaatagtacgtatctcataggcttgttattaagagtaagtcagttcgcatgtatatttataacaacctttgacacctagttaaccctaattaaatatctgctgttagtagagttggtggtggtagtaatgtttgcagttggatatgacatatttgctatagtatttttgctttctctactctaacaagccaaaagtaaagaagaaacgttttattatttcatggatatagcatatatcagacatatttaataatttttatgtttgtgaaacatattctttaaaggatgcacttctttccaaacatctatatctctccctttactctgaacttgaatggaacaaattatttaaatgacaattatgagctctaagttttatctagaccttttctgtaccatatagaatctttctttgttcactaagattaattcaatttgttaatacagcgtcatcactgagactcatttacattgcagaaatgattttgcagttagtttacgggggaaggtgaaggaagggctgggtatttatatgttggaagtcttttgatttaaacttgggaaacttctaagtggtcaaccacatatacactttggaacatccctgagctttgctatcacaatttccagtatgtgattcaactctcctcatctgaagggaggaattttgtaattgagccaagctgtggcttttagtaaaaatacagtgagcatttgtatctaatttgtggctagaatgtgctgaggcccatgatctttacttgctttgtaagcgttctgccaaccactgaggacctcaacttctcttgaggtatggaaagtgctagtagtatttacaaaaactttaggagtgctttcatacatacacaactatattgggaatgatactttatattttttcttctttccttctgagaagttttattgctacatgttcaccaaatgtagaaccagtgagaataaacattacagttgcttcttactgctttatgcaagtgggcttatcgataaaagagttaattttcaaactagtttaacattaaacttttagagtagtttaaaaatcgtaaaagagttcatggtgaaaaattaataaatataaatttaatataatgtattctaggatataaaacagtttgtgctttttattacatgtgacagtataagaagaatgaccacattattcctatcagaataaaataagtgaatgtataaacagcaccatgtttcaaagagagtttagggaaaaaagatagcaatttcattaagaaagaaagaagattagatacatcacataaatatttttaaaagggcaattatgataccacaatatgtttatttttatattactttctgccctcaattttttgttgtaaagttcaatgaagaaacattttaaattgctaaggtgatttttttgaaaattcaaatctaatgacatggctcattgaaatagtgggagtttagtaacagggttatctttcaattagacaccgaagcaaccaaagtactgagttcatttaatgaataaataccaaaaaagtgctttttacttgtatgcagacattattctttccaaatataactatcattttgtgtcgtaatagtttgaaagattttacttaatacatttatattattgaatatttagtatcaagtgcatttgtattaaggatgtcaagaaacatcaaaacagtctatttaacaaatatgtaatgtttattttattttacaataattattttatattttatttttcctcactaaaaattacttagacatatatgtcaattaacttttatgatagaccaagaaaaactcatatttaccttctctatatatgaatcttattctctgcttacctcaaaaaaaattttaatataagtaataaaataacatcttttacctcctttgttagatgaattctatttagtataagaagttaggccagctgcaaagttgggcacagtcccccaaaccaccctcacttctgacaccaactgcaagttcaaggggttgcaaaaatcaccctcagtttccatgcttcgctagaaggtattcacagaattctcttaaagctgttatatacatgggtacagcttcttacaggagaaggatacaaattaaaattagccaaaggaaaaagcacacagggcagagtcaagaagtacaaaacacagagcttctattatcttctccccgtgcagttaaaatgcattactctgactgctctgatgtgtgacagtatgcttgaagtactgccaaccagcaaagcttaccaagcctttctgtccagagtttttggggggacttcatcaactagacatgattgatggactcattgctcacatggttaatctcagtctctaggttgactgataccacatgaatcgaagaccctactctaagtcaaaatgtcctatttgtggcatgaccaggcccttctctaagactctacaggtgtagttaactcttgcccgaaatcacatggttggattttccagtatgacccaactcctactctatgaccagccccagcttgaagactatagaggtgtggctaacccctactctaaatcatatgattggactatcctgtatgacccaagacttcccaagcaaagaaagatattatagagattaccttctagaagctgagggcaatggcaagacctctctttgggcaaggctaaactctttactacacataggggtgggaaaagttagaagttcagttttcttgtatgttagtgatattgttttctctataaattttcacaccttcccaataacctttctattttcttatgaaaatagtgtatagatatttgaaatatatcattcctggtagtttatctcatagatatggatagcaatagtttttctcaagtcagttattttatctcataacattatcattatcttacctgaaaaaaccatttgaaattactgaaagaatgtctatttaataaaaacactttagattattttaatgtatctattcaatatttgttgaattctcttgtatgtcagatattacattaagtactttgtatgtaataataaataagacctggttctttccttaaggaattacagtctagtggaagaaatcaacagtgacacgattacggtagaaaggaatagttacaatgaaactgtacagagggcaataactaatccagccttacaatttcagatatgggaggggtatccaaaatgtgggttgaacattcatagccaagtaatggaagtgggaggtggggcaatccaggcaatgcaagtgatatatgcaaagttttgacgtgagaacacatagcaaagtataccctattcactgtggctggggcacaggagttaggtgcaggggtaatctgtggaggctgaaggtgtgtgtacttcactctcacacaagaaaagcctcattatttgtttagtaaatgctgtcactgtcatgggttatatgtacttgctaacataattctgaatgtagctgaaaagaagtgaatacatattatcttaagagcagataccaaaattcttgacaatttgacaagttcattcaaacaaggcatatttagcgtgattatttgcttggcactgtgctggacttgagaagacagcgcatacagctgtatacatatataacacagggatacaacatgtctgctaaataaaacagacgtatttcctcacatcaaacttatagtcggccagggagaacaacttcaaccacataatcacaaaagtgtttaactgcatttacgatatgtaatatgacagaagtttcatggtagcataataaaatatagaaagggtacctgcctagtccacagaaaatggaaagacttgctggagaaaatgatttcaactggtattgggtagaggtgaaggtgataggggagggggtattgaggttatgaggggtatgaatcacaattccagaagacaagacaatgtgatgaaccagagactgaagagaacaagatacatttgtggtcctaaaaagagaatgttctgcctggagagcagagtgtgagtgagatggcacactaggtgagctggagcatcagagagagcctagagaatggaatcaagttggctacaataatgctatggcttttgtcccaggaaagggaaattttaaaggtttcagtttatctgcttttatggagacaagtgagttgggcccagctgcatttttaaaaggttattctaggtaaccaatagaggaaagaatagagtggaacagtggtggaagtagtgatcaaataagatgtaggggttcaggtgagagatgtgggtagtttggacaagaggcagtagtgatggaaagaatggataaattcaagaatttatgatgagtttatgagaaagttgaagaaagggaggggttaagaatgtcctagaagttcctggaaagtcagatgactagaaaaaaatgagtatttgaggaaggaaagccaaatgctatcaagaagtcaaataagatgagctgaagcagtgggactcagatgagaattgattgaagagtaagaaatgaagaaatggaaaaactaaaaacagaatagatattgtcagaatccaagtaaaaatcaaacaatcaaacagcttaatatgagaaaataagaattatttatttccaagagaaagaagagaaaagaagagagaagtaagagattggtagtaggagtggctgccaacaagatggcagagcactgggagaggtgaaggttactgggaaattcccagtaaatttacggccaacaggacttttaaaaacagaattatgcagtggatgatacttttcaaggttgatttaccctaccttttttttttttttgatataaccagttccagctccttcagttgttcagtaaactaactttactaggtaagacttcatgctatttggttttctgataaaatagagaaagtgctgaatttctagtctggagctccctggtatgacaaaaataaataaataaataaataaataaataaataacagaccaagaggacagaaggaaaaaaactcccctattgcaggaatttgtagaaatcttgggaactgtttcaatttttgaccaatctatacctcaagggactggaagatctcaatcgacattaaattaagactggctaatatcaaggattaaggtgtgtggccactgatcagttctttatatggagatattaatattctgttccaactaactataccaatatgctctctcagctattattcttaacctcattaatccagcaagggttgcaaacccaaatgttttccaagaactggagggaacatgatatatgaagaggttattggtagaacctatggtgaagcaaaacgttcactccatgtacagtcatgatacatcataggtatctagatatttatcactgaaatagtaaatcaatatttttggttcataggaaaaccaaatgtccatttaaaaattgagttttccaagttttcattctaagaaaatatcttggagataattaacatgaactttgacatgctcctgctaccatacaagctgagtgaccttagttatcttagttaaattacttggattccttaagtctaacttttactgttaatcaaatggatataataagacctatctcatagggcagttgtcaaaaaagaattgaataaaagtgtgtgtatgtgtgtgtgtgcctgtatgtgtgtatgtatgtgtatatgtgtgtgtgtatatatgtgtgtgtgtgtgtgtgtgtgtgtgtgtatgtatgtatgtatgtatatacttgcacagaccaggacccggtatagagtaggcattgaataactattagctatttttggaaattacattgaaatggtgtctcatcatcacaagcaaaatttcctcaagactcaaaaatatgtgttgaacactcttggaggcaatagaatagagcattgaacaaaacaaatactcttgtcctcgcagaacttataatttggcaacagagtacatgttagtggaattgtacattttctcaatttctgcaaacttttagtatctttgtaaaatgaactgtggcacatattaaaactagtcaattagatcagctttgtgaaaccaaatcaatcattcttccaaaccatatagtatttgtttgtactcattgatacttaaaacttattgatacttattagaccttaatatttctctttaagagatatcaatgaaatagtttcatcccttgagtttctctcgatataaccctctgattgtggaaataatagaatgttaaagatatgaaagctaaaaaataccttatcaataaattattcactttatttttcagttgagaaactgaagcctagagcaaggacatagagttagcatgtctaaaacacattctttaagtggtgttcattttgttaggggaaaaaactacctcttggatcttaaatgccacataattggtgaaaaatgtactgatttgaataattgctgtttttgctaacagctggattccaatggggaattactaatccgaaatgcgcagctgaaacatgctggaagatacacatgcactgcccagacaattgtggacaattcttcagcttcagctgaccttgtagtgagaggtaagagtttcaacattttaaaattacaaaaccaaaagtatttgacttgcataaacatgtataatcttctggtaactctggtgcaaattcttacatatttagagtctcaatcccatgcttaagaatggatcttaagcttcttcccatgcctaagaatgatctatgccagacaagtagtaaacaacactgattttgtttgttttactaactacgtatcttctagaaagttacaccacatatctcctactaaatgtttgtgctttgtagacttaccaaaagttctcgtttcctgctaatactttttagtgtgttgtgtatagtgctgtttccttttttatttctatggaaaagatatatactgatgctgtttactataacctcaactgttatatatttatcacttttgtcttagagtgtaaagttaatttatacatgtatcatgtttttatttgttgctggttttttcaaattagtgttttcgttcttatgaataatataattgagattgtgatggaatatacatttattaaaaatgcaacccctttgctactggccgctgccatagcagtgaggctggctgggaacacagcacaccttgtttaaaataaagagctggctcttcactgactgccctttagttttgcacccaagaagtaccatgtgttgaccccagcttgcttacctttaatatctcacttcatgtaaccaactccaaccatctaactaatccacaaaaatacactttaacttccatgtcagttgctttattcacagtattccttccatgtctttttctcatgatttgttgaccaaatcttattcatccttcaagtcttaaagtatatactaagttcatgaatccttctcttgatgtccccaatatgagctccgatcttctgaattttcataacatatattgctttctctcatatgttttatagcagttggtacacagttatctactctcctaagttgtaaaattcatatatgttttttttttagtgaatggcagagttcctttgcattgtttcgtagctctctctttctgtctcagtgtcagttaaaattactattttttcacatttcacctactaaaaatatttattgaacattaattgtacattttgcctttacttttcacactatcagataaattggcaataaaatgatatttgtggcttgtttattttaattctccttccacatctgggtcaatataattttactcaatctcatgcagctcctgcatttccctctagagcaatgttaatatggggtccctaagcaacactgggcaaatgctgaaaactcttctactccatttgaatatattctccaatagagttttaagaagtctagttgaagtttcttcatctgaatgaacttggaaatacattccacaaaccacttattgaataataacaaataaaaatgagactacaaaatcctaagtcaaacaaaattcatttaggttcagtattttcatttattttgttatctgggacattgattgttttcaagaattattagggagagggattagagggattagttcaccattcttcctagtcagaccactagctgttaagtcatttccagaagtagccaaagtgtatatttaattgaaattgcttgcatatgaaaataattagcattaatattgcaataggagttatgttacagtgtgtggacataaatgtcttcatatgattacattgtagtaaactcatagtactattaccatagaatactctgtaatattcagagtgaagaggaattttacagatgaaatgcaagggtagtcatgatactagccacacatacttaggtaattaattatcaccactatatgtatttttatagagaatcaataaaaagaagctatagccaatattatgtagaaataaaaacgtatacagcattttaagtccttgcactatagtaggatgctaataaaaccatacaggtacatgaaaatactgcttacctctgttaaagtcagcagagtcataaccattcttcaaactttatttctaataatagaaaaagtatccatttcatatcaaaagaaatttgcaattaaaatagtcaaatatatttgactattgcagaacttgtgtcaaaaacatgtatagatgttctaatatgctttatatatttaaaccagaaggtagacaattaaacagttgtttttattttttaataataatggtgagcaatgtataagacatgccctgccttaagtgatattattattggtctatttattcatttaattatacttttgtatctagttcaggaaatcataacctggagtctatgaacaggctttaagggatccatggaccaccagaaattgtacataaaattctacgtgtatgtacattttcctgggaaaatgatttgtaattttcataagattttcgtagccagcaatgtcccacaaggcattaaaaagctaatctattttttatttccccatctagatcaagactctctaataaaataaattgaagagatgattattcactttatgcaaaagaataaaatactaataaatttcatgtagttaaatctaatagcacatttagattgtgaattgcttttaaaagattcgatttgcactcaacccttcaaaattacatgtttgtaaaaaatattaaatatgttatgtagtagacagtagaaatctataagaactttccatatttgagatggactaattttaatccatattcagatattggtaatctgaactgcagctgctgaaattagtggtgcaatgagaaggacagtaaacacagtagaggggaaagcaatttcatctgaggatcgctaaaaaattttttataacaaaattatttctgtgtataaatgattatgccttatcagagaagactgaaacaaaagtataaatatttagacataattaagattgtggatttcttttagcctacatcacactgaaggaaatgaatacatagtaagaacagtgttgctgccctaatcaacatgtgtgtgtgcgtgtgtgtgcgtgtgtgcacgcatttgtaattgtgggtggaaaagggtgagtatatgcatacagcatgatgaaagcaatttctatcagaaaagaagtgtgttttaatttattccttgcctttttattgtatattgagcttagaatgtaagcagtcaagtagttaaatctgaatgcctctaaatataaaactaaaattaaatgtaggaaaaatatagtcaatggaaaatgtagcattggatctgatttcatggggccttttactgagagaaaacactcccgctgtgagttttttgtgtcatgtatggtaggatttagaaatgaagaaagcagtggcaattgtcgccaaagaaaaacaatctgtagaaaatgtccccgataataagatatgaactattgtaattctgtaaaagcataaatgtgtacttatagaaagctatagcactttaatttatttaccatataactgggtccaaagatgcttgaggaaaagaggccagtaaagttgcatgcattgtctaatcctccagctctgcaaacaacttcaaatcatgagattgtattgaccatgtaattttcacttttcttttccaaagttggcttttatatgagttatatctgttaactttggcaacatttctgttagtctttctatagtatagagattatttttgcaagagtaacatttcttcaaatgctgttgtccaggaggtctaacatataaaatcgaagatgaagataaataaataaacatttgtgtcgtcacaaccctggcaaaagcagattatctactctgaaataggacaccttcaaccagccccctaaggattctaacaaatttagataaataaaatatgaatctatataaaaaatgaaaattgatggccaggtgtggtggctcacaactgtaatcccagcactttgggaggccaaggagtgcgtattgctttgagaccagcctgagcaacatggcaaaaaacccgtctctaccaaaaatacaaaaataagctaggcatggtggcaagagattaaaatgctatgcttgatatgatgacatttaaataacttatagaagattttagtgaaagtttatttttttcctatgaagaacacatattgacctcaattttccaattttccaaataatattgttggtgaaaggagtaatttcagaatcacccctttaagacaggggtttgtataatatacctgaaggaatttagaacttaaatcactatagattacttaatatttaagaggccttaaatatgttgcgttatgtttaaaatgtttaaaatatttatattttaaaatgttaatattaatatttaaaatgttaatatttaaaggtcttaaatatgttgccttatattgccttagctttaaaataagaaccaggtattacacttcagatgtttttaggcttctggtataaaagtctacattaagagtattgatacaaatttcctctgttgttgcaataaaatttttatttcttaggtcccataaaagtatatttcgggttgcctcgtcaaagtaagtgtctgatgcttgtgaacagccctgtatgaatattttttagcaaacaacatttctaaagctcttcagctaaaagagtgtcatttagaggcaagagttttgcaggatttatacagcaagatttattttggaaacctatgtgcagcttgccaaatctaaattctcattcatgagtgcacctttggacaacattcaaaaatagaccataaaattaggccccaaatgaaaaagaaattaggctttaacttgtacatgtattaccactttctctggtatttctgatgtattataaatattttggcaatgcttctggctaaggaacactttcctgccacctgggtgaacaaaacatgtttgccactgaaattgccaaaatagaaaatgcaattaagattatatcttatatactatatatttgtttacatcttatgtgttacattaaatgacgtttgttcactcaaatctgagtttaaaaacaaacaaaagaaaaagaaaacgactttgctatctaaactttttcttttggcctggttctcaactctaacatatgctgtatagaattttaaaatgttttggaaaaagagtagctgaaactaaagcaaatgatatgaaaactctgtaaatcattttctcctcaaaagaagtttgtgttgtttacattattacattagaagcttatttatttaaccttacgtggacttgtatttaggtgaaaacaccgtgtaagtgagtgtgtgtgtgtgtgtgtgtgtgtgtgtgtgtgtgcatgcagctttccactttatttctaaggaaaaaatacagttacagaatggagagagatattagttagaggtcatctttattgatataccctgttaaggtttttattgcttagcctaatgacgtggttaccagattttttcttaagaaggctatttagttgattactaaaccacttttaaactcttggataagttaaagtaacacggtcgaacaaataaataagccaataagcctgatggaagctgtcagtatacgttttagctggaataatattgcagtattttaaagtactataatagttgcctaaaggtcttttctatggaaaatgctcttgggtattttactcccagctggtttacattagcagagttaatatccagagtatcccactcttcactgtccagacaaaattagttctgaagcatttacttggagatgatggtccaggaaaattagtattctttttttgtaagaaatatggaatagataaacattttctttctctaagataaaagtgttctaatggtcctattattggcaaatcatgtgttagttacgtcttttctccttcccactttttcacagtaactatatgaaatctctgcatttatgttcaaatttgaaaatacaattttaaatgtagaactaatcctatgggttatctagaaagttcctaccccttcatttaacaacttggactctgagagaaagagttcctcccctgtattttccatctacatggtggcaaacaataatcttgggaccccagtccagtcttctcattgtactagactttctccagaaagtatggataaataaaatctatagttaatttctaaaactcactataccagaaagattatcaagtctattctggagctggtaggacaaattcttttactaatttttactaaatagtaaaagttattgatttcagtttctgctcttttctctttctgttcctactatctggcatatgctaatacaaaatatataatttttaaaacattgtaggaaaaataaagccaaagacatgcattataaacagatgtaatcattaattcttggattatttagggttctatttgcatgactagctcagggaccttggatattagtgagggccacaggaccgcatgttgccatgtgaaaagtttgtgtaactcttggtgctaaatcagattttaagcttctgtggtatctggcataaatgttcacattgtgttcaagaatccttacattcaacatattcttaaataagcaaatatggctttatgtttgaaattattattaaggtatggcaggccaaaataaattaaaaaggacttttaaattaagcaatttaagtattatgtagttgagaagaatagacataaaagttctatataatatacacaccaagttaaacaggcgtgtaagtatacacacctcatcacaccacacacacacacacacacacacacacacacacacacacacacgcacgcattggaagagatccaggaaagagacgatcatataaaggcagaaagatctgggtccaaatcatcacagtcaaatcaaagagaatggttgaggtagtttttcaagtatttggggcagaaaaacacacatttacctcagatatttggataattgcctccactttccacttgctctggccaacgaagtcttgccacagagacagactagagattccatctcatcagccttgcagaactgagacaggaaaatggtccttgctgcccacactggctggaacaatgacaactgggcgccattctgagccatcctgaccccactctgcactaaccacagcaatgcatccattgatagcaaaacctgcctagaaattaagccttccccttcccactgagaatcaacaaattcagatcaaagaaatacgactgggctggttctccataattgtaatacacaaaagctaaaatattgagctgaaatgcatatttggttataacaaatgcagaatttagaaaatttaaagtcagaacttagtggttatttaaacaaaaactctagtaaaaatgacagctttcccaattacttctggaattttaaagtacatcaataatttgaaattgtatttttcaatgcaagttcagcgtaaattgaggtacactcaagaattttttcaaatatggccacaaaataggtaattcactcagaatgattcacattattttaaattttaagataggtcttgaaaattatctagatgaacacttcatcttacaaattcaaaacttaaaatataaggataagaagatactatgttatgcgctaatataaatttagatttttctttccctccacactagagtacagtgagaaaagctcccgtggaggatttcttcttttctgcaattaattactcccgggtctcttataatcaaactggtcagcttttggcaaactggaatttctttttttgctgcacatttagtgtgtacccatggctcccttaaaaaataatcggccaggggaggcagaggcaggagaattgcttgaacccagggggcggaggttgcagtgagctaagatcatgccactgtactccagcctgggcagtagagcgagactccatctcatctcaaataataataattataataataataatcagcctggtgcagtggctcatggctgtaatcccagcactttgggaggccaaggcgggtggatcaggaggtcaggagttcgagaccaacctgaccaatatggtgaaaccccatctctactaaaaataaaaaaattattgggtgtggtggcacatgcctgtagtcccccctgcttgggaggctgagacaggagaatcacttgaacccaggaggtggaggttgcagtaagccgagatcgtgccactgcactctagcctgggcgacagagtgagactgtctcaaaaaaacaaaacaaaacaaacaaacaaacaaaaaataacccttctaccactcagtttgattccagggagacagtaggaaagctttacagaacttagcaggccttgggagcttttagacactgcatgcatttcagtgctccatagtgattcatacatccatgcgtatttaccagataattatgccaaattaggctacaattatgccaataatgtcaaagttcaagagcaatacagataatcagagatacctacaagtctcgaagaatatgaataaatggcaattaattcatattttgaaagtaattgtgatttatgttggtaaaatactacatttttccaactcaaatctttaggctgtgaaaaggtatttatataaaatgatgaatataaaatgaaaataaagatatataattatataatttaatatataatgacagaatgtaactacatagcatgttataataaaatatatattatatgtcatataacatgtattgattatatcataaaatgatatataacatttattaaagacattgtttaccagatttaattttaaaggacaggtattgttactgtattatattcattttacacatgagaaaattgaatctaatgaggctaagttaatcactaaaggtcacaaagctactaagtggaagaacaaggtttgaatgcagacagtctaatttcaggtagaacacccagctcatggctgtagcacactataactaaaacttaattcaaatatattcaatgtgataaaataatcagtgtggaaaagctaagctgctggccttttactttcttggcaataaatgtttattctatagagtgtcactgatactgatcttgctattttatttttgctcatgttatatttatggctggcctattacaagggaaactatagtagttatttttttttcagctactcaactttacacagttataattacaatagcaaaaccaataaatgaattgtactagatggcttgaaagcttgattttataatgtgctctttggcctaaaaataggtaaatgaaattttgatgtgtgttttcctgctttttaaaataatgtataattcatacagttaaaaatagttcattcagaatatttaaatatcttagattataatgtctacacttataggattttcctataaattttaccacgtcatcctacaaaattgctgtgaggtggtagtacaaggactgttattcccatttcataggcaaaggaagtttaaaaaagaaaaaaaatatattttcaactatcagttataaagccagaatgtggccagatactagtgttccaaattcaactacatgaatatgcttttcccttcttgatgtttaatgttcccaaagacagaagtcagaccatataattttgtattgtgcatctctatcattgttggtacatggtttgtcaaattaattaggtaattccctcaaaacactctgagttattgataattccaagttaagttagagagtagagtaacattttagctcgtttaaaattagaatttcattaatagtttcccttttcagctcattttactaaataagacaaaaacaccttagcctcattgctgaaaatataaccaagaaaaaacttaacgacgtaaaatccctttcgagcagttttattacctatgatttttgtgcagtctgccatttccagtctcgtgactatgcagtgctttcttgagggagccttttgtgggcttgctttccacccagtttctggaaatttaatttggtcacaaaagtttgggcatattagaatgaaggaaactcagaaaaagcttttaccctctaaactcatcatcggtttatgaagctacagagagattttagtgcttttgaattcctacaatagcttctccaactctaattgtcactactgggattaaatgaaacatacacagagagagaaagaaatgtttaagtattctgcaactgacgcttagctaggataccccattagatcagagcagcaaggcacagttctaaatcttttctctgccagagtgcttttccatcatcatgtttaactgtacactatactctcataactgattgcagattttggcataaatccaaaaaaacctttttcccctaaaaagcacaacactattttaattgttatttgcttaatgccagctaacagtgatgatcattgtgtggacatgggaagacataagggagtggctgaggttcatgtgcattttccagggcacccctgaagagccaacaccttcacctaaaagtgcattgggatgcaagtgagtgagagttagcatgctaccaggataactttgaatccactttatcctttgggaaaaaaatgcagaaacttctgaattctcaatcttattagtagcaaattacttgtgacacaccagagtgtagagatcccttgtgtaattattcccagaatggtctaacgtccgtcactctgaagaacccacttctgagcatctgcttcctgcactcttagcgactctcaataatgagagcttgaccccgcccctccttcacacattcctgagaatttctcgagaagaaaggaactgttactgatagaaatatgtcagatcccgctgatgtgtagggtctaagcaacttggaggaccactatttgatatctttctacattgtctggtagatacagtgactaattcaaggaaatggcacccctctctggaggagtttaggaaggctcccttggtgactgttcacagcacccccttttcagacttaaaatctcaaatcacagataagcaaactctggtaaaataccaaaaactacccaaactgcgttcaaaagaaaaaaaaaagaatatatctaaaattaggattttcagttctcatcaaaaggatttaaaattttatatgcttaaaatgtcaaatgtcttacgaccttttttttactatttaccgtaaggactgaatttacaacaagcagtcagcataggcaagttttcctagtttccgtttcttctatttaaatagctatctccagggggcagtagtggctataaaatggtataattctaataataactatccttagttatgcgtaggggaatgaggtaggtgatcactctgttaattacatggttttctataacaatattgctgtattaatatacacatactgttgttaaatgattacatggttttctataacaatatttctgtattaatatacacatactgctgttaaatgatttgcatggtgtgatctaaaagctgtggcctttggtattaggtaaatcgattagatatccactttgcctacctaacctatggtcttaggctagtctattaatcactgtaagcctcaagttccatatttatgaaagagaatatgagtagttacagtccatacattgttcatggcaactttttataaacattgtcctttacttccttccctttactatgaatgtatatatcgacataagaaataaataaaatataactcaagacacagttctcacaaaacagccttaaccgttgattaactttttcaaaccattgcttcaatctatccttattacttttattcttagaagtcttcaaggcataaccatatgtttcagtagatagacttgcactctgtggaatgaaatttacaaaggatccacgagatttgtttcatttatttgttttttgaggagagacttcagttacaacgcttgctccttagaaagtcagtcactgtgtatgagggaaaggttttaattgggccacagcttgtggcatcggtcttctccctttggccccccgtcctcagtgtgtaggggaagatacctttctgtgtttattctttcaccttacccatcaaggaaatagggcaaatcccccaagtgcatggcttcctgcccctaattgggcatccacactctcccttcagccttgatctttcctcttgcaggtaaaaacagaaaaggtggagagaaaaacatggtggattcctttctccccgtctgtgcaagcctgcctccaacctggtgatcgttgacactcaccatttctgtgaaagacttttttttttttaacatattatactagatttgactaactcaatcttgtagcttctgcagttctccccacccccaacctagttcttagagtatgtttccccttttgaaacatgtaaacatactttgggcataaatattttttaaaatataactataatgcttcactaataccttaaaaatgcctagtgaactaactcagtacattatataatggccaagtgaaagttttgtgttttcatgtcctgtttttctttgaaattatatagcccagaaattagctcattatctgaaaaacgtatgaagaactgatgaattgtataatacaggagtattgccattgaatgtactgtttgatttattcaagcaggtaatgaacaatgttgtcaaactctctaatgagacatcataattaggacataagctaaaaggggcattactccggcagtctttttttcttaatcctagtaccatacatattctttggcatgaaagaatgaaaagcattagtaaacaactgaagtcctaccatggctctgtagggtttttggaacaattcctggaattggaaagtgaaaatggatagcatgtgggggaaaccctcatctgagtagcaagattttagtaaagatgactaagccattaacagcatgcattcatatttaattttattgactcctgccatcagcttttgtagatcttttgggtggaaggttgtgatttttactgggaggacttgagtagaagtggatgattaaaattgaggagtatataattctttctgggactgcttaaatgttattgtttgaaaatgccttcactttccccctttggtcaaagagatgtgcttaaaattcttattccttcacaataaataattttgattttcttagacaggtttgtgtttaggtatgagtttctcttttacttcatctagcaattctctctgtggtcagaagaactctgaagaaagctttgagggaaatgaatataactcttaaattattatatgtgtgtgtatatatatagtttaactttaaaaataatttattagtcatcataaagaaataaatgtctctggctcaagatgttacttatttccttcttttatattttctagtctcaattactgttccaaaaggagctatcttagaacttagactagagatccagattaattgccatttttgtaagatgtttaaaatcaatttgagaattttcatgtgtctgtaaacagcaccatggagacatgtatgaatcgtattaagggcatctttccatgtagtccatactgaaattatacaaccaagaccagataggaatattttttattttattttattattacacttcaagttttagggtacatgtgcacaatgtgcaggttagttacatatgtatacatgtgccatgctggtgtgctgcacccattaactcatcatttagcattaagtattttgttttttaaagaaataataaaaattctaaaggaaatcataggacagatgtgacttgtaccagaaagggaaggacaaccttaaactatatcaatatcaagtagaagaattatacaggttcatttatcttcctttagtcttgttcttatttctaactgggatctaaatttacctttatcaatatcagaggttaagaaaattaccatattcctattaaatggtagagatatttaataagattcagcttcatcttagtacaacttcaaacatcaacatgatcagaaaacattgatttatattttaaaataggatattggagccattgtcttagataattttcaaggcaagaacaagcctgcaataaataatgagactttgacattccttggcgaagaagatgtctcctgccctaatatgactgtcactcagcaatttcaattttatgtttacttgatttaaaaagggaggataaattgttctgaaaagttttttgtttccttaacatttcaaagttttcactgaaatttgttgttttggtaaaaataaacagttaactacagaatatttttacgtggtgctttgcttttaattacttactagggaattaccagtggaaaaaagaatgtcaccagtgtttttcctacttacaccagttctgcagcatgaatatttatattaaatgtatgtgctatatgaattccccaaagggtcagtagttttggggggtttatttccaactatagttgtttagaaagccagtgtttaagagggagagagcaggttagggctactatctaagtagtggcaccaactcaaatgatacgtggggtgtagtcacagctactttacatcctgtttataaattgagacacgaggatcttaatttctagtcttctatccaatttgatttatcaaaaaaatgaatcttgattattgattaagaaaatatggtcagcttactatgtgtgaatggtcatttggaaaatttatatattgttttctcactatctttcctcaaatgtctaaattcctcttcattgaatgttactacatttttaaagcagaaatgacagaactgattaactatatttctcctcatttttaaaaattagtttacatatgaatgaaaactgagtaaaaatcaaatctatattttgttcatacataggtatgtttttctaaaaacattagtaaaatccaggaaagattaccaaatatatttatagcaatcaataaagagtgggaatgtattgaatatgaatttataaatggatgatgtgtttatctttacttatctgagttaacactgaaacaaagatttaaaaaggcatgattggccaggcatgatggtacacaccagcactttgggagactgagatgggatcacataagcccaggagctcaaggccagcccaggcaacgtggtgaaacctcatctccataaaaataaaaaataaaaataaaaaataaaaaaaagctatgatcagtatgttacagtttttgtcatattttccaaaatattcacttgtatacaagtaattcatattcttcccaaaaagaaaagtcagcaacggaaacctaataacatttttgaatgtgatactgacaatgctgttttaaaaatattgtttttaggatagttgttgaaaatttggtctcatgacaaattgattaggctcagattctaactttgacatttacttgctgggtgaacgtggccattttatttaacctattcctgtctgtttcctcacctgtaaaataggaaaaataatagcacttacatcatagggttattggtaagaattataaaagatttggcagtgacttcaatataagtactcagaaaaaagcataatttttattaaaatgtacagtataaatttcccctttttgaatgactaataattttataccatgtaaattttatattgttagcagttcaagtccaaagagaacaatagtgtagacttgttgtcatccaggtaattacttggaagtcttttgcagacaggcacatttaagctgtataatctaaatttgaaaatagatgttttctcattttgagcgtgttataccagaaaaccctgtctttgatcccatctctgtactctgtcactgattagctatgtatctctgacaacagcccttatagacttcggtgtccttttgtaaaatggattatatatatatatatatatatatatatatatatatatatatatatgttttagtggactcttaaatgtatgtgatctaccttaaatattgaaatgtttctattatttgtctgtagtgcatgatttaattgtaaaaatgttgaaaacataaatttagagaaagagagtaggggtgtggcaaatgagactctgcattgaaccatgaatgacagaatgacaggagatcattcaggccgtttccccagtcctttactaggttaaaaagtgacagaaacaggtctcagtagctgttcgtaaacttgtttttagtcaactttgaagaacccccaaggtaagaaacataacactaacaaggactttgatagatcattatttttgtatgccccataggtgaaattttatggaacattctcagtcagcattctctaagaggaatttttaaagtgagagtgaaagaatataatgggtgcaaaacaagaatagtaagagagggggtcatgcaaataggaaagaaagaatagtccatagaggcagccaccatctgaagtacagaaaggtagcccaaagaagggtagcaatttgaacactatgattttgaatgggaaaataagaatcaaaaaaatcaacactgaagtttgtcctgccaactgcaatgaaagaggaattcaatcagctggataggctgagcacaattagtggtatccactcttgatgacatcctgtgagcatttgaaagaatcaggaaacagaaatagcataaatagtagggatatgatatatgagcgtaataaaatgtatttcaaaaactcgagagcatgggtagggggaggtggtgacaagagaggagtgaagataaaactgtatttataaaagcataaaacaaaaagcatgctttaaataactttttattccctcctccatattgttctttttctcctctttcacctctttctaactccccaatattaatgttagtgagaaaaatggataaaaagactttgccaggtctagtcagaaatatatttcagttctttttcccctaacttcagatctttaataattacagccaaagaaagaaaaaagaaaaacagaagacaaatttgtcatctaatgtatctaggcatttaaaatcaggtcagattccaacagtctttttcaactgaccaatttctctcttttatgttaactttggggtaaacagttctcagaatccttagctatctggctgagaacagcctaagaaactggaaggagatatcagtaaagtaatagtgaaataagctgcatgcatcaggccatttgcttacattttccctggtttcctgaaggatttattgagagcgcatggtaatggaaactaaaaaaagaaaaaaaaaaaagaaagaaagaactcagggttagaattatgtatggttgggtttttttcattgacaaaagaatcagaagagtggtcagttcttaaatgccttcctttgtgctgagaacaaagtagttttgtcattttattttctacctcaacacttttctgtccattctaaacaaaaaaaataagcaagtaacatcagcctacactgcttgaaaaccttcctgctgagagacactgcagggctggccctgggttgaagtccgaccgtccacgtttgtctccgtgctctattttttgccacaaactgattccttaatacacagagtatcttcacattcccaaattttcctcacctacatcaaaattactggaaaacattttactttctatgttgtcctataaaccaaagagtatctgagacaagtctcaagaaagtttattttgccaaggttatgaatgcacctgtgacacagcctcaggaggtcctgacgacctgttcccgaggttgctgggatacagcttggttttatgtattttagggggacatgagatatcaatcaacacatgtaagatgtacattggttccatctgggaaggtgggacaactcaaaatggggggcttccagatcagaggtagatttaaggattttctgattggcaattggttgaaagagttattaccaatagaaaagaatgtctgtattaccatacagacttgtgggtggcggaaatcaaggttttctcccgcagatgaagccttcaggtagcaagcttcagaaaatagattgtaaatgcttcttattagacttaagaagtctgttctatcaataattcccaaagggaggagggtgtaatgaggcatgtctggctgccccttcccatcacttcctgaactagtttttcaggttacttttggactgcccttgccaagaaaagggttcctttcagatggctggggggcttagaattttatttttggtttactgtccctgctttcttttaagtaataagtggtaaatgaatactctgtaaacagatccctggaatgactgacaaagtactaattaataactcctgccaggtagctaagatgctcagaaatcttttaaagaagtaatgacaataataatattgttaatagataaggtttcctgatggctttctatgtaccaggctgagaactacattctttaaggacattatttcagtcctaacaatcatctgtttttttttgttttgttttgttttgttttgttttgttttgttttgttttgaaaaggagtctcactctgtcacccaggctggagtgcagtggcgcaatcttggctcgctgcaacctctgcctcccaggttcaagcaattctcctgtctcagcctcctgaatagctgggattattaggtgtgtactgccatgccagctgatttttgtatttttcgtagagatccggtttcactatgttggccaggctgttcttgaactcctgacctcaggtaatccacctgccttggcctccaaagtgctgggattatagacgtgagttaccacacctggcctaaaaacaatcctatatgttcggtttttattactcttgttttacagatgagtaaacaggaacttaacgattttaagaaacttgcccaagataaatcagggcacagaactgaaagctgagtctatcttaattctaaaatccctgttttttaatacaattatgattttaatagtattatttttctcaggcatttttggggagatatttgtaggcaattactagatggaaaaatctacttcatatcagtggaaccattaccgagtaaaattcccacaccagggttttgaagataccaacacacccctttccatttgtcttctcgattccacctcttcatgatgatatagtatttcaagacaattggaaaaatgaagactgtattgtggatgacaattatgtttacagaactgcctgaacattaattataataaatttatttatctatacaccaaatatttatgaagaacctaccataggccagacatgtatccgagaaaacaatggacaagtataattatagtgttttgctcaacaatattacccttaaatgagtggatgactgaattattatgcatataatgtctcaacaaatacactaataatatgcagctttattctgacctttatgaaatattactcatttgacacctcaagaacatcagagaataacagcagggaaatgatttacattttaatggttaatgactaacctatgataattttgtcttaaattccctttaacgttttctgaatgccatacccctatgctcagaaaaagtaactgaatgcatgcattacagggctttttcttcatttgagaaattcttttattattcacctctaattttttattttaacactctgaaatattctacttagtaattgacttaggatgctgcattatgtgaagtaatgaacttcttggttctgatcaagaatgtacactgtatttcaatgtgttttcttacatatgaaaaatgcaatatgttctctctgaatatcaaatgtgttctgttatgtgtctattttcaattatttaacattaagaagtctaagtatactattataggttacaaatttataaaagttcgcttgcttttcttatatgtgatatatttccaaataataaaatttactgtcatggatagggtatgtgtcttgtgttattttaacattggtggtgatgtgtttttgttgatctgcacacactttctttcttgggaccactttaaggaaatgggtgaaggtttggggtgttggccatacctctgcaaataccaatgttcttataaagaaaaaggccatctaagctaagcaacccaactgatatataaatataaaggtatatatttcagctgaaagataaagacaaatgtcctctttagtattacattaattatgaaaaatgatggtgctacttaataaaaattattaattattatattaaatatgcctaaatcaattgggggtggactcctttctggtgcaaatagaacaagtgatatgtatgtttagttataaacattctgaaatgtctatactaggagctgtctattaactgagagacttctttagcttttgaagtgatagatgccacttcaccacttaaaggacatttttctcttatttttatttgtcttatttgaagacaaaaagctcttcaaagcccaaaaagttgtgtctcacttatcttttaatttctatttcccagcacagtgcactgttgaaaggaaaaaggaatcatattggtactgagttatgaagcatctatgaaaacctatttttaacattgttttttgttctgccagaacaattcttctaagactcttcaatataatttgaggttttaagagcattcctggtatatctctgaattgacaattattttctatatattatataagtagaaacatttttaatattacttattcttatgactataactaacatgaaatgtattatgcaaaatgatacatgaaattattcccagaaatttccacttcaagtaaaatgaattacctataacatttagagttataagaaagtatgtgggccagtgcggtggttcacacctgtagtcccaacactttggaatgcctaggcatgaggatcacttgagcccagaacttggagaccagcctggacaacacggtgaaacccagtctctgcaaaagagtacacacatgcacacaaaaattagttgggtgttgtggagtgcttgtagtcccagctacttgggcggctgagctgggaggatctcttgagctggggaggcagggagaggctgcagtgagccatgatcatccccactgcactccagcctgggtgacagagtgagaccctaactcaaaaaaaaaaaaaaaaagccacaaagaacaaagaggatgtgttcagttctggggaggcagaatgacaatagaccaaatgttcccatatctaaactgaattgtgctaccatctgattcatgcattcagcaagaattcattaaatcatgctatgctacaatctgttaggtccccttggtgccaattgcatataatgagtcagagattactatatctgcataacaatgtcatttttaaatgatagcatttatccccttccttaaaaagagatacatgaaatcattcagtgaaaactacaaatgatatcacttcttataatctatatttaaaagaaatgcagacacactgattatattggacaaatgttctttagattaatggttagaagacatttttatattctaatgtgtgtttgactcactagatggaattcactgattcattacccacattttcatttcaggccctccaggccctccaggtggtctgagaatagaagacattagagccacttctgtggcacttacttggagccgtggttcagacaatcatagtcctatttctaaatacactatccagaccaagactattctttcagatgactggaaagatgcaaagacaggtgagttttatttgtctgattaatccgtgcatgttttcaaagtgaattcttttctcaaaaacaaaaatttggaggttttaaaaatgtcattatctaccttgaaaggctttctttcttaaattttttaaaatgtattctaatattttggtaatgaagaaaattacatagaatttacacatttaaatgtgttaaagctatagaaaaagaagtatcatttctaaatcaatatataatggaaagcaaaatgaggcctcctgggtttcttacttgagttttgtgtgagatttactgccccaaaatcatcgggaagtctatttttgagcaaatagcatttatagcatattatttatgaccctttttatttgggtatatatgtactatagttctgaatttctaaaaaaccacattgatcataaatcttaaattaagcatccaaatcttactactataaccctttatgtgaatgatctcacccggtttgaatttcctcaaaacagatttttaaagacattttggatctttcaacctttttcttttcttatattaagattttctaaagttgatcgggaaaaattaactaagaataagtgggtactttcctttgtctacaactttgccatttgtcatgactagcctacaatatcacacattaatacatatattttctcctgtaaaatggaagattgaagacctttttgataaaataacctgtttatctttgtaacttttgacaatatttttaaacaaacttgtcattgccagaattctttaagatggaaaagaggagacatagaaatattttcccagttgtcacaagaggagaaatgagacacgagtgtgtgaataaaatgttcctcctttttaaaaaactaaaaaaaaaaaaaatactctaatctcccaaatctgctttcattttagatttatcttaacataatggaaatcccatttccaaaatgccaatatttgtattgctcactaagatattttaatttaaatttacttctatttgatacttctctccctccagggaaataaatcaaatataaacttgaggtctgttgcaaggatttaggatatattttaatatcagatgattccccacctaagtgtataaagttgcaataaattagaaataggtgaaatatttccattacattatgcttattgttttaagaattatctgtaaatattcttgacaaaatcagatcatctgaaaaataattttaaaaaccttttagatactttataaacctaaagcatgggcagtttctacttttctgaagagaatggaaaagtatgataataatgaaactattagaaatctagccacattaaaataaataaatggtttaaatttggtttggccctgaaaaaagaaatactaattgcaatcattttcattatttatgtatgcttactatgtagctcaatttaaatatgcttcttattttaaaatatccactagaaagtaagttccatgaaggtaaaaactgttttattcactgttctatctctagcacctatatcagggcccacagtgctcattcattaaacatgtttattgagtccccactgtgtgccagaacctattctagatgcagtatgtataggtgagtagcagtgaacataataacaacaataaaacctgtcttcaaggagcttatattatagtagaagagatgccaatacagaattaaaatatatagtaagtcatgtggtgatgaatgctagagagaaacaacagaaaagaggaatggggaagtaggagatgtgttttaaatagggtatttctcatattctcactcataggtgggaattgaataatgagaacacttggacacagggtggggaacatcacacaccggggcctgtcttggggtggggggaggggggaggatagcattaggagatatacctaatgtaaatgatgagttaatgggtgcagtaaaccaacatggcacatgtatacatatgtaacaaacctgcacattgtgcacatgtaccctagaacttaaagtataataaaataaataaataagtaaatagggtacttctgatattagtaatagccactgctgctttctgaaagttcctatttccattatatatcttttccaattcttctactttcattgaatttgggtctttgaatctaaagtatgttttctgttggccacatatagttggatttttcatccagtttgatagtctctgccttttgattgaattaatcaattaacatttaatgttattattgatacagttggattgtagctgcattgtatttttgctttctaaatattttactatttttgttcctcttttccttgttcactgctttcttttggaagaagtgagcattttctagtgtaacattttaattcctttgatgatattcaccgtgtgtgtgtgtgtgtgtgtgtgtgagtgtatgtgtgtatgtgtgtatatgtataatcctgctctgaagggaagtttatattcactatacatgtgtatattcaaacacatacatacttaatgaatactctagggcttaccagatacatttgaatttatcagaataggttttataattttattagcttaaattttcagtgaatatgaaagtgtttctcctacatagttctatttcattcttcctcttttgtgctattacagtactatatatatatactatatattatattactatatattaatagcatatatagtaatatagttatatattactataatactgtatattaatattttgttatatatgctattatagcatattttattatatgctattatagcatattttattatatgctattatagcatattttattatatgctgtgtcatatatagtaatatatatattgctataatagcatataatatatgatattaatatttagtaatatattattaaatatattactcacacacagaggattaaatatattacgcacaaaagaggaagatgaaataaagctatctaggggaaacacttttatactcagtgaaatatatataaatatatatattacatctctatatgtcacaaacccaataatcttatattaatattatcactttctataaatgtttgcctattaaaccaatatgtttatattatcctttgttaatttgtctgttatattatcctttatatttactacttctaatcctcctcacttgttcatgttgatttgaatttcatctgtctaagtctattttgcattgctataaagaaatatctgaggccgggtgattttgaaagaaaagagttttatttggctcacagttctgcaggatatacaagaatcatagtgccagcatctgctccttgcgagggcttcaggaagctttcattcatggtgaaagcaaattggcttgtcacatggtgagagagggagcaacaaagagagaagcaaggtgctaggctcttcgtaacaatcagttcttgcatgagctaataaagcaagaactcactcattattggaagaaaggcacaaagtcattcattgggaatccacccccatgacccaaactcctcttattaggccccacctccaatattggggatcaaatttcaacatgagatttagagtggacaaatataccaactatgtatcaccatctgatatgatttctttacaactttgctcctacctgtcccctttgtgcagctagtatcaaatatattacatttaaatatattatagatccaataagacaattatatatatacatgcatatataaatgcacaacatatgtgtgaatatatatacatacatatatagttttctacaattacttttaaataagttaagagaagatagaagaaaaaataagtatttatatcatcttttataattacaaaattacctttaccaatgctcattattttgggggagtttattcaaattgctgtttgggatcaactactttcaacttgaagaactttaattttgttttgtaagataagtcttttactaacagtttctctcagtttttgtttatctaggagtgcattttgcctttggttttaaaatatatttgcttggatatgatattcttggttgacagtttttgtttttcttttctttttcactgctttgaatatgtcatcttagatgccttttttaggctgagaagattgttttctattctatttgctgaaaagtgtctcaaaatccctttatatttaccagtatatttattatatctgggttcctcattcctttctgtaaaactctttttttatctggtataatttgcattactaagaaacttatagcatttcaaattgttcaggttgttggactcaaaggtttttacattttttctatcagaaaatgtctttaatttcatctttaagtattatttttatttcatacaaaatccaaattgctcttcattttactttgatcactttaaaaacattgttctgttgtcttttgtctccattgttttgggtgagaagtcagttattgttttaatcataattccctgcacttgatatgtcccttttatgtgactgcttcaagatttctttttgtatttgcttttcagcttgataaaatgcatttatcctaatggagcttggcttcttgtattcttaggttgatattttcttcaactttggaaaattcttagccattcattacctcttgaaatatttcctctgctctactctctcttcttggtttctcttgacacatatgttagattgtttgatgttgttccacagataatggacagtgtgtgtgtgtctgtgtgtgtgtgtgtgcacgcacgcatgtgtctgtttatctgcgtgtctgtgtttctgtatggataatggctaatttcctctcttgcttacatagataatttattttgttggattcggtctgtgaataatcccattaaaatacttttgaccttctgctttattgtgttcaggaatttttatttctagcatttggctgcttttaatattgttcacataatattccatgggaatttcctatttgtttatacaagttgtgcatgttttccacttgacatttttacatacttaacatagttatgctaaaaccctatgagatgatttaaacatctagaccatcttaaagtctagctctgttgatttattttttctttcttgacagtgggtcatatttctttgtttgctcatgtgtctgataactttttgctcaattccaaacattgtgtatagaagaacagtgattactaaagtaaatattaattgatgtctgggaaagtgcatgtcattactttagggactgagtcaatcagatttgtagttgagatgatctgagcattgttagattcagtttagcacaggcttcaagtaattcgaatgtatgatcagacctcctacatatctgagtgtctggaggttttcctgtcctgctatcagatttcggcagactcttctacgttggaccccacagagggctctttcagttcccctgcttctgcccagatacctgctgctgataatcagtctaaagcccagagtgctcgggctttttactcagttctccttctcttcccttagacttcaacaggtccaaagcacctgtccctcacggggaagcagatctctctcagcactcctgccactatctcatgtttgtggtatcggtgccgcagagggaagtcttttttggctcttttgttctgccccaaaactttcttgagtacacatgatgaaggcctatgaaaaataattgtcaaattactatagattctccttgttctttgatctccccacgtttttaaacagccataccagcctatactttgtctgtaaatatctgttagaagttaaactgttttcttcttgctaacatctgtgactacaaccttctttcatcactgttctaccaatgatgaattttagtccattgtgtcttcacaaactcagctctctaatgggctttgaaagatggtggtttatagattatctatgtgttgtttttgttagtgtactagtgaagttctcttgtgactgcatcctaagtggaagtgaaaaatattttctgcaacaaatacagaaataaaaatcatatggtttttatttataatgtgaccactaggaaacaaaggtacaggattaaattcagcttcatgaaggtaaatacttaagatatgaaataaatatgtttcaaagatatcaattttcagtgttccaaagattaaatttagaataatgagatgaagaaatagactatgtacttttaaggcaatctattgtaaattttacttctcttggactgtttttagcagatggacagcagacagcttgatgctgttcctggagttgtacaagatgctcaggtcgttgttagaaaattgtgtttgattctatgctgttgttttcagaggacaaatgatagaatattgttagtgatggtgtgtgtgtatgtaagaagatgttggccagaacatgaagaggcatagtaaccatgctatgagaaatagttaagagaacctggaatagattatccaacatgaagaaaatatgtttatatttaaatttctgtgttatgtaagactgagttgattattaaaatttttctgcagttaacatctttgcacataaatgtttctctatactttagattatttccctaaaatagatatttgtaaattaaattgttgagtgtaaacagccaaaacccatgagctgtattatataatcgctctgcaataaagtagaaccagtttttattcccatcatcagtatttgagtatctcttctgccatatctttacctagtattagtattatctttttaaaaatgaaaactctctaggtttattgtaggacagtatcctttttttttttttgcctttctgtttcttcagtttttgtagttctcatttcaaacatgaatttctagatttttatgaggctacattcgtatttcccttagagaaggatcaaggattcacaccttctgagatgccagaacacagcttgctttacttttgcttcatggaaatttgcctaacctatggctccttccagagtcctgccaggcgatccatgggttgggtctaggacctgtaacataagactgagtaggtgcgttagaaccagtgagaagcctttaaattctcatttccagtctcaaacagacacctgaatttttatttagaatctctgagtgagtaggtttgttctgcgtacttacaaatatttgggttttagattgaaatgggggacatcaaagattctgcttgtgttcggatcttaaagaaataccaggactcactcaggtaacttgtaaaagtctacaatggaggggcttacattggctggagttattcttgacacaatctgttttttagtcctgaagtcattctggctgtttccaaagctgctcaaacaattaatcagtgtgctctaaaggcagggtaccacgagcatgatttccaggcaactaaaacacaatgaattattggtcttatgatacccatgaggcttgattctcttttcctcaaagaatggtggaaacttctttttattctaagccttagggcctcaaggcatttgtaaatagatctttgaattattgcttacagctggttgctaaactgagtactttggcctaagtactaaagtaagaactaaggtctcctgctttatatctctttgcttaaaatttacactaaaagtaaaacaaatttttaaagaactacccatttaatacacaaagtttagttttttttaaaagagagatgcctctaacaggcattatactgttaagatctgatttttcactgctgagattaactgtattgcctgactcagaactgacccggttaaaaatcaggtctagaacaaggtctgctcctgatccatccccagtatttgcctccattatgcaaagtactttactctctttctggctccaagaataacaaacaggttgcaaggaacttggctgaagaaaaaggacacaaagtctctccgttcctgtttctcttcatttggcttgaggcataaatctgcttccaaagcaaagctgacttctttagggagcaggcctctgctcccaaactgcataggtgattttggaagcagtaaaaaaagaagaaagagaagaagagaaaaggatccaatagttcctaccagggcttaaggaataggaaagaagattgcattaggtacaagtccatttatgaagacatttagggctcacaataaaacatataaaatgtgttttaaaagtaaaaccatgtttttaaaaagcatacaaagcggcagtggaagagataaatgagaatcaactcacaattgaagggaaaggaagaggccttaagaagatagagtagtactatctgctttagacaggacaggacaatttatgggctgaatacatgacaatatagagtcatggagtgatggatattatgtggtggggcaaggtaaaacagtgccctccttctcttacctgcctgattcaaggatggagaagacactaaagtgattgatatagacaaagctatgcttcttgcattgagacactgtccactctaaatagacacaaactttagaatttgtattacatatatattttaagcaaaaatgtattaagtacttctatttgtaaaacatcatgctgggcatactaggccctgaggggtttcaaaacatgaataaaaagtagaagaaatgtatacatggccacaaatgatagctaggaacaagcaagggggagacagaagaagtatattgagtgtgggcctcatgtggacctagccagtcttggagttccatttgtagtgatgatatgggctacttagctcaagataagagctgggaaaatagacagaaagtgttttaaattatgtacttctgatgtggttggggtcagaagtgccaccgagatttgcagaagtgaaagcagcttagagagaagagacacttttaattcttggtacatcttttaaaaatgatagacgttaatcatgtttttgctaaattattcctactacttacatagatggttttattgaggggatattataactatctaccaaaacatgtttgttttagatatttgtattctcgtaggtactgatgttaatataaattatcaagaagaagaataattgggtttgttctaaaaagaagagttgtcaagctattagtaatcctggtgggaatactatttttaaatatttacagcaaattccttccttaataattcagaatgtccattctggaattccatccccttaacttgcacttcgttttccccctttgagagagttttatgcgtctttggaccaaggggttcttcctagggtccacctgcttgaggtcatgactctgagtctggttgcttattcttcctttcttcatctcactcgttaaaatcaaagccttggctcctcagctggaatccagatctagcataaaatgactcctgttgacttttcttgccttacctaccatcattccttcacatatttttggtggtcaactatgatcttctactttatgaaaatgtcttccatttgtttgggatattttcatactggatcctcacactttttatatgcactcaaaatcagtcaatcaactgcagcttctccacacatccacctggttcttctttgtctgtcctagcagatacctgcccttacctgttgacctcccagcttcctggaaaagccccagtgtagccttgactatcataagaacacaatatcctcattctttaaaatgcttccaacatttccatccttaaaacccttaaattgtgctggagttttgggactaggaagcaggggagcaggtcagactgcctcaagcctcctaaaacacttttgtactgtacacccctcaacccctgccaaactcaagaattataaactcacaaatagctccatcagcttctgcctttaaggttcagtattagttttctagggttgccaacaaattaacataaacttgttagcctaaaacaacagaaatttactctctcatagtttggagaccaaaatcaaggtggtggcagggctgcatcctctccaaaggctccattccttgcttctttcagcttctgatggctccacatatcccttggcttgtggctacatcactttcatatctaccttggtggtctcatggccttctgctcttctaggtgtgactcttctctgtgtctttcttttataaagacatttgtcattggatttagagcccacctagaaaatttaggataatcctaccctaagattcttaacacttacaaccttaatttgagggtctgccaagcctttttttttttccatataagataacatttacaggttctggtaatttggacatggacattttttgggtggagaaaggtaccatttaacccaatacagcctgttttctataaggggttaaaatcattgaaaagtgtccagtaaaaaagggctaccttggccgggtatggtggctcacgcctgtaatcccaggactttgggaggccaaggtgggtggatcacgaggtcaggagatcgagaccatcctggctaacacggtgaaatgccgtctctactacaaatacaaaaattagccgggcctggtggcataagcctgtagtcccagctactcgggaggctgaggcaggagaatggcgtgaacccaggaggcagagcttgcagtaagcagagatcacgcaactgcactccagcctgggtgacagagtgagactccgtctcaaaacaaacaaacaaacaaacaaacaaaaaggctaccttactcagcgttatcagttatcacttcactctgtaaacagcccttcacaaaccaaaacttcactttacttctttcaattacctagaaaaatgtccttatgcatgtgaattaaaacaaacagtttccgatttggtgtgagggaggagtgaaagaggagataaagaggtagaaatccttaatgaatcttaataaatcaaaacagaggcgaaggtaaagggaaacttttaatcagaaagtcaaaaatatatgtcaaatctacagaacaaatccataacaaaataagaaattagatggcaaaagtagtgtctagcagagttaaaattatggcagggtgagatgggacagtctgagccatgcgagaatttgtccaaaagtagaaactggaccctggggtgcttagcatttattgtgttgatggacacgtcatctttaaaaattatgtattcatggtctacattgccagataaaacttccctaaatgataagatattgcgtcatagacaagcctacaggtacaggtatttatatggataggttgattattaaaaactcgtggaaatatttgaggcaagcttataataatgcacagatctaccttggttgcatgttttattatacctcaattaaataagcaagctaagatcacattccacccataatttatcatctaatctatattagtatctagtagcatgaattctgagggatacttaacaaatcttaataaaattattatgacatttattatcacttgtccaaatgatttgagtataaatctataaaaccaagtaaaaaggatataaacattaaccttttctacctagttataaatcgtttgctagccatagactatatcagtggcaatacataaaattttgctgctccaattgtacctttatctcaggaaatctttttagattgcaccttcagaatacagctccttgctattcaaggtgcagctcatggactagcaccaagcctggaggcttgttagacatgcagaattgcagactccctgcctcaaacttacttacataggtgattcatatgcatatcactctttgtaagtttattatttattaaacctcttctcttactcccttgaatttaacattttgtcattcctagttgtagtttttacttcaactcagtgtaatatataccattctccctgaaatagtaaaataaaaagggaagttataaaagtgataagttaatcaacctgtattctctatttactatttattttattcagatcccccaattattgaaggaaatatggaggcagcaagagcagtggacttaatcccatggatggagtatgaattccgcgtggtagcaaccaatacactgggtagaggagagcccagtataccatctaacagaattaaaacagacggtgctggtatgtatatacaagaaacttgaaattttaaaagatttgtaaatacagtgccactttcatatatggttgaatgtatttgaaaataatgctctgaggtaagtgattcatctgaaaagcatgtgtgtgtatttcactatcaagacagtcaaaaatcaaaagaggaaatatgaagtttaagaatattttaagacagtcaaaaatcaaaagaggaaatatgaagtttaagaatatattaattaagaattaatatagaggaagaggtgaataggaactactgaaaatgccactggagaccattggaatgacgtaagtatttagattataaactttaatgtaaattctgaatcttaactaggcagactcttgcttgattaaacatgtttcatgatttagaaggttcataattctgtgtctctctcgaactcatttataactgaatggccaagtcggtggatattttatggtaaataccaactgcaattaaatagtgccaaaattttaggtttgatattacttggaaataattttttcctaacatttaaggataagtagacatcatggtaaatattcttcagagttacatgcgaaccactgatagtgagcatatcacttctagatatgatcttaagtattcagagtccagagtgttcaccattaccccgtggaaccagctctagatatgatcttaagtataaattatattcagacatttaggtatgaaagaattagattgaatctctccgagacattgtttttgttattattattcttaaaaaatatttaatgttgtcacttctactttgagattaaaaaataatttaagacagatcttatggtaatcatgtctagatgatgagcctatatattgtaaagaaatcattttctgagataaataatacagataatatttgcaacaaaattccaagaaagaaggagggaggcctacatctattatcagtgtcaaagaaagtatcctttctctctgacgatttttacttcaaagaatggtgttcagctaagacttaggtcatattgtattagtcaagaaatcacagaaaattaattaaactccatgattaaaggtctgtatttgagataggtaagtaaaaatattttacctgagatgtttgtttagaccaatttaatcacttagtatttttctgcaattttagtgaatgcttgttaaatcaaatcaaatacatgatctgtcagtataaaattacataggtaaaccaccagtggaatcatgccacagtttctttatatttttgtttttaaagaaagagcaacagtgttcggtccataatacagaagcctctattacaaacatatgcagctctagggaataataataaaaaccaaacacaagaatcctggctatgtggtatctgtctcctataaagcttcatcttagattacctacatatcctgatgaaatttctgtgaggtagagaaaagcaaacactagtgttcattttgtaggtggatatgctaacacaaaaaatttagtgtttaggtcatatctagtatcatagttaaggttgaaatctaagtttctattagaactctaataaagattcatataaatagatgtgtttctagaatcctgcttgagaagccgactttgagaaaactcaatgtgtgagaacagctgtcagatctaaatttgaattctgaatcttgcaattagtcatattaacttagataaactatttagtgtctctgagtttattgcccattaatgaacatgagcataggactacctatgtcaaaatgttattatgaggattaaatgaaatggatgtgaaaatattgaacatagaccaagtattttagtgctttggccccttaatttcagaattatccttttttatctaataaattacattaaattacatgaaactttaagagatagtttacttatagcagtccctgtttaaagacattagaactcataactatatttagaagttaggccaaggaactgaggtaaacagaaatgtagagaagtgatattaagagatcacagtagcattttaatggaactctgccattcatttaaaatcttctctacaccatctaaaacactgaagtttggcaagtcctagtcaaatgagctcagagaggctacattttttttttgatatagggaataataaaagaagagctatcattagaatcagaacaacatttttccttagtgatataggggagaaggaaaaaataatagagtatttcctgctctaaaggcacagttgttactttaaaccaacttatttttgtcatcaccttctttaggcatcacctcttacattttctcaaatggtattttgttaaggacttagttccccatctgatgtgcttacaaaataacttcccttacaagccattagagccaaggccaaaagcaaacacacctattcacagagtaagatacaaccttgtagtgatatgagatgattcattcttctcaattgtaaaaaaaaaattaattctgtaacttctaacacatttgttaatctatcatcagaaaatattttgagatctttgattaataaactcattactatagtttacacatttgcagtatattgtcagacacagtgcttagttctctgtttgcattgcttaagttaattcccacaataactttatgaaacagatgaggaagttaagattacacccagctaatgtgaggcagagctgggattcaaatctaggtgtttctcatctaaaggctttgctcctaaaccactttctgaagacagtgggcagtattgtggctccgggccactgatcctttggtggaatgcccgcattattatctaaaagctatgtaatttgaggcacattacttaacctctgagcctcacttttttttttttttagacagttcagtggctctttttttggagtgcagtggcacaatcacagctcactgcagcctcgacctccaggtctcaagctaccctactgcctcagccatcctagtagctcggattacaggggcttgtcaccacgcccagctattttgtgtgttttttggtagagactgggtttctccatgttgcccagctgatcttgaactcctgggctgatgcaatccacccaccttggcctcccaaagtgttgggattacaggcatgagccaccgggtctggcctgagtctcacttttttcatttctaaatgggaatcatttatcttaagggatgatttttatgtttacaaacatattaggaaagcagttagcactgcactgcatagtatttgctcaataaaatttatttattatgctattaaatgtcctttaaaaatttaatatgcttacaagaaaatatggtctcctgtctactttgtaatggattacccatttagcaatacatttccaatttttataagcatagaagaaagatcatataattttatgtaattttcaataatcttttaaaagtcattttatgtatttgatataaaattctacagaatttctctactgttttgccatttacttgctttattaaaattgaatatgcatcaaattggacatttacatttttcatttttataagaaaataaaaatactttctaaatgagggatgtttgtcttgtcgtgtaccattataacaactctctaagagatgccagcatatgctatgtgggacaaaggctggttcccatttgatggaaaggttggtccccagcctcattatgctgattgaaagacatgacattatccaatgccacacatgcccttatctgtccaattacttaatgttaagatctcagcgcacacttgggtgcattctttggattcagacacgtgcattataaaatggatgctcccaaatgaaaaattagaagatgtatttgtaattcattttaacccatttaattttgactgtagaaaagagataacaaaagtaccctttgaaataatgtgtcattgtaagacatgcccccatggctaatagctctgcaggttcagttggtgagtccacatcctaaaatggtacattcaggtttgttttaacagctttctttattagccagatcaagccagtcaaagaaaggaaagagaaaaaagaataaaaccaggaacaacactttcatattatgtataaagccttgatttcatgcctaatgaaggtctgttgttctttcatttagtattctttctcattctttcttttttctttctctttttcacacatatttgataaaagagaagaatagaactaagaaaatattttatagctggtaaggtactatgtgatgttagttgctgtcattaatacttaaatagataaatctttaaaagaagcaaagaggatagatttttaagccatctgaagacctgaattaaagatggcagcttctccacatgtaagcagtataatctgggcaagttaattagtgtattcgggacacatttgcctttcctattaagagaggggataatgccaattctccatgatgctgatctgggtatccaattagatgaagtatatgaaaataacttctaagttctagatgtgtgtattattaagctgagatcattcattcagcaaacttttatatttaacatatcgaattaaaactagttgtacatatttattttttaccactatgagaaaatcatatccagtactggaatctgattttattcatattgttatctttagtgcttcacacaacacaatgtccatagttggtactcaaaaatatttgtagaagataaaaaggagaaaccaggagggtaagatgatgattggggctattggaagttaattgaggatgatgaaaaaaaaaggagtgatcaaggcaacaatagatttgcatattataatttagaagaatctattgccaaatacattgtgttttgatgattgaaaacaagtttaacatatacattcgatgctattgtccatatactgatgaaagaagaaagcggtcattttttaacttaatttaaacaaatagtctgtaactggtttggattcttcataagaattttactgtggataattataattttaatgtaaagaattcttttctgcccatccaaacattttccccaactgacttattcttagattatcatttcattgtgcaactaaaaactcattctgcttcacctatttaaatttcttgtttgaaaacaaggcctataacaataaacaaacctacaatttctatctgatgagacataactatctgtgaccctctatctttttaagctacaatgggaacatcattttaacatggtggattatattaggggtgttagcaatccactcctctatcagagcaagcgctcagaagagttgcaaagaactattctcattttaatattaaaatattatatagttcatttgatttttttgatagctcttcagaattatatacttaagtgcttaaagtataataaaaaagaatgtatgtataaatatagaattaatgcaggtgttagacttcagtccttttggttttccaaactagagcactatttacataaccatgttgaatctcttactaaaaaaattgtattaaatcaccatgaaattccaatgcaagttaaagtaaaaagttacattcatgattaacttttcatctgtaaaaatgactgtataagttaaagttataattaacaagaattaaagtagtcaatatgttttcaatcaagagcttatcttcatatactttataatttttataatttaggatttgtcacaagccaatttgtacattcttaaataaaacatcaaagcccaaagagatacttatatgcaaattatttaagcattgagatctgaaaggaaaattggcagcattaatttcttttcatgggaaagaatagtcatggcattggcttgattttctttaaaaaaaatttttagatctatgactgaaatacagaagcactcttataagcatcataagggaattactattaaatagaaattaagacaaaaggacaagttaaagcagctcactatttttaaccgttcacagtaaaattatacatgttattaataaatgattaataattcaataatttttctgaatagtttaaattctttttaatgatttattgtgtaaagaatgtctagtttgtttcctgttaagtgcactggagcctaaacttaagcttccttgtacttagggtgatttacttccctgaaacaaatcatgctttggccaagtccccatttctgcagggctgagtgcaaatagagcacctaactcctctattctcagattcatgttaaatatgtaggttttgtgtcaattccacctgtgaaaaactttttctaatatgctaaggctacaattgaacattcaaagctaaatgagagaaattaaatcaataatccaagtaagatataaaaacactttattaagagaagcagttactgttcttctgtgctttttttttttttttttttttgagacagcatcttgctctgtcgcccaggctggagtgcagtggcaggatctcggctcacagcaagctctgcctcccaggttcacgccattctcctgcctcagccttccaagtagctgggactacaggcgctcaccaccacgcccagctagttttgtttttgtatttttagtagagatggggtttcactgtgttagccagggtggtcttgatctcctgacctcgtgatccgcccgcctcagcctcccaaagtgctagattacagatgtgagctaccatgtccggcctattctgtgcttttgtttatgtcccattttccatggactgagctcagtgaatgatctctgaagagcaaatcagtcttgaaaatatattacaaagtgcttaaaagaaacatgataaaatggaaagagatattcaatctaatttaaacatactccatttttaggtctgttccaaataaaaaggctaatattgcttataatgaaaaacatttcagtaaaatgctttaacaaataatacttgtcctaaggaaggcaatatttgattcaacaaattgcagtataatattttagagttatttttgaaattatttgcctgtgactactatacttgtacttaaacacccttattgtttgattataggacaacttactttttgttttcctatagcatgaaaagttttaacttcagaatatgagttataggggtaaaagagttcctagaagttattttaatactccagctcttaatatatattatatctaaagtgctacaaattattttttaaccctgtgtagtcagtttcattttctaacagtcatgtaatcacagttgaatagtaaaataaaatctctcaaacttcatattattaataatttctctatggggaaacaaaataatcatatagttttatttttttttaattttaagttaagaggtacatgtgcaggtttattatataatgtaaacttctgtcatgggggttagttgtacagattattttgttaactaggtattaagcatagtacccattagttgtttttcctgattctctcccaacttccaccctctactcttcaatatgccccagtatgtgttgttcccttttatgtgtccaggtgttctcatcatttagcctccacttataagtgagagcatgcagtatttggttttctgttcttgcactaatttgctaaggataatgacttcctgctccatccatgtccctgcaaagtacatggtcttgttcttttttatggctgcatagtattccatggtgtatatgtaccacattttctttatgcagtctatcactgatgggcatttaggctgattccatgtcattgctattgtgaatagtgctgcaatgaatactcatgcatgggtctttagaatagagcaatttgtattcttttgggtatatactcagtaattggattgctaggtcgaatagtatttatgttttcaggtctttcaggaactgacacactgtcttccacaatagtgtataagtgttccctttttctccacaactttgccagcatctgttattttttgactttttaataatatccattctgactaatgtgagatagtatctcattatggttttgatttgcctttctctaatgatcattatgtggagcttttttcatatgattgttggccatatgtgtgtcttcttttgaaaagtgtctattcatgacctttgcccactttttaatggggttgttttttcttgtaaatttaaattctttatagctgctggatattaattagacttttgtcagatgattagtttgcaaaatttttttcccattctctaggttgtctgttcactctgttgtagtttcctttgctgtgcagaagctctttagtttaattagatctaatttgccaatttttgctattgttacaattgcttttggcatcttcatcatgaaatctttgcccattcctatcttctgaaatctttgcccattcctatgtcctgactggtattgcctaagttgtcctccagggtttttatagtttgagattttacatttatgtcttcaattcatcttgagttcattttcatatatggtgtaaggaaggggtccaatttcaatcttctgcatatggcttgccagttatcccaacaccatttattgaatacggtgtcctatccccatttcttgtttttgtcagctttttcaaaaatcagatagctgtaagtgtgtgaccttatttctgggttctctattctgtttcattggtctatgtgtctgtttttatgtaccagtaccatgttttttttgattaccgtagccctgtagaataaagttgggcagtgtgatgcctccagctttgtcctttttacttagggtttgctttggctatttgggcttttattttattttatttttttggttccatgtgaattttaaaagagtcttttctagttctgtgaagaatctcaatggtaatttaataggaatagcattgaatctataaattgctttgggcagtatggccatttttatagtattgatgctttctatccacgagcatggaatgtttttccatttgtttgtatcatctctgatttgtttgagcagtggtttgtagttctccttgtagagatattcatctccctagttgtctgcattcctaggtattttattctttttgtggaaattataaattggattgcattcctcatttggttcttggcatgactgttgttggtgtataggaatgctagagattttcccacattgattttgtatcttgagactttgctgaagttgtttatcagcttaagaagcttttgggctgagactatagggtttctttttttttttttttttttttgagatggagtcttgctctgttgcccaggctggagtgcagtggtgcaatctccgctcactgcaacctctgcctcccggtttaacgccattctcctgcctcggcctcctgagtagctgggaccacaggtgcctaccaccacgctcggctaattctttgtatttttagtagagatggggtttcaccatgttagccagtgtggtctcgatctcctgacctcgtgatccgcctgcctcggcctcccaaagtgctgggattacaggcatgagctgctgcacctggctatgggttttctacatataggatcatgtcatctgcaaactgatatggcttgacatcctctcttcctatgtgtatgtcctttatttctcttgcctgattgccctggctaggacttccaatactgtgttgaccaggagaagtgagagatggtatcctggtcttgtgccagttttcaaggtgaatgattccagcttttgcccattcagtatgatgttggctccgggtttgtcacagatagctgctattattttgaggtatgttccttcaatacctagtatattgacagtttttacatgacggggtgttgaattttatcaaaagccttttctgtatctattgatttaatcatgtggtttttgtctttaattctgtttatgtgatgaatcacatttactgatttgcatatgttaaacaagccttgcttcccagagataaagtctacttgattgccatggatgagctttttgatgtgctgctggatttggtttgccagttatttttttttgaggattttttcgttgatgttcatcaaggatattggcctgaaggtttcttttttgttgtatttctgcctggttttggtatcaggatgatgctagtctcatagaatgagttaaggtggagtccctcctcctcaatttttcggaatagtttcagcaggaatggtaccagctcttctttgtacatttggtagaattcagctgtgaatctatctggtcctgggctttttttttttggttagttggctatttattactaactcaattttagagctcattattggtctgttcagggattcaatttcttccttgtttagtcttgggagagggtatgtatccaggaatttatccacttcttcaagattttctagtttatgtgtatagaggtgttcataatatcctctggtggtttcttatatttccgtggggtaagtggtaatatccctccttgtcatttctgattgtgtttatttgaatcctctctcttttcttcattagtctagttagcagtctattttatttttttccaaagcaccagctcctagatttgttaatcttttgaatgaaattttgtgtctcaaacttcttcagttgagctgtgactttggttacttcttgtcttctgctagctttaggatttgtttgctctttgttctctagtttttttagttgtgattttaggtttttaacttgagatctttctaactttttgattgggcatttagtgctatgaattttcctcttaacactgcattagctgtgtcccagagattctggtatgttgtatctttgttttcattaattttaaatatcttctcgatttctgctttaattttattatttacccaaatatcattcaggagcagttattcaattttcatgtgattgtatggtgttgagtgaatttcattcttgatttctaatttgattttgctgtggtccaagagattgtttcttattatttcatttcttttgcattttctgaggagtgttttatttccaattatgtgctcaattcttgagcatgtgccatgtggcaatgagaagaatatatattctgttattttggggtggagagttctgtaggtatctatcaggtccatttgatccaatgctgagttcaggtcctgattatctttgttaattttccatcttgatgatctgtctaatattgtcagtgaggtgttaaagactcattattatgtgggagtctgagtctctttaaagctctctaagaatttgctttatgaatctgggtgctcctgtcttaggtgtatacatatttattatagttagattttcttgttgaattgaaccctttaccattatgtaattcccttgacttttttttatctttattggttaaaagtctgttttgtcagaaactaggattgcaaaccctactttttactgttttccatttgcttggtggatttttcttcatcactttattttgaggctatgagtgtcattgcatgtgagatggatctcttgaagacaacataccaatgggtcttggttctttatccagcttgccactttgtgtgttttaattggggcatttagtcatttacatttaaggtaactgttgatatgtgtggattttacactgtcattatgacgttagctggttattttgcagacttgtttatgtggttgctttatagtgtcactggtctgtgtaattcagtgtgtttttgtggtgtctggtgctggtctttcctttccatatctagtgattccttcaggagctctggtaaggcaggtctggtggtaataaattccttcagtgtttgcttatctgaaaaggatcttatttctccttggcttatgaagcttagtttggctagatatagaattctggtttggaatttcttttctgtaagaatgttgaatattggccccaaatctcttctggcttgtagggcttctgctgaaaggtccatttttagtctgattggcttcctttgtagttgatctgacctttctctctagctgtctttagcattttttctttcatttcaatctttaaaaatatgatgattatgtgtcttggggatgatcttcttgtgaagtaccttactgtggttctctgcattttctgagtttgaatattggcctcactagttaggttggggaagttctcctggatgatatcctgaaatatggtttccaagttagttccattcttcccatcttcttttccagggacaccaatgagttgcagattcagtcacatattttttgaatttttttcatttctttttattcttttttctctattcctgtctgactgtcttatttcagaaagccagtcttcaagctctgagattatttcctctgcttggtctattctgctgttgatacttgtgattgcattatgaaattcttgtagtgtgtcttttagctctatcaggttggttacattcttttctaaactgtctattttttctgtcagttccttcattgttttataattatttttagcttccttaccttgggttacagtatactgctctagctcagtaatcttcattcctgtggataatctgaattctatttctgtgaatccagccatctgagcccagttcagaacctttgctggagaggtgattccatcatttggaggaaacaaggcactctggctttttcaattttaagccttctcagaggattctttttcatctttgtgggcttatctacctttaagctttgaaattgacaacctttgattttttttctcttttatcctatttgatgaccttgagggtttgattgtggtataaggtagattcagtagactagcttctgcaagattttatggggccaacattcacctcccaattcctggactgcatgctataactctgggggactcatattaggccctgactttgtcctctggctcctcaaggtttggaatccactgcactggaagggagggctaaggtgtagcagctgtagcagagtgctaacaagtgctggggtatctgcctccctgcaggtgttcaccacagtggcagaggcaacacagctggcaggcaggagcagaggacccctgctggagactgtgtgtgggcatgctggaggtggtattagctcaggggctgggtactggtgggaaaagtctggatgtcttctctgtgtcccctaagcaggtgtgatccaccatatagttctgcatatagttttatttgtttctgtgcaattaatgtacatacttcaccaaagaatttacatagctaatatcagaagttttcatgtaggtatctttgaatcacaattattaggagctacaattcagtaaaaggataccttgctttcagcactctaaggaagatgtggctattccaaaatgggagggcatttggggactaatatttcatctctttgaaatgttaacagatttgaggatggtatgtcagactgagtcaaagcatttgcatgggaaaaggtatgtcctctatagaaacatggacttcatccagatggctgggtagctgggtggtgcccagattgcaggaacaaacaatgaatactttgttcatctgtacaaggccagttaggtgctaagcatacaaatccaataaggtacagtgcttacctgaaggagtttgaaggagagagaaaaacttggagagaatcaatgaagaggccattggacttggcagttaaaagcagttttgtgtggtttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaatttttttgtatttttagtagagacggggtttcaccgttttagccgggatggtcttgatctcctgaccttgtgatccgcccgcctcggcctcccaaagtgctgggattacaggcgtgagccaccgcgcccggccagttttgtgtgtttttaaagagaaatttcagttatttaaagaaatggatatgaagcagctatatcacctggggtatataccctggggtttgtcatcttgcaccaggaaaacttaggacatggactcacacgaggagtttagcagcagaggtttaataggcagaagagaagtgaaagagaaacagttctctctctatagagagaggggtccctcagtggaaaagactggctgtcagtgaatgtgccaaattttatagtcaggtttgaggaggcggtgcctgatttacatagggctcacagattggtttgatcaggtatgacgttcacacaatgcatgcggaaggtggttgtcccactctaatgttagcatgcaaatgggctttccagttgactggtgccatcttctctgcttctcactgtacacttggccgacaaagggaagagaagatggaccatcttgaacatgtatagtccttacttcctgccagcattcacccatgcaagctcccagcttgcttgtttatgtctgcagctcaactttacaggctgctctttgttagaaaatgatttgtggctgcctttcaataaaaagcaaagccttaccaaggactctcattcagttactttctgcctaagtgatttcttaacttctatatcgttcccccctctggagtggtaaccctaattgctgttagtggtcatttgaatgatgactctttctggcaacttcctcctataaaggggcattgtgtggggaacagcagctatggctcctcctggggtcaatctaagggtccttggaagaaaggcatgtccatgtatggttctgtctgcagcaccatttggagtttgattgtttctaaatgagaagagatgaatgttagttcgaatatgactattaagattgccactattagtggaggtaccataggccacaatcataacagtagggtttgttacctgtcagtcattttgatgaaatgaaatactggtttgcttctaccaaatgttgctgtactttatcagaagtgttgatataaaagcaacatttttttttctttgagaaaaacatatatacccccgttgctttgccattaggggataatttctggtctaggtcatcttttttaacttgcaatatgattgggagaaatatgtcattgggtggctagtgtaattttagtgttaaccctagctaaatctttcctgcaattaattccttcacagcttccaccaactatctatgacatgcttaaactttctggcttgtcctaaacatccttctttttaaacaaccaactattctttttaggacatgtatttaccatccttctaatcctttcatgacttccatgaaccatctatgacatgcttaaaccttctgacttgtcctaaacatctctcttttaaacaactagctattttctttaggacaagtatttctcatacaagatcccttcttatataaaatctctttcctttataaccttctttgcaccaaacggtagcatgagcatggagaactaaaaaagcatacttggagtcagtgtaaatgttagctacctttaccttgcttaactcaagtgctcttgtaagagctatcagttcagctggttgagcacttatgcctggagtgagagacacactttcaataacattcagagtgactactgcatatcctgccttctgtactccttgctctgtaaaggagcctctgtccatgaagagggcccaatctggattttctaggggagtttccctgagatcttccctggccgcataggtctgtaccacaacttgttcacagtcatattcaggtcctccagttcccttggggagaaaggtgactgggcttaagcaaaaacaagtttttaactggatggtggaaccctctgatagtagggcttgatatttaaggagcctgctgtctgttaaccaaaggctttccttagaggacagtaatcccaccacattatatggggtataaatagtcatgtcatttcccaggattaatttggaggcttctgggaccagtagagccactgcagcaatggatcaggggcatgctggcaatcctttaaccatcaaattaagttccttactcaggtaacccactggctgttgagctggtccacagacctgtgttaaaactcccaaggtcatttccttcctttctgatacatacagattgaaggcccttcctatggaaaggctgtgactatggcctcagtgagatggaagtcctgaagtagtcttcattccccattgagttttatgtgctcctaacattggggtgttgaatgggctgcttcaggttttgaagaggccctgcatcatcaggttattagtaatggcttctagccctttcctagcctctggcttcagtggatattgtttctggttaggaaaagaagtgggatccttaagatggatctggactggcctagcagttacagctcaactcattgttccttcagttgcccacacttctggattgatattagcttctaccagggggtgacagagtttgtcctggggctataaggatgctggtctgcctgcaagtaaaatatctctacctaataaaggagtggaactttttggcatgattaaaaaagcatgtgtcaataataggtttccccatctgcaacctaaggggttgtgaaaaatattgaattagactttttcctgagatgccctgtgatgcctggtcatgctacagaaagaggggaggcctggattagagaggagaagagagagagagactggctctagtgttcacaaggagatctaccttccttcaatttccagaatcacccagggctcctgtgctgtatgttggtttgagccactggagctccgggacccatcaatcctgttggacaatctgtgagactggtttggaacccggtgaccttcatctctgggggcagtccgacttccaatggttccttccacaggctagacaaggttaaggtggttttttcttgctgcctgggcactctttcttaaagtgccctgacttgctgcacctatagaaactagcagatgtacctcagggatcctgggctttgtatgtttgcagagcagctattagtgcctctgtccttctcttttgcttcctctctttctcctggatctcctcctcctggtccctattataaaacaccaaagtggtcacccttaggaggttctccaagatgctatctggtgctatagcctccttctgtattttccttctaatattgggaggtgcctttttaataaacttgtcccttaggatgagctgtcctcgactgattcaggggataaaggtatgttttatgagtgcctatcagtctttccataaaggctgcaggattctcatctggttttgttctatcttggaaagtatagagtaattaatagattttgcccttgctcttcataggccctccaatatgtgcattaaatggtgtttccttttccatccatctgtggcatcaccggtgttccaactagggtttgtttttttttttagaggaactgcttcccttcctatcgggaatggtgtttccattatttctttgccttccttatctcctttttcctttttaatctaccacaggagacatgttgttcatcgccagaattttctgctgcctgcagaactgcctgcttttccactgtggttaggatttggcttaagagcagcaaaacatctctccgtgtgtggtgaaacacttgagttaaattttggaagggttctatatacctatcaggatcgtcagaaaattggcctaaatcttcctttatttgcctaagattctgtaatgagatgggaacttgaggtgaccccaaataacggggattctcagatggctcctctggaagttgcttttctagtcttagggaatcattccctttgggcctgcctgatatgattgctacacttgcaaaggtctagtaagaaggccatgcccttgtgcaaaagaaaatgagccattttttcttcaaagtctcaggatcaaaggagtccctgtgcttcagaatgcactccagaggagtacaggccttagatgataaagagaaggaaaaaaaggcatccctttagtctccttccttttgatgtgacccagggtgggagaaagacagtgggggtgtccccctgttgttttctctccatggttcctggcatcctggcaccttgttaaatgtgctgcccatggttgcaggtgtggcttccccagccatggaaccagaggaactaagtggtgggttttagtcaccctcacccatgcaactctagtcctctgcctagactttggggctctctgaaaaatggatcttgggaaagactatgtaacagttgcatttgggcaattgttgcactcgcctccttaatggaggaagcgtgctggtttgagctctatatcctgctattatggcccatgctaaagtgtttacccttagagaatcattccagttaacttctgacttaaaatccccttactaattaagtaccattctaattggaggcagaataggtatcttaaaagaatgtagggaccaaatggccattttcctgaaggaaggacagtattaagactaaaatttggttttggaggacattttactcctaattgctgaaggcagagttttcccattcacagaaacagcataaagcctggtttctagtagagaggcgtaaaaaggggagagaattgggaagctagagtgcttgggtaaaggagaggattcctattccactaggtggtgctgctgactttgagatgccatgtgctctccagaccaagggcagagtgaccttgacatgccatgtgctctccagatcaagggcagagagagagagacctggaaatgccatgtgctctctagaacaagggcagggagagatgctcactgggggtaccctctgtttctagaacatcacaaaaacaccttcccttgagctatatgcccatttactatgacattatctgatcttgccaaacaggattccttccctgaaccataaatcttcccacacattgcatacacagagaggataagagttatgacagttgccaacaggaaagaaagaaattatgataggaaagttggagatcttgtggccgatagcccatcagtggggacagaggctggggtcagtccagtagcctttggatgacaccagggatagccccagccagaaatcctcagttgctccaggactccttccagccccacatgacggctgagtactccatgaaaggaagctggttcaaacatggccaatatgccaagcaacccatgggttctccatgttctccccagtaagcctgtcccccaagtcttatatggctggcagccacgctaattattttatggctgaagggggtccagtatttggtttgatttggttcttaaatggaggccaatagcctctgaatgaaaggacagagttggagtctgctcctctactcattgtttcaattaatgttgtacgctggtatcatggatgaggtccccagtatgaaatggctatgttgtctggggtatataccctgggattcatcatctcacaccaggaaaacttaggacatggatacacacaaggagtttaggagtggagatttaataggcagaagagaagtgaaagagaaacagctctctttctgtagagggagaggggtccccgagcagaaaagactggctggcgttgaatgcgctggattttatagtcaggtttgaggaggtggtgtctgatttacatagggctcacagattggtttgatcaggtatgatgtttacatagtgcgtggggaaggttggtcactgtaccctaatcttattatgcaaataggctttccagttgatcagtgacatcttgtctgcttcttactgtacatgtggctgagaaagaaaagggaagatggagccgccatcttgaacatgtgtagtccatagttcctgccggcattcacccgttcaagctcccagcttgcttgtttatgtctgcagctcgactttacaggctgctctttcttagaaaatgatttggggctgcttttcattaaaaagcaaagccttaccaaggactcccatacccttactttctgcctcagtgatttcttcttaactcctatattggatatattgtgggttgttaaaaagtgattatggagtgaagtacaaaaaaaaaaatagccatatatcagttcttccatgcagtacagtggcagaaaaggatgtgatggcttggggattaagaagaaagcagtatgacagaaagatttttaagatcagagactacaaagggtctttctagcagggaaactgatactacaagatgatataagagaacgggggagagagtactttggagtcactgacggcgcagtttcagaaaaaattggggaattgaaagtgagagcataagagacgatattagatttataatatttctagatatttggggaaacattatccaatacaaatgcatggtttcttaacatttatttgtagaatgaagcatgaaactaacacaacattaagttgttagaagttcataggcttcaaaagtaaaagtggcaaaatctttttccaacagtctatgtaatctttcaaaatcatactaactgaaaggacaggaaatgggcacacttcctatggcaccaaatcaatttttatcttggcagaaaaactgattattacagctactgtgagccattgttattataattgagtggatcatttgtccagtatgtttttcctagtaaaagaaaaacatttgtggtttctgtggtgaataagaattctaacaccaggaaaaaaatgcaggccctctttttgttgttgttttgcatatatttgtttgtttgtttcagcaccaaatgtggctccttcagatgtaggaggtggaggtggaagaaacagagagctgaccataacatgggcggtaagtattgatgagttgcacatattataggttgctgtatctatatttaacttccaccccattttgtttcctgaaataaattgagatgaaagtgactgcctactgcacaagcaagaatatattactatttttttttcttaaatgcaaatcagattttatctggcttactgtggcttagtgtgtagctcctatgcaagaatgaatcctggatgctaagagatctgttagcctagatgattaaacattcagctgtctgattccagagatactttgatcattgtagtctggtaatctaattgtaattttaaacattgtctctggacattctaaattccaaagattccatttacaaactttgtatcaaaacccatttttaaattggagactgcctcctcacttgaagcttactttgatcactggtgtaatctagcatgataggtcagtcttagaagtcacccatgggactagttactgaggtatccaaagcattttattacagtttcgtgagtcaaagagttctgtatcagagactacaatctctagaaaacaatacatcttggctggatttttgaaataggaaagatattgggaggggtgggaaaagttgtctgacaaaactgtctgacttagacatctggcatttatccagataacatggtttatacagattcatttattcattaaatacacttagtgttgaatcactgcagatagtcaaagagcacaatttaggctccaaaggattttgaagactgtggaaaaaatgacaggttttattctttgcattggtcaaatggatttatttaataaatgaatgtttagcaaaacttgactcactgtgtgctttgtagtcattttctatacttagcatttaaatcacattttaaagcaagatttagcaaaaaaaaatctaatctgaatcgtaaaatatttatttctaagtttaactgccaatgaaatgtccaaaaatgcaaatattataaaaattagaacatttcgctctttctcttatggctttttataaattctgtggatatctgctacagaataagatgggccttataaaaaattcagtattggaaattctcctccaaagattcaaattcaggtttctggagatagagcccgagagttgttatttttgaaattttcatagctgattctgttatactctaaattccaaaaactaagtagagaactatcaataagaaaaatgtttaaactattgtagaaatgttaggctatactatctaataatctaaaatcacatacctattaatatattgtgcaaccacatacagcttctaccatttgacctttccacatttctatatcttcctatttaatataagtatgtccaagcaatagtgttatatttacttcaaggttttgcctcaagacatcttaaatttgattttctggtaaaaaaaaaaaaaagtaaatatacaatgtgcacatttacctaaattgccaaaaaaggctaactgacaagtactcactagaagtagctgtaagtcagtttttattaataataggtgattagggctgacatagacttctttataaggcaatttacatgagtgacaagaaaccttgagaaaatgatgaaaaaccaagcacttgctttagaattggagatagaaacccaaagccatcctcctacaaatgagtgcaatattgtcccttcctccttgtcacctacttttattcctcttaccagtttcttttcgatcacaaggtagatattctaggctagagtcttatataactctcttaccattgcctttcaattctaatgaaattcatttgctcatccctttaatacatattacttgaagccctgttctaggtgctagggataaagaggaaaacaaaactgacaaaaacgctgcattcataaaacgtgtattctagtagttgagagagacaataaagtagataaataagtaaactgtatagactttgttagggttaaagaaaaacaataggtagggtgcgggacatggagcattgtgttggagtcttgcagtggcagaacctgtggtcggagaaaacgtcgaggtgattttacctcgggaaagtgagggggtgggaggagtcacataacatctaggagaacattctaggcagaagaaactgaaaggaaaaaggcccggagtgagaggcccctgaggtgttctaggagtagtgaggctacaatttggtaaataagatcatcccatgtttaagtatgtttttcctctgacatttggaaccagcactaatgtatgaactgtgtatgtttttacaaagagcacgcctccgtgtgtgtcattatccccatagcatttcctccctgttacctgtattactaaaacctactcaatcttttaatttctatttagcctttgtcaagagaataccactatggcaacaattttggttacatagtggcatttaagccatttgatggagaagaatggaaaaaagtcacagttactaatcctgatactggccgatatgtccataaagatgaaaccatgagcccttccactgcatttcaagttaaagtcaaggccttcaacaacaaaggagatggaccttacagcctagtagcagtcattaattcagcacaagacggtaggtgaaagaaagaccttcttacctgaggagggaggaaaaacgtatttctctagcaggcatttagtttgtttcctttcaggccttacttattaagacctttttatagcattatgcatttagtaaatgagtactattttgaaccaaattaaacatcaccctcttcatctaaatgatgagaatgttgctagagtctttttcatcatttagatcatgcccatggtatgaggaaatccccattaaaataattggctctgacttccatttttgggctcttgattataattttgtagtcagaaactctccatacttgaacagaatctcaacatgtctgtatattcataaagtttataatttaaaacttctataatatggccgggcgtggtggcgcatgcctgtaatcccagcactttgggaggcggaggcaggcagatctgtctggaggacagagcaagactccgtctcaaaaaaaaaaaaaaaaaaaatttctgtaatgtatatattatatatattatttgtaaaatggccccaaattctaacctaaaaatgtgtttaattgcagcatttacgtaactttttattacaatacagaacacaaattttgttaaagggaatctagacataattatatgaaaaagaggtcagttgaaattgttttcttgaaaagggaaaaatttgtcctgtagggcatttaggaaaaaaacaatgctaataccagctctttttgtttttctagaaactttaacttaactaaccatggtcatagaagactttatatatttatacaaatgatacacagttttagattgagcataattacattattttctctgatttctgtttaagctgctatacttttgttatttatattcttgttaaaaataatacctttctggcctggcatggtggctcacgcctgtaatcccagcacttagggaggctgaggcaggtggatcacctgaggttgggagttcgagaccagtgtgaccaacatggagaaaccctgtctctactaaaactacaaaatgagccaggattggtggcacatgcctgtaatgccagctacttgggaggctgaggcaggagaatcgcctggacccgggaggtgaagttgccgtgagccgagatcaggccattgcactccagcctgggcaacaaaagcgaaagtccatctcaaaaaaaaataataataataataataatagctttctttattcatgtgcactgtgtaaataattaatgactagaaaaacaaatagagatgtcattgccttctgatctttggcaatgtacatttacccttggccaagtttctctttgcacatgtgtgagaagcacaaatagaagagcttgaaaactaaaggtgtgtgaggtactcttctatcattagaggaaatgggctctattggttcacccaacttccattgttttcactccaagatagacatttagccatgccttatacctcaacagaaattctcacgtatattcatcggtcacagaattattagttttagtatttgttaaaaatgtaatatataattaaatcatcctatgatctttacttttattaaacaccattgtattctatatatgtatgtcataataccatgtcatatgtcttaaatatacataacaaaatttaatataaaaggcagttattcatatatgtaaaagtatatatgtgtgtatatataagtatatatgtatatatttaaagttatatatatactttttactatattttttactgcatacaaaagtatgtgtattttaatatatgtgtgtgtgtgtgtgtgtatgtgtatgtgtgtatttttttacttttaagttagcacaaccaaatatgtcaaaagaataaaatgtagaaataatttgtttattatcaaacagtggaaaagtcctgatgacaaacttatattctctatgcttgtgctcattcagcagaaatatgataacttggctgagcgtggtggctcatgcctataatcccagcactttgggaggtcgaggtgggcggatcacctgaagtcaggagttcgagactagcctgaccaacatggagaaaccctatctctactaaaaatacaaaattagccaggtgttgtggcacaagcctgtaatctcagctactcaggaggctgaggcaggagaatcacttgaacctgggaggtggaggttgtggtgaaccgagatcgcgccattgcactccagcctgggcaacaagagcgaaactccatctcaaaaacaaaacaaaacaacaatgaaatatgataacttcactcagttttaataatttgaagaacgagtacatcttacagataaaatgagtgtcttaagcattttacaagttaccttctcacctttttactgctttacttgatgctaaaataagttttcaggcaaatagcttgtcatctatttagtcatggctatttgtatttaattatatttctttcctaaatatttcatgagtctcataaaacttgcatgtgttgaaacttgtataagtgttaatctcttcttccactgctgagaaatcaatcatagtgctacacatttgccttgttttagaaagtcaacagtgttcatgtgtagaacatttttaaacattaaataggattatggcattttaatgaaagacaataaaaattgatcacccctgcttaaagccttcattggtttctttgtgtaaatttcataagggatgtcagttactttttttctgtgaacagagacctttttgatacatatttgacttgatgcccagttggaagattagacatataaaagctttcttgagcccaggaaacagtggatgttacaacttgtttcaaaggctcttaaaaatttttttttaaagatcttagcttgaacataaaaagggaagttttattaataatattgctgtttgtagttagttcacacaaatagcaaataagagaaaatgtattatattgaacaattttctataattccaaatttcctatttctgataatatagagttgacagctaaatattaataattttaatttgcatcaacaggctttcttaagcatatcagttgagagaaattaaaaaaatagtttttttttgctcacagatgtaatagaaattgatgaagctttctgtatttggtaaaagtgtgtgtgggaatgtgtatgtgtatatgtctatattaacatttatgtaaatgaatgtgtgtgtgcacatgtatcactaatgccataaaataaagtaacattagaaaaatacaggaagaggtaatgaaataattgcacttagtttgaaaatagtaaagctattttagaaacattaaaattaaagtatggtccaacatcattcatatagcaaatgatgctattcgaatttcttaaatgtaaatatctcactaataatataatgttctcataaaatttcagctcccagtgaagccccaacagaagtaggtgtaaaagtcttatcatcttctgagatatctgttcattgggaacatgttttagaaaaaatagtggaaagctatcaggtacgttaaatttttatcaaactaaatacatttattcataaatatataagcatacgttttcaaatgtgttgtatgtttcaatgtcccattaatttatgtggcaactaatactttattctctgtgtctagtattgtggtcatatataagttaattgttaagaataaaacaggggttcctaactggcctatctaggggagatgtaaagaaacctaagtcctggcaaacaattggccaaaataaaaactatggtaataacacttatgattacccaaggtctttttaggaaaacattctcataaaaagctagtgaatctcaagttttttggaaagcattttggtaatttatagaagcatcctgaaaatagtcatcctctttgagtcagtagttccatttcgaaaagtccctccaaagtaaacaattttaaatataccgaatatgtcttatgttatctatgaagtaacaatcaaaatgacccaaataaaacttcccttgagcttaattttaaagaaccagtaagaatcagtcagacgcaaatgagaaaacttgtcttagtcaagggagtaaaaactggaaaatcaaaactagagagattagttagggtctttaatacaatgctaatgcaatttagactgagttatgtaggaaatgtgaaatcatcatctcacatttttaagtgcaagaagtgaaaattcaaaggaattaacatggtttttcctttacagatgagcaaatggataccaaagagatttgacaacttgcctgagttgtcacttacagaaagtgtcagagcagtgtctaaaactcaagttgtctgattcaaagttcggggttttattgccacacatcacagacttccctgttttttttttcagtgagtgctgtctagggctgcctctccacccaccccactcccccagccagcttgcattctcagcttcagcaccctcccttatcccttgtccatggaatattagccccatgagggcagggtattgttctattctcagtgccatgcaagaccagtgctgagcacctggcaggctctaaatagatattaattgaatactgataggaataatgaagtatgattaaataaaatgttacaattgggctttctcaaggccatgtttctgagatgtagctgtaaaagaaactcaaggctttgagcagacacacccagaccaacaggaagctttttttttttttttttgacacaataggttataatttgggaagatcttaaagagccctcagatcatctatgcaagggttcagctgaatttattacagtacacagaagagtagactgggaataattagactgagaatacccaatattcataacttactaacctgacaattgtgtttgcggctagtaggaaagagagaaattcactagatgttacaaacccctgtaataaatacgcctgaggtatctttgggagaagacatcaatgtgtagagcttggaaagtaaaattttggagcacaggatttttttcttcttttatattatttatttctaactaataaatattgaaaaaaggataatttaacatataacccatatcattgagtcaaaatgccaaatatatgacatattttactttatttaaaacatgctagaaaattatatattatctttgttaatgccaagaattatatattgacgatttgcttacttttaacaagaagaagacaaaagaaataagaggtaggaagcaacatagtggaaccaatgattcagatgataattaaattaaatatgcttttttaattgggaactaaaccttgattaaggattttcacatagtcagtaaaaagtaatctttatcaaagaagatttttttcaaatgataatttcaagggaaaagtatgtaccatgaggagttggtttcacagatgtctgaccttttccaacttacattaagtaaaaacttatgcactttgctgctgagcaaacatgggtttatatttcagctctgtcacttaagaattttgtagaaaattgatttgaactttgagtttcctcacctataaagtgagaaagtaaccactgcctcatagaactgttatgtgaaagatattaaataacctgtatttaagaattttccctgtttatgtcattgggcattccaagatggtggtgatgatgatgatgctgatggcagtgaggaagatgatgatgatgttaatgatgaaaagactgataacacgtcttgagttcttattgtgctaaacacttaactaagctcattttattaaatccacacaaccctagaggatagacactattattatccctattttagagatgaagaacttgaggattagaaatgtttgtctgagtaataattgtcataatcagattttaatctagttcttgcctctccagagaacggttgattaaaattgctggaagtaaatcatagaattattcttcccattcattctttcttaaaatccttttaaaccttttacacagggtcttggatatcaaagagacaagcacgaacacttaaaagagaaaaatccatattatttattgttctgcaggaaatgctcctgtgactgtggccggtaggggggaggggggtcttgactgactataatgtggttattgtttccattttaaaatatgatgggagaagccaatggtttaacaagatagatgatggtgaaaaccaataccccaatgcacttcccatgaaaatgtacgatggatctctatttttctgtgtataaagatacacagaaagaaagcagcacattgaaaacataaaatataaagctggaaagccctgactcctgcctgattgacaccatctcaaggttcatttcctgacatttcaaatgagaattgtgagcaattgaatttaaagacaatctcttcccttgtggttttaaagtgtatctcagtagaatgtttatgtcacttagtatttttttatcttacttggttaaagagctccccactttcaatcttaatacccagggagtttttctatagtgtaggtaagctagaagaatacaagaagtctttcttatcaagggcattttggaactttgggctcttgcccaggaatccacaaaagacttagtttgctcacacagtgggtaaaatattcacttaattaatttaacaaaaatgagtaaaataggctaccaggaataatgaatgcaaaaactttagcacctaaattagagattaatgcagatgactgatttcagtcatcataaaagatgaacaatcctgtatagtctactcaaatatttttaaagtttaaattattatggtgagccgaaactgattacttagaaagtgctttattttcttattttggagaagacatccgttttggtctgaatctctttgaaacagagcctcaaacaaagatgtggagaaaggttgtttattattgttgttaattgtttgttttcaatatgatcctaggaagcaggtatgaggaaaaggcagagtgaacaggaaagaggggagctcagatacaaacgtgctatttgtcttgttggcaaccactgtgggcaactggtactccatcccttgagacctttgaggagttttataaatgtgcctctgaagctgccctgcttgggatgaaaagggaagcattcatccacttctgaatgtccagaaatgtgctcattcaacacataaacctcacttttgtgaagtgaatttgagccatcctgttgcacttcataatagtttcttacatgtttatgtaaataaaaaatgcaggattatattattattagacattttaatctaggcattttggttaattgtgaaattacaatcccgttattttatagacagggcatctaaaatatgtaaaatatcaggatagttacaaataatccttttctttttattcttatattacatataacatatttttattcattttattcataccttagatataattataaatcttgaatgcaaaaaagcctttatttaaagatgaaaattataatccataacttttcttaaactttaagagaaaagtaatcctgtaattatttgacaaaagtaatcatttctaatgaaaaaatcgataacttttttaaaaattattttatgggtaaataatttctacagtttatccagttattagatatatttctttgatatctagcttctatatgggttcaaaggaaataacattagatacttctgaaaggaggcagaagaaagtattactttagcgtattctaggccacatagtaactatttttatccagcaaaattatattcctctccaactgctttaagaatggctcagaagaagtttgaaatcatgcaaacagaagtaaaacaggaaataaatgataaaaattatagtgacaaatacttccaaatggagaccacttttatattttgaaagtaagtctgcttcaaagtttttgggatttttaaattttttattttttattttttttagtcaatgtaaaacaattttgggcaatgaagtaagactttgattcgcttttggcatctttagtcattcctgccctgtatgctttactatattctaaggctgataaaagggtagatatcattaagaaacatttgaaaatatgatgatcagccaacaccaatggtaatagaaccagttgaagagaacttttcatagctgaagactctaaatcatggcaaaatataactcatcctgaatgtttgcagattcggtattgggctgcccatgacaaagaagaagctgcaaacagagttcaagtcaccagccaagagtactcggccaggctcgagaaccttctgccagacacccagtattttatagaagtcggggcctgcaatagtgcagggtgtggacctccaagtgacatgattgaggctttcaccaagaaagcacgtgagtctcacgttttgtttttagacttgtcaaaaactaccactggattcaatcatgatacgaatatatttgaaggaaatttcctacctagctacctgagcacatttttcaatatcctttacagccacacaagatttcccttaaaacgtgaattattgtagatgatgaaaaaatgtgaaaaataccctcacacgttaaatattccattatagaaataaagttagagaactatccttttgtaaaggctgtcctctcaaattctgtgccattaacttgtctttaccctgtacttattaatttaaacattgttttcataggagtacatcaacagcatgtgaaaactaaaattctgcttatttttacatgctttaatttataaacctctgtcattgcacagtgcaatgcaagttaagtgtgtagcattatgcttactctcttattactgtatgttctagtactgtatgttttaggtggttcataaaacaagaccgcctatccctgctcacgttctggtcattctaatctctctgggttcattttgatatctctgttcttgaacccaagtggaataagtaaaaaggagaatttttatgtaggactctagggaatgtctcaagaatctgaagatgtgattaccattagagtgtgaaaatttatgaaattcactttgggacagagactctcccagtgagatgacagaatgtagtgacaagaactagaatttggtgtctaacatgtgtttgagatctgtctctgccacttgctagatgtatgacaatagataaattacctatttaaacctcagttttctaatttgtaaaaggagcattcatttttgttctttttccatttgttcatgtatttattcattcatcaaaaatatgctgtgtgctcagcactattcttgatggtgaggatacaaaagggatcaaaccagtccaaggtgctattctcgcatggtttacaagctaatgaaatgagatagaaacttcaaacaaacacaaactctgacaaataaataagtgggattaaagcagctgacagggcaataaaatgaataaatagacaaaagtaaagtgacttagataaaagtgaaattctgattgggtggccaggaaaggcctctgagaagatgccagttaagctatgatttgagtgataaatgataagaagaacccactatgtgaatagctttaggcagagccttaaggttctttgcactctaagtagtacaaaaccttaaggtgaagagcacttaaaatattttaggtgtggaaaggccactgggtccagggcataggttctgagtaaggagggggaagtgttctggggcccaattacggagaaccttgtaagtaattgtgatgagtttgagttctttctaaacatgataagaagccattgaaagattttaaaacagagagtgatatctaatttatgatgttgtttttaaaaaagtcattctggcatctgtacagaaaatggattgtggtgggttaacagtggaagcagaaaagccagttaggagactatttcagcagtcaaggagagaattgatagtggctagcactaagtgaaaatggagacagaagtggaaagttttctgtaggcagagttgacaacttgctgccaatttggatgttggcaatgagtgggatgagagactaaataccaaatttctgcttgagaaactagggggttggttgtgccatttgctgacgatggcaaagagtcattggagaaagatttgaggatactcgacattatattacatttgaaaaatgtattacatttgattatattacatttgagaaatcttttagagactcaagtagaaataggctgatatctgcctagacagagagacctatagccacatatgtctagaggttgaaagagagattagggctagagacagaactgtgaatatttaaagccatgggcctaagtgtcagtacttagggaagatccacagagagagtagaaaaggtacatagatgaagtcctaaatcatccaacagttacaagttgacagagggagccagctaagcatgaataatgggaagcagcagcccatgaggtagaaggaaaacccagttgttaagatctgaatttaagaaaaaatgagagattcaagaaagaagatggtcaattctgtgaaatgctccaaaaatgttaaatttaaaaaagaataatcaagtgacattagatttaaccaagtggaggtgattgatgaccttgcaaatagcaatttcaaaagactagtggagaaagaaacccaagtggagcatgatgagaagagaataaaagtcatattacctagctcacagggccatggggtacattaaatggactcatggatgtaaagtgcttagcatagtgcctggcatatagtaaacacttattaaaactagatggtggtggtcattatcatcagcattataatacctgatgcaatagagtatgcagaattgagattggatatagtgaccactgattgcatattactacttttcacagctcctagccagcctccaaggatcatcagttcagtaaggtctggttcacgctatataatcacctgggatcatgtcgttgcactatcaaatgaatctacagtgacgggatataaggtatatacaaatagtgatgattaatgtttgcaattcttgctatttcagtgaaacccaagatgggtttcttttctttttttgagatggaattttgctctgtcacccagaccggagtgcagtggtacaatcttggctcattgcagcctccacttcctgggttcaagtgattctcctgcctcagcctcccaagtagctgggattacaggtgcccacacccacacccggctaatttttgtatttttagtagagacagggtttcaccgtcttggccagggtggtctcgaactcctgaccccaaattatccacctacctcaacttcccaaagtgctgggattacaggcatgagccaccacggctggccccattcaactttcttattctatttaatagttgtagagcagaatcagataacgtagtgccatgatacattttgaaatggaaaacattatcttcagtgaatttcagcaaaatgttatgtcaaaagtgtaagataagtagaatactttaaagataaaatagaataatcagagcttaaggaggagagagaacgaaactatttttgtttggcaatgattatgatagggttgcccagcacccagaaaactccttgataaactgagttactgtttataaatgaataaaaaggagaaaagcttattttaaatatattctttatatcacacactatcacatttttcactggataccaaattttatggaaaatggtaaaaataaaaattgagagacaattttcagaccatttcaatatattttaaaagttctcattttggacttttttcttaaaaagactcattctttctatatttttattttgggtcatctcaaaaaataaaattcagatgcttaagtcacatctccttggataatcctacaaacttgcaaaaatcaactattgtgaattgaaactaacatgatttttttcatctagttttaaatttagtttttcctcttgttttaaatttattactttttgttaatcaaagtataagcatttttattctggttttagtgttagagcattggctcattattatgactttactgcatatttacatttctgtactttataaggtactctacagacctgatggccagcatgatggcaagctgtattcaactcacaaacactccatagaagtcccaatccccagagatggagaatacgttgtggaggttcgcgcgcacagtgatggaggagatggagtggtgtctcaagtcaaaatttcaggtaagtgagtcatttaagacacatttcaactaagtacttgtgagtttctagaccctgtggattcccaagggtagggataagcctgatacaccagtgtccatattttcctaagtagattggacatatcaaggattccctgaaacttggtatttctcctcttatgagtcacaaaagtaagtctgtgacataccacatacttcttgattattatctggatgtcaaagcacagttgaaatctttcagacataagacgaacgagtttttgggatccaatatacagtatggaacatattagtttatttgattgtggtaatcattatacaatgtatacatatatcaaatcttcatgttgttcaccttgaatatatttaatctttgtcagttaaatattttcaaataaaaagcacaattaaaatggcataatttattgaatactatataatactaggctattatttaataataaccaaacttctatcaaaaggaaatacactaggctatttttaatactcttataactctttcacttggactatagatattgatatagtagtaaaagagaaaaacactaaattatagcccctttgtcttttctctttctctatcttatctattccttttctacaaactctatttctcacacctttgtttgatttggaaatacatatatttgaggcagtcatttctttttttttatttctggcaatctgttatttaatttttgacatatttttcttaacctatatgcatgatatagtttaattatactgaatttcaatagatgttaatttgagaaatgtatgagaggctttgacattaccagaagatcctagaacaaagatgataataaataatttataagaaaatttggttaatctgtacaacaaaccccatgacacaagtttacctgtataacaaatctgcacatatacccctgaacttaaaataaaagttaaattttaagaaaactaaaaaaaaagaaaattgaaaatttggtgattttgatataaagaaataaatatgctatatattaaaccaacaaaaaatcctttaccacaatgccagagtatttaatggtatttaataaatgctggcttcaattgtatgccatgtttttgtgaagtttgccacaatacatatatacatcctttacaaatcaaaatagaactttgattttttttagtttaatcatcagcaattttgtcttttaagaaaatagagaaattacagagatgtgaaaggaaaagaaaataatcatgttccaaataccctaaaatagctactgttaatgcttagttgaatttacttatagtcactctgtatacatatataatttcatgtttcagcttccatttttgtaaattatttaaaaattataaatgatattctttcaaacaaatatgcaaactcattaaagtttttttctatcataaataatacttttagagtccattttcataaattaatctttcttctggttaaatttaagacaaagtgttttaggttgctaaatttcttcaaaaacacttactaatttctattcctattatcattgagtataagtgcttttctcactgtaccactctaatattattgtctttttagtcattgctaatttgacaggggaaaatagaattttcttatttttgaaacattttctatattcagaactttgtcaacatcttcaatagttttacacttagtgggcagtttcacaaaaggaaatcagagggaaatatggccattatttcaaggaaggtaaagcacaaataactaaataaattgctcttgaaccctgggccttctttctcttgtgtagaagccagccacagcgagcttttgctctctgtactcacccttggttcatcattcctcaccgaaaggagaacctagcttctgggatttagactagaggttttcagcaagagatgatgtagcagtgatggtaacatcagtttacctatcactaatggcactggtaaatgttaaacagtagaatcactagggataggggaaagccctgtttataatgtttgcctgtttctgtggtgtaaatattctcattatgtgtgatttcaagctttccaagtgatgtcacttaatatggagctgtgaagagctacccagtagcacatcattatatgtaattgccaccatacaggtataataagaacctaaaaaacatttgacaacattataatatagtaaaatattaagaaatgatgggttttgagtatttactacatttgttttaagcttttaaatttaagtttacataaattctattttaataattacatttttaacacattgctcatacatttcctaaaaatttaacaattggatttcaggggttgtatcggttgatttcagcataccacagctgtaatttgatatttcagtatatatagctcatgtatagaagagtatttttttaatcccaaacttaggatatttttcatatttttctctttttgccaactaatggacaacattcttattgattttagaatttctattatttatctcttattctgaccataactgtacaaataaactgtagaattaacgttatgaaatgtcagatgcttggtgaataacaccattctagaatattcttgtttttaagtttggattttcaaatcatttaaattattttaatgaggcaaatgtgtaaatacaaacagaaattacaggtttttttctaaatttaaaagactcttagtactttcttttggttttcatgccctaaatacgtagccaggattataacacactactagatcttaatgtttataagcattatgctgtttgttcattcattcattcaacaaatagacattaaatgcctacaatacagcaatcacagttcacatatttaaaatgtgctaagatttacatatttccacatctctgcctggccctgctgcaattctaatgatcctcttgcctcccagtgttggcctctcaaggcctattatctatgcaatagacaggggggttttttaaaacacaaatcaaatcatataactctcctgttagaaagatggctcacagggaatggtgtgaaccctggaggtggtgcttgcagtgagccgaaatcgcgccactgcactccagcctgggcgacagagcgagactccgtctcaaaaaaaaaaaaaaaagaaaaagaaaaaaaagaaagaaagatggctcacaggtaacatctacatttcttactgtggcctatagtggtctatataatccaccctctctctcatctcaattaagtgctttgtccctttctctgttgacatttctcttcttgaacacaccagtgttatccctgccttgaggcatctctacttgttctcccttctgcctggaattctctggatcttggcatgttagtttcattctcatcattcttgtttctgttctgatgtcacttcctcagaaaagctctatatatggccagcaattaaggtagcaggctactctgagtaaatcttccttatatcatagcactgtttacttttcatcctaatgttagtaaccatgtaaaattatcttatttattaatttgtatttgtttatcatgtctctccatccttacttgaagctaagctccatgggagcaagctcttgtttgcctcagttgacctttgaatctccagcacttaggggactatctggcatgtagcagggttttaaaaaataactgttgaattaattcatgatttctgtatagagaaaagcccactaacaagaataacttgggcaacttaaaactatagttttcatctctagaaaactgatatacttccccattaggttcatgatttatattatttcatgtgctgatccgcaaatttgattcttaaaaaaataagacttccttttagacatattttggaaatatttcagatttgattatctgtaactgcacttctatctgacttgaacactgttatccattgctttaataacttattccttattgaatatttgtagtgcatatcaaggcaaatgtaacaccacaaatgtttcatcacacatatactatctctaataattctatattatccttcaaaaaccgtttttaataattatgagcaaattaagaaaatatacatatagctataattttcaatattaatttcaataagctaatttggattactacatattttctataaattttagaatatcaattgacaaggatccttggtcataaataaatatcctcagagaagcacatatttaattatttgtagtgagcatgcatattttaagtctttacttttctttttagttttaaatagactatagatagctgaatcaagaaagactgcagaacattttagagtctgaacatttttctacggaaaagaagtagtcatttgaaatttttaaggtaggagtaacatgatcagattttctcacttggaaaatcatattggtgattgtcgaaaatatgtataggaggggactaagatataaggagatgaagtaccaggttattgccatagaatgattaaaagataatgatgtcctgggccgggtgcagtggctcacgcctgtaatcccagcactttgggaggccgaggcaagcggatcgcgaggtcaggagattgagagcatcatggctaacatggtgataccccgtctctactaaaaatacaaaaaaaaaaaaaaaaaattagccgggcgtggtggcgggcacctgtagtcccacctactcgggaggctgaggcaggagaatggtgtgaatccaagaggcggagcttgcagtgagctgagattgagccactgcactccagcctgggcgacagagtgagactccacctcaaaaaaataaaaataaaaaaataatgatgtcatgatgtcctgaactggaaagaaggcagtggtggatgtctagggtagattctaaaagagcaaggcattttttccatttgatttaaagttactatatattcattttgtgtattttgtcttctaataaatctgtaatttatcctgatattaccactgatgatgtaatctgtatatttaacctaatatttttgttaactccaagatattaagttaaactgtataaccaaacccactgacttaaacactgtgatggaaaacacattttgttgttttgctttgtcctctcctgccagtagcagaagaaggtctagaaaactattttttgggtagaacttttatatgtttaactccatcactactcctgtcctcccttctccatttcctaagtattgcagtgtaagagggacaagaggatagtaggatgtttagattcatttcatatgttattacatttagtctgtgattaagatacaatcagatattatcattcaggaaatgctgtctcttcaaccatcttgaaataaccaaatattttgttttcctttaccccatttttcatgggatcaatttgagtattcaagtatataaatctagcctatatattttagattgacaaatagcttacatttaaattacctctaaaatgcatattctcttcattaccattgaatcatgactaatcactcaaagccttgcctaaccacataaatgtacttagcactcccagttttgtaacaaacatgaagttggaagataaattatttggacaaagtaatattgtgtgagtctctaaattcaactttgggaggcaactcatagccttgatgattattaacataactcctgcagtgactaggtttgatccagcagttgttggacaactcccagcacagggagtttccagagccttaattgtccttcagaagctttgagtacaacttctagaagcacattttaatattttaactatatgtcaggccgtgaacagcacctctgtatctaaactaacctaggttttttcaaattttccctaaggtttccattagctgctaccaagttctcacaacaacttcaatattttattttgctcatttagttagactcagaaataattttgctgaaacattccttgatggaacacatgtaagaatggaaaggaaattttaaaataatcctccaagatgtactttctaccagaataattttcattaatgaaataaagtcttagcctccagagttatattttagtattataatgtgccaatgatttttttctacgataaaataaaacttactcttcaaacattacagattttcaaaaacattttgttctctagtaaattaattcattcaataagtgtctaaacaccaaccatatgtcaggcattctgctgggctattggttacaataattgcaaaccctcctgaagctcccattctaatggatatcagaagaataaagaaccaacaaacaaataataaaacaattagatttaataaaaacacaaggaaaaatgagtggctctttatatttttctttatatttaaagagaaaaacaggtacacaagtttttggtaggatgattaggtcaagcctcactaagaaggtgatgtaggctgaaatctaaaggacaggaactagccatatgacaaaagtgtgggtaaaggaagagcttgtcatgtcaaggacctgaaaggaggctggtgtaactagtgtgtagtgaggatacagagtcatatgggatgaggttggagaggtaagaggggtaaagttatgaacagcctggcattgattacatctaaaaggcaatactcagatgtttgtaatttcttgtaagttcaatagaaaaatgttgatgtgctttcaggagatgaaggacatgatctaatttaagatcatttgctgcttttgtgcagaaaatagattggagtgagacaagaggggagggagttgatagagctagtgaaaagaaagcaagtctgagacacaatcagaacaaggcactctctttcagaaataattaatttataggctactgtaggtttttttatgactctaagaagcaaagcaaatcatgacaagatcttttccaggataaatggttaaagagtgtatgtgaagactccagcttcttcttttctatgacttcccaattcttccccttctgccttttggtggcaggagagtctggagggaatgtagtgtccacatttttaccccagggagatgcaggagggcattgagagcaagaagaatgatgctgagattctgagagaaaatgcttcataccttctaaaaaaataaagagttttttatggtaatcatcaagactaacttagagaaccaagccaaatgtggactttttaggaaacatgaaatgaaatgaaagaaggacaataaattagctcttagcttctaaatcagtttcatggtatataaattgatatttttagtagcaccattaaaattatagaacaaaagctccagatgttgaagtgatatgatgatgatatttacaagcaagatttacccaagattcagaaaatagtgattaatataacctaatcaccaaggcccacagataatagtgtagccattatatttagttacttcccatattttcattttcagtattatgataacctcataatggatatctttgtatatagaccttttttctggattcccaattattttcttagaatgattgctagaagtgcaatgactggattaaagggaatgactttttaaaggcttggcatatacttgccaaactgtcatctaaacagcaatgcctgcattttatcattaaacaaatttttgtagcattttgtccttttaaaaatctttgttaagcaaaaatactatttcactattttttgttactattaatgtaaatatacagatgtatttgacagctgtttatagttccatttctgtaaaattctgttcatgccctttctatgtttcatgttaagaactttctttaaaatgttataatcaatgtataaaggaagattataaaacttttcctgccatatttgtgtaaatatttttccaggtttgtttttaaatgttattaatgatggattggtatggtttatttttatgcaaaatgatgaattctgattataaaagttcccaaatatttaacgttgaacataaacagaaagtcacaaaataatacatataaggtcatgcatcacataacaaagtttccatcaatgatgtaccacatataagatggtggtcccataagattataattctacacttttgctgtaccttttctatatttatgtatgtatatatatatacaaatacttgccattgtattacaattggctacagtattcagcacagtaatatgcttatgctgtggaggtctgtatcctgagagcaatagattataaatacactatgccttctaggtatagtcatatgttcgcacaatgaggaagttgcctaatgacatttctgtgaagacattcctgtcattaagcaacgcataactataagcccatttatatgaagtttaaaattagaaaatacattgatgtttaaaggggtttgtgtgtttaatacacacacacacacacacacacacacacacatatttatatataacatgtgaaacttcctcaaaaaattcagtccagtgttgcctctgtggagtgatgggggaattatcaggaagaggcttctggggtagtgcctgtgttctatttatttgcctggctggtgagtacaaaggcattgatggtattgtttttaaattatgtttttaggccagacatggtggctcatgcctatagtcccagcactttgggaggccaaggtgggtggataacttgaggccagaagtttgagacaagcctgaccaaagtggtgaaaccccatctctactaaaaatatgaaaattagccgggcatggtggcacacacctgtaatcccagctactcaggaggctgatgcaggagaattgcttgaacccaggagactgaagttgcagtgagccaagatggccaccacatgctagcctgggcaacagagtgagagtccatctcaaaaataaatgaataaataaataaataaagttttaaaaattactaatttacataatttattttaaagtggcaaaagtcaaaagaaggttgaagtagttgagtaaaggatagttagtttggcactttggaggtctatgtattagttttctagagctgtcatgacagtacacagactgggtggctttgttcattttctcaattttgggggctagatcaagatgttggcagggttggtgtcttctaaggtccctctccttggcttgtagatggccgtgtcttcccatggccttccctcagtgtgtgtgtgtgcaagcatgtgtgttgtactttcttcttcttataaggactgatttgtattgctttagacccactctaatgactttattgaaagaccctatcccaaatgcagtcactttctgaggtactagggggttagaacttcgatatatgaacttgagagggacaaaattctgcccaaacagaggtcattggtaggttcaagagagcaactttcacaaaatagtgtgggtgaaagtcttatttctctaagcaaacctcatagaactcacattttaaagcgaggaggcaaaataaataatatatagcaatacataaagttttgtcagatagtgatagtatctgaaggtagctgaggaaggtaaagagaggtgggagagagcaagggcatctgttttcactaagagtgcagggaggggcttattctgataaggaaatgcttgaaaaaaaatggaataaagtgagagaaaagttgaagaagttatctggagagaaggaaatgtattcccaccagaacagtacaaaagccctgaactggctgtatgtttagatgttcaaggaacagcaaggagaccagtacggctggggccaagcaagccatgaggtgaatctgaatcatagagttttataggtcctgattaaggactttagattttatcctaaaggtgatgagaagccattgaaccattttaaggtgggaagtgacatgatcagatttatattttacaatagagcatctcaaccactctttggaagggaagtagaaatctcatgaatggtggtgcaaatctctgtgaatctctggaaacagggggatcagttaggtgatagtccaagcaagagatgaagatagctttgactagtgtactaagagtagaagtgggaggcagttatattaaggatttatatggaggaagacccaacagtattttctgatgattttatgaggtatgtgaaatggatatggcagaactttaaggatttagacagaccagcacaatcatctcctgaaacaactagcagaattatatattaaaacagaatcatctactgaaaatacatgaagaaaagaaggagtacttcaaattttgacaagctgagttcaatatgctagttcaatatgcctatgagacatcccagtggagagagagaaaaagagaatcatctagcaaaactgagaaagcagctgaggtcagatgacataaacttgtcagagaaccaactggcataattatataactttatttgcaatgcataccagcctggatggagatggaggaaacagagatagcagatgtttcttggtgttgcccaaagttggcaaatggcatggttaatataagtggagatcaaggaaaacaaggatttattacttctagttaaagaataattaaaattgctgaacagagtcagtattatatattatgaatattagaatattttcagctgttagtaacaaactctcaactcaactctcaactcaaaattgcttaagaaagcccctgtggaatcagtgtctcaaaaatataactaaagaacaatttttccccatttctccacttgagaggcctcagcttcattctaaggcttgttccctctgtggttgaaagattctgcagatgtgttaggaatcacacagaccctataatgtccaagaaagaagagggtctgtctcttttgaagcttcatcttcaaaggaagcccagcttttaacagaagctcctcagaaaaaccttccccataatgttcagaagtgtgtcaaaagtctttccttaaactagttaaatatcatttctataattgctcaaagcgatcaagattcatggctggtctgtgattgagaaaaccttccttgatgagtgaataatatctgaacaaaatatgaagagtattagcaaagaagcagagagagaaagattttttgcatgatgttcaaagttaaatagtgaggtaaataaacacagacataggatatacatttagagaaattagagacgaggaaattaggtcaaagagcagcttcataaaaatgcagagaaagttactttgggcagtatggccattttcacgatattgattcttcctacccatgagcatggaatgttcttccatttctttgtatcctcttttatttcattgagcagtggtttgtagttctccttgaagaggtccttcacgtcccttgtaagttggattcctaggtattctattctctttgaagcaattgtgaatgggagttcactcatgatttggctctctgtttgtctgtgattggtgtataagaatgcttgtgatttttgtacattgattttgtatcctgagactttgctgaagttgcttatcagcttaaggagattttgggctgagacaatggggttttctagatatacaatcatgtcatctgcaaacagggacaatttgacttcctcttttcctaattgactaccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctaatttattgagagtttttagcatgaagggttgttgaattttgtcaaaggccttttttgcatctattgagataatcatgtggtttttgtctttggttctgtttatatgctggattacatttactgatttgcatatattgaaccagccttgcatcccagggatgaagcccacttgatcatggtggataagctttttgatgtgctgctggatttgacttgccagtattttattgaggatttttgcatcaatgttcatcaaggatattggtctaaaattttcttttttggttgtgtctctgcccggctttggtatcaggatgatgccggcctcataaaatgagttagggaggattccctctttttctattgattggaatagtttcagaaggaatggtatcagtttctccttgtacctctggtagaatttggctgtgaatccatctggtcctggactctttttggttggtaaactattgattattgccacaatttcagagcctgttattggtctattcagagagtcaacttcgtcctggtttagtcttgggagggtgtatgtgtcaaggaatttatccatttcttctagattttctagtttatttgcgtagaggtgtttgtggtattctccaatggtagtttgtatttctgtgggatcagtggtgatatcctctttatcattttttattgcgtctgtttgattcttctctcttttcttctttatttgtcttgctagcggtctatcaattttgttgatcctttcaaaaaactagctcctgggggctttaattttttgaagggttttttctgtctctatttccttcagttctgctctgattttagttatttcttgccttctgctagcttttgaatatgtttgctcttgcttttctagttcttttaattgtgatgttagggtgtcagttttggatctttcctgctttctcttatgggcatttagtattataaatttccccctacacactgctttgaatgtgtcccagagattctggtatgttgtgtctttgttctcgttggtttcaaagaacatctttatttctgccttcatttcgttatgtacccagtagtcattcaggagcaggttgttcagtttccatgtagttgagcagttttgagtgggtttcttaatcctgagttctagtttgattgcactgtggtctgagagacagtttgttataatttctgttcttttacatttgctgaggagtgctttacttccaactgtgtggtcaattttggaataggtgtggtgtggtgctgaaaaaaaatgtatattctgttgatttggggtggagagttctgtagatgtctattaggtccgcttggtgcagagctgaggtcaattcctgggtatccttgttgactttctgtctcgttgatctgtctaatgttgacagtggggtgttaaagtctcccattattattgtgtgggagtctaagtctctttgtaggtcactcaggacttgctttatgaatctgggtgccatccccctcaagctaccaatgactttcttcacagaattggaaaaaactactttaaagttcatatggaaccaaaaaagagcctgcattgccaagtcaatcctaagccaaaagaactaagctggaggcatcacactacctgacttcaaactatactacaagtctacagtaaccaaaacagcatggtactggtaccaaaacagagatatagatcaatggaacagaacagagccctcagaaataatgccgcatatctacaactatctgatctttgacaaacctgggaaaaacaagcaatggggaaaggattccctatttaataaatggtgctgggaaaactggctagccatatgtagaaagctgaaactggatcccttctttacaccttatacaaaaattaattcaagatggattaaagacttacatgttagacctaaaaccataaaaaccctagaagaaaacctaggcattaccattcaagacataggcatgggcaaggacttcatgtctaaaacaccaaaagcaatggcaacaaaagccaaaattgacaaatgggatctaattaaactaaagagctcctgcacagcaaaagaaactaccatcagagtgaacaggcaacctacaaaatgggagaaaatttttgccacctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagccaaaaaacatgaaaaaatgctcatcatcactggccatcagagaaatgcaaatgaaaaccacaatgagataccatcttacaccagttagaatggtgatcattaaaaagtcaggaaacaacaggtgctggagaggatatggagaaataggaacacttttacactgttggtgggactgtaaactagttcaaccattgtggaagtccgtgtggcaattcctcaggggtctagaactagaaataccatttgacccagccatcccattactgggtatatacccaaaggactttaaatcatgctgctataaagacacatgcacacgtatgtttatagaggcactattcccaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaaggacaaaaaaccaaacaccgcatgttctcactcataggtgggaattgaacaatgagaacacatggacacaggaaggggaacatcacactctggggactgttgtggggtggggggaggggggtgggatagcattaggagatatacctaatgctaaatgacgagttaatgggtgcagcacaacagcatggcacatgtatatatatgtaactaacctgcacattgtgcacatgtaccctaaaacttaaagtataataataataaaataaataaaaaaataaaataaaaaattcagagaaagagtaatggaaatttacagaaaggctaggatgttagcttcaaaatgcaggattgttttggattcaagaaacagaaattgctgacaagatggatactgagattaaaacaatttatgatgctgggtaaattgccaaggattatgtcaataagttgagttgtaagaattctggtgcaaacaaagtcagtaaacacaggtttatcctttaaaaatatattatttggctctatcactgttaaataacatttaagtagtcaagtagagaggaatatttaaggattggtttacatcattaatgacataaaaattgtaaatgtttttgttttgttttatattttagattagttattccacaattttgaaatctatgaggcaaatccttcacctcaaataactgcatttggtgatgtgttctaaatttagaatgttatactgggagggtagaatctggaaagaatattgctgaaggaactaaaattggaatctagcatgaggaggaactcccatatatagtgagtgctttggaaaaggacgtcagaaattaaagaaattaatcatttttggagaatgtaattatagtgaagaattttcggagaatgaaccaatagtcctaagggagatacctttattcaaagatgatttcatttttctgagtattgggtattagcaaaattttaattttactaaaaagtaatgtgtttctcttacctgtaagtataacaccaaggtttgagaaacttcgttgtaaagtttcaaccaatttatgatatatgcatgaataaattattcatgagaaaatggataatcttttacaatgatttatatgaagaattttaattattggtaagcctaattttgtatttttctatgaatgttgatttactaatgacataaaaagttacattaagatatctattctttacactcaagtggattgaaaacatcctgttcctaaggatgaactaagatacacctacccccgccccaaatcataggatattactttaccttctcttctgaaataagagcaacacaaaagttaattaaaacaatcagattatctttaatagatatatgcatcaaccatcagaacaagacttcaaaattcactttcctttgaaacattataggctgtgttgaaatttgtaaccctcttaggaaaatataaaaacaattgtctgttctgagaaagggagttgggttttaaattttctctcctgaggtttgacacttattcactataacataaatttgaaaaccatttagaaaggaaagtgactttgtgatttttaaaaataaaacccttgaaatttctcataaatattactggaagcctttaatgccatagtaagagggaatataaaatgcttaaactggaaagtgatatgtcaacatattaaaatggtccattcgatactacattagggaccagctttagtgatttatgaaggaacatttaggtctcaaagtaattcccatagttgggtaaggctagaagccaggcctcttggtagattcttcacagtatgagagcagtgcaaaggacattccagaggcagtttttatagacacattctgcaaaatcatccagaccaaaacaaaataaataatttagaacaatttcaagagtatgagattatccagccagtagtccttcttctataaccttccattttagggcctgcatacttgactctcacttctttttcttaaaaatgggctcaaaagcaaataatcagtcttgggtcacatggccaggagaagtaagaagagtgaaggttattgaaggttacagaaaatgcaggaagagtcgagggtgtggcagagtacagagactaactcctcaagtcccttagcccatagagatgccttagaattctgatgtgcctgaaagttgtgaatctttaggatatcaacatccatgtagatgattcatccaatgccatagcttcttaatttatctaacttttcttttctgatgatcttgtcctgtgtcctgcctcagccacccactcatgatcacaaccgaaacaggaattcacagatttcagtgtgaatttgaatttgagggatttctgaaacttggatggtaaaaaattacattataattttcatgaatttctaactgaaatttggcattttaaaatatatgaatttaggtcacatattactctgtcaccaataacaatcaaacatattctcatatatttcagctgttgaagtattacttcaataatacatttcttaaatctgctcctagatcctgttatttaatgtgttaataagcatactatttgaatgtgttagtaacttacatttggtttcttgatacttttataaatgaatttcaatacaataggtttttaaaaaactctatgtattatattttatgcatgtaataagagcattattctcagtattttcagaaatccacagaccactaaacgggtccatgacaccaaaaagtttaagaacccctgtaaatcttaatattactaataactgcaaatttttttctttaattttgattttaaatactgtgttctctgaccactgattcttctttttctagtttatttccttaaatctcctcccaactccagcagttcttctactttcccctacccagactaccagtgatcttattgcttatttcttttttttttttttttttttgtccttcattcatcctcatgtcctcagctcctgccttgaatgtcagctcagattccacggttcatattgaaaacaactgccctatataccttgtccctttccctctttatgcttctcacttggccaaacccaaactcatattaaatataactgttcacattttatgtgtccacatccaggcagaaggcagaagccatatgcccctaccaagatctcccctttgcattcccatcccccttgcattcccatccccaacattcaccctctcaccagcaccacatacctagagactctgagatataatctgttcatgcccttcagccttgtttatgacagtcacctacagaaacccaggagtctctgattaacacggatccaggtgcccattttctgacatctctattcatactttactcttaaaaccttcccactgttccctctaaaactcaccatcagttatcagtagagtcttctgtaacttccatctactcactgaatgcttccttcaccttttaactttatctgaagtcttgctctccctgatgacattgctccttctgcagtctattcaaaagtggtggttctctctcataccccttgaaggctgcacctggtggagggtagttgaccttcctttttgtcacttctacagtattctctttctctcttgcctaaaaagctctgcttggaatcataccatcaccctctcccacccatttccccttcttgtccaagttttctactagcctctagggccactcttactcattccatggagactttacttttcagataattttcattctttccaaatgacattggagagaatgccattctcttttatacttctttcataagttctagtgatacaatgtaggcataaatgatttttgcattactctgtcctctccatttctttctcttattgatgttcttcccacggttctaccctagcccttttcattactatctacataatctcaaacatcctatcctctgcccacttcctatctttactcttacctctggtactcagactcccaaaagtttttgacctatcaggaaggacaagccattgatctgaccactgtctgtgtcccttaccttccttgtatcctcactctttccatatccagcttaaatcccacagccatataatataattattcccttgcatagaccacccattccacccagaagttcccttttgctactctaacttcaccatactcacttggctaaaggaatggattaaatttaactcactacttgctccaagcctacactttcatggctaaaggtggccagagaagaatgccaacacgaacactggtttcaccttgaattcatgaccacaaaacttcaagtgggcccatagtgctgctgggccattccactagattttcctagcacatccactctttctttcacctagaaacctatttcacaccttctttttttctttcctttaatttctaacacatctttaccatcttctctctttagtcaatgaccttgcttcctatttctctgagaaataaaagcaatctgaagcagtcgacacctacacatacgcccatgtgacctgcctttctttctaagatcctggctgaatgttctatgttcctaaggacacccctccacatggaagccagattctaacacctctcgttaattcaagaatattgcttcaactaccctttccttcctcttctacatcattatatttctttttttctatttgatttttctcatcaccatacaagtattctgcaatattgcccacttttaaggggggaaaatacaaataagacaaaacaaaacagagcaacaattgaaagaaagaagaaggaaaaaaatgaaggaaggaaagagggaaggaaggagagaaagagaagaaggagagaaagagaaggaaggaaggaaggaacgaagaaaaacaaaaaaagaaaatctcttccagtaactaacgcatgttctattatcttctttggagtaaaattcaacaaataatttatcatcttcaccacctaattcctcttccaaaattctatcttaaatttgttccaatcagattttcaccacaacaccctgtcaaaacagctcttgtcgaggttgctaatgacctccatgtttctaatttaggagtagtcctctccttactcaagctctcagcagcactgatgcatatggccactttctctttcttggctttctgggcaccagtctgttttgatttttcttttccccttaagagctgccattctcagtctccttttctggtttctggtaatcattccaacctttgaactttaaagtctcccaggactcagtacgtcagtaattcttttcctcttagcccttaggtaatctcatgcagtctcgaggctttaagtgcatgacatgtatttgtagaaaacaatcaaatgtcagtcttctctgatttattcagctgcctgattgctatctccattcagacatctaatttaaactcttccccatctccctttgtttgctttttctgcagttttacccatctcaataaagtatctccaatcttctttgaagtaatttttggcatcattttctttaacacaccacattcatttcatcaagaaatcctgttggttttaccactaaaataaatgtattgagaaacatccacctctgctgctaccatcatagggtccagtcactgtgccttgtctccaggattgttgcactaaccatctaattgtgctcttcgcttggtgcttaacacctacaattcattcttaatataatgaccacagtgattattttaaaatatgtcagctcttctcatgtctctgcacaaaaacctttaatggcttcctatctgagaaggggactagatcatattcatatttgtattttgcctgatctctgccaatctgggtcactaccattaactccccagctcatgacatataaaccagtttctggaaaacataagcctgtttattttatttcccaatgtcctgcaaaatttgatttaactaattaagatgtctgtaatttttttgttttgagatggagtcttgctctatcacccagtctggagtgcagagtagcacaatctcggcttactgcaacctccacctcccaggttcaggcagttatcctgtctcagcctcccaagtagctgggattacaggtgcatgccactaggcccagctaatttttgtacttttagtagagacagggttttgccatgttggccaggctggtcttgaactcctgacctcaggtgatccgcctgcctcggcctcccaaagtgctgggattacaggtgagagccactgcacccagtcaagatgtctataatattattataaatttatgtatgtttttattatttatatgttgcattagtccattctcatactgctataaagaactacctgaaactgggtaatttataaagaaaagaggtttaattgactcacagtttcacaggctgtgcaggaagcatggctgggaaggcctcaggaaacttataatcatggcagaagggtaaaggggaagcaagcacatttgcacacagtggcaagaaagagagaagggggaagtgctacacacttttaaacaaccaggtctcatgagaactcactcactatcacaagaacagcaagggagacattcatccccatgatccaatcaccttccaccaggtccctcccccaacactggggattacagttcaatctgagacttgggtggggacacagccaaaccattatcatatgccttgattatttaacataggtatgttctctttttgcataaatgagaataatggtgtctacctttgatatgagccataaatgaataaattaaacctgtttttatatatcttaaacctttgccacccaattataaccggaagtatgagtgggaaagacaacactctatatcagcatttctcaaactttcttcattattgcctccctaggaagcctcgttacatattatttttccaagtgttaccacttatgaaattttaataccaaaaatctactgtatagctgtttatgttatgtggccctttagagatccaaaactattatgagatttcagattttcccaccccacaagaaccaactttcacttagttggaggccatgttggccctattgagaatgcatgctcggtggagattctcactcattccactccctggagacacagtaaattctatgaatcaatcagtccaaaccttcagtgagctgtgtttttagaacatattgctttgtgatcttttttttttttttttttttgagacggagtcttgctctgtcacccaggctggagtgcagtggtgagatctcggctcactgcaagctctgcctcccaggttcacgccattctcctgcctcagcctcccaagtagctgggactacaggtgcccgccaccatgcccagataatttttttttttattttttagtagagacagcatttcaccgtgttagccaggatggtttcgatctcctgacctcgtgatccacccacctcggcctcccaaagtgctgggattacaggtgtgagccaccgcacccagcctgttttgtgatcttatataattaattttgtattgaattgtactttagtcttatgctattggcttagactgagggcaattaaaaataaagtagagaaacaaaaccaaaaaaaatacacaaaatctactattatattattctacaattgttgaggatatatttctataaaacacatacaaaaatgtcctctttttaaggaactgtgaatgaaagttctctcaggtaggggtgaacctatagaagtgagcaccctggtctaggccaataaataaatatttaatgtctaaataaaataatttaatattaacattaaattagtcttgaaattcctgcatactatgtatttaatggagaagatgagatcttgtaagaggaagaatgcaaggaggatcacttctgtctaaactctggaacagttcatctcctaacatccaccccacacaaacacacacacacacacacacacacacacacacacacacacacacaaagaaacctacagttaaataatccattctctgtgagcagtgtagatattacttattggaatgtattaaatagcagactcactctccacacacacacactctaaatagcttatcagcatcttccttcagtagagaactgtgggggtagaatactgtgataaatatgctttcccaatttcttgtatttctagtactgtgttggcatccagtacagtttatatcccggatatctgcccaactagactgttccataaactttgtctctggtcttaagaccagaagtagataagctcttcctgagacattacttgtttttatcttttggataaagacattggaaactcaatggctgatgtatttccgtgtttgcactgcatggccaaagctcagagccaaatctgctacatgcctatagcaaaatatataaagtattgtatattttactttaaaatgtctgaatatatatgcagtggctttaaaaagtgcctggaacaacacagacacaataaatattagcaatatttgtactagctttagttgatgttgctgctattttggtattacctcttattttgtatcatgtttcctaactttatcttttttcctctcaattttcttatttgttttctttatcatactttatctatctttgtaaactatcagaaagtctttttagaatgaagtagcctataacttataagtaaatatttatattttatcccccaaagaacctggcaaaccattttgactcagtgtttgttttttcaatttaactagcaaaaaaagttctctagataaatactgttggattacaatatctggaagacttcaatagtaaatgtcttaagaacatttatttatcctcaagaactacaaaacatgaatcggatttccagtatatgctttataattaaatttaagccaaaaagaattcttgaaatattatttaaagttataaagaatgcatctaaaatgtgagagccaataaaatctaaagagaaaattcttaaaataaaatggacacaagaagaaaaatgaattaaaaagcacttacatatttagtaaaataaatgtgcttagaaaatagagaactggcatgtgtgatcctaagactacatagatattataatccaagcagaagtctaaaatataaagcaaaccaatttgatagagaaatatttgaagtagaaaaaataatgatgccatcacatttgaaaaatatagtcttcataattcttacattctttcaagtatcccaagtgctttcgtgacattatatagtctgagtttatttttagaaagccttggtttttataaataaaaagacattctttctttttatagagtcactatgaatggctgactaaacttctaaacatataaatacactgccatggatatatgatacccaaaatgaatttgatgtagaggaaaaagtagttcacagacaaaatttatttagattttgtctctttcatgttttcactaaatatatatatatatatatatatatatatatatatatatatttgccaataatgcagtgtcagttctttataaggtggcttattcctggaaactcttgttattttgtaattttgttaattatgttgccctttatattgatgatttagatgtttgaacatatcttttgtagctctctgcagccacatgttattctttttgcttttgctcctgggactgaaaactgtcgtcatcaagaacttttaactaatctttaacagattttaaaataactaacatatatttaaatgtcattacaaataatataatgctagctcatatttattattatacttgttgaactttggattcagttaaaggaataaagaattatttaacttagcattttcttactctgactttttaatccttttttacccatttttaaaataaatacagtgtaccactaaggcaaaagtccccaaaactctattgtcttcttgttctttcattctttaaaaatatatattgtatgccagctcttaattgtgttcatggaaacttgtaaaacactaatcaatattctataagccagataaaataaatataaaaggaaacattttatatctgaattttagaggctaattccctttcctcaaagaaagagaagttatattattctcaaattaaagtgaaaatgagtatgctttcttattgctacttgattatttaggactatatagtgccttaaagtctctatactatcctttctggtataagatttatttttctaaaatttgagaatgataaaattagtaataaattttgctaggagttatagcatcgatattgggaaaaaataaggcaactatattacaggcactagtaaacatagtattatacatatttcctagaacatatttgactataaacatttttctacaaattaagtagatattgttgtcaatgcctaatatcttacctatttttcatggaacataacatgtatgaggcaaggttagttatacacaagatgaaaaatcatggtgaaaatatgattagagtatctgctttagcaaagagagaaatggtaattctctcctcattttaaacataaacaagtttcctatctttataattaacctattgataatataaaccaaagcacttatcacagaacatagcagttgctcaattattttattgatcttcagcagttactaatacattctgtaagctagcacacaaataaggtacttcacatagaataatgtctttaaattacactatcagttgccatgtcacatttaaagaactcattctctagttattagatgtacttgaatgtacttatgtgatttagagaatgtcaagtcatgcaatatatttttgcaaatttgatgaattttcatttatatgtgttaattttaaaatattgtttcaatcatttaatatattttctacacagctctgctgcatggtcaatgaacagtatgtcatttgtggtttatcgtcagccatttttaattagacgaaatccaacattgcaagttttaaaactgaagattaggcatcattccaagtagcaaatatttttgttttggttttcttctaggttaataacttctctgacatttgcacaactgtgtttgaaatatagtctaatagaatatgtatttgccttctataaaattaatgtcctagacgatgataaaatatgttgaagttttaagggaattattttttttattatcttggattggtctatgaattaatgaaatggaaattaatatacatgagaggatcaactataactttacattaatttagagtattataagcagtggcttagaataagagtttactttttgtgaatatccaggataactttcactagcttctccctttttcacaatgcatttcttggtaaatattttgttatcatcacgacagtgggtgtttctaaaacccattcatatattttgccccatctcttcttccttagtgtgttttcctcctcctccaggaaaccccttttctgctgccacctggaagtaccctcctttttgctcccctcatatctttggcattctaagtgcaattgtgtttaccacaccgtactacagttgtggtttactatcattcaaccaagatctcttgagaagaagaaaggccatttctgcacccagtactgaccacagaagtagtgggttcttattaaattgaaattcatgaatggaggtttggcagttaagttttttcctgttatattaaaactgagaagcaatcctaaagaaagaaaaatgacttggatagaaactcacattttaatcacatttagatggttcctgcccacttagttaaaacaactagcatctttatctataagttggatcatgtcaatgtacctttctcagcagtgacttcctctctcttccctctcagcttcccacacagggacattacagccacggatttgctcttactttgaagaagcacgggtacctcagtacctagatcttcttttgagtttgcacaaccttggagatgcagagtagttaagttgtagtcagaagagccctgattcctcccggcttggattaagtggtaccctaaatcctaaataccttctaatgccctttagtctgggcctggccagatacttctttcctgagtccattaccagaaatctttggaatgtggcctgcagagaccacagacaattggcactcatttttcaacaaacaaagtaggttagaaaataattttccagctataataatacaaagagccaccaatcatgaaatatttatttataatagcaatgcactctgtatctttgttaaaataacacaattagctaattgttactatcaccattttactgatgaagtcactgaaattcagagagtttatgtaacttgtccaaagtcctacagctggttaagctaggagccagaattcaaatgatttagttctaacactaaagcatgtgctcttaatctgtatactatgttaggatgggattagttccatatggcaatttttagcaagaacctgatattgggacatgacatagcaacaagagaagagaaacagagatacccagaaatacacaggtcattctataagtaactactatattgcagaataaatagtgaatgccagataggcacagctaaaatttctagcactccaactccaaaccaaattttgttaactatttgggagaggacctgacatagcttctgccattatctaaacagacagaatccacatgattcttggaggaggaaaaaattaaataaactcagattactttcttttaatcttctagactccatccgtacaagtggaaaattcatctgactcagttaaaactaacatatttaaagcaccaattatatagtccaattaaagtattatctaaatataacatttagatcataatttattatattataaatatttggatatttataaatattatatttagatatttataaatatttataatatttagatatttataaatatttataatatttagatatttataaatattataaatatttagatatttataaatattataaatatttagatatttataaatgatatttataaatattataaatatttagatatttataaatattataaatatttagatatttataaatattataaatatttagatatttataaatattatatttagatatttataaatattatatttagatatttataaatattaagatatttatattataaatatttagatatttatattattatatttagatatttataaatattattataaatatttagatattatttataaatatttagataatattttatttcctctaaagaaagagccatgtattcctggtccaagattatattctaaacacaggcttaacttaaaatagaccatgatcactacaaaaaggaagaaaggtgataaataacacttaaaaatctcacatgtacattagtagaccctttacaaggaaaatattattaaagtttaatgtgcaactaatttagctcggtgaaatatttttgatatgtattaaaaaatcaacctatggctagctaacaatgtaattctcagaatatgcaatatcaacataagactctgttcatatttctgaattaagcactttagtggatattggtttagatgggctgattgcttgattttaaatcttatttgatgaatttggaatggaagattaagaaataaaggtagagaggtatgattggagtataagttatatttagactgtgaaaagggagaagattaagtttgtggtctttgctttttgttttctggcgttttggcgtgattttttttatttttatattttgcttttcttatacataagcatgagatgatgagatcctaaacttctaatgcacaggcaataaaggtgaagagtcgtgagagattctagagctatactggagatcaaatcagttggacttggcacccaagttgatatattacaggcgaggaagaaaaagcactttgcaaatgacggcattttctattatgaataattaagtgcatggtacctcatgaactgaactaagtagtgcaggaggatggacaatttttataggagtagtggcaggaatagggagtatagagggagagagaagtggtcctgtgacaaacgcaagaacctcaacatggaaaaacaggtaaagtgaacaagagataaaacaatccaggtaagacatagtaaatccaaaatgagtcaatgctcccaagcttctttttaggtttcctaacatttctctcaacacctagaaaattcattatgaattacttcatacatgttactatatcatcattgacaaacacctaaaagtccctgtttccactgtcaagataaatgagtataataagacacaagtcttgaaaagagaaaaagcaataataaccaaaaattgtatgatggaatgaataaaagaagcctggcaatactgatagaaatgctggtattgaaggaatttcagttccattcacttgtgggaatttgatttgttcaatgtaaacaaaatggtttcttaaagaatttcccagaattccaaatggttagaaagaagtaactactctgctgattttataaataaactcctgcaaaagtgatgaaagttaatctttttttcccctttttttaacttaaaaagaatttgaaaagaacttaaaatttcaaggtttaacaccatgaaactatgactaaggatgagccttttcagaaaagaaggaagtctgaaaaatatataaacagaaccaaggaaattctgtgcagatacaatccaaggtgattagaattattttatatcttcaggttgagaaactgaacaagcacaatctcttagaaattttttagactagtcaatgtccaattctagccagtgactccttacacacttcagactatagttaaaatagctgaaaaattatttctgctgtgaaagtacaaagagaagattcagcttgttatgatcctcttaatagtttcagtgattcaatgaatttggacaatttcttataagaacttcatgtgcatatagcaaaacagagagacaccaattaatcctttttgatagatggatgacactgaattgtgaaataaggtcccaagatctaacaaacaaatgaattcaaggtcataaaaagaagaaaaatcttaatagcaaataccaaataccaatacactaggagaaaaatcttaataccaaataccaaatcttaatgcccttaataccaaataccgatcttaataccaaataccaaaatacagcctcaaacaggtgaatcactcatttgtcatagcctcaaagccaaagatgactgaagaccaacagaactttttgccccagttttatcctgagaaagtttccagggtagttctgtctctgcatcaccatttgaaaccagtgagagaatgggattattggctgtcattgctattgaggcttttagaaacctctagtcattttcaactctcaactcattacattaaggaaggcggcatcactgcattctctagtaatgtttaaagatgtttatgaagcagccaggatgtagaggaaatagtactgggcttagattctggtttatgttcaatacctaagtttactgtcttttaggtatgtaaatataagccctaggtccctaatctgtaaatacaaataatgatacatactttaactgtatcttataagaatttagtaaaataaatgttgtaatgtgtcctagacaaattaggcacttactaagtggtttaaaagaattaaaaaatccattgaacaggccaagtgcagtggcctgagcctgtaatccgagtactttgcagggtcgaggtgagaggattgcttgaatccaggagttccagaccagcctgggcaacattgtgagaccctatatctacgaaaaatataaaaacttagctgggaatggtcatgcatgtctctaatcccatctactcagaaggctgaagtgagaggatcacttgagcctgggaagtaaaggctttggtgagctgtgatcgcatctttgcactcactcaggcaactgagtgagtttgtctgaaaaaaaaaatgaacagatatttgttaatgacatattatggatcaggctgtccagaatcttatgaataaatgaaataattttaaggaaaattgagtctcatggccagttagtttcactctttctctttattgtcaatacccacaaacaccagccagtctccacaaaaaaagagaagcaaagcaatagaacgagcaatttttgtggtgggggatgattgcaagggacagtctttctttgtatgtaaataaacccacagggccatgtatctgttgaaaatgtccaagaagtcctagtcacagtgctcaactggtccctcaagacttgcactgaagaggaaccattaaccttggcatagtggaacatgtaaattttcaaactttctctctggttctacttgtctctttgcctcaaaaactaatttggagaaggcaaggtagaggcagtggaaggaataatttagcacttgtttttataagtatggcaaaatggaatgggcatttgaagttgccagtctttctaactttgattgaggctgagaaaagttactcctggtgataactcagtgtatttcacaaagttggggctgtaaatgtgagaacattctgtcaaatagctatttccaaagccaagtgcacagattacctaataaactggctctggttgttggttaattaatcacaaattaaaaacttgaatgttatttataaaatattttgtatacgttgggaataaaacaaacccatgaaacccattatacataattctgtgttttctatagaacagaacccagataccaaggtctgagtctcttctgtcttattccagactgagtatgttctcactaaatactcactaaaaaatcaaatatctttttaaatgaatgaactacatttaatattgcaaattcacaattcatagatggtttttactttgcattttaaccccattatgtaagtattagactcccaattttacaaataagtaaatggagcacagagagatttagtaccttatgagaggccacacactcaagtgagtggtaacagtatgcagatagaattgtctcacctcaagtctcatgcttttgtgtaaatgtcaccttgcatttctaaagaagtaggtaagccagttttaaaagtcctcataattatggtctcaccttgccccaaaatatcaaaattgggcttgttgagcatgtgcttattggccagcttcttataaaagctagaagttgcttttatatttcccagcaaatcaactggtcatcactctattggaaatgctcactcctttctcaaagaggaaatgcatcctggtgatctggtgttttctgacagggaaagggccagagtcaacagtaaggaacaaatacaactgccaggataagctgccagaaaaccatgtacctctgccaaacaaacaaagatctattttgcttggcatgtgggtttgggttcacaattgccaaacgaataggagcagaaagattagtgggcttcactggatggaaaaacccaccgaagccactagcacttagatgatcaagcacttaatgtatatttataaactaatatcaactttgattagcataaataagggaaaatgtaacaaatatgtttgcaaattttatggctcaatgcttgatattctcaaatatattatggtttgcctagaattacagactcagggctgtagtaggaaccttaaaacttataacattaaaccctatcattttacagaaggaaaatccacatccttgagaagtaaaacagccaaagatcacagaagcatcagaaccatgtcttgagcccaaatattctctgttgctaaagttatataactagctattgacagaactagaggtaggtcttaagctgtcttttttcttctctacctagcttagtatttgagtgttgctatctcaagtaggcaaagggaaataaaatcatcaaaagcaaaataagcaagctgatacacagacaatatcataaaatagatattttagggaaaaaacaaaaatcatcaaatgtgcaaaaattctgctgaacctcaaagatcaaacccattttattttctgatttctctttgggtctcttctttagaaactcttaaaaccaattagtgtgactatccattactttattttgtcaaagtcatgaagttaatgcttataataatctaaaattgaaaattacattaacgttttccccaagaaactggtttgaagccaattcagctaactttctaaaaagacacctcctttgttaacattagaccattcataaaaataacaattttgatatatagttcaaagaaaatgttaacagtaacctcactgaattacagcagtgttactgaaaattgtatgctagtttccaggcaagtacaacttttctaccttacagatttgcaagttttacatctcaactctagtctatacttgcattgttgataacatttagacaggatggaaacctggaaagaaaaaaattatgcaagagaaaatgtgcaaggagaaagagacaaagatgagacagaaatgctaaaaatgaatcaagcaataattcaaagattcctttgtttcagacatttcataaaatctcagttaatacatttaaaacatttgtttttacctcaatagcttcacattgaccaagtgttaattcaaggaagtaaatgggactgcatgaattttttaaaattatcattgtcagaaaattaaccatacaataaagtagatttcagtgtctcaaagtaaaacatacctcttcttcttttaatgtttgtttttatatatttctgccacaaaatttaataaaataaatacctaactgatttcctcacctagttctgacagcaatccaatggagaaacaaacacaattcagtaatttgcagaatggaacaccaccagtaaaagaaccccagaaaattcccaactgattagactaagtccaaaacaaagctcttcaccataaatttaccattttttcagacaaattcttatgagtgactaaatttgcaaagtggcaaactcacaccaggcctttctgtacaaataaataagataaaaaatgctgaaaaattcgaacgctgcacctaccttgactgcgtcccagtggttactcataaaaatggatccagtactctgacaagttcactgaaagtgttgtcttcagtagctaaagagagcacttgcttttcttgtgttgattagcctcaagcaattgggaaaatagctaaaagctgagaaaggcaaattagagaggttttaaatgatacaggtgagcaaagtcctgaaacacgtttttccaattaccacaaatttaccagaaaacgtacttttccacagctatgggcagaatataattcctgtgtgatggtccttgatagaaagttactgtggtcaacaagtttgggagatactgattatcctctgttgctttgatgattctcaacatgcatttatttgcactttttagatgagagtagtctcttttttgccccagaactcctcttttgctcctggatccacacagccctttcactgggcaaagtaccgttcctcctgagataagaatgaaagctaccatcttcttacatggccctgcttccttggccagagtgattggttgagtgatggaaagcttctccaaactagttcaatcaaagaagccactaactcagccacagttattggtctggggataggtgtgtgacctgatgtttgcaaagcagagcctttccttaagaatttttcattagtgttggggtaaaacgatagcccagtctgtttgttcttaagaatacgtgatgtgagctaggagctcatatctctcttgagagaagtcagtctgagaatgtgaggcaacaggccgggcgcggtagctcacgcctgtaatcccagcattttgggaagccgaggcgggcggatcacgaggtcaggagttgagaccatcctggctagcacagtgaaaccccatctctactaaaaatacaaaaattagccgggcatggtggcgggcgcctgtagtcccagctactcgggaggctgaggcaggagaatggcgtgaacccgggaggcagagctttcagttagccgagatcgcgccactgcactgcagcctgggcgactgagtgagactccatctcaaaaaaaaaaaaaaaacaatgtgaggcaaattgtaaaagaacaagaggtgaaagccagagacttggaagatgcaggcattcaattatctgctccagtgtgcctgtaaaacatcagctgttaggttggggttctgtttcttaaaaccaaagatccctgactaccatgctacacaaacactggagctggaagctagactcttacagaaaaactcagtatgcccagcttatgccattgtttgctttattttatccaactacttttccagaaatacagtgcaggtctagaacaagaaataaacttcatgaaatgtagtaggaattgctaccatttactgggagttatctattaatcatgcatttctgaaatgctttacataaagcagttgttttcaaaccgtgataagcagagtcccacatgttccatggggtgatagagttgcgggaagtacaggtgccagcatgaaaatagagaagacaaaaatctggtggtttcctgctcttaaacccatctttgagtaaagcatccccctttcacccagttcaataatggatttccacatataattacttctgaagaaaggttatgctacctctctagatagatagatagatagatagatagatagatagatgccatgagacatattattatccctattttatagttgaaggaaaaaggtttaatttttttttaattttttcaaattaaaaaaattaaagaacatgctcaagattacccagattatgcagccagtaaaaggcagaggtagagtttgaactttgctttgcctgtttccagaacgtctgactcagctgccatgtgatactgttcccaatatatccttgtggctcctactaggacaggcactcattgcttgctttattttatttttttatttttttgagacggagtctcgctctgtcgcccgggctggagtgcagtggcgccatctccgctcactgcaagctctgcctcccgggttcacgccattctcctgcctcagcctcccgagtagctgggactataggtgcctgccaccaagcccggctacttttttgtatttttagtagaaacggggtttcaccgtgttagccaggatggtctcgaactcctgaccttgtgatccacccgcctgggcctcccaaagtgctgggattacaggcgtgagccaccgcacccggcctcattgcttgctttattgatactcatattagccagcttgtcctgttaaaattaaatagccaaagatcaaacagaaacctgtagtccgacaaagccagagttattgactggatgtagcaaggaaacacacaccagagcaatcatggaataccatgcaggtgcgaaggagaagtgtcttatgtaaggtttgagttcctgctgaagaattctgaggagggtggaaataaactggcagtcagatctggattagttctgtttctgaagtgggaataggagaagcaggaattaactagagctggggctgtcatgaggggagtgcagtccagcaattgggtattcccactaataggtgggacaagaagagcagagctggggcatcattggtaacagcaccatccacttggtgaggaggtcatgatggcattctacagcagctctgtgatcttggtagtgtttcctgtgaactttacagttggcattatccatgtctgtcatacgaatctgaataaaggttttgttatttttctgcctcagctgattttcactctaatcatagggatgtttttactctttcagttctcaaacgtgctgtcccagcaggagttttattgaactcaacaattttcaacgcaagcatccattcatgtgtacctaatatacctcatatatattaggcacacctctaggcagtggggaatcaaccatctaataaaaacactttcttccatatggccagggccattaatagacctcggaagaataaaaaataatgtcggaccaggactagttggaggactcctggactgagtagtaaaatcattgccttctgatattatattatgaatttttaatattatctctttaataggaaaaaactattttctgaggaaaagtaatcataggaaggtataacccctttctttgtccaggttcctagaagttagagagattatgcaatatagaataaaataaaaagaaatatcaggggtcacactgaaggtcacagtggtttcctctaaccatcttcttccttagaccccctgtgctctgtaataagaaaaaattcagggcctacaatggaggcataactcaatcatttaacattataggttgagtactttctatgcactaggcttggtattagtcaacacagctaaaacataatttggatatcatctctgtcttgaagttgttcataatatagagatattagcagttgtggtcacaaaatgtgacaccacaaagagaaaattctaaatgttatggcatcgtcagcaataggcaagcagtagaaacaaagactgcatcacagtgtccagattgaagaatcagaaaggaagtttgtattaaaaaccaagtagagcagttttctacttatcagaaagcctgcagtactgctcaacttttaattgaaatgtctgttttcagcatcactctccatatagcgggaattctccctgaaggaagtatgaaatcaaagtttagatttaaaaaaaaatcaagaattcccatggaagagatatagtactccaaattggttttacatttcttctgatagagaaaaattattcacaagatcaatgatttgttcaggtttaacattcatcagctatgtgaaaagcaaaatatgtgtttactatataacacataagtaccagaattatgattgatagcagtattctgatatatatgttgttagattcaaaaccaatatatattgaaaaactcctcaagaatatatgtcatttaaaatgacattagatagtacttcaattcggtctctaatttctgtttggaatgtgggatagaagtaaagatgaagaccaaaattacataagcttgagccattagagaaattaaatataacacacgtaaacatggagagtttatttcaaatatcctgatgtcaaagccacaaattatgaaattgtatttggttttcatactagtaccaaaacatcaagatggcatccacaattcactaaatttctttcgagcagccacagtttgtactttgccaacccacatattcagccaagtacataaacatgtccccatgatagatgtaatttgtggtcaaaagacagagcattgtggagaccctgcagtcatcctcagacaaaaaaggcttcagaatgatgatttccaattcctatcgcaagaacaaaaaaccaaacaccgcatattctcactcataggtgggaattgaacaatgagatcacatggacacaggaaggggaatatcacactctggggactgtggtggggtgggggaggggggagggatagcattgggagatatacctaatgctagatgacgagttagtgggtgcagcgcaccagcatggcacatgtatacatatgtaactaacctgcacaatgtgcacatgtaccctaaaacttaaagtataataaaaaaaaaaaaaggcttcaggatggatcatttacactgggtcaaacattgacgtttaaaggttttactgtgtgattgaggtttattattgggcatcttatcagaataaaataatgtgtggtctgtggcatattttaaaaaatttgtagaaaagtagaagataaaaaaaattacaagaatacaaagatctctttgaaacagtttatgtgttagcttttttccatatgacatttattattttccttctgtgcccttgccttgatacattaagtgcagagcgcagtttccttctgcatttctaaaaccagtcccttgctaaagctacctgcaagaacacggcagagaggtcaaaagtgcatggcctttgcagctggacaaatttgaattctaatcccttctctgccctctagtgactattggacttgagcaactcattttacctgactcagttacaaaatatataaaattagggtaaaagacctaccattgtaggttgttgtagtcatgtcataatctacataatgagccaacatagtcttgtagctggctgtagggcagtaagtagcatctctcaaagtaatgataagtttactattgttattgatagtgtccttaggagctctgctacttgagggctgtttatattccccttgttatctgccctcactttttgaccctcactttcctgctcatttctaagaactactttatctgtatccgataaagctttccctcttatgtttccaggcagctccaaaagccccaggcagggcaatgttgaagacaagcaagcagacagacactattatcttccaccttatagggaacatgaatgtgcttttaatgaccagagattcaggagaaatgcactaaatctccctgaatataaaaggaccatgccaaagaatgagctgtttatggtcacttttaatgtgatagataataataatttatttggtggtttcaaatttagagagtaaacttccaaaaattaatgaaaactgttatattagtaagccattgactaaattttttaggtcttcactcattctagcagcatgttcattgaagatagtgccagccaggcatggtggcttatgcctgtaatcccagcactttgggagactgaggcaggaggatcacatgggcccaggagtttgaggctgcagtcagctatgactgaaccactgcactccagcctgagcaatagaacaagaccctgtctcttaaaaaataataattaatttatttaaaaagaagatagtgcctaatagttgtggacattgggaagaaagagtatgactttttggtcctactttacaatagtttctcaaaaattctcatgtcggcaggacacggacccataaacttacttgactacaggagtagcccttctaagtgtcacccaagacgtaaattaagtccatagcatattataatacatcatttcaatttttaattcacagtgtaatatctcagggcaattgttctttagataaaaattgaatgagattatttaatatcagaaatacattacttaagtcattctgtataaatgtataaatgtcttaaaaccattgggatgtgaaattatgcaagatttacctagcatacctatgttgtcattgtttcaggaaaaattattagtatttttactgtatctctttttttacattttattattattatactttaagttttagggtacatgtgcacaatgtgcaggtttgttacatatgtatacaagtgccatgttggtgtgctgcacccattaactcgtcatttagcattaggtatatctcctaatgctatccctccccactccccccaccccacaactttatcttatttttaaaacttacttttttaatgcatgtatatatgtttcttgacattttgccttctggtaggaatttgggactgctggatcatagggacagcatacacatttgtgatcatattattttaaatgattaatcatgttgtgtaaacagttcacatggtctcacacagaaaatctttgatcaaaagcttttgtttttcttaaatcatgtaagaataagagattctgttttgtgaaaggacccatttgttttccagggctatgcaatcttgccttagccgaagcagactaaatgagcaatagtgacatgtatcaatgaaataatatgcacacttttggtttaccttgcaggtgcacccaccctatccccaagtcttctcggcttactgctgcctgcctttggcatccttgtctacttggaattctgaatgtgttgtgacagctgctgttcccatcccagctcagaagacacccttcaaccctgggatgaccacaattccttccaatttctgcggctccatcctaagccaaataaattatactttaacaaactattcaactgatttacaacacacatgatgactgaggcattcaggaaccccttcatccaaaagaataaacttttaaatggatataaatgatttttaactcgttccaatatgccttataaaccacttaacctgattctgtgacagttgcatgatttaacccaatgggacaagttacagtgttcaattcaatactataggctgtagagtgaaagtcaaatcaccatatacaggtgctttaaatttaataacaagttgtgaaatataatagagattgaaatgttggttgtatgtggtaaatgtaagagtaatacagtctcttgtactttcctcactgttttgggtactgcatattattgaatggcccctatcattcatgacatcttgagttttcttgaaaagacaatagagtgtaacaaatattttgtcagaaatcccattatcaaatcatgagttgaaagattttgactattgaaaaccaaattctagaacttactatcagtattcttattttcaaaggaaataattttctaaatatttgattttcagaatcagttttttaatagtaaagttaacataccatatagatttttttttacttttatattctactctgaagttattttatgcttttcttatcaatttcaaatctcaaaaatcacagctcttatctagagtatcataatattgctatatttgttcatatgtggagtgacaaattttgaaaagtagagtgcttccttttttattgagatgtgacagtctttacatggttaggaataagtgacagttaagtgaatatcacaattactagtatgttggtttttctgcttcattcctaagtattacgtttctttattgcagatgtcagatcaaaaagtcacctgtaggttgaaaaagctaccgtattccattttgtaaaaataacaataataataataataataattagttttaagctcatttcccacttcaatgcaatactgaaaactggctaaaaataccaaatcaatatactgctaatggtactttgaagagtatgcaaaactggaaggccaggaggaggcaaataatatgtctttccgatggtgtctcccaagtgttggtgctttgggtttttataagttgtgaaaaggaagatgcacatttcttcattctccatggtgtgcatggaaatgtgtttgagtgtggatgtaaaagaaatcgagtaataaagaattagctggcttgtgaaatagtgcagtgttggatgcttcaagaggtataatcctattttattagcacaaacttgctagctaattagagtttatctttttagaaaggacaccgtataggttcgtaaaaaatatttacaggaagcaaaatagatctattactactttaccgactttaccccctttctttaatttgtataatttttgtactatatatcgatgtgtaaatgtttagagtcttcattatgaaaatatcaataaatatttcattagtttacatttaactctggtataaaatgaaacttttaaaaataagtgaaatggatgatttcccagtggaagtatgtcaacagtcttaagatcattgccagatttcataaaatatttaagtatttgaaaaagaaacaaaatgtcttcatactttagggaaacgaataccctgtataccttctgtacaaatgtttgtgttttcattgttacactttggggttttacttttgcaatgtgacccatgttgggcatttttatataatcaacaactaaatcttttgccaaatgcatgcttgccttttattttctaatatatgataataacgagcaaaactggttagattttgcatgaaatggttctgaaaggtaagaggaaaacagactttggaggttgtttagttttgaatttctgacagagataaagtagtttaaaatctctcgtacactgataactcaagcttttcattttctcatacagttgtacagatttaactgggaccatcagttttaaactgttgtcaagctaactaataatcatctgctttaagacgcaagattctgaattaaactttatatag

SEQ ID NO: 16193 - DNA, 18157 bp, Human
cacaccacagcactccagcctgggcgatacagtgagactctgtctcaaaaagaaaaaaaaagaaatctgcctaagaagttactactgttaataaccctatttgcagattaagaaactgatgcacaagaagactaacttttccaaagtaaaatggccccactaatggcagggtggagttctgacacaagctctcactgccctctgagactgggcaggggaggcctctttgaagaagtgacatttgagctgcacctcaaatgatggtaaggagccagttccaggaagatctcgttgaaatggagagaatcgccagtgtgaaggtcccaaggaaggaatgatgtcagcatattctagaaaaggaaaaaaagaaaggccaggcccagtggctcaacctgtaatcccagcactttgagaggctgaggcaggaggattgcttacagccaggagttcaagaccagcctgggtaacatagcaacatctcatctctacaaaaacaatttttttaattaggcagtcctggtggtatatgcctgtagtcctagttattcaggaggctgaggcaggagttcaagactagtgagctataatcgtgccactgaactctagtctgagtgacagaatgagacccccatctctttaaaaaaagaggagaaagcaactgtgtctggaatgtagcagagtgtgttgaagtagccaggagccaggtaacatagggtcctggttctcagtctcaacgacggcctccttttagagcaaagagtttgtaacaccatttacagtcgtgaaatgaaattccccatcagtaatataacttgaatttgaaaaaaaccaatataataccctaatagtaatataaaggagaagaagaaaaaggaaagtaatttataatgaaaatggtatttatttaaatacataaatgctggagtgctgccaggatctaacgaagttaccctgaagcagtagaatgctcatgcctctaggtagaatcactggggatgtgacagccacgatgcaggtgtgttgtattggccactgagttacaccccaagaggggctgccatggcagcgtgggatcccagaatggtgagcagctctaggtaaagtttcagacaaagcatgacatagtcttcccttcatatacataatagttgcattcctgggaatttcagtgtatattaacactgtacaaaatgtcctgtgtttatatgtaaacagagctaggttctaggcctggcgatcctaacccaggttttccctctgtggatgcctttgggatgtgacaagtcatggacttgggataattctcctcagctacataggactgactcacctaatagggcagctggtttccctgccccctgcccaatagatgccaatgcgtacttcaccatcaaagtgaacagaaaacatctcccagaatttccagaatgccccccaggaagcggtgccccctctgttgagaaccattggtgagaaccatttggtgaagtctcaacaaagaggcgggatttttttttttttttttgagatggagtttcactgttgttgcccaagctggagtgcaatgacgtgatctcggctcaccacaacctctgcctcctgggtcaagtgattcttctgcctcagcctcccaaatagttgggattacaggcatgaacgaccatgcccagctaattttgtatttttagtagagacagggtttctccatgttggtcaggctggtctcgaactcctgacctcaggtgatccacccgcctcggcctcccaaagtgctgggattacaggcgtcagccactgcgcccggtctaagagactggattttatcttaaatgaagtgagaagccaagggggccttttaagcagagagattttttttttttctcctgatctccttgacagcagttgcttcccagccagcacttggcgacatgtgggccctgcctgacccctgggcttggacaccctggccactcatcttctgtcttgctttccatcctttagccactgagtatcatctgggcctgctgaaagctaagctcgccaagtatcgggcccagctcctggaaccgtccaaatcggcctcgtccaaaggagagggctttgatgtcatgaagtcgggtgatgcccgtgtggcgctgattggatttccctctgtgggtaaggtcagtgatggtcagtgtgggcctcggggaggaaagcaagaagtcatctttcaaacaggtgaccatccaggctcccctcgctgcctttctgcttagctccagggacacagaagacctggcctcccccagggtcagatcccagccctttatcatcctaacatggaggacgctctttcctcttgccagcagatggagccctacttggtcttccgactcagtcatcacacacaaatacttctcgagtgtgtatctctagcggggtcatgtgctgggcactgtgccagggactagagacatagcatgaatgagacagagctctgtccctgcccacatagatctcccattcttgaagagaaaggacagtaaataagtaataaggtgcatccagtggtgaggagtgggggctggtgagtgacagggtgaaggtctgctagttacgacaggtcccggcaggtttctctggtgagtgagtatttgggcaggggcctgaaggaagtgagtgagcttgcagagtcctgggtgagaaccttccagacagagggaacagtgagcacaggcccttaggcaggtgctcgcttggtgtgtccagggaggcccaggtggctctctgaggagcacaaggagggcagaagacggagaggatagcggcatatgggcggccgaaaggaccctggcttggattgaagaatgaaactgcagagtttttagaaggtttcttcggccgggcgcggtggctcacacctgtaaacccagcactttgggaggccaaggtgggtggatcacctgaggttgggagttcaagaccagcctgaccaacatggagaaaccctgtctctactaaaaatacaaaattagccaggggtggtggcgcatgcctgtaatctcagttactcgggaggctgaggcaggagaatcgcttgaacctgggaagcagaggttgcggtgagccgagattgcaccattgcactctagcctgggcaacaagagcaaaactccatctcaaaaaaaaaaaaaaaaaaaaaaaaaaaaaaagaaggtttcttctggaagttgctctgtttagcgtataatctatattggtttacttttttttttgagatggagtcttgctcggctcactgcaacctctgtctcctgggttcaagcagttatcaatcagcctcccgagtagctgggattacaggcatccgccaccacccctggctaatttttgcatttttagtagaggtggggtttcaccacgttcgccaggctggtctcgaacttctgacctcaggtgatccgcccaccttggcctcccaaagtgctgggattacaggtatgagccaccgttcccggcgtgatttacttttatgtgaggaataaaataaacatcattgcagggttttgagcagaaaagagatgtctgatcggctcttttttttttttttttttttggaggtatagtttcactcttgttgcccaagctggagtacaatggcacgatctcagctcactacaacctccgcctcccaggttcaagcaattctcctgcctcagtctcccaagtagctgggattacaggcatgcaccaccccgcccggctaattttttgtatccttttttagtagagacagggtttcaccatgttggcaaggctggttttgaactcctgacctcaggtgatccacccgcccttggcctcccaaagtgctgggattacaggcgtgagccaccgcgcccggcctaaagtaaactttttattttcgaatagtcttagatttacagaaaaattgcaaaggtaatacagagttcccatataccccacacccattttccctggcagttaacattttacaccaatgaatattgatctgttcttgcctcaagtctggctttatgcagatttccttagctcctccccactgtcctttttctgtcctgagatcccacatcacagttcagttgttatgtctccttaggctcttctagacagttccttagacttgccttgatttgataaccttgacggttttaaggagtaccattcccatattttgtagaaagtccttcagttggggtgtgtccagtgtttttctcgtggttaatctggggttatagttagcaaggaaggccacagaggtaaagtgccatttttatcacatcgcatgaaggccacatactgtcaacatgacttacccctgctgatgttgatcttgaccacctggctgaggtgtgtcaggtttctccaccgtggagacgctctcttctccccttgccatgccgctttggggagggaggtgactgtgtgcagtccaattccatcgcctccttgaggggagcatctacagaaactgtttggaattcttctgcatgggagatttgtctctcttctcccattcattcgttttattcaatcatttattgatatccgtatggattcgtggggggttattttgtgctttggggtctaaacccataccatgttcttttgctgctcaaatctttttagctttggagctattttagttggcttctttgatgtacttccaccattgtgtttttccagcacttcctcactttctgacactgcaagatgcctcaggctcattttgtatattccctgccctggcctagaatctgccatttctctaaggagccctggttcctttgattggagaatagcattagaaactaccatctgggcgctgacttacttttttacagaatcactctggctgttgtgtagatagcaggttatagcagggcaaagtgaagtgggacagtggagaggttgctagaatataggccaagtgagcaacaaccaaagctctggacaggtgctggggagcagcttctaactcagttcagctgaacaatttgagcccacacccagtttccattgctctgggccaggcacaggggatggtggttaacagctaccttttcttgagtgcttgctgcaggctgggcagtgtttagttttatttgttgtactgtctgcctatatgattggtatatgtatcagagagagagagattgatagagaagccgctctagttaccaagagccgtgacccttgaagtctgggcccatggcagatcccacctgccttattgggagtataggctctcccaccgtgggagggcccaggtcttacaggggccagacagaatcagggagtggccccgaggttggttgctggctgtctcaacagccattgctcttggggccaccgtgtctatccctatacctgtccactccaccaggtttttctcatttcttgagtttccaggagatccccaaggctgagggtttctggatttgggaactcgatgtatttccatcacatgccacattctggacttgagaggtctaagggtgccttggggagggtgcccccagtcttcctgccagtcagccaggaggcagggtctggatagctggccctgcaactcagagtctcaggcttctcgttcctggggccctgctgattaggatggggcaggaggcatggggctgggtttcttccctccctgggtctgcccactgcttggctggcctcagccacagcatctatcactgatgttacagtgtttggagtgaggcacatcccgggccttatctttttaatccctgtgcagtcctgtgaggtagggaccgggttcatgcccattctacatgtaaagaccctgaactgagagtatggagtttcctgcccaatcccaggacaccccggcagaggcaggattcaaagccaggtttctccaactcccagccacagtgaacggtggtctgagtggtcacatccacatcttcccagttccccactccctccctgcgacacctctcctgtcagctgtctctgcctcagcccaggaggttgacatctccttgcacacctccttacaccctccctgggtgcacagcatgtctgggtactggttccacgagtgccgtgggactgccacctgcttaaagttctctggggccaagagggcctggaggattgtgtggggttaggagaggctcctgatgtatatggggaaccccatcagaatccagatccctgcctctacctgagacagtcctgaggcctccaaggaacagatgggcctctggtgtctgacccatccaggacagggccagaggtgagccctctggctgggaggtctcttcacagccacctaggtcaccaagccgagggtgagagggtctcctcctgctgcctgcacctgcaggcccccagcccctggggcctctcccagaaggccagggacaaggctcctcagtgcaatgatctccttttctcctagtccacattcttgagtctgatgacctccacggccagcgaggcagcgtcctatgagttcaccactctgacgtgtattcctggggtcattgaagtaagtgggtgtgctgggcccagaaggagaaggggcgcatgcttgtgtttggacttgtgcctgtgcccaccctgtgtgtgagtctgggtggatgtccccatgtcaggacaggctctggactgagctgctttgccctccagcactgacacttctggggatcctagctgctggaccccagagatgcctggtggggcctggaactaggaggtcaggccagcatgtggctactttgcctggcgccccctgtgctctcctccccaacaccaccacagctctggtcactaattgctgcttggctggatccttctgcctccccatgaagcttcactgccttgggctgtgtttgctttgggcagctgagtggtatggccttaagttcccatggtgaaacaatttatttgtaaagtgctggtatcatcagtgatgagtgttgtgggattggaagatcttgagccctccctaggcggctactcagctcataggctgtggtctgcactgggctggggtggtgacaaggctcagacttggccacaggttggcatctgggtttccctcagcccctgagccccggggccattccagatgtcccagatccagacaggacctttccagtggaggcccagccttgccttacctttcttctcttctgcatcctagtacaaaggtgccaacatccagctcctggaccttcctggaatcattgaaggcgcagcccaaggtgggaggcagggcaggtgtgtgggaagcagactggagctctgttactgatcgttgaaattgggtgtggctgtcatggagatcactctggatccctggtccattatcccgctttccagaaaagacaggttccagttcaaatccttggcaccaaactagccttgtgatcttgggcaagtgattgggtatctctaagccaagcctcagtttcctcagctgtagaatgggcataataatacataatttacagcatagttttgaggattaagtgaggaaatgttcaggaagcatttagcctgggccctgccacatggtaggggtgggcgtaggacagccgttattatcctgttactccttttatgatggtggtgtcggattttcttctgaaataagtctccgtcagtaaaacatgtggattaaagaaaaatgccaagcttgtgctagtatgtggcagaggctgtggtaggtctgtaaaggacaggagtccagggcgccgtgggctgggtagcagtcacatgggtccacatatgtaactgcatccctcacacccatccaggaaaaggccgtggccggcaggtgatcgctgtggcgcgcacggctgacgtcatcatcatgatgctggatgccaccaagggagaggtgcagaggtccgcagggtggggcatggggcaggctcacatgtctggggagggccaatgtgtccctgagctcgtactaggcggcctgtgggtgtttggctctctcacacgtgagagtagtggtaggacttgtcacagactaaacccaacaccacccagcctatggcgtcttctcctcaaggcttgtgtccagccagcacagaggtatcttgggactgggggccgaggggcttggcctggccctgcttcctgttcagaggcacaggtgcctcatcactgcccagaacctgccaggagcccagccccaggcacagaagcattgttcatccacatcctggcagaggggtacaccaggcctgcctcctcgggaccagaaggagtaccctcatgtggtcacctcgcgggggctccaccacttgcctgtgcatgccgaccgtaaaccgggccagtcccctctgggactgtggcagagtttagaagttccctgcagctctagggcattgggaaggagtgttctctgggttgctggggaagggggtggaggagagagtcagtctctgggtgggcagtgacatcctgcgtaacagggaagctgtgcatctggctctgtggacagcctgtgaggggcttaaggggtactctgcctaggtctctgctggagaaggagctggagtctgtgggcatccgcctcaacaagcacaagcctaacatctacttcaaggtgaggcacctctctggccttcaggccaggggtgtggcagttttgagactgcattggctggcggctgaggctgtgggaccattgctgtgaccccttggtcagcagttctccccatccctttctcctctttcagcccaagaaaggtggtggcatctcctttaactcgacagtcacgctgacccagtgctcggaaaagctggtgcagctcatcctgcacgaatacagtatccttccctgaaagacacgtgaaggagggcagccaccaccgtcagcgcagcggggggactgactaagacaggaggcctcatggagcagggtggcagcaggtcacccccactgcccctgctgtccattcaagtagcctctgggcaagctccagactgccaggtctgcagccgtgcacttgacaatggcttcctggctcctcaccaagtactgggcactgtggtagccagatgacatccggaagaaaaagatgtcatgggaaacagcctctgaggacggggggttcctagcctggagaagccccagggagagctggggaatgggtggtgcctctaaagtagtgtcgggggctggttgtgttctggggccctggggatagggcagggccttgggcagagttatgcctggcatatagagaactcttagagtcagctgtgagcccctcgttgccagaggtgtgcaagcagaggcaggatggcccccagtggagtcctgcatggaagaagctgggttcgaccagctttcagatgctcctggtgctaaaacccaggcttcccctgaggggctttggggattctagcaggtacgtttttctccctgcctagctgtcaagattaaaactctgtgttgattgaaacttttatatattgtggtccctctggggaagagaacagagggcttccaaagcattacaatcttgcaaaacctcacaagcagataccgccacggtcccacacggccagcatatttcctgcttggctttttggggccctccgctgatgggggacaggggcagctggtgcacaggttgcccttaatcggagcccctcagagatcttcaatgcagaagtgcttttccgagaagactgctccccggacgagttcatcgatgtgatcgtgggcaaccgggtgtacatgccctgcctgtatgtaagtgcaggaggggagccctggcctggccactcggcctttctaccacatgcatttcctcagctcccggaaccttgtgagagaagcagaaagagtctgaggctctcccctcacctcacctcacctcagtggctgcttggatcttgcagacatagagagcttgaaaccagggttccagcccagccttcccaaccctgaggcagcaaggggaggaagggcgtagactcagctctccaaggaagggctgcagccggcacagggcgatggagggccctttcctggatgccttgctcctgtcctcagcaccggcctccaccttctcaatctcaggtttataacaaaatcgaccagatctccatggaagaggtggaccgcctggcccgaaaacccaacagtgtggtcatcaggtgaggccactggcatcctgccactctgctgtccttgctgtgggttctgaccccagtcgtcaggcctcccagccactttggctgtggaggaggaaaagccagcacagcctccagcagcacacagccgtcacggagcccaggacttcctgcccagggcagagcactttgtccatgaggccaaggagacactgcaggagggtccccttcatagctgctggaggcattggcccattccagttctgaattgccgtgggcagggtgggtgacgtcttgtgggctctggttaagaaaacagaaggatttcatcaaccaaggttgaatggctaagaggcttcttaacttaggccaggcgtggtggctcatgcctgtaatcccagcactttggggggctgtggcgggtggatcatgaggtcaggagatcgagactatcctggccaacatggtgaaaccctgtctctactaaaaatacaaaaattagctgggcgtggtggcgtgtgcctccagctactcaggaggctgaggcaggaggatcacttgaacccgggaggtggaggttgcagtgagccgagatcatgccactgcactccagcctgggcgacagagcaagactccatctcaaaaaaaaaaaaaaaaaaagaggcttcttaacttagtagtgaaccaaggtccccccaagaagccctgggtgtgagcctacctctcctggtgctctggaaggtgtggcttctgtctgatcacagctcaaagggaaaaagggaactaatgttctcaggccctggccactcacttcctgccctcctttgcagggtgggtccctggggtaccgcctgcactctggatgtttgttcacttgccaccacagcctggcaggctcctctttggggcagactgattcaggtgctccactttgctggtttcctgacttgaggcaggcactccacagcttcacagtgaagcttggccaacagtactgagagctcagggaccaagaggctggacagcgcaaatgatggatgagggtcccggcctgagcacaaggaccattttgtggtggttgtagccaccacaaagagcagtgtcagttctacagcacagcctcagctcctctcctcctgctgtgtcccaggcctttgaggggctgccatcctcagggcgtgagagcttctacacctttacctgcttgtgctcagaatagctctacagaggtcaggacacagctcggggtcacggcgcaaaccttcaagccacggtccacccagtatttggagcaaggcacatcccgggccttatctttttaatccctctgcagtcctgcgaggtagggactgggttcatgcctgttctacatgtaaaggctctggtgtctccagagccttggttctcccctcttcttgctgaaatccctgctggacttcctggcagtcccttgctcctctcaaggagtgaactctgggtgtcagggttcctagcctttgcccatggtcccgtcacagcccccggccatctcgccatggcagcccttcactaatcacacatgctgcaaccctccacagagcacaggcttgccagcccctaggagagatgctgaccctggttgagtgtgaccatgattggtgcccagaggcactggcagcagaaacatcaggctgccatcatagtaatgggcttgtttccctgtgggtaccagcgggccacctggccagtggaggttatccgctccaatagtgagaagtggagaccccagcctctgaattcacaggggcccctgcctgactggccgcctccctctttgcagctgcggcatgaagctgaacctggactatctgctggagatgctttgggagtacttggccctgacctgcatctacaccaagaagagaggacgtgagttgcactgcgcgtagctgaaaaacaggctgagcttcatccctagaaggctgccaggccggtgtgtggtgcccagagaccccagcaccggctctggcctggcttgtctagacacacctcagctcttttcccttctcagcactgggcactgctggttttgagggtaccctggtggggcaaggctaccttggggtccccactggctgtagcagtcagtgccctcctgacctcccctcacagtgacaggccctaccgcaggagcattagggacctgaatccacaggagccatccccatgtctaactcctgcccatcctcctggtgcgcacacacacatgccctggggtcccaacagctgaattcggagcagtttgcatcaaccctgactttggcaaggagtgagctacagcttccctcactagactccagcatccctttgcgccctgcccgttcagtccaggtcctggtctctgtcagtgctgtcacagcagatgggtggcaggcactgtgaatcctagacgtgatttattttgagtcactgtgttaagatcaaggtcgtagaagatggtacagggatctatgtggagggtgtgctggatgtcagggggaggttaggccaaggcaaggagaccgaaagggcctctgtggccagctcttccctcgcgcagaatcacaagatggcagtgtgggccctgatgtgtggctgacgttctccccatcctgccctgcagagaggccagacttcacagacgccatcattctccggaaaggggcctcagtggagcacgtggtgagttgacaagacctgccgtgacaaggggtgggagctctgcatgccctttggggctctgttctgcctgaggtgccctgggctgggggtgggctctgctggtctcactctcagatgtcaacgcaggctctggagttggacagcctggggctgcgtctgcagcaccccttcttagccatgtgccgaggctctgacctctactgtgaggggggtgtgctgcctgccccctggatagtcaggaggacacgttgaatgaggtccagtgtgtagggcactcagcatgctgcctggctctgcagagatgccagtaaccctgcttccatgccattcaggcatcagtcaaggagagtagggagtggcaccagcttaacacagaggtcaggacagcggcttcaaggaggcaacctgagccggcttataggactagtgggtctggcagtgaagagttgggatggggagcatcccaggtaggggagcaggcatgcacaggccccaggggaggtggtctgggctcagggagcaagaggctgcctttccctgtccaggattctgtcacctgaacatgaccctgcaggcacagatggtggccaaccttcgggtcacatggccgtcctcctgggctgatgctttcctggtgttgttttcctctagctcatttcttcttgggatctgtatcctggaggcaagggatgctgtagacccagctgtccctgcagccccttaggacagtggtggcagggcctgtaatctggtctcatgcattcattcattccgcaagcccagccccaggtctctgagtgccaccctagaggtgttaaacaaaggaggccaggcaaagtcccatctccctcagggcctaggcttgagatcacagcaggaggagccaaggagactcacgattaccctcctgaatcccttcagtcactcacaagtggcaatgctgggcaagctgagtaaaacaaaacccatctgcagaccagagtcagccaccttcccatctgtgtcaaggaagtgttcctgcaggcctggcgccggcctccgccccagggacgctgggctgaggtgttgggtctcccaccagggcctggaagacctgtgggcatgtgagaggaggagtcacattgcacaattgcagagtcccctccccaccgccctccactgtgccaccatcagcgtggcaaccagaggtctacactctcagggcaattgctggctgcctcctccagggtctccttccagttttatatgacatctgggacccctgggatcttcacccctaccaaggagcactgaagtttatacactgccctgggagttgggggtgatgtgatgtgtgggaagcttcaggccacaggtggggccaggaggagtgagagatggtgaccaagcaggggggactccaagctatcaccctgtcccattctaaaggagcatctgttcaggcaaggcaagcagagggccactagcagccaggcccctgaccttcccctggtggctttgggaacattcctaactatgcaccacagctggcagatcaggagtgggaatggcagggccacctgcagctgtgattgggtggctatgtgcgaattgagcacgtcagtcctccacacaaggcccagactgtgtgggcacctgccgcgggaactcctgcctcttggcctgtgtcctgagctttgggtgtgcagccaagcttgggatggggttaggtgaagcctcacctctctacctgactctctcctgtcctccagtgccaccgcatccaccggtcactcgccagccagttcaagtacgccctggtgtgggtgagtctctgggtggaaagcaaccaggggggtagacccaggacagcccctgggttaggcatgaagcaaggcattcacactctctgcgtggtgttcctgtccttcctgtggggattggcatgtctgtgtgtctgtcctccatagaatgtacatgccaacccagggtagacatgggccttccccacccttttttttttctggttttttttttttttttttttgagacagggtctggctctgtctcccacgctggagtgcagtggcacgatcatggcccagtgcagcctcgacatctgtgcaaaagcgatcctcccacctcagcatcacaagtagctgggactacaggcacacaccaccatgcctggctaatttttcatggagacaaggtttcgctatctggcccaggctgtctcaaacacctgagctcaagtgatcctcccaccttgacctccagaagtgctgggattacaggcattagccactgtgcctggccctccccaacctttgagatcagggatggtcagacaactgcggacatcctgctgcctgaggcccccaccttatgccatggcatttacccttcaggacacacacgcccagggatatcttccttgaccttggccagtccaggctgaggtgacccctctgcccccattcctcacccagggcaccagcaccaagtacagtccgcagcgggtgggcctgacccacaccatggagcatgaggacgtcatccagatcgtgaagaagtaacggcgcctgccgggcctcccgcccacctgcctcgtctccctggggaggtggtcccactgggacacacaaacacccaaacagaaaaatacaaatacacgtaccccaggaaggggtccctcaagtctctgctatttacagaagtttcttcagtaggcagacgaagagtgtgttggggcaaaggggctcggttggaggcatttcccataagactgagccctctcatgggggttttgagtttgtagtgctgagcctgcatctgtgcctcccagccccctgcactgagggagcaagttgcccacatgcccgccagccagggcctaaagcagatggcatgctcagtgccaggctggtagctgggcctgtttgggtccctggaggctgtggctgctgtcatggcacctcactccctcagctcttgccagcttctctgacacttgggttgggggcccttccaggaggaaacccccttgggtgccccacacagggctctccatgatgggaaccagtggttagtggcttcaaaggcccagctgacaccctccacagcctaaggggtgtcctaaagtgcctccccctgtattccccctcccagggcagcccctgcccagcacaaaaccccaggaccctggctctgcacgcctggggcagggacttttgagtttaggatctgtattttctaagtccccagttctcctggctctcctttctgaaataaaggattgaaaacggttcctgttcagactgagaacactttgtaaacttgctgaacagtagccaggttgagtcaggtgggcacaggtcaggcattgggcctgggggtcggagagggtgcagcctgggccccaaggcagacccaggccttgtgtggcaaggagactgcagggttcctcacccaggcacaggcaggctctgcccagggggttggtgttcgggggtgtcaggcccagactggcccctccggaggggcctggctgccaaggtgggcagcatcccaggaggcccttgtgaccatctgggctggcagggaggctctgtgagaacaaggtggcgggtcatttcctgttgcctcagaagtcaggagtagaggggctggcaggggctcgatgagtgcctaccgtgtgccagggactgtgccaggccccccacagtgttctgctgtcccccagaagctggtgtaggctgcacagtttgtgagtgcagaccccggatttaagacctctgagcagcggggaaggcttcctggaggaggtatgccttttgagatggatgcagcaggttctgtgaggctgccaggaggggtagagttcccgggggcctcgggccccgctggagtgtggagcaggcccatgctcagctctccaggctgttcgtggctcccctgtcagctgctcactcctttccagagacaaaacaggaataatagacatcattaaatatacatagggccccaggcggtcggcgtggtgggctgggcctcccttccccataacactgagctgctctgctgggccaaccgtgctcctgggccagccagaggacccccatgaggcggcatgcaggcggggagcaggccacagaacgcaggtaaggagaccttagcctagagtccttggggtctgtcactggccaccctcgcatcccaggctgcaggggtgataagggaaggggcagcagcagagctggggcctcgcccctaactcatcttgaggcccttctctgcctcactttgttcatctgtgaggggtgtgatgcccatgcagtcccctcctggcgatggtgggataccaagacaggcagggcctctgtggcttacctcggcccctctcctgactgtcctgatgcctggccatgaggccctaagtgagggtttctgcctggctggtggccattcccacttccactttacaggtaggggctctgggcccagggtgaggtagggaaggccttgagttcacagggtgtcagggtgagtccagaccttggattagatccagacctgttttgtccccaaggctggctggcaaagggtgggaaatgaggccagaggctgggggtcctcaggcagtgagggctcaggtgagaggctccagccactgggccacaagttcctcaccgtggatgggcttgttcctgggctagatctgtgtgcgcgtggatcagggcaggcactgcggccctgttatgtcctgggctttctggatctgtggtcaggatggttgcacagtctacatttgcttgtgagagagcgagcaagggatcctgcagctgcgtatgcccaggtcagtgtgaagtggcagcttgcggtgcctttagggctggggaagctccctaagaccccccaaaggtctctgaccctcccatccccgcacctgggtaagctccaggcttgggcctcaccctgtcagccaccttgttctcatcaccctccctgatgatcacaggcaggggtctgcaccctcactcaggcccatgcccaggcagcagagttgcattcatctcccagctggcatccctgcagcctcccgggggtagtatggcctgcagctttagaagactcaggtacataggagccaaagacatgaatattcatctatctgtcccacacgtgtgcgttcactcattctccgtctttcttcctctccagcttagattccacagtttctcatttcggaaccctcctttggcaagaaagccgagtcgagaccctctccttcccactctgtccctctcctagacag

SEQ ID NO: 16194 - DNA, 25951 bp, Human
  misc_feature (1)...(25951): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaagggcctgggaccatggcatttacactgagaaatgggcagtaacactgagccatttgagtgtggagaagaggtgggaggtagaggttgatctctgccttcagataggcagttggttgtcctgtggcccagggtgtcagacacatcctttgccaatttaatctgattttaagacatttttaaaattgacattatctgttaaatttctagttaaatttaaatatttggtcatttgtctttaggaaatttactcgtaaaacttttaagtctaatatatgattattttcaaggacgagctgaatagtaaaaaaataattcaagtttgtaacttaaaaaacactggataggccaggggcggtggttcacgcctgtaatcccagcactttgggaggcccaggcgggtggatcacctgaggttaggtgttcgagaccagcctgaccaacatggagaaaccctatctctactaaaaatacaaaaattagccaggtgtggtggggcatgcctgtaatcccagctactcgggaggctgaggcaggagaattgcttgaacctgggaagcggaggttgcagtgagctgagatcacgccattgcactcctgcctggacaacaggagtgaaactccgtctcaaaaaaaaaaaaaaaacaaaaaacactagataatgaatagaaaatgtgtttactgtagctatgaatttgcagtgctcatatgttcctgatggtgcactgttgctttctgcctcttgtcatttaatagtgtttgcatttttgttatctttcaggttttaatacaacaacaaatgtcgtcattttggccggcaccaatcgaccagatatcctggaccccgcgctgcttaggccggggcgtttcgacaggcagatctttattggtgagatgatgtttgctggggcaggtccagtgctcatgagtgtaggtgtgactgtttcaatatgattttcttttccttaaaaatgatttctaaaggaccaccagacataaaaggaagagcttctattttcaaagttcatctccgaccgctaaaactggacagtaccctggagaaggataaattggcaagaaaactggcatctttaactccagggttttcaggtgagtggaaaataacgaggaccctatttagaagcatattaaaatcagtaacagttaccaggtaccggtttactttcttaccttttcacttctttactgtgggcttcctaagtttatattctcatttttattttttttgagacagggtctcacttaattgcacaggatggactgagtggtgtaatcatagctcactgtagcctcaaccttctgggctcaagtgatcctcctgtctcagccttgtttgtagctgggactacaggcatgtaccaccatgcccagctaattttttgattttgtggagacagggtcttacttattatgttgcacaggctggcccgaaactcctggctgtaagtgatcctcctgccttggcctcccaaagtgctgggattataggcatgagccactgtgcccgactatttttactttgttattatgggaaatttcaaacatacacagtattttgaggaaatggtgtaatgaacccatctgtacctgtcacctagtttcaggaacaattactaattcacatctgaccttacttttatctataccctcttctctttctgcttcctcgggagtattttgtgaaaaattcttgacagtgtatcatttttttctataaatattgtaggaattattcctaagcgtttttttaaaagctctattgaaataaagttaactaaaaatcacccgtataaagtgtacaattaatggtttctagtatatttacagggttgtacaaccatcactataattttaaaacattttgggctgggcacggtggctcacacctgtaataccagcactttgggagtctgaggcaggtggatcacctgaggtcaggagttcgagaccagcctggctaacatggcaaaaccctgtctctactaaaaatacagaaattagccgggcatggtggtgcatgcctgtaatcccagctgttcgggaggctgaggcaggagaatggcttgaacccaggaggtgaggttgcagtgagcctaaatcaccccactgcactccagcccagatgagagagcaagattccatctcaagacaatcaaactttctgtctctctaggtttttttattctgtacatattatataaaaacgtggttttggccaggtacggtggctcacacctgtaatcccagcactttgggataccaaggcaggtggatcacctgacgtcaggagttcaagaccagcctggccaatgaggcgaaaccctgtctctactaaaaatacaaaaattgccgggcgtggtggtgggggtgctgtaatcccagctactcgggaggctgaagcaggagaatcgcttgaacctgggaggtggaggttgcagtgagctgagatcacgccattgcactccagcctgggtgacaagagcaaaactccacctcaaaaaaataaaaataaaaacatgtggtcttttgtgcctggtttatgttcacttaacataatgaacaggattgattcaaattgtggcaggcatcagaacttcattcctttttgtggccaagtaaatgtgccattgtttggctgttccacatcttgttgatccacccatcagttgatggccatttgggctgtttccactttttggctattatgaataatgctgccatgaacatcagtgtacagattttttgtggtcatagtgtttctcttggtatatacctaggagtggaattgctgggtgatatggtaactctaactttttgaggaactgccaggttgttttaattacctgtgccattttacattcccaccagtaacctgtgagggtcccagtttctccacatccttgccagcactcgtcactgtgtttttattacagccatcctagctggtgtgatttggcatctcactgttgttttgatttgcacttctctaatgactagtgatgttgagcatcttttcatgtgcttattccaataattttttaatgtaaaatatgatcctttcccattccctatttctctccttctgaacgcaaaatgaaataaaaaaagaacagtttgagaagtatgaaaagattatatacaatagtgtggtcagaagatgatcatcttgttccagggatcctaactttttacttgtctttggactttgaaatttataatgttttaatatttgtttatttaacacagatggtatgctgtagcttatttatgctaccatatacttaactgaaaagttagtttaaagagatggatctaaaaagcatttgacaagcttttagctatatttaaatttagttgtttcactgaatgtactaggtgattataaaaattagatttttcatcatatatcagtacttcacctaatatctatgcaagccatttttccaacacaggtgatagaactaagttatttaaatgagcatttttagatgctgtcttagtttgctattatgtgagctatattgtctattaaggtaaatagttgcctgtaattatctattgactactaatactttcatcttagttcagagggccagaattataccaggcttacattaaacgctagaatagcttagggttatcatgagtcaaaacagaattatatttacacaaaacctttattcattgtactgctgatttaaaaattaactatggatttggctgtccatattgtgtgactgatcagtttgggcgtatttcggtgggtaagctgttctgtgttcattttttaggtgctgatgttgctaatgtctgtaatgaagctgcgttgattgctgcaaggcatctgtcagattccataaatcagaaacactttgaacaggcaattgaacgagtgattggtggtaaggaaactgaacataactcaagtggaaaggctgataaaatgaatttgaggccagggatttctctgtttgggcaagaactagaagcaaagaaagtgtatccactcagccctggggcccaccacatttgtgctctcttggtgtcatggcccctcccatgcctctcctccctctcctccttcttcctgccaccgtcccctgccacctgccctctgcatggaggtccatggtgctgggtgagtttgagatggcagctcacgaatgctttgcttgcacaggcagccagcagcgaggtgtctacccatgaactataccaatcaagtttgttaaaaagctcacaaccttcctgtttacaaaagtttcatcacatgagttagaggtgctctgtgctagatacaggtgatgggtgtaaaatatctgtannnnnnnnnnnnnnnnnnnnatacaggtgatgggtgtaaaatatctgtaacagccgggtgcggtggctcacgcctgtaatcccagcactttgggaggccgaggcgggcagatcacaaggtcaggagtttgagaccagcctggctaacatagtgaaaccccatctctactaaaaatacaaagattagccaggcatggtggctcgtacttgaagtctcagctacttgggaggctgaggcaggagaatcgcttgaacccgggaggcagaggttatggtgagccgagatcgtgccactgcattccagcctgggcagcagagtaagtctctgtctcaaaaaaaaaaaaaataataataataaataaaataaaataactgtaacaggcgtagagctggaagtgcttcctcagtcagcatagggggagcgcacacagtgcgttttcttagcattccatagggcttctgatttaatccctaaaggcaagtagcaattcaagaacttgggcattcaaaggaaggggaagccctgcaccaggcagagttccacggaagaggaggggtgtgccccaggctcaggatgaaactggggtgtgacgtggaagtggcctggcagatggacttgaggcagtctaccctgtgttgagggagagtaaactggtcagttttggaaagtcttgaatgttaagctcaaagacttttaaaattttgtcctatggccagtgttgaattaaggtgggttttttgttgttgttgttttgttttgtttttttgttttttgagacagagtctcattctgtcacccaggctggggtgcagtggcacaatctcggctcactgcaacctccacctccagggttcaaataaacagctttccgagtagctgctattacaggcacctgccaccatgcccggctaatttttgtacttttagtagagatggggtttcaccacgttggccaggctggtctctaactcctttttttttttttttttttttttgagatggagtcttgccctctcccccaggctgaagtgcagtggcttgatcttggctcactgcaacctccaccttccgagttcaagcaattctcctccctcagcctcccaaacagctgggattacaggtgcgtgccaccacgcctggctaatttttgtatttttagtagagatggggtttcaccatgttggccaggctgatctcgaactcctgacctcaggtgatctgcctgcctcggcctcccaaagtgttcggattacaggcgtgagccactgagtaacataatgatcgatggtattttaggagaatgaatctggctttgaagagtagggaagcctctggatggaggcagagaaccttgcagtcatcactgtgagcaccatgagcccacagcttatcaggggggagcaccagtgacagccgtaaaaaaaatgaggacagactgagagaccgcaggagtgtggggcgcttgcagaggcagctggctcgtagagaatgagctgtcctgcatgtgagccggggcaggggtatgcgtgtgtgacttgggaacaggcagtggtggtcccagggtgtgccaggtggagtgagatgggcggttggggacacttggagccaccctcctgggagagagggagttgcagaggaaatgttacccagtgctcacatttggtaagaggagagaaaggtgagtcagcaaggtcacccgtgctcatggtgtaccacaagcactgaaggtgcatcagcagacaagcgaggaagatgtgccagtaacagggacctgtaggctggaggggacaggaaatgaggcgctggcagtagggcgaggcacagggatgtggaggaggaagaggaactttggatttggcagtgagcgtgttagggtgacttttgacagttcatctgagtagagggtacaaaaccagacgagtggggcttccagtgaggacatagaggctggtagagcaatgtggtttgccggggataggtgcccagtaaacaatgaattgttgaatgaatgaatcaccagccctcttattctataaatttgttattgaaaaggtaaacctcagatggtaagagttttgaatggaatgaagcaaaatataataattcactgtagagacaggtgaaaactgtgtatttatgccttttttttaggttaaggagaagtgatcagagagggcagggcagagcgggcagccacgcagccgcaggttttgctctgaggcagctgctgggccccgcaggcagtgttgtgtagtgagataggcactgagaaaatgaatgactcctaaggtgaactgtggggaaagaaggcttctttgcttttacaggtaagccagaagtgttcatcggcagacagacttaactcctgttttgtaacttcccgccctgtggcatatgcttgtcttgggttgtgtcattgggaacacagcttttgtttttgtcttccagtctccttaacatcagctgagaaattctcaggtggattaccatgaacatggcaaaactacttttgccactgtgtgatgatttgttttagtacaaatggcgcagttagtttttacagcacagaggtatggagtgaggggcagagcccacgttgatccaggccagagaagaatcacgctcagactagagtccggtcagcactgtggtggacgcgggctgcagcacgggtcttgtgggccctgtgtcgctggggtttgccctctgggtctgctctgccacttctgtggcttgctctgagccatagggccggctggttaggtgagggtgcgccagcatcagcctggctggctccacctaggtagctccgggtgttgaactggctgcctgctttctcagactctcttctgccttccagcagaacagacagcaggtagtgtcttatggcagccatcttcgcgtgcccagtatttgataattctgaatacctagactatgcaatgaggacctttccagagttttggtttctgtaattttgcgtgttttaaaatgaccttaatgctgaattttattttacatttctatttgtttcccaaaacacagggtgtgtggcttaaaagtgagagagttagggtgaaagcaggcctggggatgggggagtgagtgcatttttgctgtagttgtattttgaacctgaccttttgcttttattctgaccttgattgggaattctatttaattttttaaaaaaatttttaacttaatttaattttttttttttttgagacggattcttactctgtagcccaggctggagtgcagcggcatgatctcagttcactgcaacctccgcctcctgggttcaagtgattctcctgccccagcctccctagcagctgggagtacaggcgctcaccacgacgcctggctaattttgtatttttagtagagacggggtttcaccatgttggccaggctggtctcgaactcctcacctcaagtgattggaccacctcagcctcccaaagtgctgggattacaggcatgagccactgcgcctggccttgattaggaatttttggattgtgataggcagctcagtctccaaaccccattttaggtaaggcaatgtatagcactgtataactgtcttttaatgtcagtgtcactgtaacaatggcttgggtttttttgttgttattttgttaggcttagagaagaaaacgcaggttctgcagcctgaggagaagaagactgtggcataccacgaagcaggccatgcggttgccggctggtatctggagcacgcagacccgcttttaaaggtgaagcagggtagctgcactaggcagccagtgcatgggtgagcagatgctcgctgcagtcactcaagaagcaagctacactcctgcaaaggagaaagaaacaaggctttagccaaaacttctggtaacttctggtaaccatagttgcacaaaccgtcccatagataaatataaaatttggacagaaaattatttaaagggaccacagagtgtccaaaagcaggcgagagctggagagtttgctcctataaagcagcagctgcagtgggtttgaactgggagcctgtggctttcttgccaaagggtttttcataatctccacactacagtggtatgagacatagtctttattatcctgaggtggtagaggagatagtccaggacttaaagaatactggaaatttaacaggaaaatcccagaagcaagaaaactaccaagtggtgaggcccgaatctgagcaggaactgcccaaatctcaggccgacaactaaactacacatgcacagtggcaatcccagagaacctggcaaaagggtaagcagagaccaaagagaaatctacccctgaaagacgggggaaccatgtgagatttttaagttttttgcttttcaactgaggcatttcccgaactgctgcagcacagatgacagaaagcagctgcctccctgccttgcgatgggtatcagggctgctgggaattgaggcgggccaggggtgtgggggtcccctgaagcaagggaaccatagagaagacaacattagagtgtccataaaacatcctaaggaacccacagagaacccactagaactaataagtaaagttagcaaggttgaagaattcaaggtcagtatacaaagaccaattgtatttctgtgtattagcaataaacaattggaaaatgaaattttaaaaattcaatttcattagcaatttcagtagcatctaaaaactcgaaatatggaggaataaatttaagaaaatatttgtaggacatgcacattgataacaagccctaaataaaaatagaggtggactttgctcatggagtgttacatcagttctcccaaaactaattgataatttcagtgcaatctctggtaattatagcagattttttttttttgtggaaattgagaagctgaatctaaaaccgatatggaaatacaaatgagtaagagtagccaaaacagtaagttactcatcccagtattaagactgtgcagctacagtgatgagagtgtagtgctggtaagaggactggcacgcaggccagtggggtggaatggagcccggaaagtgaaccacaaacttttggttcacagaggtaccaggataattcaagggggaggaattgtcttatctacaggtggttctggcaacagagtattcacaggaaaaatggtgaacgttaacccttgcatcatatgcaaaaaattatttgaaacaggtcataagaactaaaaccatcaaacttctaggagaaaatacagggaaaaatctctgtggccttgaccatgcaaaaatttcttgggacacaaaaagcatgagccacaaaagaaaacgttgataggtgggatctcatcaaaatttcaaactctctttctttgaaagacagttaagaaaataaaaaggcaagccacgccctccaaaaatacatgcagtacatatacaggacaaaggacttatttctagaacctgtaaagaactcttagaactcaataataagaaaacaacccagtaaaacaatgggcgaaagatttaaacatgcatttcccagaaggtatatgagtgggcattaagcacacacagggtatcattatttatcagggacatgcaaattcacccatgagctacctgaacatacttgctagaatggttaaaatgaagaagagacagtcttcattgttgataaggatatggagcagttgaaacgctcacacgttattgataggaatgtaaaatggggccgggtacagtggctcatgcctgtaatcccagcactttgggacgccgaggcaggcggatcacttgaggttaggagtttgagaccagcctggctaacgtggcgaaacctgtctctactaaaaatagaaaaattagccagacatgatggtgaacgcctataatcccagctactcaggagactgaggcaggagaatcactggagatggggaggatcacttgaacccaagaggcggaggctacagtaagcagcagtcgtgccactgcactccagcctgggggacagaatgaagctctgccaaaaacaaaaatagggaatgtaaaatggtaccattgttttggaaaacagtttggcagtttcttattaaggtagacgaacacttccatgtgaccaaacaattcaacttttatttccccaagagaaataaaaacctatgtccatgcaaagactgttactactttatgtataatatcaataaactgaaaataaccctgacttccatcaagaatgaaatggatatttggtatgtttgtagcagtggagtgccacacagcagtaaaaatgaatgattattaatacatacagcagtatctatggatctcaaaaacagggaaagaggccaaacaatgaagtatgtgccatacaatttcatttatttgcaattctagaagctaaactaatccatagggacagaaggcatgcctgtggttgcctggggttgggtgtggagggaaagactccctaccagtgggtacaagggaactttctgggcatgatgagaatattctgtatcttcattggggcttgatgttatgtttgtcaaaactcattgaactctacacttcagatgggtgcattttaccatatatgtcatctctcaataaactgaattttttaaaaattaaaggaatttacttaattgcaaaagaggactggaaaggaaaggctgccgagcatcttggcctgctgtacccctcttccttcaaaggagggtgtggccacgtccgacagcagagttgaatgaagcctgcatgcttgcacaacatcagaactgtcagaatgtcaagatggaatactttcaattgagttttacaaaaagacaagaaatttgctgggtgtggtggcgcatgcctgtaatcctagcactttgggaggccaaggtgggggaattgcttgtagtcaggagtttaagaccatcccgagcagcaaagtgagaccctgtttttacttaaaaaaaaaaaaaaaagaaaagccatttagaattctaaggtgaagctggacgtggtagctcacgcctgtaatcccagcagtttgggaggctgaggcaggaggatcacgagctcaggcgttcgagaccagcctgaccaacatggtgaaaccccttctttactaaaaataaaaaattagccaggcctggtggtgggcgcttataatccgagctactcaggaggctgaggcaggagaatcacttgaacccgggaggtggaggttgcagtgagttgagatcgtgccactgcactccagcctgggtgacagagcaggactcaatctcaatctcaagaaaaaaacactctaaggtgaacttatcctgagagaaaatactcctcctgagcagtcactgctagatcacatcccactaaggctgatgaactgtgcggctgttgtgcttatttttagtcaatgagtttatctgtttatacacagatgttttgatcaagtcttcatctgtagtaggatcttcaacactgttttctacttaccaggtatccatcatcccacgtggcaaaggactaggttatgctcagtatttaccaaaagaacaatacctctataccaaagagcagctcttggataggatgtgtatgactttaggtggtcgagtctctgaagaaatcttctttggaagaattacaactggtgctcaagatgacttgagaaaagtaactcagagtgcatatgcccaagtgagtatatgaaagagtgcatttcctcctcatgtattcatatttgcacgagaaattgacattctatgaatggctctgaaacaatatagttgtgcttcactgttttaggctttttaggcaaggattatctcttaaaagaagtaaagcaattaaaacttatgaagagaaactttatttttttgagacacagtctccctctgttgcccaggctggagtgcagtggctctatcttggctcactgcaacctctgcctcctgggttcaagtgattgtcctgcctcagcctcctgagtagctgggattacaggcatgcgccaccacatgtggctaattttttttttttttttttttttgagactgagcctcgcactcttgcccaggctggagtgcagtggtgcaatctcggctcactgcaagctctgcctcccaggttcacaccattcttctgcctcagtctcctgaggagctggggttacaggcgcccaccaccacgcctggctgatttttttgtatttttagtagagacagggtttcactgtgttagccaggatggtcttatctcctgaccttgtgatcctccagcctcccaaagtgctgggattacaggcgtgagccactgcgcccagcttttttgttttttttttttttgatctggagttttgctcttgttgcccaggctggagtgcaatggtgcgatctcggctcaccacaacctctgcctcctgggttcaagcaattctcctgcctcagcctcttgagtagctgggattacattcatgtgccaccacgcctggctagttttgtatttttagtagagacggggtttctccatgttggtcaggctggtcttgaactcctgacctcaggtgatccgcccgcctcggcctctcaaagcactgggattacaggcatgagccgctgtgcttggctgagaaaccttttttttttttttttttttttttttgagacagagtctcggtcgcccaggctggagtgcagtggcgccatctgggcacactgcaagctccgcctgccaggttcacgccattctcctgcctcagcctcccaagtagtgcccgccaccactcctggctaattttttgtatctttagtagaggcaggcatttcactgtgttagccaggatggtcttgtctcctgacctggtgatccgcccgccttggcctgccaaagtgctgggattacaggcgtgagccaccgtgcccggccccgagaaacctttttttagtacagtatttaaagtttatttcaggctgggcgtggtggctttgatatgtattttttctctagcacctcattgaagcttttctagttctgatttaagtagatctttcatatcatatgtcatttccctgatttcttttagcctgttttgaaataagaagatacggatttcctcttaatattgacacgtcttttcatcccacttttcttatctctggagaaactattcagcttatttttttcttataataactttataagggatttttctattgcctatttttacatgaaatttgttctgctgctctcttaggtgggaggaggtctaggagcttttctgactgtattcatgaaatgttaggaatgtggtttcctaccttccaagcatccctggctgtttgatccccactcttatctgggccttctcttttttccagtgagtttgggtcttacttgcagaagcctcctcctttgtggtgctggttagttttgggggctcatgggtccagactggatcagcttcttcagactgttccctgggccccatggactcagtgaacggggaaatgcagttgcccttctggtctcacatgttctcagcgtgagtggcatgccatccttctgggaagaacctgttggcagctgggggttcttgtttcttcaggtctatcagatgcttcttgcttcttctctactttctcttgtgcagatagtaatatcaggctgggcacggtggctcatacctgtaatcccagcactttgggaagctgaagtgggaggataatttgagcccagaaggtcaaagctgcagtgagctatgatcatgcactgcatttccagcctgggcgacagaacaagaccctgtctcaaaacaaaaacaaaaagaaaccaggtagtggctgggctcatgcccgtaatcccagcactttgggaggccgaagcgggcagatcacctgaggtcaggagttcaagaccagcctggccaacatgacaaaaacccgtctctattaaaaatacaaaaattagccgggagtggtggcaggtgcctataatcccagnnnnnnnnnnnnnnnnnnnnnnnnnnnnnnnnnnnnnnnnnnnnnnnnnnnnnnnnnnnnnnnnnnnnnnnnnnnnagagaaatcaggtaataatatcatacagttgggatttgcgtcctaactttgttgtaggtgttatgcctgggcttctggctctgtgtttctagtcatgagtttaaagcactgtgctgctgctgctgctgctgctggctacacagagcacctttgtgcactttagccggctccaggctgctgtgtagattttgtctggttaaagaacaatcatatgtaatcaccactaattatgtatttttcagattgttcagtttggcatgaatgaaaaggttgggcaaatctcctttgacctcccacgtcagggggacatggtattggagaaaccttacagtgaagccactgcaagattgatagatgatgaagtacgaatacttattaatgatgcttataaaagaacagtagctcttctcacagaaaagaaagctgacgtggagaaggtaggtgccagttgtgggaataattctttacagttttgcaaaaaaaagattgaagtgatagatagactgttttggttggtgtgtagactgcagaattccctctctctggctcacccatgggtccgttcgttctgatgtttcgttgtctgctctgtcttcaagcgggggttgcaatgtggtgagcagaagttgacactgtcccggctcctgtggctcttaggaatgtgactgaatgattaatgaagtctgtcagtaaccacaaagtaaacaaatcaggactctccctcaccagatagttcacagtactcctaatgagaagcatgattgcctggtttaccattgtgtttcacctctaaaataaataggtagtgaaagatgaaagggcaagtaaaagaagcagccaaactgctaagtaggaaattggtacgtgaaagttaccttgcttgtggcttgctcatgaacttccacaagaaagcattgtgtttgtcgttgttgtacctcatttgatagcacctacaaaaggaagggaccctttctgaactcagtggatttcttgcatttggtaacttcttaattttccagagtccatgtgaaaaaaattagaattaaaaaaaactttgaatattctatactgtaatgagaaaaacacaaatgtaaaagccttttataagggattgacacaactgcctaatagatttattttgcctgctgcccaggtacagccagtttctcaagacaggggaattgcagtagagaaagagcttaattcatgcagagctggctgaatggcagcctggagttttattattactcaaatcggtctccttggagaccagggtttttcaaggatagtttggcaggtaagggccagggagtgaggaatgctggctggttggttggggcagaggtgaaatcatagggcatggaagctatcctcctgtgctgagtcagtttctgagtggggccacaggaccagttggtaagtccaggtggagccattggttgtcagaaatgcaaaaagctgaaaagctatcgcaaaaggccaagcctaagttttacagtagatgttatctgtaggagtaattggggaagttgcaaatctgacctccataataatggctggtaattatttaaccatgcctacatcttagtagaatgcagtctcctcttatcctcctaatttggtggcctttcattagttttacaagggtagtttagttttggggaagtgctattatcatttaaactataaattcctcccgaagctagcttggcccacacccaggaacaagcgaggacagtgtgtgaggctagaagcaagatggagtcagccatgccaaatttctcttgctgttataattttgcaaaggcagcttcactaagattatgctgttcaatcagcaagtcttcaagaagccgactataacccctatgttagacttcagaagaatccatgctgtcggtgcacaaaagtgtgcagtgaaatgagtgagcaccagcatccccaaaacactggaaagcatgcagcagggctctgaggaagaaaaggccagcatgggcagagtggtccaggacggctctgcaggagatagggccgaggtacccagaaggatgagcaggtcatagagctgaaggaaggggaaggaagagtgtgcggcgtggagcccaggggcagccctgagcctgctgcacttgcaggtggtggaccctgtagacccaagagtggctgagacagatctctgtcagcttagaggtttatttcgtcaaggttgaggatgtacccagggaaaaagaaacaccagttacaggggatctgtggtccctgctttttccagagagagcttcgagggcttgaatatttaaaggggaaagagtggcaggaagggaaggaggaagggagaaaaggggagggtaggtggtgaaggtgagtggtcgcattcttgatttttgcccattgaatccacatgtgacatgtgaaaggaggagtagagggatgtcagttacgcatgcatctcttgttcagtaaatcctcattttacatgcaataaagtaaacatagagtagaagaaagagtcaaatacacatttgtctcaggttggcagagggatgatttctggtctggtctttgtccattcctgtgagataagctgttaacttacattgtcagggtgagatccagcagaactttgtttcagggtaaaggttttagggcccacaaggaatctccttgtgagcaatgagtgagggaggccacctggggagataaatggtttctgtctttgcagccatctctttaggaacaataggaaggcagctcttgtgcaactcagtttccaagcttaacttttccccttggcataatgcgtttagggtcccgagattttattttcctttcataagtcccaggccctccagagctaggtagaaagttgaggcacacagctttagaagtagaagtgatcttaaaaatgatctaacccagcctccttattttgtagtagttcttaaaggagtccttaaagaatcttgagcagaaatgatgaaaagatcatttcaggagagtgtggtggcagcatgccagctggattggaacaggaacacagaccagaccagcttggaagcagtgggggcatctcaacactcctcaggtggtgcctgcaggggtggccatgaaaataaaaaggcaaaggcagagctgtaaaaccaagacttcatagagaacaaaagagaagaaagcccaagaatgactccaaggcatccctgggcagggggaggaaagggagtgataaacggtttggtctcaacacccaagaggatttgagcaaggcgcatttgcaatcagaatatgaacagaggtcagggctgccagatagccaggtgttgagctgtgaaagacaggaatgcagaagagcccagtccagatgagccctctgtgaggcactgaggaggtctgcagtgatgtgagaatctccccagttctcccacccatccacagtctcagtgtctgtactcacacgactcacgctgcacaactaaggtctgtttattgaaaggagaattgggttagcatggtgaggctcttgaaacactggacagttttgaagtactttctggtccatcagagagaatgagccacgtgcagaatactgcagagccagccaggaggtagggaggctatggagaagagaggggctagggcctgtgctcctgaaaccattgccttccagactctgcgagggcagggagtgtgtacctgagggcttgccagcattcacccaacacctgtgtaccaggcactgcctgagggttcctttctgaaaaccctgtgacctcatgaggtggctaacattagtgacctcttacatcagtttcaggtgaagaagctgttaacagagagaggtcaggtagctttgcttagggtcatacagtgggtaagcagcacagccagggtctgacccaggtgtcctgcctgcagagccctggtcgttcccctctccctgagcctgtgtggccctgtaaggcagctgcggagggctgccgagcacttggtggccgctgtgaatcgagaactgttaaatgtcaagtgcatgctggttactgaagattcagcatgaagaaaggaatgtaaaaaaacctcaatcatgttttgtgtcgtcacatgttgaaataatattttggccaagaactgtggcacatgtctataatcccagcactttgggaggctgaggtgggtggatcacttgagcccaggaattcgagactagcctgggcaacatggtgaaaccctgtttgtactaaaaatataaaaaattagcccggcatggtggtgtgcatctgtagtcccagctacttggaggctgagatgggaggatcacctgagcccaggaagttgaggctagaggctacagtgagctgtgatcacgtcactgcattccagcctgggtgacaagtgagaccctgtttcagggggaaaaaatatatatatataattatatattatatatataattttatatattatatatttataatatataatatatatttatatattatatataatctatatttataatatataatctatatatttatataattatatatcatatatttatataatagattatatattagattattatatatattatttattatattatctattattatatatattagattattatatattatatatattatatatataatctattatataatagttatataatagattataatctattatataatagattatatatttttatatattattaatatattttatattatatataatttatataatatatttatataatatataatatattatagtatataatatattatatgttatatagtatatgttatatataatatatattttttatatattggattaaattattgaaatgtaagtgatcacccacaactatggtgtgtgtgtgtgtgtgtataagcaaattgagaattaaaaatggcctaagaatgaatcctaaagcttttttcccttacgtatatgcagacaatatatttttaaaatcagagcattatagtattctggttttctaaacaatcctaatcttttagagatatagacaaaaaaaatatatatatatatggataaaatgatatgacatctgggattttcttaaaaataatctagagagctgaaacaagaatgtttctaaattgatcactgttgatagtggttacatggggattatccattctttccacttttgtacctatttgaagcattttataataaaatttttaaaaactgaaaagacaaaactttcataattttatatctttaaaaacataacatttattgcaaactacaaatagattaaatttcagagtaaggagttatctcaagaaataagtctggccaggtgcagtggcttatccctgtaatcccagtactttgaggggctgagtttgagactagcctggccaacatggtgaaaccccatctctacttaaaatacaaaaagttagcgggcgtggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctccctctgttgcccaggctggagtgcagtgcctccatcttggctcactgcaacctccgcctcctgggttcaagtaattctcccgcctcagcctcctgagtagctgggattacaggcaggtgccacaacgccaggctaatttttgtatttttagtagagacagggtttcaccatgttgggcaggctggtctcgaactcctgacctcaggtgatccgccgccccaaagtgctgggattacaggcgtgagccattgcgcgtggccatatattttttatgtaccgtttaaaagaaactttagacaaagtaaatttaacagataagtttatttgagcaaagaacagtttgggaatcgggcagccctcagaattagaagttcagagctctgctccggcagcatgagcagcaagcttttgtaggctgagcctagaagcaaagaaagaaactgcagtcatgtgttgcttaatgatggggatacggtctgaggagtttgctgttagttgattttgtcgtcgtgcaggcatcagagtgcgctacacctgccgcacacctaggctgtgtggtgtggcctattgctcctaggctgcatacctgctcgcatgtgactgtactgaatgcttcaggccattgtaacacaatggtatctaaacacatctaaacatagaaaaggtacagttaaaataaggtattataatcttacgggaccaccatctacatgtggcccatcattgactgaaacgttgttagcagtgcatgactgctcttagcggtgcatgactgcttgattggctactgctgggcatttgccttatttgtgtggtccaatgcatggtcccaagttctgccacagttggctggttggctgtttatgattggtagaagcttaatttgaagttagttacaaagaatgcctctaggttaagttccagtttgtgtatggatgggttctgggtacagaaaaagccctaagctgatggctcctgcctagtctgtttttttttttttgagaccgagtcttgctctgttgcccaggctgctggagtgcaatggcgcgatctcggctcactgcaacctctgcctcctgggttcaagccattctcctgcctcggcctcctgagtagctgggcttacaggcacccaccactgcgcctggctaatttttgtatttttagtagagacggggttttgccattttggccaggctggtgtcgaactttggacctcaggtgatccgcccacctcggcctcccaaagtgctgggattacaggtgtgagccactgcacttggctgcctattctgctttaatgcacataaaaagatacattcttatcacctcagaaaagcaaacgtaagatgctgtgcacactgaacatcttgtttttttaattgaagtgtgtatctctgagatgtatatagaacatacacagcctcctcctatttttttttgtttgtttgttttgagaaggagtctcgctctgtcgcccaggctggagtgcagtggcacaatcttggctcactgcaacctccgcctcccgggttcaagtgatcctcctgcctcagcctcccaagtagctgggactacaggcgcacaccaccatgcccagctatttttttgcatttttagtagagacacggtttcaccctgttggccaggatggtcttgaccttgtgatccacccgcctcggcctcccaaagtgctaggattacaggcgcgagctaccgcgcccggccagcttcctcctcattatagatggtcagcattcattgtgcagatgtgtggaaatatgtctagtatggaaatgtatcccttacagatggacattggttgctttgatattttgcacatcttactctaaaactatgcaaccttatgtatgagacatctttttcattggtcttaaatccttttttggaatggggtcacctgtaaataaaaaattaatatttctgaatagactttgctgagtaactgtatttaatgaaaattgttcatatttcaggttgctcttctgttgttagaaaaagaagtattagataagaatgatatggttgaacttttgggccccagaccatttgcggaaaaatctacctatgaagaatttgtggaaggcactggcagcttggatgaggacacctcacttccagaaggccttaaggactggaacaaggagcgggaaaaggagaaagaggagcccccgggtgagaaagttgccaactagaggcccagagggaggccatctcagtctgtccactgtggtttcagctggtgcattatttcagctgtggctttcagaagaatgggaatgctgcgctgattttagccagccactggcccagctgaaatgatggggaaaggagtccttagtcctttcagcctcagaggtcacagtgggtggcaggtgactttccggaggccttgagggaaatgcacactgtcccatagcctcattgggctcccagacgtgctggaaaggttgagcccagagtggccgaggctggaccctgtggcaccaagtggggtcggctgaccgtgtggcagggatcgttgcactggactcttggcgtgtgggaagggatgctttctctttgtcgcccactcttcattcctgtttctcctcagttcccctgtgcagatgggctgtgaaattaaattggagtcttgataagaacattttaatttgacttaatattttaaagattgaatccagatcacttgttgctgtcttaatggaatggttttctacaggagctgtaacatacttaaaaatatgaatgtattatgtaaatatggcttctttacataaaaaataaaatgtcaacactgtacttttctgaacacacatagggtccctatttatgctctggatatttttagaaaacataatggcaagaaattaaattttcttgctttttagaggagaatccttcaaaatctcagcctcgctggttctcattagctcccacaggaggttggaaccttctagagttatgtgtcctgtaaagatgcactgagctctggatataaagtacatgggtcctgaggggttagtcatggcctgaatctgtgataaccaccccagtgcaggtcctcaagaggccagtcatggccagatgttggccacaccttctgggtatagaagttaacgtataactgtagcgggcctggcaggctgacctgagccgtcacctggatttagagaaggaacagtggaactaagctggagtcccctgggccctggctctctggggacatctcaggagtggtctgactggtaagctgctcctattgtctattgaaagggagttattggttatgtgcttccagaaaagtgagtctgtagtgttgcaaacctatatcaaaattccttaaaaaagatggcatgaggaagatttgctatgtcttctatcaattgctgttatttggacatggaggagacactggcatttttaactatttacatttttagcagtctgttttagcattattccagcttgccttgtgtggtgttgatgttgtcggaacagtggctttagaattaacacaatctagtggcatccctgccatggccccaggccatgcatgctccacccatggctacttcccagcagcctgagatacccacctgtccccggcaggccgtggaagcagctgtttggactccacagctcagcatgccaggagaacaggcgccccctgctggacctttgcacctgcaggcattgccacactggccacttcctttcctcatagggtgtttttgggaggtgcccaatgaagcattgtttccaggctgaggctcacacagttgtgagggtgctgggtgtgctttttaccatacaggcagtagacgattaggagacgctctctactccttatccaaccactgcaaggcatggagccagcgtgggctgccctctcacaggccttggctgtgagacctcccgggggacgagagtggggcccactgtctgtcaggcttgatacagtaagagtgacaaagccagatagcaccgacaacacccatgtttttggtgaggtgagcaaccttaagctctgggccctggatggctgctcaacctgtgcaagtggccctctgtgctaggagcaaccatggctccctgtgccaccatcttgtggggcctgctcatgcatagatctttccacggtcacacagaacatgttttcaggacagatgtgggtggtgagctggtaagatttatttttactgtggtctcagaatagttcagatttctgcaaaaagatctgtgatcacctcaagccatgctgctgtgtttagtgatgaactttccatctgcccaaggctggggcttaacacaaaataaatacagctagtcaatgtaaggcctgggatcacagaccaagggtggtgttgtggttgtactgtggggaaccctaaccctaagtggtcccgaatgacaaagctttgtctgtctcttattccctgtccaacacaggtcagagtgggctctgcccaggatggtcactcaggaacctggacgggtggacaggagggatcgggggggctgcccacgtgggaggcagagcaggagggctggcactggcacatgacgcttccactcgggggtgacacactatgcccattcttatggctagagcaagtcccacgttcacagcttcaagagggcaggaaga

SEQ ID NO: 16195 - DNA, 45091 bp, Human
tcatcagccttatctggaaacttgttagaaatgcacatttttgggtcccacccaacacctactgaatcgaaaactctagaggcagggcttaccaatccaagttttgttttttggtttttgtttttttttgagacggagtttcactcttgttgcccaggctgaagtacaatggcgtgatctcagctcactgcaacctccccctccccggttcaagctattctcctgccttagcctcctgagtagctgggattacaggtgtctgccacaacacctggctaattttttgtatttttagtagagacgagacttcactatgttggctaggctggtcttgaactcctgacctcaggtgatccacccgccttggcctcccaaagtgctgggattacaggcgtgagccactgcgcccagccaccaatccaagttttaacaagctttccaggtgattctgatggttgctgtttgagaacctctagaagcaaggcatggtataagtgtcagaaattaatctcctcatgagtaaggaccggttatggtccatcccttaagttcccagcctctgcatggcatctagtgtaaagcaggcatcaaaaatttgtgagtttatgggaaagtgatgtttgagctgggtctcttaccccgcctatcactgcaccagaccgaataggagggagaatgggagttcccagaaactttgagactagcaaggaagtggttgtgatacgtctagcaagatatgataagggtctgcaccagcataagaaaccatcagaatggcagtgaatcatgtgagagcagttcagaaggtaaacatgtcaagacgtggtgaacagctgaatagatggaaagaacaagggatagaggaactgtcatttctgacatgaaggtgctgttcgctgagataggaagcacagggcaagtatgtttgtgagtgaaagataaagtgtttggtttggacttcttaaatttgaagtgctggtaggatatccaggtggagctgtccagcaaacacttggaaatgtgagtatgagacatggttggaaacagagatttggaaggatagttgggccgtaagagtggatgagacctttaaggggagagtggaatgagaagagagctgggtttggaaccacagtgaacagttaatgaggcaaaagcaaaaggggccctttagaaagactgaaaaggacttaggcaataggagactgcagaagatgccgcagccaagtagaaggctcagaagggaagtagaggcacagtgacagatgctgcagagaaataattgaaaagtatcctttggatgtcaaccccaaaagtcatttaagtgacgtgatgagggcagaagctgattgacagttcaggcatgaactgtagatgagaaagtggaggcaggtgcttcccaggtccggcggatagagctctgtagctgcacttaagttcaaactgtgacatcttccagggtaggccgcgtctctacttatctgtggtctcagcgtccagcacatggcgtggaagagggggtggcgtcagtgagttcagtgactagggacggagaaagacttcgtggaggcagtcgctttgcagccaaggcttgaaggatgagggtgattgggaggagaggtgggaggcagggcccctgggcgctggagtgccagggggtctgggaatgaagtggggttcccataatgtgtgcgcgcagctcggtgcgacaggcgggggctgtgtgtaggtttggagggacctatttggggaaaagacacagggctgaaggctgctgtggcgggatgtcccttcgccctgccccacttataccactgcgcggttccaaggcacctctactggcgccctcccgccgggctgcatggcgacgggtgaccgccaggggccgctgccttgggtccccggtgcccccgcccctctccattggcctttgttgccgtcggagcgccccgcttgactcgttccggtccgccccctgggcccggcggtcgcgcctgcgcactggcagctggccgggcgctcgcagtgggagctgctgcaggctccgcggcggcggcaacggaggctgcgggggcggcggcgcgagcggccgggcttggtaggggagccgagcccggcccgggatcccgagcagcgagagtgtggggtacctaggcccctcacgctggacttcacagtctccgggccgcctgacctccgcacgggtatatgggatggaagcgggaccctcgggagcaggtaagggtccccaggagggggaacggtgcatgctccaaggactgggggatcccgcatgaaaagcgtggtttccaagtgatggaagcgctcctgagtgaggagaagggctctcccacgatgggggcccagtttgaaggaggctgtgtgcagttccgggggagaaccatgtgaagagagccctgagatgggggctgtttgtccaaggaggctgtatacagtcctgcgggttggaagtaatctgggagaagggcctgcacgcacggaaggactcccagacatccgtggaggcctacggagaggcccggcaggtggcaggggacgggctccaggtgtccaggagaggagggggcgacacagatgggcctggagctaccgcatgccgggggcgggggctccgctgggctggaataggctaatgtctcttgggagaaggcgccagagctggactgtgagctccgccccactgggcctgacgcgagggcgagggtcagggggcggtgggtggggacccagtcccgggattaccccccgtgggtctggggagtcggagcggaggctccagagcatgcgcggaggtggcagctggaaggggctgcccgacgtggtgggggcgtggctgtccgaatacccccacctctccacacccccccgccccgccccgtttggcttggaaaaaggagcgcgctgatggggtgcattctctcttaggttatgctggcagtgtgcaaatggttatggtcccctcccccattttaggggctcttacacttggccctcagtcacagtttgctaagaatgggttgagggaagctgccaaagtgcatttttctgccacaggaaagactgggaccgaagcgatgggttctgggggtgggtcctcctgaagataggccttaggaaaggtattggttacggaggaatcaaggacagggcaggggctacctggaaggagttgtctgcttggtttgcaagtttctgctccaatactgagtagtgatgggggcttttaatccaaagattttccattgaattgtctgttaaggttacactctacatttataacatttattctaatatttcttaatattttcatggctcctatcttccactggatatctttccgttttcctctccccactccccagaaactgtcagggctgtctttagagccaagatctaaaccctacaaacacgttggaggatgggggagtttatagccttcatcctggtgaggcctaggtgatagccttaacttcttatttgcaggcaatgaggaggaaaagacataggaacagaggataaactgaggcaggattgcctcaagaaaactggagtccttaggatgggctgtggggtggtgatacctcttgtgtcttaagtgtcttaccctgtgatgggacgaggagcctggacctgggaatccttcaggtcatctctcaccacttccttacatttggtctggggatgggaatcaaatttccatttaggccatgaacttcattactttcctagtggaattattttgttttttttgtagcagacctaactccctcccaccctcccaaggaaatagctcctacgacctcactcaagttatccatttagtgatctctaagtacttagtgactgttttccctcttaacaaccagccttgtatagactgtgtagtcgtaaggataagcacagggagcaactgacttgagtacttcctctctgtcaggaccctctctccatcccaggaacttctgtttttcaaggctggggactatttccaacaacccatgaactagagtagtggggtaggtcattgaggtccacatggattgctggttgctggtacccattctagactaatgatttttatcctgatgaattcctaataggctctggagtgatgaaaaattgactttttaaaaatttgttacaaaaaataagcttataggaaaggagctagaacctgctgtttggagtcagccaaagccttgggaaaagccgaataggacaggctttgcctcagtaaagggtataattgagattcagtctggaagctgcaaattgagggaccccataactgcctccttcctaggcccggactgttctcttataagaagttagagtggtgtcccaaggtggcctgaggacataatacacaaaactaaagcgttgtgtaaaaaacaacaacaaaaaaccccccaaaaactaaagcattgttgctagcctcactgggcttatgcccaggtctgccttctgtgctcaggtgtgttccaagcacatacagtggactgggtgctccctgagggtagaagcagtgtctggtttatttgtagaactagcaagtgcctagtgtataggccctggcacagaatacatgtttattaattaaatcaaatcacattcaagtgtgaacataaatggttaagcacgtatgtggatatttaataaagtgtatactcacatggaacagatcctttttggagagattggcttgttagtctttgcttgcccaccagctaacctaacctaacctaaccttgaatttgtgtcttttgaataggcagtctggctccttgggaggtgtgtgggcctcagaactgcaagaaaggaatcctgagccagggttttcagctctgttacttttccttctctgggctccttggggatgggggagggggagtgtccttttcagggcccctccctccttgcttttgtctgaagagaagggtcccgcccctttccccctaggcccaagctttgtcctctgtgctggggccctcatctgcatcacaaagtggccgtctgtccctgtctgggtctgtagggaagtgtctccctttctcagactaaaagctggggtaaggggggcggggaggagacagtgctgttgttaggctttcagggggatgtaatgggagagaggttcctgcttcctgctgtctttcctagtttggagatgaagtgggggtgtgggctcccctgttttcccaaagcctctttggagaggaaggtgctctaaggctatgtgtggtatgtagtcgggtttctggggaagagaaggctttgaggctagagtgtctgtcccatcccccatcatttctaactagccccccagctctaggagttatctttctccgaaggccccaaatgattattcagtctgggaggggaagaaggtgaatgaaatataagaacttggggagggaaaggatgtctcttactggctacacccacaaacgtgcatatttgtcttgtgtagtgtttataattgtttctgggcaattgcaggtgttcgtgtgtctgtgtgctgtgtgtgcttgtgtgtttttgtggtgtgtctatggatatgtttgttcattcatttcatatcagtatgttgaatacttcctgtgtgtgtgtcagacactggaaattaaacagtgaccaaggcagatatagtccctgcctttgaagaactcagtctagggcagtgaaggatatgtgtgtaagtgtaaattgccaaggtctaagtgtgtgtttggatgtgtgtgatggggatgtgtgtctgtctgtccgtgagcttgtgtgcaatttctgtccagcactttctgaggtaggcagccaggtgctagtagataggttttcccttccccatgtagctgagttctgaagaccttttccatccaggctgggccttcatttccctgtctgcagagtgggactgggcttggacaggtggttagagggaaacagagcagcttagctctgggaagctgcccctcccatgaatggttctgacctcttcctgacccccagctgagggtatgccccatccccccagcttgtctgactgtgaaagcagaagtctgataatgggaggttctgggctggtttatccctctcttctcccacctgggctagttctctactgccaagaacaatagcagcatattattccctttttttctctcttccccccaagctagaaaataagactggagacagcagccagactggcaaaagagggtaaagtagctggatctggccttaccctatccctttcccaagggcctcctctgtcttgaaattgatctcttctgctgctgtctggaccttctgtgtggaaggatctgtggggcatggagagaatcttgtgttcttcccagagccagtgtctcttctccagcattctaattgccacctcttcttcccaaacccgttagttctttctttattcaagcttttttttttatcattgtctccccagttgctgctttgtttcttcctgcctgagcttccaaccctaacctcttttgccccaccccttgactccagccttctctttctcctggcctttttcttttgtgacctccagctctgtcctcttctccaaccccctttctcttttccttagtctccaaactctgtcctttgagccttttctccttttccctgtctccaactctcgccattcagttgccttaattctgcctcaaacactgaccctgccctctccagcctggccttgtctggatcttattcctgcccacctataaaggaacatcaaggttatgccattttgtattcagcatggtggcgaatggagtgagcatctggctggcagagaatagaaattcttggtctgctagatacctggtggaggcaagtgtcttactctactagaagaaagaaagggttttgttactaggagccagatttagtctctctgcttaacatgcaataggaacttattatatattaacttaatgaattaaaaatagacaataaggataattttcctaactggagagagattaaaaaagaaaaaagagaaaaaacacagatgagcttgagatgtcccctggaagcccttggctgggttgggtagcaggaaagaggcattctctatactctcgtgttcctgttctgggaggccttgttcctcctctgataagagtagttaggagattgccagactttaccctcaccagcctctttgtcttgtagctgcgggcgcttacctgccccccctgcagcaggtgttccaggcacctcgccggcctggcattggcactgtggggaaaccaatcaagctcctggccaattactttgaggtggacatccctaagatcgacgtgtaccactacgaggtggacatcaagccggataagtgtccccgtagagtcaaccggtaagtgatgcacacctaagccaccaaatctgaaagacaccaaccttgaaagaggggccagaaaggtaaaagaaaaaccagtagagggtagtatcaccaaatctaaggaagtttttgaacgggagatgccacgtcgggtaaatgctgaaaaatagtccaattggacttcgctattggaagattattagtggcttttgccagagcaatttcagcagaaagtagttgagctagttaatctaactacattgagttaagaaataagtacagtacctactacatttcaatattagttgaatgaataaagagttttaaagaatgagatatgggtatgtttacagattaaggagaaggagctagtaaagagggagaggttaaaggtatgggacagaggggagaaatgaatgggatgtccttgatgaggcagaaggacagaggggagaaatgaatgggatgtccttgatgaggcagaaggacagaggggagaaatgaatgggatgtccttgatgaggcagaaggacgttgtaggatgcacagttggagggattagccttatttagaggaagtgatatttccttttttttttttttttttttgagagggagtttttctcttgttttgtttttgagagggagttttgctcttgcccaggctggagtgcaatggcgcgatctcaactcactgcaacctctgtctcccagctttaagctattctcctggctcagcctcctaactgggattacaggcatctgccaccatgcctggctaatttttttgtatttttagtagagacggagtttcaccatgttggccaggctggtctctaactcctgaccccaggtgacctgcccactttggcctcgcaaagtgctgggattacaggcgtgagccaccgtgcccggcctctgtgatatttctttaattaattttattatttgaaaactatatgtataatattaaaaaattcaaatattacaaaaagaataatagtgaaaaatgtctccttactatcctggtctctagtcccccagtaccattaattgttacctttttttctttttgagaaagaaaaattagatttttctttctccctctgtcgcccaagctggagtgcagtggcgccatctcagatcactgcaccctctgcctcctaggttcaggcaattctcgtgcctctgcctcccgagtagctgggatgacaggcaaacgattctcctgcctcagcctcctgagtagctgggactataggtgctccccaccatacccagataattttttggtatttttagtagagacagggtttcaccatgttgaccaggctggtctcaaactcctaacctcagatgatctgcctacctaggcctcccaaagtactgggattacaggcgtgagccaccgtgcctgaccaattgttaccattctcttctttttttgagacggagtttcactctgtcatccaggctagagtgcagtggcgtgatctcggctcactgcaacctctgcctcccgggttcaagcgattcttctgcctcagcctccctagtagctgggattacaggcacccaccaccacgcctggctaatttttgtatttttagtagagacagggtttcactatgttggccaggctggtctcaaactcctgacctcaagcagtctgcccgcctcagccttccaaagtgctgggattacaggcatgacccatcatgcccggccaattgttaccattcttgaatatgcttccagatacttttctacatatatacaggcatatatgcacatataacatttttaaacacccaaaacatagggttctttatacattgttctatactttgcatttttccacttaacaatatatttttgaagatattacataccggcacatatggatctgcctcattcttttgcataggttgagtggctgtaatataacttatgtaataaatctattgaggaacatttgagtctaaattctgctactaaaatgaaactgttgaatattattatatatagattcatttttgcactcatatgagtatatttgtaggataaattgctaggagtgggactgttggcctaatacatttcagagttttcagatattgcaacttgtttttaaaggtaagttgtatcaacttatactcccatcaataaggcatcagagtgtgtcttcctatacctgcaccaatctaatatttcagatttttttgatctttggcattctgatcttggtctaattttaaattatatttttctaataagtgaagttgaatatattttcgtatgtttaaaaataatgtatggaaggggcattttgagtataagaagaaaggagaaaaattgatgcacacacatataaatatgtttgtgtatatgtctggaaactcgagggtggccttgcgtactatcctctgcctttttcaatattagagctgcttcctggtaggagacaagtacggggtctggagttagaggctagtggagaaagttctacatagtctacatagtgtaggagggatagaagtaatcagggacatgaaaaagattgctaggcagcactgaagcctaattgggattgaaaccatatgatcacagtgcttctaatgtaccattttgagttatccagtagtagtcaagaactttgatctagaaagtgtgaaggtcagttggtcagataaactggaattttgaaggaataatggacaccctggggtctaagtttcagaggtcaggaagtaagagatggtaatggagaaaaaatagggtggtgagactaagtgcttcagagagatggaagagatgagatttttcttccacagtttattcttattccagttcacatctcttctaccttttttgcttatcagatctgggattagagatctgggattagattggagcagcctagattctgttcctgatttttttgttttgttttgttttaatttattttttattttttattttttttttgagacggagtctcactttatcgtccaggctggagtgcagtggcatgatctcggctcactgcaacctctgcctctcaggctcaagtgatcctcccgcttcagcctcctgagtagctgggactgtaggcacacaccaccttgcctgactaatttttgtattttttgtagagatggagtttctccatgttgcccaggctggtctcaaccttgggagctcaagcaaattgcccgccttggcctcccaaagtgctgggattataggcatgatccactgcacctggccatcctttttttttgttttttgttttttttttgagacagggtctcgctgtgtcccccaggccggagtgcagtggtgtgattatagctcactgtaaccccaaactcccagcctcaggtgatcctcctgcctcagcctcccaaacaactgggattataggcacatgccaccatacccagctaattacaaacattttatttttttgtagaagatacggtctcactctgttgcctagtctagccttgagctcctaggcccaagtgatcctcctgccttggctgcccaagtactgggattacaggtgtgagccaccatacttagccctattcctgattgttgatagaccctggagtcaagcttttctccctttagcctccccctcttctcagaaggcactcacaccactctttcaggtccattacagccttggtgatctgaggaccagcagtgtcacttaggagcatgctagaaatgcagaatttcaggcttcgctctagacctgctgaatcagaagctacattttaataaaatctccaggtgattcataggaatattaaagtttgagaagcactgtcatagagtagatgttaggagtgagtataatagatgggacattgcctggactttgaattacttccaaaacttgaagtggtggtagtctctcagcttccacaggccactcctatcccccacagggaagtggtggaatacatggtccagcatttcaagcctcagatctttggtgatcgcaagcctgtgtatgatggaaagaagaacatttacactgtcacagcactgcccattggcaacgaacgggtaaggttgggagtcaggctaggcctgtgtcaggggtctggggtagaaccaagctcatgtaagcctctttggagatccagagatccttttcatcttttgtgctgagaaagtatgttttagggtgaggggtgggtaggtgctgatgtttatttagtctatcatgtgcctgtccgtgtcctaaacagattgagattagacttaaaatagacctaagggcttcctgctaggctgagaggtagttgagaggaacagaagcactgagccaaggtggctagaacctaaggggctagacttactctggattttcattatgagcccctatcaacttgaaaaacatgttctcagcaaatccatggagttgggggtcattctcgcagagcaatggcaatccttcatccctttctttcaccctcctgaaggtcgactttgaggtgacaatccctggggaagggaaggatcgaatctttaaggtctccatcaagtggctagccattgtgagctggcgaatgctgcatgaggccctggtcagcggccagatccctgttcccttggagtctgtgcaagccctggatgtggccatgaggcacctggcatccatgaggtattgggtgtagttagtatctgggctactagtgttggcagaactgctgtcaggggaggagggggagcacatattaaggtcccacagagtgccattaaaaaaaaaaattatttgaagccctaccacttgccaggcaaatgtgtatttatatttagatggtttaaagccctggccctgaacttcttagatatctttgggcctcatcccatctgtccctgcagggcagagagaaggtagaaacttgtacaaggtcagtcatacaactagtaaagcatcagagctggcattaaagccccggtgtcctgcctttcaggccagggctcctccgtgcccaggatgcctcacagggtgggggcctgtgcccgagggaccagttctctgcctgtccctgccaggtacacccctgtgggccgctccttcttctcaccgcctgagggctactaccacccgctggggggtgggcgcgaggtctggttcggctttcaccagtctgtgcgccctgccatgtggaagatgatgctcaacattgatggtgagtggggagagctatggagccaggggcaccccaagtccagtgaccacactcccagcctcatccctcccagctctgcaaccacactcctagtctaattcctacagccctggcacccccttcccccatcccaatgccctttaaggaagagggtataaattgctgtgcctccatgtattgtggaagacagaacctgagctgagctatctttaccctgtccccacagtctcagccactgccttttataaggcacagccagtgattgagttcatgtgtgaggtgctggacatcaggaacatagatgagcagcccaagcccctcacggactctcagcgcgttcgcttcaccaaggagatcaagggtgaggacccaacaggaggggaagggaaacagcgccactttagccctaagaggaaatccccttggggtatgctcaggggagagaccaagcctgggcacatgagcaacctattttagccctgacaagcagtgtgtgtatctcaggcctgaaggtggaagtcacccactgtggacagatgaagaggaagtaccgcgtgtgtaatgttacccgtcgccctgctagccatcagacgtaagttggcaggggtgctgagtcatactttgttggtggagaagggctgagatttaaaactatctttccctccctccctcccccactggccttgagaatgagccttggggactggccctgtttttgaagataagctgtgggaatttggcatcctttctcaaccttctctgatctgttgatactctccctaccatttttaccttcttgatctcctcgcctctttggttccttacttgagaacaagtgtgttctctgattcctgttagggttaggcaaatgttagaatctctctcaaattattctttctcttgaaaaaagaaagcgaggctcctgggctccttggggaagctgtcattgattccattcccattcttgaccttaggctatactgattattatgagtgtctactctgtgtcaggctttatgctcaacattggaaataaatgagtcagatagtgtcctgacttctgacttttgtggaacttgcctttcaaacctttggcttctctcttggagccctgtatgtcctgttttcccatgagtggcaatgctcaaagaagttggataggatgaagcaaagtctgggacttccttcctgcacatcatattggggccaaatgaaaaaggaaaaaatctgaggcttccatggttgtgggtctagagaagtgggactgaatgctgggttatgacacccccttccttcccttcttctgaacagattccccttacagctggagagtggacagactgtggagtgcacagtggcacagtatttcaagcagaaatataaccttcagctcaagtatccccatctgccctgcctacaagttggccaggaacaaaagcatacctaccttcccctagaggtgagattgccaagtaatggctggggaataggcattgtatatacctgcatgctgatcatcagatgtctgttctttcattttgaagtttggaaaactgacattctgagaaggtatgaggtagttctcctgtgaaatagaggcctcattcttacctgctaagttgtttccttatcccccatcctactctcatgttctttcagggctgccaggcagagacaagctgaatttactgtttaataagtaattagttcgtagaggacagagattttagatacccacactcatgttctcttaatttctcttcccctgttgtttagagctgggatcctaagtgacctgaagatataagtctaccttattcttcacaaactggtgataaatactacctataatgtaaatcatgtttctccaaggattaatgtgttccttttgaaaaagttttagccccaagattgtcatacttttataagtcagtagacctttggaattctgcaactagaggaggaatagtaactaacactaagttatagaatacaaatacagaatcactgggctatattttgtttggtatatactagccaaaatattgaatgagaaactactgcctactgcttcattgtctcgtccaatgctactcaaaaagtgtggtcatgtgtaccaataggataggcattacctgagagcttgcttaaaatgcagatttcagattccacccataccgactgaatcagaatcttttttttttttgagatggagtttcgttcttgttgcccaggctggagtgcaatggcatgatgttggctcactgcaacctctgcctcccgggttcaagtgattctcctgcctcagcctcctgagtagttggaattacaggcatgcgccaccacacccagctaattttgtatttttagtagagacggggtttctccatgttggtcaggctggtctcgaactcctgacctcaggtgatctgcccaccttggcctcccaaagtgctgggattacaggtgtgagccaccgtgcccagccagaatctgtcctttaacaagatccaaagggaatgtacattaacgttggagaagcactgtactagactaccctctttttcttttttgtttttttgagacagagtctcgctggagtgcagtggcaccatctcggctcactgtaacctcctcagcctcccaggttcaagcaattctcatgcctcagcctccagtagctaggattacaggtgtgcgccaccgtgcccagataagttttttttgtatttttagtagagatggggttttgccatgttggccacactgatctcctggcctcaagtgatctgcctgcctcggcctcccaaagtgctggattacgggcatgagctgccacgcctggcctaccctcttacttttatccaacagcagaagtcagatagcccagaccaaagctctagtcttctagtgagcttctaggatttcagaactaacctgagggagttaggctgaagggagaagagatccccaaaaccaagaactctgacttggttaatagctactgatgcacatgaaggcaacatgttctctgaggtataaacagaggtctttagggacaatcttagctaagtagatagtaggtgatatttactgtaagcagagatttgttagcaaattaacattatttctatttaaacagcagtttccaaggggtataatttatgttatgacttagaccttgatttctgttgttgcttatttaacatatatttatcgagctcctactatgtgtcatatactctcaggtgctaggaacatggagattaacaagacagacaaggtcccagctgttatggagcttacattctagaagggggagatagacaataagttgataaacacgtaaagtagtttcagatggtgataagtgctataagaataataaaataggttaaggggatagaagtaagggaggaagagggtagagagctattttagttgttagggaggtcctcttttaggagacatttgagctaagtcccaaattatgacatagaatcaaccttgtaacaacctgagagaagagccttccaggcaggaggaagtacaaaggttctaaagcagaagagaatttggatctttttgagggatagacagaaggctatggtggctagaatgtattgtgtgaggggaaaagcagtaggatatgattctgcagagggtcaaataatatagcctgttgaaaccacgtggcattttattactgttttttggaaaagctttatccaggttggctgtgtggctcatacctgtaatcccagcactttgggaggtcaaggcaggaggattgcttgactgcaggtgtggtgtggtcccagctacttgggaggctgaggtggaagcattgcttgaacccagtgagctgtgattgtgccgctggattctagcctgggcaacagagggagaccctgtctcaaaaaaaaataaaaaaacagctttatcgagatataattcacataccataaaattcaccattttaaaatgattaggtagttttagtatattcacagaattgtacaacagccatcaccactatctgattccagaacatatcactcctgaaagaaagcctgtattcattagcagttatgcaccattcgttctctccccaacagcctgtagtaaccactaatttactttcagtctctgggtatacctattttggacatatcatatatgtgaaataatacaatatgtggccttttttgactggcttctgtcatttagcataatgttttcaaggtttatcctcgttccatcagatggatatgtcatattttgttaattcatttatcagttaatggacatttggattgtttctactttttgggtatcatgaataatgctgctgtgaacattgatgtacacatttttgtgtgaacataagtttttatttctctggagtatacacctaagagtgatataatatataacaatgtttaacatcttttttttttttttgagacggagtatcgctctgttacccaggctggagtgcagtggcacgatctcggctcactgcaagctccgcctcctgggttcacgccattctcctgcctcagcctccggagtagctgggaatgcaggcgccgaccaccacgcctggctaattttttgtatttttagtagagatggggtttcacggtgttagccagaatggtctcgatctcctgactcatgatccgcccgcctcagcctcccaaattgctgggattacaggcgtgagccattgcacctggccaatgtttaacatcgtgatgagctgcctgattgtttcccaaagtagctatgatattttacaatcccatcagcaaagaatgacagttgtaatttctggccaggtaggattttattctaattataatatgaatccattggaaaattttaagtagaagaacaatgtggattattgttctagtttctagttgtgaagattcaattagaaactagaagtagtgcctccagtccacctctgtgtcttccttgaatagttatgtaggtcattgagtgtccacaaaatcatttattcatgttcaaatcacagttcattccttcttccgtctttttcaaattgtggtaaaatatacataatgtaaaatttaccattttaaccatttttaagtatacagttctgtggcattaaatacattcatgcagttgtacaaccatcaccatgaccaatctccagaactttttcatcattccacactgaaactctatacccattaaatggcaactccctccttttaacccctagcaaccaccattctactttctgtctttatgaatttgaccactgtaagtacctcaaataagtggaatcatagtatttgtcctcttttgactggcatatttcacttaacacaatgtcttcaaggttcatccgtgttgtagcatgttaggattcccttcttttttaaggctgaataatagtccgttgtatgtatatatcatgttttgtttattcattcatctatccatggatacttgggttgcttcttccttttggttattgtgaataatgctgctgtgaacagagatgtaaaaatatttgttgaagttcctgttttcattttttttgagtacatacccagaagcagaattgctggtttatatggtaattctgtggttaattttttgagaaattgccataccattttatattcccactggcgttgtacaagtattctaatttcaccacatccctgatttagtcttttgctagtgttaattctgtatctttaaccacctgtagagaatgctacaactttaaggcacctttaagagagcaatctcacaaatttcaataattttggattttcattacgtgaattgactattttgtttattctctggaatatggagtttgaaggcaggtgaccttgggctggttttccttcccattgtttaccatgaactctgggaattaggacgagaactagtatgtaaagaatgttggccctatgggagcaagttcctcatttcatctcatctaaatccttacaacaaactcatgagacagctagtgtatttttttttctcatgtttgagattaaagaagaagattctcagagtggttaagagtcctgtttaaggtaacatcacctagaaatggcaaagctggacttcaaacagaagtatttccagacctactggctctctcaattctagaagcctttctgttcacagcatcctgaatatagtatattggggagtggaagtcttgtatgtcactagacagctttttatgatctctgttgttttctgttgggcccagaacagatgaagtaaatggcaggatgtttctcacaccagcagaggacactgtcagccaacagagacagtgatagctgtaggctgggggctcaggagtttagaaccaaccctagtcctggtgggttgcaggatggagcaacctgtcaccattggacagctgccttagaaatctaatttgtgtatattgagttgttcagtattcagaagagctctatatatggtcctttggtaaataataatctgtgctacaatttattgtttactgtgttccagaactatactcagtcctttaagtgctttatttaatcttgaggcaactcttagattgttactattatccttccttaaaatatgaaggtcaggcatggtggctcactcctgtaatcccagcactttgggaggcggaggtgggtggatcacctgaggtcaggagttcaagaccagcctggccaacatggcaaaaccccatctctattaaaaatacaaaattagccgggcatggtagcacatgactgtaatcccagctacttggaacgctgaggcaggagaatcgcttgaacctgggaggtgaaggttgcagtaagccgagatcgtgccattgcacttcagcctgggcaagaagagcaaaactccctctcaaaaataaacaaataaatacataagtacaaaaattagcgaggcatggtggcgggtgcctgtaatcccagctacttgggaggctaaggcaggagaattgcttaaacccgggaggcagatgtctatgagccgagattgtgccactgcactccagcctgggtaacagagcgagactctatctcaaaaaaataaataaataaataaaatatgagacctgagcccagatctggctctggatcacaagcggttgaattgcccttttttttttttttttgagacagggtctcactctgtcacccaggctggcgttcagtggcgtgatctgggctcactgcaacctccgcctcccggttcaagcgattcttgttcctcagcctcctgagtagctgggattacaggcgcacgccaccatgcctggctaatttttgtatttttagtagagactgggttggccaggctggtcttgaactcctgacctcaagtgatctggccgccttggcctcctaaggtgctgggattgcaggcatgagccaccatgcccggcctgaatcgccttttacaatgcacacgaatattttctaatttacctatcaaatgatactcaggaggagaatacatgtatgcacaacggattttgcagttcccttccccatggctgacagccaaggtatctttccttattgtggggctctgggtacagggtggactgtactcaagccagagctacctgtccttcttgtttcctcaggtctgtaacattgtggctgggcagcgctgtattaaaaagctgaccgacaaccagacctcgaccatgataaaggccacagctagatccgctccagacagacaggaggagatcagtcgcctggtcagtgggcctactcatttgctcagtcattggggccattggtagcataaatgttttaatgccccagcaggaccttccttcaggagaacccaagtctagatttgttgcctaggactgtataaggctgcttttgcttcttgaccgtatagctactttgctttctgtctctttttctctcctgtattactttgctgtgttattccctcacttccctcatcttccactttctctctctttttaggactattccgtaccaaccccagcttctccttagggttctctccttgatacccagagggtgagcagtattgccaagctcctgttctcctgagattgctctcttttgtcctgcagatgaagaatgccagctacaacttagatccctacatccaggaatttgggatcaaagtgaaggatgacatgacggaggtgacagggcgagtgctgccggcgcccatcttgcagtacggcggccgggtgagcagggtcagggccagacaacatctcggggcatatgggggtggttgggttgtatagccaggggcttttgctcccctacccacctgactctactgaggctcacctaggcgccccctctacctatccccagaaccgggccattgccacacccaatcagggtgtctgggacatgcgggggaaacagttctacaatgggattgagatcaaagtctgggccatcgcctgcttcgcaccccaaaaacagtgtcgagaagaggtgctcaagtaaggagggttcgctgtaggggtggaagggtgggaaggaccctggagctgcctgccttcctgtagtccacaggggctgatattgatcagtaatgtgttctgtcttgactctgcctgcattgtgctttctggctcaaacttctaccaattctttttctatccatctgtgatcaggggaagttaataaggagccatatctatgtcaaagatgatgattttagggcatgaatctcctgagagaggcctgaattattgttataattattatcattggtaataaatagtagtagtgatgactgtaatgtttacgccaaaattatacttaagtacctaatttatattctcttatttcatctttacagtgagtaggtggtgatatgtccattttcaggagactgaggctcaaaagaggttaagtaacttgtccaaagtttgcacatcatcaggaaagtgtcagagttggaagcaaatcagatctgagcttcaagacttgtgttcctaattggaaacaaaatagagcagcttgtttagctggttgtcagggcctctgtgccaccgtagctgggagtagatggcaccaatgaggaaagtgttatagccaaatggtttaaagaaaccaggcagtaatggcttaagaagtcaacaacccctcacctggagtcttttttttttttttttttttttttaagacagagtcttgctctgtcacccatgctggagtgcagtggcacgatcttggctcactgcaagctccacctcccgggtttcacgccattctcctgcctcagcctcccgagtagctgggaccacaggcgcccgccaccacgcccagctaattttttgtatttttagtagagatggggtttcagtgtgttagccaggatgatctcgatttcctgacctcgtgatcctcctgcttcggtctcccaaagtgctgggattataggcatgagccactgtgcccggcctttttttttttttaagttttattgagataggtttaaaatgccacaaaactcagttagttgtttcatagatacaacatacagttagttggttactgccatctttcgaagtggttgcttttcatattctctgaatctggagtggggtcaatgcactctagggatgaggaggagttgatggagccgaccattttggctagacaagggtagtggggaagtatgccatgacgaattcagctgaccttggagtcatcatgagaattcgttcttagctggggtgcagtggtgcgtgcctgtagtcctggctactcaggaggctgaggcaggaggatcacttgagcccaggagttttctgggcaatatagatcctataagttctaggctgggcatggtggctcctgcctgtaaacccagcactttgggaggctgaggcgggcggatcacaaggtcagtagtttgagaccagcctggccaatatggtgaaactccgtctctactaaaaatacaaaaattagccgggcgtggtggcgcgtgcctgtagtcccagctgctcaggaggctaaggcaggagaatcgcttgaacccgggaggcagaggttgcagtgagctaaggttgtgccactgccctccaacgtggtaacaaagcgagactccatctcaaaaaaaaaaaaagttctaacagctcctgatggatctggagactatgggacctgcccttgctcttcttcccttacccctcacagatacacaaacaccatcataattgtagttcttgcaaatgggttcttgtctcctttcctgagctctttttttttttttttttttttgaggcggagtctctctctgtcgtccaggtgcagtggcgccatctcggctcactgcaagctccgccttccgggttcacgccagtctcctgcctcagcctcccaagcagctgggaccacaggcacccgccaccacgcctggccaattttttgtatttttagtagagatggggtttcaccatgttaaccaggatggtctcgatctcctgacctcatgatccacccgcctcggccttccaaagtactgggatcacaggcgtgagccatcgtgcctggcctttttctgagttctttagcccccatttaagccaggctgcttggcaacattggaaaggctcccagctttttgcctttgtgccatagtcacttcattgtagttctattctctatgtgctcttgtctttctcccatgtccttcccttgtccatttcttttgggatgatctattgttttggccatttggggtatgggcaccagtaaacccagaaactcaaacttggaagagtttatcagtgacacctagttgtaaggggtaagaatgtggcttatgcatctgggtcagtagtagccagttaaatctgtggttctgactgggctaaaggtaaatatttccaagtcatctatagcagtggctgagattgtccagggagaatgtacatagtaagcagagattgaagatataactcagagaaactggaaaataaatagagcaaagtccctaagtgtggatgaggtgatgggatccagggcactgagaaagggcatcctttccactgagaaagtgggggaaaacatgaaggtgctatggggtttgacaaactagtagttgggggatgatggatgagagagttctagacgcaaccctcaatttttttctggctaaagaggccctattactttagctatatcacctttaagatgggattttaggaccttcctcatcttaaacatctcacaatactttgtggcccccagcattggacacagtattccaagtgtagtctggtagtagagagaagattggaaataacgtctttccttgaagttgagacccactattcatgaaatctggtaacatactggctttttaatagctacattgcagttgtatacagggcagagaaatggaaaacatactattaatggtcaaagccctagctgttatttacatgaaacagtggttaggtcgtgtttttttattctaacattcattttgaaaaatttttttaagataataaatgtagagaataacatgtatccatttttgtcatatttactttatccttttttaaatgtaaatattacagataaatttgatgctccttcatgtcctccaccctagtcccattcctcccttctttttttgacagcctcgctcttgcccaggctggagtgcagtggcgcaatctcggctcactgcagcctctgcctcctgtttcatgtgattctcctgcctcagcctcctgagtagctgggattacaggcactcaccaccatgcccggctaggttttttttgtatttttagtagagacagggtttcatcaggttggccaggctggtctcgaagtcctggcctcaagtgatccgcccaccctggcctcccaaagtgctgagattacaggtgtgagccactgcaccagccctattcctcccttctgatgaggccactgttatgaattattgtaaccaggctactcaatttatatacctatatataaatgattttaaattttgcataatagtatcagactgtttcttttcttgtgtgtttttactaaatatgtgaaaaaatactttctcataaaactatcacattgctttttgtatgctatataataataacatctcctaaacagctgcttccattctcttcttgtacattgtttttaaatttaaatggaagattatcacaaattaaatttcctgctgcttatttcagtttttgagtatctttatgtagcttgatttttttactctactgcatgtgtgtcctctcttgcaactttgtcttcctttccagggtaaagccctaaagccaaaggaagcttaataattggctcttaggtttcaaagaaccagttgggaaggagggaactcatttttactgagcatctcttgtgctcccatcactgttggaacctcatttgctttgagcagaaaggccttacacgtgggcatctgcctatttctttggacatgtaatgaagcacaggaatcagctgcttgagcggggcaaggtgggaaccctgagaattcccatgggtcccttttctgggcttcctcgtctccttgcttgtaccatcgaacacttagcaagtactctcttaccttactcaactataaacatattttttacattagctattattgtgtatcattcatgttagaatctcagtgttagctgggtgcggtggctcatgcctgtaattccagcactttgggaggctgaggtgggaggatcacttgagtccaggaacttgagaccagcttgggcaacatagtgagatcccatctctaccaaaaagaaaaaaaattagccaggcatggtggcattcctctagtcctacctactcaggaggctgagatgggatgattgttttagcctagcagctcgaggcttgagtgagcccagattgtgccattgtactccatcctggttgacagagcaccctgtctcaaggaaaaaaaaaaaaaaaaaccaatctctcagtgcctcttatagtgctaagcacctaagatggatggatttttgtcagaagaattcaagtgagactcactgcctcctttgtgaccatgcgtgtgtacaggaacttcacagaccagctgcggaagatttccaaggatgcggggatgcctatccagggtcaaccttgtttctgcaaatatgcacagggggcagacagcgtggagcctatgttccggcatctcaagaacacctactcagggctgcagctcattattgtcatcctgccagggaagacgccggtgtatggtacagttctcttgggacagtgataatggtgataggactcttctcagcgtagttccctggggtctcctgggaaggactcagtctggattcttggctttgaccagagctgttacttaatgtcagtgctcctcttataggagaaatagcatgcctgagccattgagttatcccagatcctaattacctgcacacactccttcccagcaacatttactggggtcctttgtgtgctggtcctcatgccaggctatgctgggccaggtacagagacgggttggtctagattcctgtccttaggagtgcgttcctgtcctcaggagtgcattgtttatctgaacatcgtgcagcacaaccaagcagaataggtggtcctgttagtatcgtgttgcctggtaattacttggactttttgagaggcttgctatctctcctcttttcctctcattttttagaataagaatgattatataaatttctgtcacagcacttttcttttatgccattttccgtctccatctctcctgcttcaaagcaataagagtttttcttaccttgttcaactaactcctctgtgctcttattcccaacccatcctgctacctttgggactttatacctttcaaccctcaaatatattcagatcccccatcctaatgcacattaccacaatcttaccatctcttttagcttttgtcttcctatttccttcattaaaccttctgaggcctggtacagtggttcacacctgtaatcccagcactttggaatgccaaggtgggaggatcgcttgtgcccagaaattcgaggctagtctgggcaacaaagcaagacctcatctctacaaaaaaataaagttacccagtcatcttgtgcacctgtggtcccagctacttgggagtctgaggctaaaggatttcttgagcccaagaggttgaggctgcagttacccagcttgggtaacatagtgagaccttgtctcaaaacaaaacaaaaaaaactttttgaatgagttctctatattctctatgccctatacctcaccagccacttattctttagcctctttcagccaccttgccttctgtctacctttctcctaaatctcctctgcacaggattgccaatgacttttctcagttgtcctcttgacttctggatattttcttctatctctccttattatttttgtcattaccaggaatccttggtattctacaggttcctattgtctgccttctcattctgcctttacattttattaaaattcccattcatttcagttgcttcaatcatcacctattgctattatatgtgattaaaatcttgattcaatccttgaaccctctgcagctttggtctgtccctttggcctctctccctctcttcaagagtttattgatcacctattatgtatggaacactgtccaacatctggatatattgatgaataaaacagatatagtctctgctcttagaaagtgttttgttggaccatctcttcagtagtttgtcctctctacaaacctttgtctttactacttctgtatttgacatcacagttgcttctaagtaccttcattcaaacttcggagacagtcttgtcttttcgcttcaccttcattgttcttcttcaaatttttctcaagataatatgccctgctcttgatccacacttctcaactgagttctaaccttccttttttttttttttttttttgagacggagtcttgctctgttgcccaggctggagtgcagtggcgtgatctcagctcaccgcaacctccacctcccaggttcaagtgattctcgtgcctcagccttgaaagtagctgggattacggtgcgcactaccatgcctcgctaatttttatatttttagtacagatggagtttcgccatgttggccaggctggtctcaaactcctgacctcaagtgatctgcccgcctcggcctcccaaagtgctgggattacaggcatgagccactgtgccctgccttaagactttcttgaatgggttccaagaaagacttcttgtgactctaatatcaaaaaaaccttcattgattcctattattcactgcatgaagggttttcatggacctgattttagtttaatgttttcagctttatcttgcactgttcacttgccactcatactggaatgattgctggttctggaattgttgaagagagctgaatttgaatttaatcctggctataccagtcaactggcttggacacatatctaacctttctaagcatcatgaattaattatataaaaagcagaatctagcacagtgcctggcatgtagctgacactctgagtgctcatttcttgtctgtggttttcagtctctggtgttgtacacatcatttgcctttgcccggagtatctgcatcctcttcttcttgtcccccaccttgcacttaaaattctctccatcctttaatacccagtttaaatactacttattttttattcttgacatttcacctggagagtgaacttgtctttttctggattcctctagtttatcaggccactgatcagttactaccttacttgatactttgttgtggagtggatctgattctgctctgaaatctttcctctctatatacacacctaaggtaatgcctttcactgatacaatactcagtaattaacttatggagagaagttgtttgatcttcagtccttgtctttcttggacccttgtatggataaggatgctttttaggagaacttccttgaataagtattcatgtttctgatttccctccattaaagggaaaatccaatgttttggcttgggaatggtacagcatgcttcggaaaggcagtacttactcagaattttccctttcctgggctcaattatgttacacttctctctagcctcaaatattttattgggacttcgagtttctttcatttacatgcggttccttgattataccacctggacaatctgactggtactcttttctgctggcttagttcctaggcaatggagtcatttgcctaggaactaagccagcagaaaagagtaccagtcagattcttctaaagacccttcaccatccctcctgggaggctgggtaaaatggcatcctcctagtgatggtcaaagcaaggtcccattggcttttggttgccctgagagcgtagaaggacagtgtcacatttgccctgttctgatcaggtactatacctatcttgtctttagtatatttaattgcttcctctccactaaactgatattattgtttttttaatgtaaactttttattaaattgtatatatagaaatcttacatgtttagctcagtgatatttcataaagtgtcacagcgtaaccagcacccagttcagcagcagaaccttaccacagccccagtcactacaacctcctaccagtggtaaccactattctggcttctaataccataagttagttttgcctatatttaaactttatataaatagaatcatatagtatatactttttttgtttctgacttctttcatgcaacataaagttgtggtttgttatagtttttccatcatatgaatataacaccatttccatctatccattctgttaatacacatatttggattgtttccagtttttgactgttgaaaataatgcttcaggctgggtgcagtgactcgtgcctgtaaacctagcactttgggaggccaaggcaagtggatcacctgagttgaggagtttgataccagcctggccaacatggtgaaacccagtctctactaaaaatacaaaaaattagccaggtgtggtggcgggcgcctgtaatcccagctactcgggaggctgaggccggagaattgcttgaacccaggagatggaggttgcagtgagccaagatcgtgccactgcactccagcctgggcaacagaggaagactctgtctcaaaagaaaaaaaaaataataataatgcttcagtgaacactcttctttgtgtcctttgaacatgtataaccatttttcttgggagtatatctaggagtggattttaagtataccaatttatcctttcaccagcagtgtataagagtgctagatagttcatatccttatcaaacttggtatccgtctcaagaaaaagaaaaatgaaaaagaatcccagggtcatgaagatactatttgaagtgtttttttgaatgattttaaaaaatcattcatatttagaattaatttatctctaaacagagcaaaaactgttgcttttcttttccatggcagtggtgcagagcttagactcttagcttcctacccacacctagattcaacaaatgtacccagggtaaaagcaactgcagaagatagctcacctctgagatttttttttttctccctctctggaattttaccccctctagttcttgttttcttagcattctctgctgcctttaaaaagatgatttttatattttatctggcttttctgagtgttgtctgtagaactggcttgccgctattccatctctcttggaagtagatatgatctttttaaacatgctcaaatctcttccattgaaagcataccaaattcttggtcagtcctacattttcttcctggtaccttaaatcaccacaacaatttttgcctctatacactaatttttttttaatcttaatatcactaactccagaggacatttctggtcctgattttacctcatctcttagacacatttcactttgttgaccacttgctccttcttgaaacactctctttcttcccttggcactcgtgatacaacactatcttagtcttccttctagctttctggatttttttgtcctttgctgactcatcttcttgttctgccaatactgggagttcctcaagattcagatctaggttgtcttctctttttactatgttatcttccttagtgatctcaagatcatgccttcggccgggcgcggtggctcacgcgtgtaatcccagcactttgggaggccgaggcaggcggatcatgaggtcaggagatcgagaccatcctggctaacatggtgaaaccccatctctactaaaaacatacaaaaaattaaccggacatggtggcgggcacctgtagtcccagctactcaggaggctgaggcaggagaatggtgtgaacccgggaggcggagcttgcagtgagccgagatcgtgccactgcactccagcctgggagacagagcgagactctgtctcagaaaaaaaaaaaaaaaaaaaaaaagcatgccttcaactactacctgtacctaattatcacacaaatttgcatctccatttcagactactcttttgagcatcgaaccatgaggcccatttgcttagttgatatcctcactgagatgaccaaaaaactacttcagactcaaaatgtctcacaaataatttatggcctatttttattttattttatttttttatttatttttctgagacggagtcttgctctgtcacccaggctgtagtgcagtgggtgtgatctcgtctcactgtaacctctgcctcccaggttcaagtgattctcctgcctcagcctcccaagtagctgggattacaggcacatgccaccacacccagctaatttttgtatttttagtagatacggggtttcaccatgttggccaggctgttcttgaactcctgacctcgtgatccacccacctgagcctcccaaagtgctgggattacaggcgtaagccaccgtgcccggctggcctatttttattacagaagctggaaacttaaaagttatccataaaaattttcttttcccttactcacacatgtagtctataacttgagtcccttaaatatctgtggaatccatttgtttttctccgtctcaacaactcacccatctttttttttttttcttctggatatggagtctcactctgtcgcccaggctggagtgcagtggcacaatctcggctcactacaagctccacctcccgggttcacgccattctcctgcctcagcctcccaagtagctgggactacaggcgcccgccaccatgcctggctaattttttgtatttttagtagagatggggtttcaccatgttaaccaggatgatctcaatctcctgacctcatgatccacccgcctcggcctcccaaagtgctgggattacaggcgtgagccaccgcgcctggcgttcaccggtcttgttaatctaggctacccttatctcctctggtaggtcagtctaatgaccacattctttccttacaacatgctccccttgctcttctttttagctgctatggcctttctgtttctcaaacacatcttgctgtcttctagcagggtgcatttttgcatgttgttccctctgcctggaatgctctctctcaaactccccctctcctctaagtcctttgctgtcatcagatttcatttcaatcattacctactcaagaatcctttcctgactaggtttttatttcccattttatgctgttattgttccatgaagttttctgttgtgtcatttatcagcgttgtaattttcacgatttttaaaattagtccctatttagtaagcactttgagagtaaggaccttatgtgtttcctgtcattattgtgttccctagcacctcatacactgcctggcatctagtaggcattcagtaaatatttgttgaatgcactaatcatttctctccctgcccttagctgaggtgaaacgtgtcggagatacactcttgggaatggctacgcagtgtgtgcaggtgaagaacgtggtcaagacctcacctcagactctgtccaacctctgcctcaagatcaatgtcaaacttggtggcattaacaacatcctagtcccacaccagcggtatgaactctgttgtccacttgcccttgtcaaggtaccatgctgggaattgatgaagagataggaccctggccaggcagactgaatcagacataagggggagaagagcagagtgggtactggatggtgccagctagagaagacccagcgcctcaccattttgttttctcttccttgctcagctctgccgtttttcaacagccagtgatattcctgggagcagatgttacacaccccccagcaggggatgggaaaaaaccttctatcacagcagtgagtgatattctgtagctgcctcataaggttctcctcttcgctctgagtcctcaaaactgcccatgatttccttccctcagctctggctcttgagccttcataagatgtccatttagctcgctattcccaattcccattcccttgatatctcataaaggtagctctgtatggtgtcttttttcagggagagtaatgagagtgtagccagagacttgactcattctgcatcactcttgctctgcatttgaatgtctctctttccccatgcctgcttttgggatgtaggggagggactatatcttctctgaaatccctttaaagggagttacttagttgcgaggactatcctttgctctgcccatcctcaccccgatctgtataatagattagatgtttctcttatctctctcctgacttttctgctctttgtctcttaggggcttccaaattgctagggattagaccttctttcccacttatatttcctaaaccctcacatttctgtaagcacactggtcttaacctcagtaagtgcagggaaaccctataatatgcttatccctgttttccttgtggccatccctcctaggctttggctgctgtctcctttgtaaatggcatttcttccatcaaccacaagaacactgttactatggtcatgattcctgggtagattagcatttgaatgggaaaaaggataaacttgggactggatgaggccattgtttgatttagtagtgctaaaccttcacatgctcctctgcaaaggggagagaaatcagtttatcaagtacctactgtgggctacgtcctgtgtaaggtgcttaatatggaccccagtagcgctgcaagcaggtgttcttatcaccatctgagaagaggaaaaaagatcagagagattgagtaacttctgcttgtgtgatagaatagagattgaaaccagggctcactgagtctcaagccctagtcattcagttgtagttttcttgctaagaagcctttccacaaacccatagcctgacagtgaaggtgaaggttctaggagctaatcctttctctctgactgtcaggtggtaggcagtatggatgcccaccccagccgatactgtgctactgtgcgggtacagcgaccacggcaagagatcattgaagacttgtcctacatggtgcgtgagctcctcatccaattctacaagtccacccgtttcaagcctacccgcatcatcttctaccgagatggggtgcctgaaggccagctaccccaggtagggcccacagtaggtggagaaaaccttcacatcatggctggaaagctaggtgctactaccttttctaagctattggcactgagaggtgtgtcacttcttagtgagctttgctaaatggagtagacttgggggcaaggatcgcaactgagggatggagtgtacaagcatctgtagatttttcttctcataatagaagaccctcactgcctatttaagtagttggttcatgttggagactgattgtttagaccagtgattctcaaatgctagcttacattaagatcgcctggagggcttgttaaaacagttttaagggctctacccttagagtttctgattcagtgagtcttggatgagggccaagaatttacaatactgacaagttcttaggcgatgctgatagtctggagactacatttgaggactaatgctgttgaccctccttcataatattcctcctattcattctcactgccagccttcattttttttttttaacttctatcctgaactggtatccttgactaccatttaatagtattataactactgttccaatgaacttcctatgtgccatgaactgtcctaagcacttcactttcttttttttttccctaaatctgagtggaaacatatgttctatttaatgctttacaatagtcctttggaataatagtgtatttccatttaacagatgagaaaacaggcttggaaatgttacatgatctttaatgtcatcaaagataattaggagtggaaccgggattcagacacattggtctgattccatagtttatgctcttaactgttatgcccagtttctttttttcttttttttggggggaacagagtctcgctcttgcccagggtggagcgcagtggtgtgatcttagctcactgcagcttctgcctcccgggctcaagcgattctctttcctcagcctcccaagtagctggggctataggtatgagtcaccacacccagcttatttttgtatttttagtagagatggggtttcactatgtcggccaggctggtctcaaactcctgacctcaaatgatccacccgccttggcctcccaaagtgctggaaatacaggcgtgagccaccgtgcccggccattatgcccaatttctaagtcatccagtattttctaaaataacagacacatttatcatatcacatatctgttcagaaatgtctagtggcttcacatagctttgagttaaaattcaaactgcttagcaaagcaatcagtagttattaagccctactaggttttctatgcttttacttaattgtctatcgtagtcttcttaatagctttgtgaagcaggtcttagtaacattaacagacgtggagaaaatgagacttagtggagttgaataacttgcctgatgtaatacaactagataaagcttggatttaaatctaattgattccaaagtctatccttctctaccatacagttttgaccctctgtatctgacatccacggccacaggcaactattgcctatgattatttacttctagcttttcccttagctagcctgttttcttataatcctgctgctttgcaggactgaattcacctactctctctgcacccattatggaactatatgtctgctcttctctggtggtccacaacctgtctgctcttggagcccaaaggagaactctcattagtcacctgatcctgtgtgaaactaactttgggcattgtgattttagtgatttctctgtgaaccttggttctgtgtcttggtattaggtctctttatacacaggaaccagatgagtgttgtcttctgatgccaagcctcctggccaaggttttataggagcatattaagtgaactgagcataaggctgcttttgacaagaagggcctgtcatctctaattgttgagcatcagcatataaagggagactgagccaaaagttatattacaagtggcaactccttagttcagaagggtatgtgaactcaagaggaactgtgtatttctttgtttccctccccatttttttgtgcctagatactccactatgagctactggccattcgtgatgcctgcatcaaactggaaaaggactaccagcctgggatcacttatattgtggtgcagaaacgccatcacacccgccttttctgtgctgacaagaatgagcgagtgagtgagggactgaggcctcccatcccctccttctgtctcccttatcttaatagagaagaagcccttgagataaaggctggggatttagtccttgtcctatctatcctccctggccccttccctcctcctagctcttgtggtccttcctctgccaccgccttcactagtgtccacctcctcccgtccttcccttatacttcctttccctcctcctagctccctggcctagaccccatatatagaccagctcctagagaaggggaagggaactaccatttattgaactcctcctatgtgccagatactgtacaaggcgtcttcctcacagcaaccctgtgaggtacgtattattattatctccaatttaacctcagaaaggttaaacgacttgctaagatcacacagctaataggacttgaacacaggtctgtgtgactttagaagcatattattttaagattcagtaccctcagggaatagcaactttggctttgttcttgggattttggtgaaatcagagtagaattgagccagggtcctggttagggccaggcaggtcttgggatcttggttgtgtttgtctctatacagattgggaagagtggtaacatcccagctgggaccacagtggacaccaacatcacccacccatttgagtttgacttctatctgtgcagccacgcaggcatccaggtagctgggctttatcttgtggttccaatgggtcaaagatgagttgttcattcatattgcctctagaatgtatcagtcatcactgaatgacatccaaattaggattgctctcttttctgtttgttctgttttgttttgttttgaggcggagtctcactctgtcccccaggctggagtgcagtggcacaatttcagctaactgcaacctccaccttctgggtttaagcagtcttcctgccttcccgcctcagcctcccaagtagctgggattacaagcatgcgccaccatgcccagctaatttttgtatttttagtagagacagggtttcaccattttggccctgctgttcttgaactcctgacctcaagtgatccacccaccttggcctcccaaagtgctgggattacaggcatgagccactgtgcccggccaggactgctgtcgtaataagccctgagtacacttgcaggttgcttataagaagagtgctttatgacattggtagttttgcatctgcctgttcatgggtgaattatctacccagccatattcttaacagtgatcctgttcccctattatcagccatcttctctgcccagcctgggacccctcaccttcctatcttcccagggcaccagccgaccatcccattactatgttctttgggatgacaaccgtttcacagcagatgagctccagatcctgacgtaccagctgtgccacacttacgtacgatgcacacgctctgtctctatcccagcacctgcctactatgcccgcctggtggctttccgggcacgataccacctggtggacaaggagcatgacaggtgaggcctgggatcaggttggcctcctttttgcttcagcctattgtgccagatcttcttaactttccttgggtagaaggaaatgagtgctgtccaatttggtgtcattgggctcgtctgcccaatcctgggttgggtttctctcttaagttggtatgggaattggcatcccagggctgggcgagggaattagcagcagctctcagttcaccaggaaggacttctttcattttttccttttcagtggagaggggagccacatatcggggcagagcaatgggcgggacccccaggccctggccaaagccgtgcaggttcaccaggatactctgcgcaccatgtacttcgcttgaaggcagaacgctgttacctcactggatagaagaaagctttccaagccccaggagctgtgccacccaaatccagaggaagcaaggaggagggaggtggggtagggaggagtgtaggatgccttgtttccttctatagaggtggtgtaagagtggggaacagggccagcaagacagaccaccagccagaaatctctgatatcaacctcatgtcccccacccctcaccccatcttgtcacatctggccctgaccccactggaccaaaaggggcagcactggtgcccaccatacacacaggtgtctcatgtgactcacagtgctaaagactcatgcttgacagcttggtaaggtcaactctgtagccctgcagacaaaagctggttaggtttgggtttgatactttagatgggaaagtgaggggcttgagaaagtgggtgggaggagggaaggattttttaggagccttaatcagaaaaggactagatttgtttaagaagaaaaatgaaaccagacccagatcaatattttaggatactagatgttttaatgggttcagaatccagtttgtaggaagattttttaatggttttggttgctcctcccccagctgccaccccccaccttacccttattcctctctgtccacattttctgccccaccttacttctcctccctgacagacatccagcccctagtaatacttaaggcactatggcacttagctttgaagtgacacgaccctgtcttccttccgcccgctggtgggtaaccagtgccttccctgtaacggtaatgctgcagaactgcaaccttttgtacctttctttggggaatggggtgggggtgggagaggaggtagatggggaagaaataccccagacccaacaaacctccagccagaaagccagctattttgcatttgaaggaattgacttcctcattcattgagctttttaaaagatcacaacctcaagatggttaaaatccattgacatttgcactttcaaacatgacaagtctcggagctgctgagatgacaggcccctggcctttccacttatgcctccttttctccttattcctcctacctcccgccccgcccaggtctggagttactttcatagcatttttcactcttggcttcttttctcccttgatggtcaagtctcttatgtttcaatatttcttaactggggtgtcttataacaaaaaactcttaggtctaaaatgagaaaaaagagagaaaacaaaatgttatttttataccataacttgagtgtattgccaaaatttggaaatccttcccatgcctgatgagtttatatcccagaaacattgagccatcagaatgaactgtgtacctgatttgttctctgacctggctaggtagggagggggtggttatcgccccaagatggggtccaggctccatccttcctctgtgcagataatacctttttcttgctatagcctccctcctctgcactgtcctgcactctttcttgcaagtgcatctttttccttcccctggactgtcctctgaccctttggctcatcctagattgcagtgtgtcctgtggacaggctggggaattttgctgctccctattgcttctgtttacaaaaatgaatttttcctggtttcccactagggcatgtgggtgggtggcatggacttttttttttttttttttttgtcttgagacatggggtttggctgtcttgcaggactggagaaggtggtggttctagcttggtctctgttggccttgaagcaagcatcccccctgccctttttccttgactgttcatttttttcctgccccactgcttgggatggggagttgcaacttcagtgtggaatttcctctttgaggagcctgggcttggatctatcctgatctggtgatgaagccatgattactttagacctagcccaggcttggaggccagctggaggaagaagggtctaaatcctggcctgtagagttagaactaccatttcctccccttagctgcccttgtatgacccggatttgctatgcaaaacaatctatcccaggttctgttctggttggctacattgttcagcaactcacaaaacgtagcacaaacattcattatggagaaagcatcaggactgttgagtaactcctcctttacttttttcctgctggctacagcatggggtgccctataggcacaagcccagctgaagaacagaatggagggctctgggaggaggcagctcactggagagcctacattccttacacaagtgcctaaagagagtgatgctaacactccatctgccctgtccattgccttcatatacagtctacttcgtgttctgtcaccctttggggaggggagttctcctgggacagtgggctctgcatgttctccacttggatacattttggggctaggatcagggcactattcctggagggtccagtcattcaccagcatttgcaaatgtccatagggagcaggtggcagcctctactcccagcaacaagtttgtgttctctccttttctctctttgcctcactctctccagttggttttcagctggggcttgaaatgcatttttagccctttgacgtggcttatgccattcaagaaataaaaagcaagagaatcagctttgggcaatgacaagaaatgagttcttactctgatttttttgtaaaaagataatttttgagacttgaaaaataccccgaccttgagattattcctgtttgaaaggtggtgcatgcagatggagaagtggtgttggcagcaagctttggctcatgtggatttggtttaagtggtgcttcttacccaagcttcaaggaagtgcttgggggacccccagcctcatcctcttagttgggtctcttgttccctttgtaccactgttttgccttccttttcctcttctctctttgcctggcttcctttcccttttcttctattcactctgcttgcttgctggccggcctgcctgcctgcctgcctgcctgcctgcctgtctgcctatgtgatgatgaaatctctgcatggctgcaatgatcccactgttagctggcagggtcaggcttagctccttgactgcagaagaccaagaacctgttccccaagcccagagatgtccacctgggctggactgccctcaagcttatactagagaagagcaactgacctgcccaacttgtgtgaagtcaggagggtttctggcattttccacacctgtccactccttggagctggtttctctcattgctttttctaaatctggttctttttctctttacctggggcctggcttttctgagattgtcttagggttgagctatttgggtatcctgggtttgagtgttaggggatggacataaaggaaaaagagtgatgagaagagaatggagagaatttgaataaaaggtgggaaaggagagcactgttctttgattgtttatccagtccaacctgatccattagggatcgaggtgctacactggcctccagggataagcctggggctactgttgctgggaacttaggcttaacataaagccgaagaaggtacctagaaatttgaaacttccctaaaaagctcctaatgcccacctgctagatagcttctctgtggcctcctatttagctaagcagcagtgtttttggatactttttttttctgtttgtgaataaggccagcactcaagatgggcagccaagggtgcactgactattagctggcccataggatatctgtaaggctggtgggacagttttggacctggaatcatgtgtaactaacaaggttggacgtttcttccccatcagggtagaaaaatcatctcaaactagccaaaaggcagttttggaaactacattgggggacgttatttttatttatatatggggcctaggccaatccaggatggtagctggaataccttccttcttaaaatctgatcatggcagggatatgcagggcactttttactatttggccttctaagcagattgggaaggaggtattttctggttttcgctttcctccgacttaataggacttgccttctccctgggcagggagagaggctgggttggtgctctcccttactctactcatactgacttagagcctctggctgctgtttgggcatccaagaaagggaggggaaggaatgagctaaaaacaaaacagaatgaggtgggaaagggagattttcttctttacagaggaaaataggaaaccctccaagaattgtgcaagtaaagacatttgttgaatgcactgagtcccttggtgtagtagcaataaggaaaaatgaaattactttcctgtgcacacagtccagcctaattggtatgtgatgttgcacttagcagccatgtggtgggcatgtgtgactactctggttttcactttagtttctaaactttttatccctctcaagtccagcatggatggggaaatgtctctggatccccacagctgtgtacttgtttgcatttgtttccctttgagatttgtgtttgtgtcctgctttgagctgtaccttgtccagtccattgtgaaattatcccagcagctgtaatgtacagttccttctgaagcaagcaacatcagcagcagcagcagcagcagcacaattctgtgttttataaagacaacagtggcttctatttctaaagtgcggtctttctctttttttttcctaccagcaaaacaaacttttgggactgattacatctctaatagattttaggtgagaataatactgtagattgttatgcaggaatacttcacagagccttcatttattcttcattcaacaaacatgcaaagcactgtgccagcagtattgtggggaggggaggcacaattcaaaatgaggaaaatagtgtccgtctcattaagggaattaagtttggtgggggatatgattagccaaatagtcccctggcataggaggaagataatgagggagtggaataaggctacaacaacgaatatagggaggaagggacagatttgagagacgaggtagaattaataggactcgatggctggtgggaggagaagacaggagtagaggttagctcccaggtttctccttgaccataggagtgtgttgggacattctgccagtcaagatgggggtgacggggagactgtagaaggaaggtggggagtttttgaagaaacagaatgttgtatagactgagttttgaggtgtttgtggggcagtaagggtaaggtgtccagtaaacacaggttggtgctcaggtaagactgtaaaactgcatttatagatacaggagtcttatagatggtagttaaagccataggcatgaatgagatagcttagaaaaagagaagagaaactagtatacagccccctaagaaactcaatttaaaggttcgggggaggaagcagatcttaaggtgacagatcactggtagacagtttgtgggttttttgtttctttgtttagccagtttggtgaggtaggagaagaaatcagagtagaagaaggttcatgaagggagtgattaacaacatgaactgctgcagagagggagttctttttttttctgtgtgttttacctttctactccccatcttttggggatcttgtaactctatgacttacttacgttattctccagtatttcttgaaaatgagcattggaaaaaccaattctaaaatggctaaaactaggactttcaagttcaccacaactaccaccaattaggagataattgtaaaagaataaacaaaacctaattttgttcctagccaatattataaaccatgttccagcatactagataatagtagcatactatatttatttccataatttgtcttctttagagcctatgaactcctaggagcagaagctatattctcttcatttttgtcatctcagggtcatggcatataccaacagatcagtatgtgcaaatataattgaaataggctagtagtctgtggtttatgagtatgggctgggtgggcagtggatcaagaagtgataggagtacacaggatgaactcagaattcctgaatcttcaggtaagcagatacttaactacattatcattgtcttttcccactcaccccaagttggaggttctatggttttgtactttaagctggtggtataattgtcaagcatgtaaattctggcattcttcctggtactgctagagcattgttatttctatgcatgggggtaagaaggctcagagaaggatcctggcggataccccagtgagaaatcgtcagtggcagccagtgtgtacatacgtggacctagcattcctctggaggccaagtgttgtaaattggcctgtggctatcatctggcagactcccttgggaaagagccagccagccccatgcttcttttcagcagcaagggttagggaggttggttgaacttgaagagcagattggacatggagcagattttgaccagttgaaataagacataaatttatgactccgagtgaggcagaaataaagaacttagcagggggaataggaggaggatgattatggcaaattttgctataaactttagttttagaaaagattgatattgaaaagccttcaggatttgcctgtggttgctactcaagttaaaaagactgggagcctgcattgtttggtcctggagct

SEQ ID NO: 16196 - DNA, 14205 bp, Human
ccaacaatgtctccacttttagacacgtaagttggtcctcttttgtgttgtagtgctgcaacactaaatatctctctctcttttttttttttttttgagagagagtcttgctctgttgcccaggctggagtgtaatggtgtgatcttggctcactgcaacctctgcctcccgggttcaagcgattctcttgccttggcctccccagtagctgggattacaggtgccgcaccaccacgcccagctaattttggtatttttagtagagacggggtttcatcatgttggccaggctggtctcgaactcctgaactcgtgatccgctcgtcttggcctcccaaagtgctaggattactggcgtgagccactgcccctggcaacactgagtatctcggtacacaaatatttggactgtgtgtccaaacatttcttttggacatattcaaaaggttatgcatatttaacagatattaaaattgttctctataaaaaggttgtacaacttagaaccttacccccaatttatactttctcattgtttcttatttcccattttcctaattaccatcaaggttgaggatcttttcatgtttattggccattcgtgttgcttcttttgtgaattgtttttcttagtctttggtctttttttatttttttattttttttttgagatggagtctctctgttgcacaggctggagtggaggggcgctatctcggctcactgcaatctccgcctcctaggttcaagcaattctcctgcttcagcctccggagtagtacaggcgcctgccaccacgcccaactaattttttgtatttttagtagggacggggtttcaccatattggccaggctgttctcgaactcccgacctcttgatccgcccccgtgccctgccgggtcttttaaaaatggtattgtctcacccggctcccctcccattggtttgtaggaatatcttttaagttatagatattaactttttcctttcttctgtctataaggtccaaaatagtaactatttctacaattgaaacattcccaatttacatttactgttgagcatgataatgactttcaccacatagagacgtgtaattttaggtagtcaaatctgtcaagtcttttctcatattgcttctgggttccctgtcaagcttagaaacacatctcttccaaaaattacagaaatatttttctactttttcttccatgtttgtatctctctccctctcttttttttttttttttttttttttgagacggagtttcgcttttgttgcccaggctggagtgctcaccgcaacctccgcctccagggatcaagcgattctctgtctcagcctccagagtagctgggattacaggcatgcgccaccacgcccagctaattttgtatttttagtagagacggggtttctccatattggtcaggctggtctcgaactcccaagctcaggtgatccgcctgccttggcctcccaaagtgctgggattacaggcgtgagccactgcgcccggccatgcttatatctttaatccaaccatatactatttttgtgaatgatggaagtaaggctcccctcaagttaatttttctccaatctggcttgcaggaaaggggtttctggggagattttaccgagcaacgtagggaaacggctgcctggctacctacccctttttgacacccacacgtgctcggcaccttacatacactgcgtgattttatcctaaagccacttttaaaatcttagtgtgtaaacagagaaactgggcgtcacataaggcaagtgacctgcacagcctgctccggaggagaccggtacgatcccagagacaagcactgaacataaggcacccggcgccgcgcccgctttgcaacctctcgcgacagttgtacgtcatccgagagcgccgtggaagtcgtgctgcaggcgtcgcgccaatcttcgctctgaggtgctgtctcaccggtgagacctggaagcgggcgagtctcgtgctgtgtcggacctgcagcccctggccttccgccaccatggagtacctcatcggtatccaaggccccgactatgttcttgtcgcctccgaccgggtggccgccagcaatattgtccagatgaaggacggtgagaggaagcaggggaggcccggccaggcctggggtgtaggagcggccagaaggagtttgtcgggggttgaataagtaccagggaggatctgagagatggaagccggcctgccctgcccgtacttattttatttatttatttattttttcgagaggggtttcgctcttgttgtccaggccggagtgcaatggcgcgatctcggcttagcacagtctttgtctcccgggttcaagcgattctcgtgcctcagcctcccgagtagctgggaacagatatgcgccaccacgcctggctaatttttgtattattagtagagatgtggatttctccatattggtcaggctggtctcgaactcccgacctcaggagatccgcccgtctcggccttccaaagtgctgggattacaggcgaaacaggcagacaggtctgggaccttggcatttgctcctccagggctcctgggtcagtgctctgctctggccttcgctaaatgcttcttgcttggtgagagttgcctaaagggaatcagtttataaatgtttaagcgcctgcccagagcctggctctctagatccccgaatctctgataagtttcctggtgtcgctagtaatgaggttagtttgttggcggcataaggtgggatcctgaggagagtgagactgtgggactggctctctagatccctgaatctctgataagtttcctggtgtcgctagtaatgaggttagtttgttggcggcataaggtgggatcctggggagagtgagactgtgggaccagaagcttggcattttccttcttcccgtggctcccgattcttcttttccagttttccagagcaatggctgccaggttttccttatatttaagtagttaatggagttaagagattggagccctgtcatttatttgccttatgagtttgtataagttattttgcagtgcccagatttcctcatctttaagattagcaataccaaactcacaaacttgtcgggaggatttagtaaatgagttatgtgcaaatccttagcactaggcaggtacttaataatactaagtgtacgtaggtgcccaaacatatttgtcaaatgaccattaagtcatctgaaccaaagcttaatactttttcaacagtagcacgtctttgatcagttaaggaaaacaaacttagattctgcagaaaaacaaccaaaatcttcttaaaattatgtattgagtaatttagtatagatagtatagtatagtatagtatagtatagtatagtatagtatagtatagtatagtacttaggggcaaaatgtctggactcactgcataggttgaacccaggttctgccacttgtgaccttaagcaaatttctctaactccgtgccctagagctaacatctataaggtggtaatgtaatagcacctatctcaaaaggttaatgaattaatgtaaatcacttaacatagcaccttatactttatgaaattctatgattagtttgtagaagttttgtttgtaagccagtccttccaaaggagtgaatttgttttgagagtaaatttgtccattattttgaatactaaggtctttgacaagcaagtgattttaacattaagtcatgtctaggtagaacaataatcattacctttacaggtcttttgtttcatcccaaatgtatgtgaaatcacattgaaaagtagaatgtgctttaagcctacttatgtacacagtacttttagtcattataggggatgcagtatattacttataacccatagaagagtccaagacattaagaaaacaaggaaataaatgctgcaagatgattttatataataaaagaagtattactagttagtagtaggttggtttttaaattaatgagttcaagagcaaatcctaagagtaataaaagaaagataactatggtatgggagaaagatgaatttgagttagttcttgaaaaataattggaaatagttgcactctgcacattccaattttccctatagtcttttctggtataaaacaaattataatagaaattttagtattgtatgatgacttttttatttattttatttatttatttttgagacagagtctcgctctgtcacccaggctggagtgcaatggcgcgatctcggctcactgcaacctccacctcctgggttcaagcgattctcctgcctcggccttccaagtagctgggattacaggcgcccgtcaccatgcccagctaatttttgtatttttagtagaaacggggtttcaccagtttggccaggctggtctcaaactcctgacctcaggtgatccacctgcctccgcctcccaaagtgctgggattacaggcgtgagccaccgtgcccagccgtctgatgacttttttctaatcattcatttcacgatggagcttgtttagagtaggcaagaatgctgaaaaaatagtaaccttctgggactcctttctccaagtataaaatgataatacaacttccaatcaattgtccagtatgtcactttgtaaaaacattttgatactatagagtagacatttgctgaggattgccaccttattaagtggtataacttttggtttgcttatatgccgcatttcatgtctcttttctcttggcctatgtagaattgcttttaagttactcggagtactccagcccacacagaattctctcttttctgaattcctatagcatgtataatccgaactacattatctaacactgagtatcataatattggacatgtatagaattcattagtttttctcacttgtgagttagacaggggtaagtcatattattaacatttcacacatttggaaataacatttcacacatctggaaactggggcttagagaggacaagtaatttgccgaagttcagagtgccaagtccacatcataaccaaggtctcttggattctagttcagttggttttccacagtatgacatgctaatgttgttcattttgttggccatttgtttcatgtatgtggatcttgtaagttcctcgtcaagaatcagaaattccccagagctacacaggcagtttcctgtacaactcaggggtctctaagtatctatctcttgtgtttttattaaatatgttgccctctgctactcattggacatattcagtgtttaaaaaacatttttggccttgtattaagctaattttaaagttgaacaggttactgcctaggattttagcctttcttctaagtgtgacataagttctttgtaaacaagctcccccttcaaataaaaatatcttttttcttattataaaaataatgcgaacttattgaataatgctttcttataaaagtgaggcatgttaagtatagaagttttaggaaaaaccaacaagcaaaagaaggaaacgaaaactgcccatactcttaccactggcaagcacttagaatatacccttctgctcctttttctttgcatagataatataagtgaatgtttttcgtttattaacaagtttgcaaactaacaatctttaaatctagcctgcataacaaataaaagtgtgtttgtttaggagttttgaggcaatttgatattatctacaggtgcattttgtgtgttttttccctccaagtctaagaagccatattactggtatctacaactctgaaacacttgtaaagtatttgacagtagcattttgttctttaaatcctattaaaggattttggcatttcagaagctttcaaacaggaaacgtgtctcccagggaggattattcagcactatttgaaaaatgaaaagtgaaagtgaaagtgagataggaagatttaggccttttctgaagctgcagactgaatgtggagttttcttccttaggcaataactgtaacctgaatatttatttatctgtctaatctgaatgactctggttcagctagataagattagagtattaggatttttgtgaggtattttaaatagcttactgtcaaaatattcactagaatttttgctttggcaatcattttaattttctctttttctttggaagtggaatttgtttactttttaaagtgattaatattctcagttgattttctattctttcttgaaatggttccttaattttaattatagcaccagtccttttcatatatgcttttgtatgtgtataaatataataactaacatttgtagttgtggaaacattttagggctttgttatcatgagcctaaagataatcgccattggctggattccttcagtttcttctgtcgttctgttccttgcatttcaaatgcctttaaatgctttaaattgtattttcaattggtagctttcatgtatattctccaaccgaaattggcattacacaatatgctgatggtttaacatgaagagtgaaagagaaaaattgataccattacctattaaaatcttctaaaagcaataattagttaaattattcaatatacagtcgtcccttggtatctgtagggattggttccagaacccctgcagatacccaaatccatagatgcttaaagtccattatatacatggtatagtatttgcatattacctatgcaggtactcctgtgtacttcaaatcatctctagattatttataatacttaatatgacataagtgctatgtaaatagttgttataccatattgtttagggaataatgaccagaaaaaaagtcagtacatgttcaggatagatgcaagcatccatttttttttttttctgaataattttgatccatagtttgttgaattgtggattcagaatccatgtatatggaaggccaactgtagtaattaataaacctgtttatggttacataaataatgacggtcaatgtctgttaaggcagtttctaacacagttttcttctttgagcagatcatgacaagatgtttaagatgagtgaaaagatattactcctgtgtgttggagaggctggagacactgtacagtttgcagaatatattcagaaaaacgtgcaactttataagatgcgaaatggtgggtaagacttacagttttagttggcatatgagtttactagggctgccattactaaagtcacagactgggtggcttaaacaacagaaatgtattttctcacagttctagatgttagaagtcaaagattaaggtgttggcagcgttgatttctgaggcctctctccttggcttgcagatggccatcttctccctgtgtcttcacgtgatttttctctttgtactatatccaaattttctcttctaagaataccagtcatgttgaattaggaactcattttaatttaataacctcttaaggatcccttctccaaatacagtcacatactaaagtactagggattaagacttcaacatatgaatttttggtggacaaaattcagcctataacaattggtttgtctttaaatttgaactgaaaaataatattctttaagacttatgtggtcatattttcttttttttttttttttttttttttgagacggagtctcgctctgttgcccaggctggagtgcaatggcgcgatctctgcttactgcaacctccgcctcccaggttcaagcgattctcctgtctcagcctcctgagtagctgggactacaggcacgcaccaccacgtccagctaatttttgtatttttagtagagacagggtttcaccacgttgaccaggatggtctccatctcttgaccttgtgatctgcccacctcggcctcccaaagtgctgggattacaggcgtgagccaccacgcccagcccatattttcattagagttttctgtgtttaagaagttgtctagaccctaaagattctaatccttcataaaagattttctacaaaaatcctagagcagagaactgttgtaacactgatagctgatagataaaactaacaccatcggcctggtatgatggctcatgcctgtaatcccagcaattggggaggacaaggtgggaggatcacttgagaccaggagtttaagactagcctgagcaatgtagtgacacctcatctctacaaaaaaaaaaaaaattttttttttttttgagatggagtttcactcttgttgtccaggctggagtgcagtggcacaatctcggctcaccgcaacctctgccttccaggttcaagcaatcctcctgcctcagcctcccaagtagctgggattacaggcatgtgccaccacgcctggctaattttgtatttttagtagagacagggtttctccatgttggtcaggctggtctcaaactcatgacctcagatgatctgcccacctcggcctcccaaagttctgggattacaggtgtgagccaccacgcccggccttctacaaaaaagtttttaaaaattagctgagtgtggtggcatgcacctatagccctagctactcaggaggctgaggcaggaagatcgtttgagcccaggaggtcgaggctgcagtgagttatgattgtgccactgtactctggaaggcagcaagactctgtctctaaaaaaaatttttttaaaccaaccaaaaaaaaaaaaacccaacaccatcttggaggtagggatggtagtatcagactttttaagtgttagatatctcagaggatgtggtttgagtttaaaagtatctgaacctggccaggcacagtggctagcacctgtaatcccagcacttttgagaggctgagatgggaggatcacttgaggtcaggagtttgaaaccagcctaggcaacaaagcaagaccctggctctataaaaaataaaaatatttacctgggtgcagtggtgcacacccatagtcccagctactcaggaagctgaagtgggaagatcacttgagcccaggagttcaaggtctcagtgagccatgatagtgccactgcactccagcctgtgcgacagagtgagaccctgtctcaaaacaaagaaacaaaaaaatctgaatctcagcgtcaaaaaacctaagtaaaccttggctttactattttttatgtgataagtcatttatcttctctgggactttattttccttatctctgaaatgaattataatactaatgaataatacatatgaaaatattttgtaaacctaaagcattgtgtaactaactataagtatttactgtgccataaaagggttctgccttactctctggtaggtttccttctagagagataattaagacttttgtgaagtattttgtgagctctctctggggctaatgaactcttatccactgggaaaacctccctagcaaacgatactagccactaggcctctgatccaggaatgtttgtagtggtggtctggcagagaaaaccttatttccacttacctcacagttcaataacaacgttatacactgcactggtataatatggagctatgaaggaagttaatttgaatatacttgcatgtgtaaaatgaccaaagatctattcacatagtttgggcagtggatttagcatttgtattcaattccataaatacttttgagggcctcttctatggtaagcattctgcttaatacttaagagaattcaaagatgaataaggcttagtcctgacattcaggaacataaagtacatggtacttaggtttatgcaggtttagaatatttcaagaattctgcttttttttccagtggttccactttttgcctgcataacaaatgaagtatgtcagtaatgcttctgaagtccagtaggtactgtatgacttcactggctgtcctgagagagggagaagagtgaacaagagtagcaagagttgtttgttactgggttttagggtctaaagtcagtgcacagacaaaaactgtttggttaaaattgcccttaaagacccttaaattacctgccaagtacagttttgtgtatgtaactctatatagtaattcttatataagttaaagaactgagctaaaataagggaaagaaagagaaaatctatatgcagataatcaggcatgacttttctgcctttaggataatggtcagatcttcagtggtgtttagggggttaagtaaagaattgaatagtattcccacttgtctaggttccttctttttttttttttttcttttttgagtcagggtctcgttctgttgctcagattggagtgcagtggtgcagtctcagcccactgcaacttccagctcctgggtgcaagtgattctcgtgcctcagcctcctgagtagttgggattataggcatgcaccgccatgcctggctaattttttgtattttaagtagagacagagtttcgctatggtggccaggctggtcttaaactcctgtccccaggtgatccacccacctgggcctcccaaagtgttctgggattacaggtgtgagccactgtgcctggcctctttttttaaattattattattatttttgttgttgttgttgagacagggtctcactcctgtcgcctgggctggagtgcagtggcacaatcatggctcattgcagcctcgaattcccaggctcaggtgatccttccacctcagcctcccaactacctgggaaaacaggtgtgcaccaccacccctggctaatttttatatttttagtagagacggggtttcatcatgttgcccagaatggtcttaaactcctgggctcgagtgatctgcctgcctccgcttcccaaagtgctgtgattacaggcatgagccactgcacctggccaaggattgctttcattatgatttaatatgcactaatagacttgtgaggataaagtacaataatacatgtgaaaacactcagcatagaccctgaaacatagttgctgctcaataaatatttgttaggatttgaatctgaatctctcctaatttgacagtggtatttgaaatgttgtaagcaattacttaaccacactgctgtgtgtctttccatactgacattttctgtgtgggcccactgagttatggatcattcttgtgccttttggcactggtcccattctacagggggattaagctccaaagtgaatgcgttattacatgcacacctgatgctattcctctgggttgtacctttgttggtatgacaacttttatttttgaagttttaacacttgagatactctatttttaaaaatactgcagaatgatggaaatgttctttttctgtggcttatacttttgaaagtcatattatacttcttaataaagtaacatttaaaatatttttttaataaactatgactctgaggtagtcctaacttctagcctctcttttcccaatatcctttttgttcctgttttcgtttttttagagacagggtcttgctctgtcacccatgctggagtgcagtggcacagtcataactcacttgaacttctggggtcaattgatcctctccactcagcctcctaagtagctgggattacaggcatgtaccaccatgcctagaaatttaaaaaaaaattttttttagagatgggggtctcactatgttgcccaggctagtctcaaactcctgggctcaagcgatcttcccaccttggcttcccaaagctctaggattacaggcatgagccactgtgactggcccccaatatcctttttaaaataaacttttaaaagattggcatctaagacgcctttctttttttttcacttcttgtgtattcgtgttcctttccttctacggcagaaaccacagtgtgttgatgaatgaatagtttaagcaaggctgctagaagtttcattccactatagaactggttctgtttgtggccaagaattgctgtcagtactaaccagctatttcatagctgttgcatgaggaaagggactagagtaggattgtacccctcagtctatgctttgtttactctgagtgtacaaaagatggtgggctttaggaacaggggtagtgaataatttggggcactgttattccttctgctttactttaagtatgactctttatctcttctaccaggatatgaattgtctcccacggcagcagctaacttcacacgccgaaacctggctgactgtcttcggagtcgggtaagtaatatatcagacattgttagatagagcagaaaaatcctttgtgcttcttttatattctcattatacatgagtagtatttttgcccttttttggccttccagaacccctcctgttgctacttgttcattcttaagtccaatgtctttgtgcacagttgttattaataggtacagcccaaagggcaaatattcattcccagagaattggttgggacacaccaatatgaaggcctgtgacaacttaccctttttttttccccctaaaaactattttttagagcagtgttaggttcacagcaaaattgagaagaagtataaagatttcccacattcctcctcacccacatgtatagcattccccattatcagcatcttccaccagggtgatacattgtcacaaatgatgagcctatattgacagtaatcacccaggtccatagtttacattagggtttacttttgctgttgtggatgttatgggtttggacaaatgtataatgacatgtatctaccattacaggatacagagtattttcactgccctaaaaatcctttgtactctacttattcatccttctccatccccacaactcctgacaaccactcatctttttactttctccatggttttgcctttcccatcatgtcatatagttggaatcatggattatgcagccttttcagattggcttcttttatttggtaatacacatttaaggttaccctatgtcttttcatggcttgatagctcatttctttttaacattgaaaaatactccattgtctagatatactacaggttatttatccattcacctactgaaggacatcttggttgcttccaagttttggcaatatgaataaagctaatgtatacatccatgtgcaggtttttgtttgaacataagtttttttttgcgtaaataccaaggagtgtgattgctggatcatatagtaagagtacgtttagttttttcaaagtgtttttgtaacaaaccatattacttaatacctgtgactgaaagtctctatgtgttagtgaaagtagaactttgaaaataataattcagattatttttatttttatttttttgagatggagtttcactcttgttgcccaaactagagtgcaatggtgcaatcttggcttactggaacctctgcctcctgggttcaagtgattctcctgcctccatttcccaagtagctgggattacaggcatgcaccaccacgcccagctaattttgtatttttagcagacacggggtttctccatgttggtcaggtgtcaggctggtctcgaactcctgatctcaggtgatctgcccgccttggcctcccaaagtgctgggattacaggcgcgagccaccgcacctggccggtaatgtggatttttatctcgagattgcttatctgtgtttctctttttttctttttcttttttctttttttttttgagacggggtctcactccagttgcccaggctggagtgtagtggtgtgatctcagcttactgaagcctcaacttcccgggttcaggtgattctcccacctcagcctcccaagtagctgggactacaggtgtgcaccaccacatctggctaattttttgtatttttagtggaggcaggatttcaccatgtggcccaggctggtcttgaactcctggactcaagcaatctgctggccttggcctttcagggtgctgggattataggaatgagccactcactgtacctggcgtacttacctgtgtttttctatgactttttcccaaagcatacagcattgttcctccttacttattctagccttgttgctattctagagctgtctccatttcatcgacagcatgttaaaagatgcaacactaagttaaggattgaatgcattaaagattgtgtaggatgtgctaggaaagttcatatggttgctaaaggtgtgtgttattcccttcccacagggactaaataaatagagccttaccacgtg

SEQ ID NO: 16197 - DNA, 53737 bp, Human
ggagcttttttctgaacccagctaaaggtggaaacttggaagaggaggccagtggattgggtgaagaaccaaccatttggtatacctgtgactgaggaggttctcaggatgcaggacttttagtgctaaaactaggaaagtcctgggcaagctgggccaagctggccacactggcagtggatatgaccatggagggtgaagtgagcaataaatactctgacctttctttcctggtggcctctcatctccttacagtaaccttataaggtgtctttacaggggcctgacccaaccagaagggcaagggagctgggataatacagtctagagaggtcagccttgccttgacacacaccagggtaaaggaaggacagagaattgacctggagaggcaaaaaataatggccagcacagtggcaaaactgggattagaattgtctgggataggccaggtgcggtgactcacacctgtaatcccagcactttgggaggctgagacgggcggatcacgaggtcaggagttcaagatcagcctggccaaaatggtgaaatcttgtctctactaaagttacaaaaaattatctgagcgtggtggcacatgcctataatcctagctactcaggaggctgaggcaggagaatcgcttgaacccgggaggcggaggttgcagtgagccgagatcacgccattgcacccagccatggtgacagggagagactctgtctcaacaaaaaaaaaaaaaaaaaaaaaagaactgtgtctgggataaacctgatttcagagcttcaattctttttccagccttgtttaaaggtagaatgccctctaggagtgatgagtgctttctacatcctcaaattaactctacagagaattataaagattatccaaccatattctttggtatctgagcagcccacaaaacttttttctttagagacaaggtctccctctatcgcctacgctgaagtgcagtggtgcgatcataactcactctaacctcaaactcctggactcaagccatcctcccacctcggcctcccaaagcgttgagattacaagcgtgagccatggagcccggccctctttaaaaaataaaagtgggccgggcacagtggctcacgcctgtgaggggtatgaggcctcccagcactttgggaggccgaggcgaggatcatttgagatcaggagttcgagaccagcctggccaacatggtgaaaccccgtctctactaaaaatacaaaaattagccaggggttggtggcgggtgcctgtaatcctagctactcaggaggctgaggcacgagaatcgcttgaacccgggaggcggaggttgcagtgagccgagatcgcgccactgcatttcatcctggctaacagagggagactccatctcaaaaaaaaaaaaagtgtgtgtgtatacacatacatgtgtatgtgtatatatgtgtatgtatatatgtgtgtacatatgtgtgtgtgtgtgtatatatatatatatatatatatatatatatatatatatatattcagtggtaagtgtcatgtacaagaggcacacaggatctagctgctccagaaatgaagtcagtggagaaaatccccacgggaaccttggaattcctctaaaaagttcaggtacaggacactcccaggtgcccaggaaccgtttcccagctcacttccccccgaaagactcacccctccaatcgcactcgatgctttggcaagtgtcaaaggtcaaagaccacggctcgcctggtaccgactgccccgcccccgtgcacctccagctcccccaggctccgctaccagcagctgcgacccgccaactcagcctgggtaataggagattgggcggccagaggcgctgcgtgattggtgggtcggaagggggcggggactcgctggaaagccccctctggattggtgcaaaccatctgggtgggacctccactctggctgggcgggaaagcaagaacagcactgctgggctggagacggcgggagccgctgctctccggctgagggaatcagagacagctccgtccctagtggagcgcaggggaggcagaagtcatgacaggcgaggtgggttctgaggtgagtttatgcacacgccccccacgggggcttagaaggccgggcaccgagaggttaggtggggccggggtagaccccgctgacccgaggcgcccgggcgggaggactgcggctcccggcgttcgccgcgccggctcccgcggcctcgagactcggccgggatgggttccgaccgggcatcccgtcccgccgccgggcttcccgcgcttcgggctccgtggccggagagctccaggtctctgcggcgcgcactgccggcagcccagcccctcttcagccggttcctgccgccagccctcccctttggcgcgtttcctgtcgcggaagctcctcccctcagggtgctctgaaagccgggaggctctagccgaacccggccgcagcggtgcggggggattctccgcagagagagggcgagcgagggtgttagggagttccacactgggcctgggaggggccctggaggtcatcgcgcgcaggccctttgcgttttccgaccgggccccgagtggggaagtcaccgctggggctcctggctggtggctggcagctccctggcgaaattgggcatagaaaacagatgtttccagagctgtgtcctttctgggccggattcgggcaaggcactcccgccttaggagcaaaatttaaaggggcgccaaaaccctcaatcaaactcatattttaatgcaatatttttaaaaaaccaaaattaatgcaaaaactttttatgatttgatattgaacaaaatatcagacgtttaaacaaagacgagatccgaccagtcatttgcacgaccttgcctcaatcacctcaccctaattccatccctgtttccaataaactttatttacaaaagcgggcatattatttacctcatgagctgtagattattgatttaattttttaaaaaatattgcattaatgttattcattttgattactgaattttttgagacctcaccccaccctgttactggccctgccctttgacgttgctgcaaattgcctagaagataatcgtcattcaaagcagccctattccttgagctgtctggttacctaaattcggtttccacactcacaaacagaagtaatagttttactgctttggattgttgagaggatcatcagtgcatacatattaattctcagcaatcccagcacttcgggaggctaaggccggcagattgcttgagctcaagagttcgaaaccagcctgcatagaaaacatggcaaaaccccgcctctacaaaaaaaaaaaaattagccgggcgtcgcctgtggtcccagctactcggtcccagctactcgggtggctgaggtgagagaatcctttgggcctgggaggtcaaggctgcagtgagccatgatcctgccactgcactccagcctaggtgacagagtgagacactgtatcaaaaaaaaaaaaaatttgtaccttgcattcaaatcaatttaataattttttttttttgagacggagtctcgctctgttgcccagactggagtgcagtggcacaatctcggctcactgcaacttctgtctcctggattcaagcgattctcctgccccagcctcctgagcagctgggactacaggcacacaccaccacgcccagctaatttttgtatttttagtagatacggggttttactgtattggccaggctagtctcgaactcctgaccttgtgatccacccacctcggcctcccaaagtgctgggattacaggcgtgagccaccatgcctgaccaatttaataattttttgagaaaccactcagctgaggccttgtgccctgttacattactgatgttcatatttctccctttattaataagttgattcagagccctgagaacactaaggaggtagacttggcatctagggttagctttaaggtcactaactgatcaagtcacctaacacacccctcctccttaggtttttatttgcgactttttaaactgtcttatttagaaattttcaaacctatacaaccgtagaaaggatggtataatgaacccatcaccttacttcaactacagtttgaatatctctcgtctgaaatgcttgggaccagaagcgttttgaatttcagattcattttggattttggaatattcgcatacacataatgagatatcttgggggagggacccaagtctaaacatgaaattcagttatatttcatatataccttacacacatagtctgaaggtaattttatacagcattttaaaataatttcgtgcatgaagcaaaggttttactgcagctcatcatatgaggtcaggtgtggaattttcatctagtggcatcatgtcagtgctcaaatattttggaattgggagcatttcagattttcaggttagagatgttcaacctgtattttcaagtcatggccaatcttgttttattcatacagctacccatttttcctctcacaggattatttggaagaaaatcccagatatcatattatttgaaccacaaagattttagtgtgcatatctaacaaacaagagctttccaaaaatagatactacgatattattaccacacctaagaagtatctagtcagtgttcagatttctttgactcagagatatttcatttatttttatatgccactttagcataattatttacatttttagttttttgaatcatcatccgaagttggcattttgtaattgtttatattatatatgtgtatatatgcatatatgtatgtattttaagatatacatacatatataaagcatacatttatgtatatagaaatatacagggccggttgtggtggcttacgcttgtaattccagcattttgggaggctgaggcaggcggatcacctgaggtcaaaagttcgagaccagcctggctaacattgtgaaaccccgtttctacaaaaaattagccgggcatggtggcacgcacctgtaatcccagctactcgggaggctgaggctggagaatcgcttgaacccaggaggcggaggttgtagggagccaagatcgtgccattgcactccagcttgggcaataagagcgaaactccgtctcaaaaaaagaaaaaaggaaatatacatatagccgggcgtggtggctcacgtctgtaatcccaccactttgggaggctgaggcgggcggatcacctgaggtcaggagttggagaccagcctgactaacatggagaaaccccatctctactaaaaatacaaaattagccagacgtggtgacacatgcctgtaatcccagctactcgggaggctgaggcaggagaatcgcttgaacctgggaggcagaggttgcggtgagccgagatcgcgccgttgcgctccatcctgggcgacaacggcaaaactccatctcaaaaaaaaagaaatatacacatagcatatagaaatatacatacatatataaatatatagaaatatacatacgtacacacatatatacattcacttatgtgttaactttctttataggtttctctccctctcttttttttttctttgcaatatattgttaaagaaaccggccgggtgcagtggctcatacctgtaatcccagcattttgggaggccgaggtgggcggatcacctgaggtcaggagtttgcaaccggcctggccagcatggtgaaaccttgtctctattaaaatagaaaaaattagctgggtgtgttgatgtgcgcctgtaatcccagctactcaggaggctgaggcaggagaatcgcttgaacccaggaggcagaggttgcagtgagccgagattgcaccactgcactccagcctgggtgacagagcgagattctatctcaaaaaaaaaaaaaaaaaaaagagagagagagagagaaagaaaccacccagtttgacttgtagaatttcccacgtctagattgcatatctgtggtattattcaacatgttcccctattccctctatttcctataacttgctagttagatctagagacttgataggattcaaatttgattgttctgtcaggaatactttatggctagtattgggtacttctattaggcagcacataatgtctggttgtttctcttttggtgatgttagcagccattaatgataattgcctaggtctgttatttaattgagggttgataaaattgtgataatctaattctatcatttattaattcattaggatatttctctaaatagaaacttcccctcatcaattgtatggatatattggggaacagttcacacagaaaaggcataataaatgcttgattcttttcatttttttttttaccgttactaaaagagttggttctgttagcatccttcaaaggtgaaaaatgaacttttgtttgtttgttgtccagtaattctaaatgtcatcccttcaaggaaccattgtatttggttctttccttagttcaggttgatgatcccacgatgatttgtgtgtcattatgtacttggagctttcggtcacctgctggttgatataaagtatattgtcattttctaggttcacctagaaatcaatgacccaaacgtcatttcacaagaggaagcagatagtccttcagatagtggacagggcagctatgaaacaattggacccttgagtgaaggaggtttgtaatagtacttttatttttaggaataggttgcgggagcctcagttgtaagtagattggattgatttcattattctcttgatttattacattattaatgccccatccttattgtttgttttattataaaagcaaaataacagtgcttgtacctttttgaaactatgttatattgttgaatgtctaatagctaccatattgcctggttaattgcattcatcctataataaaaggaattttaacacctgccggaggttagaacaactttacacattgtaaatatacgtaaaattacatttcccagtaagagacatttttcccagggaaaatgtttttcaaaatgtatttttagatttgctttgctacaatcagttcttaacagtagtcacgtaatttcacaatgttatatatcacttgtataaaaatatatttttgaggagtagtgggactaggaggaagatcaaatgatggtataattaaaagaaaattgtttcctccagattcagatgaagagatatttgtaagtaagaagttgaaaaacaggaaggttctacaagacagtgattccgaaacagaggacacaaatgcctctccagagaaaactacctatgacagtgccgaggaggaaaataaagagaatttatatgctgggaaaaatacaaaaatcaaaaggatttacaaaactgtggcagacagtgatgaaagttacatggaaaagtctttgtatcaggaaaatcttgaagcgcaagtgaaaccttgcttagagctgagtcttcagtctggaaactctacagactttaccactgacagaaagagttccaaaaagcacatacatgataaagaaggaactgcaggaaaagcaaaagtaaaatcaaaaagaagacttgagaaagaggagagaaaaatggaaaaaattagacagctaaaaaagaaggaaacaaaaaaccaggtacattttaaagaataatttgctattgcttgggtaggttaacattttagaaaaggttgctgttagtacttgaggttgtttctgctctctgactattgctttgaattgactattttgtgttgagaattattctcaataggtatgtgatttaaaactaactggtcttggccaggtgcagtggtgcatacgtctaatcccagcactttgggaggctgaggccagagggtcacttaagcccaggagttcgagaacagcctaggcaacagagtgagatcccatctctacaaaaaatttaaaaattagttgggtgtggtggccgtagtcccagctgtagtcccaactacttgggagggtgaggtgggagaatcacttgagcccaggaagtcgaggctgcaatgaagctgtaattgtaccactgcattccagcctggatgacagagtgagaccctgtctcaaaaaaaaaaaaaacaaaaaccaaaaaaacaaaacttattggtcttattctattttgggtatgcagaggacatttccaaataaatgggtttctgattttctttatgagcacatggagtaattctttgctgtctctgagctgatgaaaattaactgaaagaaggcttttttatgcatctatcagtcagtagtcttgtttgctaactagaaaaaccatcctcaaatttataaactagttgcttaacaagtattttacttcaaaaaaatatttactgtttattaagttagttttagacagttgcataaaatcacaacttggacttcaaaggatacatgtgagttagaaaccagtaagaatgttctagattttatatgcttgtctgttgatgaaacatgggctttttctggcctgatccaaattgccatatgatgttgtgaaatactggatttttaaatgattggattatgctttttgtttatgtattacttaggaagatgatgtagaacagccatttaatgacagtggctgtcttcttgtggataaagacctttttgaaactgggttggaggatgaaaataactctccattggaagatgaagagtcattagaatcaataagagcagctgtaaaaaacaaagtaaaaaagcacaaggcaagtaaagcatgattgcaataagagttaatcaactgcttctgacctttgctatatttttaatttactgttggaaccttaattttttttttaactgaagaaaaacttgtgtcagttgacttaagtgtttcagctgttaattttggagacttgcagtacaagtgatagacatgctaacttctttggaaactagtgttttgttattacccttttaggaatgctgaaaaaaaaaaccactaagatatttgatggtgtagtaagatgcaggtaaataatagggaagagatgtaaattttgcaatcctatagcctttgagaaatgaaccctatagggtttcaggaagggtatcaaagagaggcatcagtcaaaacattgttgtcccgagtgtttggaagcataatttttcttcctaagatttttttttagcttcctgcgagttattatccctctttagggaaagatgtaagcagaggtaaaagaaataagggtccagactccatctgaggtatctgttttctaagcataataggatgctgtgtgtttaataatttctagttgatgattattgatttattaatgtagcatgatgtggtgttggactacaaaagtagtcttcagctaaagcatcctcttatttgaatttcgtttttgtcctaatcaacctgccatttcttttagaaaaaagaaccatctttggagagtggggtccattcatttgaggaaggaagtgagttatcaaaaggaaccacgaggaaggtgaggtagagccctgtatattagtcacactgatctctttacacaggagattatagatttcttagggataaatattttattttgtctatcatatttttctgttacccatcatattgctttgtacatagtaggaacaaaatatggattggattgaacaaattctctgagacttgggaataaatgaattccttgagtttatactgcatttgggcttactcatgcttactatttcctttcctcttttcttggagagagcaaactcttgagtgatgaatatctatctttctggatattcatataattaatgtagtctcacttcttgttttctttaaggaaagaaaggcagccagattaagtaaagaagcattaaaacaactgcatagtgagactcagcgccttattcgaggtaatgcaacccagtaaactttgaggcaaaatcacaacatttctttgtaagctcaacttggatgttggggacttttatttttttaacacttctaatgtgaactcaggttataatattaagtttagaattgatcttggtgaaaggccattgttctaaagcccttggaacattagtataaactgaagaaattttcagaactgtagtgcaggtaaggaggaaattttttaatggttgtctatggactgattgtgtcaggattctttggagaggtagtaatccctccctatttgcagttttggttacctgtgtcagccatggtccatggaacttaaaaatatcatccctttgtccagagtatcacgctgtatacattacctgcctgttagtccgttagtagccctctcagttatcagatcaaaaaaacactgcatggtttagtaccatctgcagtttcaggcatccactgcaggtcttggaatgtgtctgtctggataagcggggactactgtatataaatgtttaggtcccacagagattctgattcagtagattcgaaatgggatccaagaatctgtatttctaaaaaacttcctggatcattttgatttcacatctaggtttaaaagccactggtcttcagggagcttttttgtacttagctcctctgcctttgttaaaggggagttttctatttctagtgatggctttggttattatgtttagttaactgaatatgaagtgacatttcagaatatacagtatatatatttgcttgttttattccattttatagagtctgcactgaaccttccatatcatatgcctgagaataaaaccattcatgatttcttcaaacgtaaaccccggcccacttgccacggaaatgccatggcactattgaagtaagaaccctctttccttattataattttcatgaacatttagttttgtagcaaacatctggcataaaaagttcagatttctcactcccttaaaactgatttaactgatatatactaagggatgagaatgtttcacatttaggataattttcaactccagctcaatttctcttctctaggtcatctaaatatcagtcaagccatcacaaagaaatcatagacactgcaaatactactgaaatgaacagtgatcaccatagtaaaggttctgagcagacaacaggtgcagaaaatgaagtggaaactaatgcactccctgtagtttcaaaggaaacccagatcattactggatcagatgagtcttgcaggaaggatttggtaaaaaatgaagagctagaaattcaggagaaacagaagcagagtgacattagaccttcacctggggacagctcagtgttgcaacaggaatccaacttcctcgggaacaatcacagtgaggaatgtcaggttggagggcttgtagcatttgaacctcatgccctggagggtgaaggcccccaaaatccagaagaaacagatgagaaagtggaagagcctgagcagcaaaataaatcatcagcagttgggccacctgaaaaagtgagacggtttactctggatagacttaagcaactgggagtagatgtttccattaaaccacggctaggtgctgatgaagattcctttgtgatacttgaacctgaaaccaacagaggtaatcctttacattgtggggagcctccctggagtgattatcctggtagcttttgattattgactactgtcgaggacagagaacacaggaggaaccaataaccactttgatcttatcctgcagttgttccagatatgggcagagtcttttttagagaaatttggcagggtatcagaatgatctaagccatgtttaaaatggaagtctgttggctgggtgcggtggcttacgcctgtaatcccagcactttgggaggccaaggcgggcagatcacgaggtcaggagtttgagactagcctggccaatacagtgaaaccccgtctgtactaaaaatacaaaaattagccgggcatggtggcacgcatctgtagtcctagctactcgggaggctggggcaggagaattacttgaacccagaaggcagaggttgcagtgagccgagactgcaccattgcactccagcctgggtgagagagcgagactctgtctcaaaaaaaaaaaaaaaaaaaaaaggttgttgatagttaatataaaaaagaggtacattgctactgtgttatggtatttaggaatttattatttctgcctttccaatctgaaattaagttttttctgtaatcctgagtcaaatcttaagacattgatgaaaacatcatttagttttttactgctaaagagaaacattttggttcacttaaattatctgtgaaaccgaatttcttttgttttcactcattcaacaaatattaaagtatctactatgagtaagttgctgtggggcataccaagataaatctgacatttaaggtatacttaagatgcttttactctaatgggcgagataagaagtatgcaaataagaagtacaaaggagaaaatggtaaatgatgtctttgataatgaatatgtcattgataattggaaaataaataacatgaagaaaaaggaaaagtattttcttaaagaacatttagaataaagtactgtgggaattcagagaagcataaatttcttccaatgaatagttaaaagacagcctgaagaataggtggattaattacttgttcactgccttccctttatactgtgagttggtatcttctgccttgttccctactctatccctagtgcttcctcagtggacgacacattgtaggcacttgtatttatcaaatgaatgaatgatccctcaacactgaactcaagtattaccacattgaataaatttcctgactcttagatagagctggatgctccccactctgccttgaggcagtatggaatggtggttaagagcttagactttgtagcaagaccaggatttgaatctgaactagcatagtaattgtttaacattgtatacgccatttgacctcttcaagcatcttttgtttaaaaaagagaagaaagccagacacagtggtgcacacctgtagttccagctactcgggaggctgaggcacaagagggtcacttgaacccaggagtttaaggccatcctgggcagcatatgaaatcctgtctcaaaaaaaaaaaaaaaagaaaaagaaaaaagcactatatgacttgtgggctatggtgaagatttgttgaaataatgcatgcaaatggatagtataaacaagcactcaaaaagttgttgctgcttctactattattagtgaaatggttcacatcaagactttttttttttgagacgggctttcacttgctcttgccacctaggctggagtgcaatgctgcgatctcggctcactgcaacctccgcctcctgggttcaagcaattcttctgcctcaggctctcaagtagctgggattacaggtacccgccaccacacccagctaatttttgtatttttagtagagacagggtttcaccatgttggccaggctggtctcaaactcctgaccttaggtgatctgcctgcctcagcctcccaaagtgctgggattacaggtgtgagccactacactcagccaagactctttcattaaaccaagcatagtcagtggcttatgcctgtaattctagcactttaggaggctgaggtgggaggattgcttgagcccaggaggtcaaagctgcagtgagttgtgagctgaaattgcactcctgcactccagtctgggagacagaacgagaccctgtctcataaaaaaaaaaaaaacacaaaaaaattatctttcattaaacatcttattgttggcaggtgctatgtcagtgactatatctggtgtgtaaaatatgctcagtgagtctgttaattgaatgggttgactttggagatggagaggatagaaagagcaccttgtctcattaaaacaaaaagaaaaacaaaacacacacaaaaaagattctgtttcattaaacagcttattgttggcaagtgctatgtcagccactgtatctggtgtgtaaaatatgcttagtgagtctgataattgaatgggttgactttggagatggagagaaggacagaaagaactctgcatggtggtgcgtattgggaagatgtgaaagtcactttgaccagggctggaggttcaggtggcagagttgtataacagaactagcatagctccattagcaaagaagcatgagaataagctgttgtccggaacactgagggaaagtttttgttatatgggactaaaagttacctaaacagtcctagactgataggaaagggagaaacattttttgagtaccaactatattagacactggtacattctttgttagttgtctttcttaattctcacagtgccaggtattattttgcaaaatgaagagactgaggctcagagaggttaggtaatttttccagcattatacttggcttataaagggacctacacagtggctggcatataatgagcacttattttttaacttggaacatgttttcctttagaaataattgacacgaaatttgggtttccagaccagccataatatacatgaagttagaatcaacattcattcattcattcatgcaataaacttttatttagcactgtgttgggtgctgtgtatacacgtaaaacactccctgctctcaaagaaattgaagtgtaataggagtgatagacaggcaaacagaccattacaatactggatggtaagtgctgcgatcaaggtatataattgagggtgcattgggaacctagaggaagggtaccttacttggagcctagaagtcagggaagtttctgaaatgagctcagtagagataccaaggcagagaggtgagggagggcttttttggtggaggggttggacctgcagatgtcagagacaatggaaagcacagggtgatctccctggctgaagtgaagatagcaaggacattggtgatcagagcccagatcattcagggtttttatgccatgctaggagcttggactttagctctttgtaagtagaggaccactgaaaggttttcagcaaaggaaatgttcaatcagatactcactttaggaagttaaatctggtagctgttgtggtggatgcattggaaggggttaagagtaaaaacagtgggaacagctcagtttctttacctcatatagaataaggtttccatgagaaaatgcatgtaaatttaaattttgtgatgtcagaaatacattatttctgttgcttgcaatagcatatggaataatccctgcctctaattcctctactttctggacaagagcaatgtgaatgagaacagttcttatgctgctgatagagataagctaggaaagagacttttcacttaagagaggagatgagaggtgatggaggatgagaggtgatggactaatagagatgaatggaggtagaggaacttgaacaggggttttaggatgaagacagtgatggttgcatcatgtaataaaggccaaagaaagtggttgctccaatgggttgggggaggaagagctttgaggatcctagctttctccagttatgaatgaagatacctcttgcctgactactattttaagtcccaggtaatcttcccacccaaccatttctcttaccctagtggcacccataataacctgcctatttctgttcccttttccctgctaccacctgttgctttcagctttactgaaccactgcaaaataggaggcagacttacagcttgtctctctactcttttgtttgcaatgtaaacataccatcctttagagttgggtttttgctgctaataatgttggggtttcaggataaaaagatttccttcatttttctctttttctagtaagaccgtctagaggaaaaaaacacatctagatgctagtcacaaaaacaccgaagtatgatttgagtgcattttagaaaattagtcaagtttcatgcctatagtcccagcactttgggagactaaggtgggaagttcgctttgaggccaggtgtttgagaccagcttgggcaacatagcgagttcctgtctttacaaaaaataacaaagccagatgtggtgacatgcacctgtagtcctagctacttgggagggtgaggtaggaggaatgcttaaacccaggaggtcaaggttgcagtgagctgtgatcgcaccactgcactccagcctgagcaacagagcaagaccctgtctctaaaaagacaaatgaaaagtggctgggcacaatggctcacacctgtaaccctagcactttgggaggctgaggagggtggatcatttcagtccaggagttcaagaccagcctggacaacatggcaaaaccggtctctacaaaaaatacaaaaatcggccagtcgcagtggctcactcctgtaatctcagcactttgggaggccgaggtgggtggatcatctgagatcaggagttcaagaccagcctggccaacatggtgaaaccccatctctactaaaaataaaaataaaaaaattagctgggtgtggtgacgcatgcctgtaatcccagcttctagggaggctgaggcaggagaattgcttgaacccaggaggtggaggttacagtgagccgagatcatgccactgcactttggcctgggcaacagagtgagactccgtctcaaaaaaaaaaaaaaaaaattagctggatatggtggtacatgcctatagtcctggctatctcaggaggctgaggtgagaggatcacctctaagcttggggagattgaggctacagtgagagccaagattgcaccactgcactccagcctgggcgacaaagcgagactccatttaaaaataaaccattttatcatggacgagaaggccgcctgaaaatatccagtgtgcatcaactccaaaggaactttctccttaaaactgccagctctcatcacagattccattatgatatgaagtgttaagcagagtgagtagggattggttccaggtaacagctagctgagggagaaggaaattctaagatattgcagtggggaagaggggtaagtttatatcactattggattgctgaacttactgttcccagtatatatatatttccgtttgtatacaagttgagcatgtggtactggggctgcagtattttctttctcattgtaccaattgtactagtgtaacagttttcaccaaaaaactttttacagtcctgctgcttagttatatcactgactggattgtcattttattttcccttcttgaaaaaaattgactttgcctatatttagtaagattgccaataatgaaacattcaaaatagggaatttgatcccagcactttgggaggccaaggtgggctgatcatttgaggtcaggagttcgagaccagcctggctaacatggtgaaaccctgtctctactaaaaatacaaaaaaattagctgggcatggtggtgctcacctgtaacctcagctactcaggagactgaggcaggagaatcgcttgaaccctggagatggaggttgcagtgagctgagatcacatcactgcactccagcctgggcaatagagtgagactgcatctcaaaacaaaaacaaaaaacagcaataacaaatagggaattttaaaaggagaccaaaacccatgaaaaattaagcccttgaatagatgagattataatcttttttcctaccagtttaatacttttaaagaatttttaaagaatgttcaaaagaattgcacatatttagaaatttcaggtataaatttctgtctgattttttaaagtctgatttttgaaacgttgaggaagaacagttgtggcagtcaattagtttgggttaagttgtatgaatttgactcaggagttagtagcaaggggtttttggtttctctgtgtatgtgtggtttccctcataattgttgagctaaaaaaaacttagcttataagtcttaaaggaaagagttttgagcatggcaaactgacacactggttggcgtttgggtttagaactggaagccttgaagcagcgtttctggaagcatgctaatccagcagccaaacccagggctggtcagacagtgaatgtgaacgtcatagtgaaagacatgggcactgatggaaaggaagagctaaaagcagatgtggtacctgtgactttagcacctaagaagttggatggagcaagccacacaaaaccaggtatttgagcccacaggttttgttttttgctttttgctttgtattctaacagatcttcaaggctattgaaaaccttataatgaaaagttatagaatctttttccttggaggctttgcagagcagtatctctggcatgattcacgtgtagcacacctagaggtgtggggtggacaagctggctttattttttttttagatatcatttgtcttattataaaaaaccccattatagacaaatatatagaataaatgaaaaacttaatcttctatcagagacaggttctataaccatatcgtgtatccttttaaactctcttctttgcacatatgtatatgtatttaaacaaaaacaggctgggtgcagtggcacatgcctgtaatcctagcactttggaaggacaaggcaggaggatctgttgagctcaggagttggagaccagcctgggcaacatagtgagccctcatctctaccaaaaaaaaaaaattatccaggcatggtggcctgcacctgtggccccagatacttgggaggctgagacaggaggatcatttgagccaggaggttgaggttgtaatgagtcatgattgtggcactgcactccagcctaggcgagagagtgagaccctgtctcaaaacaaaaaacccaaaacaaaacaacccacctataatgtgatcataacatgcattctgctttgtgttttagaaatgtattaaggacagctctcacccctcccttgaaatcacaagtaatatatcacatggaaaacagttttaaacactgaaaaaaggtatcaaatgaaaaactagtcttcccaaagataactattaacaatttcttgtatgtctttataggagtatttttatccatataccgtattttgtgaatgtgtgtgacattgaacatttactccctgtcaggcattgctctaggtgctttatatgttttatctcatttaatccttacaaccctatgaggtaaataacattagtatccttattttgtatatgaagaaactgatatgcagagcacttaagacacttgctcaagtttacacagctaataaatggtaggaccagtagtctaatccagaccacctaactccagagctcagatctactttatattgcttttgaggctttttttttttttttttttttcctctaagacagagtcctgcactgtcaccctggctggagtgcaatggcacgatcttagctcactgcaacctctacctcctgggttcaagtgattctcctgcctcagcctcccgaatagctgggattacaggtgcctgccaccatgcctggctaatttttgtatttttagtagagatgaagtttcgctatgttggccaggctggtctcgaactcctgacctcgtgatctgcccaccttggccccgcaaagtgctgggattacaggcgtgagtcactgcgcccggccttgaggctttttttaaaatggctgcataatattccattgaatgaatacaacatgactcattaaaccatactcgtattgacagatgtcttgtttgttccagttgttgctattgcatacagtgttatattatagtgccagatatatggtggtatattagatgaaaattccttacagtggaattgtcatgatatatatcacattttgatatatatcatccagttgtctttcagaatggttgtaccactctgaatcacagtgtatgagttcctgtttcctctcaataggtattatcaaaccttctaatttttgccaggctaacatgtcgaaaatgtatctcgttattttgatttgtagctcttcaattagaagtgagattaagcattacttttaatttattaacaatatatgtttatttttcgtgaactgccagttcatatcattagctcattttactcgagtcgtttctctttttctttaatataggtaaatttatcaatgtttttcttcatggcttttgagccacagacttgaagctctactccctacccaccttttctctcttttgaacaattattttataatccctgagtagtatactatctagggtgcagaagttctctttgatacttcaattcataataatactcttgtgttcaaataacaaaaaagcccagaatactagagtctcagattttccttttgggatgtgactagaatatttctggagttgcctaaaatgcatacctaattattgtattatgtctaaagcatttctacatatttctgttcaggtgaaaagcttcaggtgttaaaagctaaactgcaagaagcaatgaaactccgaaggtttgaggagcgccagaagcgccaagcactgtttaaattagataatgaagatgggtttgaggaagaggaggaggaagaggaagaaatgacagatgagtctgaggaagatggagaagagaaggtagagaaagaagagaaagaggaagaactagaggaagaggaggagaaagaagaggaggaggaagaagaaggaaatcaggaggtttctggcaattacattgttttgttaccttgtcatggtgaatatgagagaaaaagtcagacttgaaaaagagtataataagcatgttcaattgtataagaggttttaggggcatgatgagggtaactacctcatatatccctaaatcttaggaacttcagttctgtcagtaccactgaatatctgtagatcatcattatatatctgaatacagatattcagtggtactgacagaataccattgcctgggcttccacctgtttatatattttaatataataatgctaatattaaaaatggctttgtattcgtaggaaattttatctttgttgtttatttaggtttctctagcagattaaaaagcagtcctaaccttggctagattgaggcctggagtaaattcttagggaggtagaggcctttctgagttattttcgttctttgtagaagaaggcatttgtagaagggcctcttgcccttgttccgtagtactgttttctgcctagggaaaacaggtgatgatacgattgttaagtattaaaaaactttcctttttgggccgggcagggtggctcatgcctgtaatcctagcactttggaaggctgaggtaggtggatcacctgaggtcaggagtttgagaacagcctagccaacatcgtgaaaatccatctctactaaaaatacaaaaattagctgtgtgtggtggcacacacctgtaatcccagctactcaggcaggagaattgcttgaacttgggcagtgaaggttgcagtgagccaagattgtgccactatactctagcctgagcgacagagcaagactgcatctcaaaaaaagaaaaaaaaaaaaaaactttcctttttgtatgctgggatcactttattttattttattttatttatttatttaaatttttttgagatgagggtctcactatgttgaccagactggtctcgaactcctggcctcaagtgatcctcccatcgttgtggcctcccaaagtgctgggattacaggcatgagccaccatgcccagcaacttgagttattatttaattttgggtaaaggagaaagaaagcaatggctgagctatacagcctgtctcagtctgtgcttggtttgagatcagtagtcagcctgcaatcttagactgattaattaacctcttactgcctcaataaaatgataatccagtcgtcctttataatcttagcaatttcgggagggtagaaggtaaaaaaaaaaaaatagaaaaaagttctagaagtgtcagggaaaattatgttgataatggtcatatggaacttccttcaagtttacctttttgaatttaagatgtgatctgtaaccaatcagccatatttcaggctaccagtgtatttgcttttaaatgttttgacttgtattttttgttttgtggtggcctgattggtaaagactgcagaattccttcttagtagtgaagaaatagaaacaaaagatgaaaaagaaatggataaagaaaataatgatggcagtagtgaaattggcaaggcagttggcttcctctctgttcccaagtctctctcatcagattctactttacttctgtttaaggacagctcttccaagatggggtaagtgattctctctaagaaaacttaaaattgccttggatttgcccctcctgtaaaaactaggaacagatactgaaccaatttactttcttattttgcagttactttcctactgaagaaaaatcagaaacagatgaaaactcaggcaagcagcctagcaaactgggtaagtagtgattcttgtgcagaacttaacatttcttttgtccctcagctttgatatttaaggactgcagtacggtaagtttccatgtttttaaatctggtcacttcccagtttcatatgtagctatgaaaagggtttatgaattagaatatttttcttggtctattttttgcagtttatttatagtagaccatggtacataatgtccttagtgaatgtgtgttgattgagtgagcaatgaaatgtttctgtatgtagatcaaaggaagacgtataattgattggacaatgaagagtgtgatcataggcattaggaaggataagagaaagaagagaactttcggccaggcgcagtgactcacgcctgtaatcccagcactttgggaggctgaggcaggcggatcatgaggtcaggagatcgagaccagcctggctaacatggtgaaaccctgtctctactaaaaatataaaaaattagccaggtgtggtggcacgcgcctgtagtcccagctacttgggagggtgaggcaggagaatcgcttgaacctgggaggcggaggttgcagtgagccgaattcacgccactacactccagctggggtgacagagcgagactgtctcaaaaaaaaaaaaaaaaaaaaaaaaagaactttcaagtgtcacttagctcagagtaataagccctgattatataatgctatcttagtactgtaatttacctttaacttaatgttttggaacatataacttgaggggtttgcctatgaattttatctgacagtttcatcctcaactctttttcctaaacaaatccaccttatttctgtaatcatgtgcttaaaaggtgtttctctttctttagatgaggatgattcatgttcattgctaacaaaggagagcagccacaatagcagctttgagctgattggctccacgattccatcctatcagccttgcaacagacaaacaggccgtgggaccagttttttccctacagcaggaggattcagatctccttcccctgggctatttcgagccagtttggtcagctcagcttctaaggtaagatggtaatggtttttctaatctcctcctctctttgcttcccacattgctaaataaagtttgtcccagccaaccaactcccaccacgttggtactgagcttatgtgtgttcagtttaaaaaatccaccccctttgtgtattaaaaacaagcttcatccagtattcttactttcttggaggtatttttctttatgcttctcatggctgtgtattgtccccctcaactacaatttcctgagagtagcttaaatattgcaaatagcaacttttgtggttgtcatgacaatgaatgacatttgtaaaatgttttgttattgtttgtttttgtttgtgtgccagagttcagggaaactgtctgagccttcacttcccatagaggattcccaggatctgtataacgcctccccagagcctaagacacttttcctaggagcaggagacttccagttctgtttagaagatgacactcagagccaactgttggatgcagatgggtaggtagttttgtgtttctgtgggcgggaatggtgctgggtactgcttaattttgtttaaaaataagtgagcttctgtcactccatctgtgctttctcttctgagaaagagaaggtgtacagaccattagtattacattctataagtttgaacaaagtctgtccagaaaataaacataaatagctcttgctaacattctggtccttcaatttctgtcttatttgaaatgcatagatcttgtattgtaaggtcatcaaatttccctgtatccatcctgctatgttattattgttgggtaaggttgagaattcacagactggtggcacattacaggacataatgccaagccctgctctagcatcatctgaagctaaaagttatcctttacactttaccttctgagtaacattttattctttcacaaaacttttccctccctctttagattaacacaagcctaaagtttgaatcttttgctttctggtttgagattcagcttttaactggtgtaggaaatgaattcagaggtttttcaccccctactttgccatttctctgaggaatttttttttatttttttttttgaggcagagtcttgctctgtcgcccaggctggagtgcagtggcgcgatctcggctcactgcaagctccacctcctgggttcacgcccttctcctgcctcagcctcccgaatagctgggactacaggcgcccaccaccacgcccggctaattttttgtatttttagtagagacggggtttcaccatgttagccaggatggtcttgatctcctgacctcgtgatccgcccgcctcggcctcccgaagtgctgggattacaggcgtgagctaccgcacccggccctctctgaggaattttttacactattcgttgtgctcattggttcttaggttcttaaatgttagaaaccacaggaatcagtaccaagctttgaagcctcgattgccattggccagtatggatgagaatgccatggatgccaacatggatgagctgttggatttgtgtactggaaagttcacatctcaggctgaaaaacatctacccaggaagagtgacaagaaagagaacatggaggaacttctgaacctttgttcaggaaaattcacttctcagggtaaatatccaaccgagagtatcaagcttaccacacccaagtatcagtgcccttgaaaagaattccctgggcgggtggggtggctcatgcctgtaatcctagaactttgggaggctaagttggatggatcgcttgagctcagaagtttgagaccagcctgggcaacatggcaaatccccatctctacgaaaaaaaaaaaaaaaattagccaggcatggtggcacgtgcctgtggtcctagctacttgggaggctgaggtgggaggatctcttgagcctgggagatgaaggttgcagtgagctgagatcacaccagtgcactccagcctgggtggcagagaccctgcataaaaatagaaaaaaagaaagaaagaaaagaagccccttaccctcaggtgaaaagttcacagaaaacagggctgtgatggaatctgtgtataaactgaattcactgcttagtgccctgatatttagaactcttactttcttagagtggtaaagtatcaacttaagactactttaggccgggcgcagtggctcacgcctgtaatcccagcactttgggaggccaaggcgggggatttcctgagctcaggagttcgccaccagcctgggcagcacggtgaaaccccgtctctactaaaatacaaaaaattatctgggcatggtggcccgtgcctgtaatcgcagctacttgggaggctgagacaggagaactgcttgaaccccggaggtggaggttgcagtgagccgagattgtgccactgcactccagcctgggcaacagagagagactgtctcaaaaaaaaagtcttgaaaaaaaaaaagactgctttagctttgcccatatatcatttatgattaatgtatgtacaaagtttagaacagtgtctgatgtataataaatttcatataaatgttaacttacttcctgttccctgcccccaatacacacaactgctagatcgaacataagctctatgagacctgggatagtggtttgttcattactgtatccctggtggcctggcacatatggcacatagtaagcactaaataaggatttgttgaatgaatagatggtaggctcttcttggcaagcttaccttagaactgtatcgagctggcatgactttagatggctgggaaaagagtataaagctatcattccttggtgacacatcttttccttgttgtgatgtagatgcctccactccagcctcatcagagttaaataaacaggagaaggagagcagcatgggtgatccaatggaagaagcacttgctctttgctcaggctcttttcccacagacaagtaagtctcagattgctgggaatttgggaaggcctggccttttgataaaatcaaaataactgatcatcttaagggctttgcaccttttctgagaatcttgcagtggatttgagtctcatatatgcctagtaagcaaattataatgctttggtggagaacagggtaaaaaaggcaagaatatgaaagctatttaatatcattaatagagaaatgccaatcaaaaccatagtgagacacccattaagatgacttttatcagaaaaaccccaagagtgttagtgagaatgtggagaaattggaaaccttgtgtactattggtgagaatgtaaaatagtgcagctgccagggaaagtatgatggctcctcaaaaattaaaaatagaggccaggcacggtggatcatctgaggtcaggagttcgagaccagcctgaccaacatggtgaaaccccgtctctactaaatacaaaaaattagctgggcatggtggcgcatgcctgtaatcccagctacttgggaggctgaggcaggagaattgcttgaacccgggaggcagaggttgtagtgagccgagatcatgccattgcactccaacctgggcaacaagaacaaaactccgtctcaaaataaataaataaaaatagaatgaccatatgatccagcaatttcacttcttagtctgtaccccaaaaaagtgaaagcaggacttgaacagatatttgcacccccatgttcaaagcagcattattcacagtaagtagtcaaaacatgaaagcgacctatgtttattggcaaatgaatgggtaaacaaaatgcggtatatatgcaaaggaatattcaacttaaaatggaaattctggctgggcatggtggctcacacgtgtaatcccaacactttgggtggctgaggtgggcgcatcacttgagctcaggagtttgagaccagcctggataatatggcaaaaccccatccctataaaaaaaatactaaaattagctaggcgtgtgccggcagtaccagctattcagggggctgaggtgggagaattgcttgagcctgggaggtcaatgctgcattgagccatgattgtgccactgcactctgggcatcagagcaagaccctgtctcaaaaaaaaagaagttctgacacttgctacaacatggatgaaccttagaatgttatgctaaaagaaataagccagtcaccaaaagacaaatactgtatgagtccacttacatgagatacttagagtagtcaaatgcatagagacagaaggtagaatggtggttgccagagactgaggttataaggaaatggagagtgtaatgggtatagagttttagttttgcaagctgaaaagagttctggagattgcttaacaatatgaatgtacttaacactacagaactatagaaagatcgttaaaaaggcaaattttatattatgtgtattttaccacaattgaaaatttaaaaaattttcttcctgtttattgaagagattattggtgataataaaagttttaaatttggctgggcgaggtggctcatacctataatcccagtactttgggagcccaaggcaagcagattgcttgaatccagaaattcaagatgaacctgggcaacatggtgaaatctgtctctacaaaaatacaaaaattagctgaacatggtggcttgtatctctagtcccagctactcaggaggctgatgtgggaggatcacttgagccctggaggtggaggttacagtgagctgagatggtgccactgtattccaggtggtgtaagagaccaagactgtctcagagaaaaaaaaaaaattaacacacacaaaattttttttaattcataacttggctgactacttgtagtttgctttcaacaacttatttattgattcattgatttacattttagggaagaggaagacgaggaggaggaatttggagactttcggcttgtttcaaatgataatgagtttgatagtgatgaggtgagtatgaagggaacaaagtaatcataactgagctccatgtattgctgccctcaagtgtttttttcccctcagttcttgagaattctaagtttggcatcttatcagaaacaatttcctagaatgaggtatttgggcagatgtttataaatccttttttcattgaggacgcattttattctgcttaatttggatatgatgctgattttgtaggatgaacacagtgactctggtaatgatctggcactggaagaccatgaagatgatgatgaagaagaactcctgaagcgatctgagaagttgaaaaggcaaatgtacgtgttattaatatgtccattccttcaggtgtatttaaaatttggtcactaggccaggcatggtggcttgcgcctgtaatcccatcattttgggaggctgaagcaggcggatcacctgaggtcaggagttcaagaccagcctggtcttggtgacacaggtcaagagatcgagaccatcctgacaaacatggtgaaaccctgtctctactaaaaaatataaaaattagccagatgtgatgacaggtgcctgtagtcccagctactcaggaagctgaggcagggagaatcgcttgcacccaggaggtggaggttgcagtgagccgagatcgcaccactgcatttcagcctgggtgacagagcgagactctgtctcaaaaaaaaaaaaaaaaaaaaagttgatcacttaatatgtcctgtgtgctaataactgtgctttacaggcattaacatattatcttatgccaggcacagtggctcacgcctgtaatcccagcactttgggaggccaaggcaggcatattacttgaggtcaggagtttgagaccagcgtgaccaacatggtgaaaccctctctactaaaaatacaaaatacaaaataaaatacaaaaattagccaggcatggttctgggcgcctgtagtgccagctacttgggaggctgaggcaggagaattgcttgaatatgggaggcggaggttgcagtgagccaagattgccccactgcactccagcctgggtgatagagcaagactccatctcaaaaaaattatcttatgagtgggtactattattctcctcattttacagttgaaggaactgagcctcagaaagattaaatttacccaagatcacatagctagaaggcagcagaggctggattcaacttagattaggtgaaatctcccctaacagtcagttaatagtttgccactttttaacttaaatcctcctgcctcagcttcccaagtagctgggacaacaggcatgtgccaccacacctggctaattctttctattttttgtagagatggggccttgctttgttcccaggctggtcttaaactgttggcctcaagtgatcctcctgcctctgcttcccaaagtctgggattacaggcatgagccaccaggcccagcttttttttttttttttttttttttttttgagacggagtctcgctctgtcgcccaggctggagggcagtggcatgatctcggctcactgcaacctccgcctcccgggttcaaagcgattctcctgcttcagcctcctgagtagctgggaatataggcacgtgccaccacacccagctaatttttgtatatttagtagagacggggtttcaccatgttggtcaggatggtctcgatctcttgacctcacgatccacccgccttggccttccaacatgctgggattacaggcgtgagccaccccacctggccggcccaactcatttttttgatatgctgttctggtcatgaaagtaaaatatttattttaggatatttaaaagaatacaaactgggtgcagtggcccacgcctataatctcagcactttgggaagctgaggcgggtggatcacctgaggtcaggagttcgagaccagcctggccaacatggcgagaccccgtctctactaaaaatacaaaattagccaagcgtgatggccagtgcctgtaatcccagctactcaggaggcaaagctggagaatcgcttgaaccgggaggtggagggtgcagtgagctgagattgtgccattgcattccagcctgggcgacgagagaaactccattctccccgacccccgcaaaaaaagaatacagaaagatataaataaaaacttatccatgtccaccatccaggatataaatgaaagttagtttgttccccttaatcttttttatgcatatatttttatatagttgagatttgtacaatctttctatatgtataattttgcatctttttttttctacttagcatatccagaaacattttcctatgatgttaaaaaaagttttataaagataattctaataggtatttaatattatattgtatgtgaatgatttggaattcacatataggacatcatattgatccctattagatttatatggttgcttttatcccatcatttcattctattaagattcactttgggttctaatttatcacctatcaaattaactctcatacagctttaggttatccatagatttttctaaggtagtggttcttctctgcagagctctttgttcaaataaaatcttttaaagaatgacagataaaagttgaactgttcaaagatggtaagtgggaagtttgggaaacttagtgactagtggcctctgaaggaattttccaggaactctaggatttagaacaacttagctttaagaaaatacagtataggctgggcgtggtggctcatgcctgtaatcccagcactttgggaggctgagatggacagatcccctgaggtcaggagttcaagaccaccctggccaacatggtgaaaccctatctctactaaaaaaacaaaaattagccaggcatggtggcacgcacctgtaatcccagctactcgggaggttgaggcatgagaatcacttgaacccaggaggtggaggttgcagtgagccgagatggcatctctgcactccagcctaggcgacagagcgacacttcatctcaaaaaaaaaaaaaaagagaaaatacagtataggtcttcgataaaaatcagttttcagaaagccaccaaacttctgccattttggaccacatgggaccaaggtgactttgaatccagggtgacaccagatttattctccgggggagctgaagtcataagaagtaactagtcgttttgattaccaggagctctgagccttagtcttccttctgatgtgggggtcaagatttgttaggctgtaagaagatcccagtttattacctttctacaccacaccatctctagtttgtctcttaaagctggtgtgctcaaatgcaaaatgaaatagtttgaaccttccagcaggtattctaatacatgtaaaagagattaagagttttctggctttcaaatcacccaatctaagttgaatccaggctctgctaccttctagctatgtgaccttgggtaaatgtaatctttctgaggctcaattccctcaactgtaaaatgaagagaataatagtacccattcctatgataatatgttaatgcctgtaaagcacagttattagcacacaagacatattaagtgatcaacttttaaatacagatgctccacatcttacaatgggactatatcctgatcaatccatcataagttgaaaatgcactttcatattatccagatataactccatcgtaaatcgagaagcatactaagtgcgtatcacattcatgtcatcgtaaagttgaaaaatcattaagtcaaaccatcataagtggagactattacaaaaaaatttaaatattatcaaatgtattatgtttattattattagaagtgactctgttctgcttttctttgcttccatattctgtgagtatattcactgttgcattttctaatcctcaaaattgctttctaggaggttgaggaaatacctggaggatgaggcagaggtgtcaggaagtgatgtgggaagcgaagatgagtatgatggggaagaaattgatgaatatgaagaggacgtaattgatgaagtacttccttctgatgaggaactgcagagtcaaatcaagaaaatacacatgtcagtatcccaataagcccttctgagtaatagggtacatcttaagacaagccctgtaaccagccagaatggtccttgttttgaacaccttatttctcctgttgcaggaaaactatgttggatgatgataagcgacagctacgtttataccaagagaggtaccttgctgatggggatctgcacagcgatggtcctgggcgaatgaggaagtttcgatggaaaaacataggtatcttggttgttgtctttaaaagcaatcagttacgggctgagcatggtggctcacgcctgtaatcccaacactttgggaggcagaggcaggtggatcacaaggtcaggagttcaggaccagcctgaacaacatggtgaaaccccgtccctactaaaagttcaaaaattagcaggctgtgatggcacgcgcctgtaatcccagctactcaggaggctgaggcaggagaattgcgtgaacccgggagacggaggttgcagtgagcagagatcatgccattgcactccagcctgggcgacagagcgagactccatctcaaaaaaaaaaaaaaaaagcaaacagttacaatgcatatttgtcgagtttcagatggcaaatggcaagcaaaactataacaggctatgtgaagacctagttgtaactgttttctgttaatggatgggaaaagtttacatcattatatagtaaatgataagggtttattttttgtctgtccaagcaccctctcctgtgaggactgccgaatgctgattaccttcactctttgtttagatgatgcttcccagatggacttgttccacagagactctgatgatgatcagactgaagaacagcttgatgagtcagaagccaggtggaggaaggagcgaattgaacgagagcagtggcttcgggacatggtaggagttcacctactctgaccctagtttatgagactgtcccttagcttgtcatgatagtttcaaaatcttagcttgtcatgatagtttcaaaatcttaggcaacatattgctatctcttttaatccttgagctatcttttgtgttttgagaaggctataccatagacagttctcttcatgtttgtctaagattaatttttttttgtctaaagcagcaaaggctgcaaaaaggaaaacaaataccccaggaactctagtttcacaatccaggccatgctaactatttaggaaggttatagacttttaatgctgtatatatatatatatatatatatatattttttttttttttcaggcacagcaggggaaaattacagctgaagaagaagaagaaattggggaggacagtcagtttatgatactggccaagaaagttacagccaaagcactgcagaagaatggtgagctcttgtttctccttagggtctagccccctggattgttagtggtagagctttggaggtgactctaaccttcaggagctgttgcagcttaatcataagcttgtgtctaatactgtcttaaagaggcttcacagaggtggtgggagacagtgtacttagatcttagactattgggcagtagagactgtattcatgagtatatgtggctggttttactttatgttctaaggctcagagtagttaattctggctttctctagttgcccaggattgtatacctaagtgttagaggtaggatttgaatccaggaatatttaactccagaaatgaagctcttcactattccctacactgaccacttctgtttttcttaaatgattactgttcaacttagttgtgtctcttcttggagccaattattatagtttgaaagtcaccattatatagaacagagttcccatggctttagcatattgatttagttacaagatttcttagcttgtttagatttaaaagtaattctaatcagcttttcccagaataggcctctctgtcttttctttccagccagtcgccctatggttattcaggaatcaaagtctttgctcagaaatccttttgaagccatcagaccaggaagtgctcaacaggttggttgggaaccttgttaatctgacatcatagtctacaggttataaaggcccaggtccagcttagagaatagtctctgtcattagaggaaggaggtggctgcagggaaaaagttaatgtcaaaggagtctgctatttcttttctatttgaatagggtaggcatatgtaccctcaatatctagggggaagcagggagggaaggacttttcattctttagttggcacttgggatttgataccagatgactcttctttcctcaggtgaagacaggctcactgctaaaccagcccaaagctgtgcttcagaaactggctgctctctctgaccataaccccagtgctcctcgaaattcaagaaactttgtctttcatacactttctcctgtcaaggctgaggcggcaaaggaatcgtctaagtctcaggtatggaatttgagaactaatatggtggcttcccaaaccagaatttattcatttatttaaatttaaaaacaaaaattctggcttaacctctatgctgcaatgttgaaatcttgcactccccgataaggtacaagagaattgctaccccagtcggtaatcaacttttaaacttgccgagaaagtttatctttctttctttttttctgttgttaatcatccacaatttatgagttgcttgagagctaattgaaggtaaatacttgtatgaaggtctttagctggccctgactccctctctgctctctaggtaaagaaaaggggtccatctttcatgacttctccttcacctaagcacctcaaaacagatgatagcacttcaggattgacgcgaagcatcttcaaatatttggagagctaacaccatcaaaggtgccaaaatctacattgagactgctttgagaagtttctagcactgaaagttggaattgacactccagccaatgatccttccttctttcataatcaatgcaataagattgcagacagaaattccagtgatttctactgcacagctctggacatctcttttcctagtattattccctgaattggccactgatttcaattctgcagtatttacaacatcaacaactcatggaatacttgggtgaggtttcctttttttttttttttttaagatgggagtctcactctgttgcccagcttggagtgcagtggcgtgatctcggctcaccacaatctctgcctcccaggttcaagcgattctcctccttcagcctcccgagtagctgggattacaggcatgtgccaatacgcccagctaatttttgtatttttagtagagacggggtttcaccatgttggccaggctggtcttgaactcctgacctcaaatgatccatccacctcggccccacaaagtgctggtcacatgcatgagtcactgcacctggccttgggttaggtttcacttcctccattagacatttgacattttattgtagcagctttctgggttaatatctctttgtgattgatagaagtggttggaagaggaagagtagggaaaagtgtgacattacagattaaacagtgaaaatcagtaccataatgactcctttacacccatgagatacgtaccatgatgaccagggctcggtgaaagaaagatttctttttttttttttgagatagtctcactttgttgcccagtctggagtgcagtggcgcaatctcggctcacggcaacctctgcctcccgggttcaagtgattctcctgtctcagcctcccaagtagctgggactacaggtgcatgccaccacacctggctaatttttgtatttttagtggagacagggagtcaccatgttggccaggctggtctcgatctcctgacctcaagtgatccagctgcctcagcctcccaaagtgctgagattacaggcgtgagccactgtgcccagccaaaagaacgatttcttagatggaggacctaggaaccaacagatgggctgctgtattactcttacccctttcattttcctgtatgcttcttcccaaggcagcatcaaattttgaattaatttttgctgcttaataaggacttaaactggtacccaagtcagaaagactctgcctctaattttctggggcttggggatgaagataaagtgttacacccagtgtttgtccaccacagtctgtggggcagagagacccttcctgggactgaattctcaatttgaagcactgttgttcaaagatctcccttctgggtctgacaagaagaaacataacccttatttattgcattcttctggcttacatacattgccctcactaatcaatggacatttcagcatttcattactaattttgagagaaggccaccatggaatttaataaaaatattattgaagagaattgccatcattctccattttccctgaactaccacaagcttctcagaattttagacaaatgtttttcccctcagaactgagcatcagtgctgctttggaaaaacattccatgtgaatactgtggtttcagtgtcaggacctgtacttgggcagttggaagagagtgtgccagttttttactgggagatgggaacaccaatttaattgatgcaattaggttgtaggttttttacagtttttcttttcttttctttttctttttcttttcttttcttttctttttttttttttttgagacataggctggctctgtcacctaggctggaatacaatggcacgatctcggcttactgcaacctccgcctcctaggttcaagcaattctgcctcggcctcccaaatagcagggattacaggcacctgccaccactcccagctaattttttgtatttttattagagatgaggtttcgccatgttggccaggctggtcttgaactcctgacctgaggtgatccacccgtctcggcctcccaaagtgctgggattataggcatgagccaccgcacccggccggttttctacagttttctaatactcaagatgttgactttgacaatacttatgtttgtatacttgtaatcttataatggggaaaatgtgtataaagatgttttaatatgtatgtagtttttcaataaatcttaatgccttgaagggaagatttgctgtccagcttgaatgctcattcttgggtcagtgcctgtctaaccttgaggagcatttcattttcaggttatctccatcccagggaaaccctctgggtctaaactgagaagctgctgcaattgtcccctcactggcttctcagtcctagtgaattgatcaagttaacttaccaagtggtttgggttcagctcaggtgaagaggataattgagtttacataaatggtaccttctattatagctctttgtttaaaaaacttattttttagagacagtctcattctgttgcccaggttagagtgcagtggcacaatcatagctcactgtacccttgaactcctgggcttcagcatcctccttcctcaacctttggaatagctgggccacattacaggcatatgccaccatgcccagctaattattttattttagtagagacagggtcttgctgtgttgccccagctgatcttgaactcctggcctcaagtaatcctcccaccttggcctcccaaaatgctggggtcacaggctcagccaccatgcccagcctgttacagctttgattggcctttctctttagctaagtttgtatgtacttcattttatccatgggttcaagatacatgtttttgcctctttctttgaactctctaaacagttcccaaggcaaagtagcccttgctgggcaaaagagaactgagcaggaaggctagatatttcttccctcttgtttccctacatgtcttttgaggagagatagaaaagacaattggaattgacaactgaggataagaaaattcagccaggtccggtggctcacgccagcactttaggagactgaggtgggtgcattgcttgaactcaggagttcgagaccagcctgggaaacatggtgaaatcccaactctaaaaaaaaaaaaaaaaaagaaaaaaaaaagaaaattagtgcctgagaaatccagggagaaaatggtttctgggctgggcgtggtggcttatgcctgtaatctcagcactttgggaggctgaggcagctggatcacctaaggtcaggagttggagaccagactgaccaacaaggtgaaaccccgtctctactaaaaatacaaaaatcagccaggcttggtggtggcaggtgcctgtagtcccagctacttgggaggctgagacaagagaattgcttgaacctgggaggcagaggttgcagtgagccgagatcacgccactgctctccagcatgggcgacagagtgagactccctctcaaaaaaaaaaagaaagaaagaaaatggtttctgattgaggctcctgggagaaagcactctttggagaaagaaaacttgagtcaaactctgggttacttttccttatgccaggatggctgctataaagtaagctaagccttgatcttggtaacaggattgacatggacagtttcaatctgacccatatgccctttgcccaaagcactgagccagcagcatcagttatgttttaatgaaattgaagccccaggacctgccactatggctctgaggaggactcagcttcactagcttggaaattacatatttggagggatgagagcccatgagtgtgggagatagggtaggctcagtgtcagtgtttttgtttcttccttgttccatacacttgagtagggatacatggtattaacctctttaaacaggtctctaatttcatctcattaattcacagttgcacagccatactagggtctcttccataaaccataagattttattcaccaaagctctagagacaaggtactcagatctctgtggcatccctcattttctcaactgcttctctacaaacttctcctcactttgagagtttctaatgctcaggctgggagactttttagggggtgtttttggtttttatctcctagggttatgtctaatcactcttgtggcatcctgtcctgggatttgtgctcctaaggatagaggagagtatttctgggaggagtgttcccatgatactatttgattatgtcatccttgagatggtattgtatcttctacccttatatcctactcatcgcctggcacacagcttggaatgtagtggtgcctaccacagtttgaataaataacactacacctttcagagcctctgtttataaaatgaggatactaagtcatggctgtctcagagttgctggggggcttcagttggaaaatgtatgtcagtgcattatgtcaagtgccactctgtaagcataagaaattgccagtagctcccagaaaaaagaaattcacctcctttgagaatgaaagaaattaccagtatcacaattatatcatatattgtaggccacttctgaaaggcccattgtttctcaaatatctcaaacttaaaatgaaaatgtgatcttctctaaaaacctgctcttcctcctgtatttgccatttcagtaaaaggtacctccatatatccagtcactcagactggaaatctggagagcattcttgacctgttctttaatcctgtaatcagacaatttccaagttctgttatttctgcttccaaattgcatctggaatcagctcatttcttccagctctatggccagccccctggtccaagattccacaatttctttctagggtcctaccgtagcctcctgacccccccacttctgtttttgcttccttttcatccaatctgcacagcagccagaggcgacctttatgtaaatataatttggaggatgacacttcactacttaaaatcttttaatgtcttccgctgcactcaaagttcaaacttctcatggccgatgcatgacatagctctgcctcccaacctgctgtctactcttctttctcatgacatgcagcctcaggagcatctaaagtgtcctctttccctggaatgccctcccctacatccatcctccttctttgtctgactaatgcataattctcaaggtgttagcttaagcctaatttcctcagagaagccttctctgaccattaacacccctttcttttttctttctttcttttttttttttttgagacagagtctcgccctgtcgcccaggctggaatgcagtggtacgatctcggctcactgcaacctctgcctcccgggttcaggcgattctcctgccccagcctcccaagtagctgggattacaggcatgcgccactacacccagctaatttttgtattttcagtagagacggggtttcactatgttggtcaggctggtctcgaactcttgacctcgtgatccgcccgccttggcctcccacagtgctgggattacaggcatgagccaccaagtccagcctaacacccctttcttaattaggttacctttgtataagtttcctattctttttttttgagatggattctcgctctgtcgccccggctggagtgagtgcagtagcacgatctcagctcactgcaacctttgtctcccccgttcaagcaattctgcctcagcctcccaaggggctggggttacaggcacgcaccaccacacccggctaatttttgtatttttgatagagacggggaaggtgttagcttaagcctaacttcttcagagaagccttctctgaccattaccactcctttcttaattaggttacctctgtttgagtttcttgttcttttttttttttttttttttttttaatatggattcttactctgtcacccaggctggagtgcagtgacgtgatcttggctcactgcaacctcggcctcccgggcaatcaattctcctgcctcagcctcccaagtagctggggttacaggtgtgcaccaccacatctggctaatttttgtgtttttagtgcccagctaatttttgtatttttagtagagacggggtttcaccatgttggccaggctgatctcgaactcctgacctcaagtgatccagctacctcaggctcccaaagtgctgggattataggcatgagccaccacacccagccttaggtttcccattcttttgggtctgtcatcatgatgtgttactttaatgttagttgaggcttgctttccctactagactgtaagtgctgtgaaaacagagcatatccgttttgttgaaaaatgtatgctttgggtagcaccatgcctggcacataaaataattcaatgaattttttgagcaatgagtgatgggaggcctggaagagctaatggtgaaaagcatagagctgaattatatacagaggagctttctagtgcaggacagaatagaggtgtagagctttagtccttgctctttctgcagcttgtaagcatcatgactttgggtaagtcagtctcttttttcctcaactggaaaatggggctcatgtgaaatgacttggtttagctcacagggtatggttaggatcaaaggtacaaattaatgtgaagtgaatgtacatatttaagaggctgcactaatgcaggctaactcactgctgaggaatgggtagagctgagtgggaaggagaagccaagccccaacaaagctccatagtccaccattggtggctagctatgtgctgagacttgttatagcagtagaaatggaggcctgtgtgtatgcctggactccagtgaactggggagatagacgtggcttgtgtatggctggtgtcacctcagattttaccttttgagaccaaggtgcctggtttctgtccccagtagttttattgtcttggtctgtaccatccacgtccttcccatcccctctttttgtcctctctcctctcaccttaaaggtttttcattttcagtttattgatttagttctaccctgtggtgggattcataatgggaaaagggagtttgaagtagctacagcctaagggtgattggaaggagttggggtggacacctgagttccttcccttcattttagagagaaccgtagtccgcggaattcttgatggctggtgggctagatgtagggttgaagaggcagctcccagctccaggctggagaattattgcctagtccaaggggtagaaagtgctgaggcagggttgggagtgagccgtggtttgggttttttggccctcatctctttttctcagaggctgaaggaaggaaaaaggctgactgcccacccttctgtttgtttgtcttgtctaatttaacttacgttatttatcaaaaagacaggttatttggaaaaccagatggacctaggcaaaaatcatctgggttttccaaacgtgaaaaattaggttctgggggcccagcaggaaaggcgtgtgtgtgtgtgtgtgtgtgtgtgtgtgtgtgtgtgtgtgtgtgtgtgtgtttgaggggagggtgaggttgagtgaatgtctctgtagttagacccagaaattgttccatgacttccaagcatactccctccttcattttccttcaagttctttatgattagaatctaaatgagaaaattaaaatcttcatgttggttgctggatgtcttaattgaccaaggattagaacccatcagggctatagaagaacagcagctgacagttttctctatctttccagccctcagtcccttacacagagtgggcaggttagtgagaggtgcagggtactgagagttttctgaaacagaaacctgtgcttcttgtcccttcaatgttattgttccaaagagttgcagcaaatatggaggttagacattagggaagaacttatcatcaactttctgatgatcaaatggctaaaagaacactgaggatccagggctgtctctccattgactatccagggaaggagctagcccagttttcttttgggcaatggtggcttgctctgtagctacaaccaggaatttgtaaaacttgtggttttgggccaggcatggtggcacatgcctgtaatcccagcactttgggaggttgaggtggggggtttgcttgaactcaggggtttgagaccagcctgggcaaaatggcgaaaccccatctctacaaaaaatacaaaaattagctgtgcatggtggcatgcacctgtggttccaactacttgggaggctgaggtaggaaatcacttgagcctggaggttgtggctgcaatgagccaaaactgcagcattgcattccagtctgggtgacagagtgagactgcctcaaaagaaaaaaaaaaaaaaaaaaaagcttgtggttttgttaccttgagcagcaacatttttaggaaggaattaaagcaggaggctattgaggcatagctcttggctgccatagaggaaatgttctggctgaaagcagaaagcaagccatccagttcatacacatatgcacacacacagaagacagccaagaccctttctggcctgagaaatctttggcggcagcaatagcacttgtcccattgtgagtggcatttttttcaaagtgtcattggactgtgaaagctacttaataacttgatctcatctgaataatctgagttaatactagcttcacagttgtgaggattaaataaaaaaaaattgtaaagtgtctgcctcaaggcctggcacagagtaaatctcaacaaatgctcgttgaatgaatgaatccatgaatctgagcattaaggcccccctcaccgtttccaaggatcagtgcataacagccccggtaactgagacttgtagactgtcccaactgagcctgcagcctgaggcatgatctaaacctgctgttcctttgacaaatatttgatgagttatggtgtggagggtggacccttccatgaaggccttgttggcctagctgttggaagcactatgcagacagtcttccagggtgggaattgcctcagagagcaccttgcccaaggtcaaggatagcccacattcaatggcaacaggtgtgtaaaggcctggccttcttagcttattttgggtcaactctgaagggccattctagcttcagagctccctgtggggttggctgaggctgtcactggcttgtcttgtagatcagcctcttcctctggccactcctgctcattctcattcttccacagctgttgatcccaaaggaggttcttaataaacatccagcacattaaacagtctcagagttggcttcctgggaaatccaagctatgaatgcactagtcctggtggccaagcctttagaacaacaaagaacggagactcctttgcaatggatttccagcgttggaggtgtggatactgtctctttatgcccaccagagggcagcagcatcctagccacctgcccttctgaggctccaggagtgggcttgaagccttttccccggcaacttcacgccccacaccagtattgggcaggatcacctcccttagggtgttcaccctcctgactaaaacaacaaaactttcttaaactgtccaggccttagttttgttagtctcaagctcctgtaccaccatcactgaaggccaatcagtcttcctactgtgccccttcccctgctcctcgtccggcaagctccgtgcctgggatcccccacctctcacacttaccacccacaatagatttgttttctgtgtgacaaggtaattacaagcttggggccagtaggcccaggggccagtctgaggatggtcacttcattctggctctccctgttctgctaacggtattgattttcagttttatttattatgatgatgtgtgtgtgtgatctggccctggtgacatgacatatggaggcaagagggcgagagcaaatttccttttgtcacaatttgacttcttgaaaccgcacccccaccaccaccacccagcattgtttatttacaggttttagcatctttgcttacctgtcttcattctgtcccctcatccccaaagatttctaagagattcttctgggaattggagccagatggatgtgactacaagaaggaggaaagggtctgggaagaggagtgacagcagcaagcatactaccttttgttagcagccattaactcatccagcaaacatttactacattcccatcacctgtcagttacttctaggctaagctccccaactccctgctgggggccatcctggagacaggttttgctatgcgctttttttttttttttttttttttttttttttgtctgcatctgtttctatgggtgtgtgaggaaaacctggccagaaagctttgagagagtgagattgagtttgggtgcaaccaactcaaagaacgatgcttgcctgaatttaaggctacttaaggcctcccgtaatgtagtctacttccttacgaggaagaggaagggcaagcttgaggcaaaacattacaagtgggagggggcactctgaactgcaatgattgccgtgggaatcagctgaggctgagggcgatttgtggggccatgtttccccagcctgtcttctctgtgcgtgccaggagaatgaataaatcattgttcaggggcgggatgcagctgccgagctcctcccctcggcacatgccccaactccagctcctccattgagggctgctggagcagagcggtttatacacccagctccccaaatcctattgaggcctccccctccgcacgagccaccggctccaagcccattcaggctggccctttgtgctgggggttaagtggttacatgtggggggcacccagaaaggaactgtcaggccttgaaaggctgtgctgatacagtgccctcctactgatgaatggggtgggtggaggagaggtgggcggccggagggtggggtgggggagagggcatggggattatggagcccacagaggcagctgctaggaagggggtggaacaggcacccccttctctctttcctccttcacttcagcttctccgtctagcttactccctctgttgtgggcactggatgatcaagagccttgggaccttggatttggcttttctgatgtcctggtgaccgcttgagtgcactggagagaaagaatttatattacctttcattcttccagcagctccgaaaagacctgtttctcccttttcccttggaaggggtgggtgagaaggggaacagtgttggggacagggggaggattcatttcctaggttcatctggtgcagtggatttgcagctgtgccctgccgaacttttaaaagcttctctgaagttccctcggagcccttaggtggagggtttaggggaagacagatctcaaactggatatattggaaagattttgttgaggaaaaagaaattacttcaaggctctaaaaatgctttaaaacttctaattgaatgtaccgccttgtcattttacagctgggaaaacagccaaaatggaagataggggaatgggcatattttacctaaggtaaacacatagtaatttcttgatagactaaagaggcactttacctttaagaagcagtagagaaatggatgaacaaaacaagtaggtcatcagcttcctaggccttcctttcccaagatgaaccaattctggggaataatgttcgttccaatctgccttaatggctctttggcatgtcaaaggtcctctggggttgtgcctggtcttgggagcccaagtgacaatgttcaccactatgttattgaacaatttttaaggcatattattttatttagcccaaaaaggttaaaatgatttgatttgcctaagttcccaaagccatgtggggaagttgacagatgatgtgacctcaggaagagagaagaaagcaggttagcaacgtagtttgtaatccaggatcgtgctttgttctgatatggaaactctgagggcttcctcagttacttccctgctgtccccaggatggagcccaagctccttgggatggtgtcaagaactttcacaactgggccaactttatcttctagcctcaccttacctccatttcccaccgagctccagccacactggcctacggggtgtttcctgaactcactctgaaaatgcagtctcctatgccttctcttgctttctcttggtgagctcttattcatccctcaaggcctggctcaaatatcacctctgtgctagctgggtttagtggctcatgcctgtaatcccagaatgttgggaggccaaggtgggaggatcacttaaggttgggagttcgagaccagcctgggtaacatagcaagactcccatctcttaaaataaaaaaaatcacctctgtgaagcctttccttacccttttctgggcttactacttttgcctcctggctctgttgcagggcccattacattgttatagcccactcttctgtctattccttttctttgagacagggtctggctctgtcacccaggctagagtgccgtggtgtgatcttggctcactgcaacctctgcctcccaagttcaagcagttctcgtgcctcagcctcccaagtagctgggattacaggcgtgtgccaccatgcccggctaatttttgtatttttagtagagacggggtttcaccatgttgatcaggctggtctcaaactcctagcctccagtgatctgtccgcttcggcctcccaaagtgctggaattacaggcatgagccaacacaccatgacttctgtttccctttctaaacaaggagctccccaagaccacgaccagttctgattctgctctgaattcccaacacagtacctggcacaaagtaagcactctgtaactgtatgatacatgtaaatgaatgggtgggaagggacaaggtctttgaagctgaaacaccttgatcttacccacccctttcttcctgagaatactgatattgagaaattatccacctatgaataacccttaggcctgtcctatttcctggatgagaaattcctctcatcttctctggtctccttgcctgacaccccaggccctgggacctggatctggctactcactgctagcctctcttggctctgacatctgtttgccaagaggcttacccgctgtccatcattgggtcttgatggcatggccttttgcaaagccctgttcaggctgatactggccatctctggaggtttctgtgtccttgccacttaagttcctggcatatatgtgggtaggtgaacccagccacagataccctttcacttgggggtgaattattctctggtgtcctcactggaaaagcctctggcaaatgaataacaggcatctctatagctgcttttttgtcttcctgtggacatggacatccctgcatttggagcttttttttcttcaggttttgagctctgaaaattatggagtgaccaggactgctgtgtgagcactgactgtattaattatacagtgctagagtattccatacaacactgcccttgattaacaaaactggctacaggctgggtgtggtggttcacgcctgtaatcccaacactttgggaggccgaggtgggcagatcacttgaggccaggaatttgagaccagcctgggcaacatagtgaaaccctgtctctattagaaatacaaaaattagccggtgcagtggcacacgcctgtagtctcagctactcaggaggctgaggcatgagaatcgcttgatcctgggaggcggacgttgcaatgaatggagattgcaccactgtactccagcctgggcaacagagtaagactccgtctcagggaaaaaaaaaagaaagagagagactacaatctgatttcctttaaatgaattcacttgacttagcaggtattgtattatttaggaataactagctttaggccaggtgtggtggctcacgcctgaaatcctagcactttgggaggccaaggcaggcagatcacctgatgtcaggagtttgagaccagcctggtcaacatggtgaaatcctgcctctactaaaaatacaaacattcaccaggtggcgggcacctgtagtcccagctactcaggaggttgaggcaggagaattgcttgaacccaggacgtggaggttgtagtgagccaagactatgccactgcactctagcctgggtgacagagagagactccatctcaaaaaaaaaaaaaaaaaaaggaataactagctttttagaacaatggaattgatgactcagctattccaggctggggtgctgccctgcagagcacgatataggctttatttattttattttaattttttttttttgagacagggtcttactctatcgcccaggctggagtgcagtggcacgatcttggctcactgcaatctctgcctcttgggttcaagcgattctcctgcttcagcctcctgaatagctgggattacagacgcgcaccaccatgcctgtctaatttttgtatttttagtagaaacggggtttcatcatgttggccaagcttgtctcgaattcccagcctcaagtgatccgcctgcctcggcctcccaaagtgctgggattacaggtgtgagccaccacaccaggcccaatataggctttaaatcaatgtatataatgctttgtcctttgtggccagaatgcataacaagaagaggtagcggtggttgtggcaccttatatgatttacctaaggactaagagttttcttcctgtctctgagattctgggtattgcaggtcagaaggtgatagcatcggccaggcacagtggctcacacctgtaatcccagcactttgggaggtcaaggcgggcagatcatttgaggtcaggaatttgaaatcagcctgaccaacatggtgaaaccctgtctctactaaaaatacaaaaattagccgggtgtggtggcacgcgcctgtaaccccagctactcgggaggctgaggcaggagaatgacttgaacctgggaggcggaggttgcagtgagctgagatcgcgccactgcactccagcctgggtgacagtgaaactctgtcttgggaaaaaaacaaaacaaaacatggtgatagcatcatgggaggaatgtttcttctaaccaagaaacacaaagatgattccctgggatttcggctcctggtagcactagaggaataggagaagggggtggtctcagtgtagactggactgatcatggctaccaaggagaaagggagttactgttacctaataagtgttgagaggtgcgtgaatggaacccagagaccctggggtcaccaccttgtgctattgtagtaatcagcattctttcaattgtcggtgaaagaaattccactcaagttaggcttggcaaaataaggcatacaaaactataagtttagatgcaggaaacagggtctgcaacattatcagaactatctctcatctctgtttcttccctgcctcgtcttcctttaatttcgtttcagaagatcccagagaaggactctgactggctcacctggagtggagctcctatccctggattcttcaggctttcatttgacccacatggttaagctgggagagacagagtccaaagagaggcggagaagggctattctgggcagaacaaacaattgatgactttatggctctgtggtctgggcagaactgcataaccctagatcaccaaagctgagagcctttaggagtgaggatttgggccaggcatggtggctcacgcctgtaatcccagcactttgggaggccgaggtgggtggatcacaaggtcaggagatcaagaccaacctgaccaacatggtgaaaccccatctctactaaaaatacaaaaattagctgacgtgatgcatgcacctgtaatcccagctactcaggaggctgaggcaggagaatcgcttgaacccgggaggtggaggttgcggtgagccgagattgcgccactgcactccagcctaggcgacagagcgagactccatctcaaaaaaaaaaaaaaaaaaaaaaaaaagtgaggatttgggtcaccccaggctgaaggccaggggaacctgaagtggataagggaagggagaagacttaggccacaggatctgatgtagaaatggggctgacgtctccacctgtattttcttagctggaggagtgtgcaaagtttgaattacttctgccttctccttcttatttccttttcccttttaaaatagtcatcataatcataaaaatttcttttccattttccctgtttttgcatataggatttcttggtgtgatttaatttgccaattagtctctaggttgcagaatggtgacttggaatcaaattgaaactggaagagggcacctcatatattagggtcagcaattactgaactctgttctcttttattccaaacagggcccccaacttcacatttccccagggtgcaaaagagtgaggggggtcaagcttcagtagagtggagctctgagaagaatccactggagtttggaacccaagacccttttttatcacgctgttcctcctcacctgggcaaaagcactggtacccacttcacaggcatcatgggtgggctctgtgtcctgcggagagcccccgtcccgggtacaggacatcagccctgagccctgtcccaggcttggatcttctttctctctctctcttttttttttttttttttttttttttgagacggagtcccactctgttgcccagactggagtgcagtggtgcagtcttggctcactgcaacctccacctcccaggttcaagcgattctcctgcctcagcctcccaagtagctgggattacaggcgcccgccaccaagcccggctaatttttgtatttttagtagagatggggtttcaccatgttggccaggctggtctcaaactcctgacctcaggttatctgcccgcctcggcctcccaaagtgctggggttacaggcgtgagccaccgcacccggcctcagtgactttagtcaagtaagcacaaaaaggaatatataattccaaattgtgataaatgctatgaagaaaaggaatgtgctctgacataaaggggggaacgaatgtgatctagggagtcagagatctctccgagaagagatctgaaataggagtaagtcgagagggggaagagaatgctagaccgagggaacagtgcgtgccaaagccgcgtggcggaaaggggcgtgtgggagggtaactgcggagagggagggtagaggacgaagccggagaggcagacgaagggcaggacgcacagagccccgcggctaccgccttaggggttgtcccggcggtggggaagccattgaggagtttaacgccggaaggtggtgactaatcagatttcacttgaaaatggcacggtgtctgcagcgaggctaactgatgggaagggcccagcgaatgccaataggagagagcaccggacctggaaggcctgggtcaacgcggccccgcgcgggggcgaagcggttccggcgcaggggcctggcgcggggctccgcggaaaaccgaaccggcccacgtgggaccggtcgctccgccctgctgcgcagacgccgcctgactccgcagtccgggactggggctgggcgcgctgcccgggagccccgcacccacgcctggaccgcggagacgcccaggccgaggaacccccagcccagggactagacaccaccagggccgggcggagccagagccagacgcgccggagcgggcgcctctacgccgtgagtccgagtctggggcccgaggcggggtggggcttggggctcagccgcgggaagcggggagtcacagtggcctccttcgaggagactagggaaggatggtctctgtctcctggggtggtctcccactcccgcaaggccagaaaaggaggctgcctcctgtttgggcggagacctagtcctggcgtgtcggggttctcattttactatctctgagaaccctgtgatccctagcgccacccccaccccatcccagcttccttcacggccccatccaagtataggaaaaataaaaaattggggcgaggggagatctctaggcaccttcccacaagccttgcttagagggcgattagaaacgaactgttcctacacccttctccccaggacttctctgcccattgctgggggtggggagggtccatgccacctatggagcgccttccagtgccggctccacttacaatacccttcctcttcatgctcttcaa

SEQ ID NO: 16198 - DNA, 78810 bp, Human
  misc_feature (1)...(78810): n = A,T,C or G
gttggcagctgtggaagctaaagaagcataagacctgattcttgacctcggacaatttacagtttagctgtggaggtaagacagggacacagaatattatgtggcaattgaaagtgtaaatattatagatttaagtagggtaaagagctcattctgtagtagaggggtcagtgaaaagtaattgttcacctggtaataagagaagatctctgtgaacaaagtctaagactgcaaacttaggactgttgggagatagtcagatagattcatatatagatacaaatctttaccatcctcagacatccgccaacttggttgtttaggttgtagggcttacatgaggaagggtgtataatagataactctaaaaatgtttgagccttagacccagtgagtgagaaagagtgtcatcatttaatattctcctgacattcacctgccccttctgcatctgtggctgtgactgaggacttggttctttatatcacccagtgttcatgaggattctctggagaaatttcttgctggtctcagtatcaagaaagggggatcttctcttgagcaattttgtttttggtcttgcatgtgataggaattgaactttagacaaggcctctctttaaacttgactgctagaaatgcaggagacaaattttggtcccacctgtagcaagggtatttgactctatgagatgcatttatttcaaatgatgttcatttttggctccatcttgtgtgcctcatttttcatttcacacacttctttttgtaggttatgtgctcttgtaagctatctcgaattctgttttaaggacaaggtagcatataaatataaggaaatatataaatgaaacagaggaaggctttaaagtccagaacactatggccaggaagacaactatgactgtggctagagttatggtctgtggccgtgataatgagtgtgttattagggcagtccagcagtgattacagggagtcagacagacctcagtccaagtcagaggtctctctgctgtttattagttgtatgatctaaggcatagcattctctaaaccttcattttctcatctttacaacagtgatctctttgtatcagggagagtggattaaatgaggtaatgtatagaaagcacttagcacaaccgcactcaatcattagctattgagattatcagcactatcacctggacaagcagcggatgggccgcccctcttggccaggtcttctgtgcgcactgacgttgtatgaaagttgtccccacatctcctacacccaccgacgccaggcggccgcgtctgggccagatatggatcacgcctgtggagcgcacctccacacaggcagccctcgtccaaggtgcagggcgcagggcacagggcacatgtctacggcccagtcctgcagacggctacctagagaccccagggcacaggttaaggcaacttcacaactgtctttccgttcctttcccctgccggactccgcgctctgatatatacaggagaggccctggaggggagaaggcgtcctcactgcagtgctccgagcagcggccgcaggaagaggcgtggaagctgcgggtcggctgcgggaaagggggtcccatgggagccgctagcgcagcccgtttcccgagctgaggtggaggtcgaaacgcacaggtgccctgcaaggcgcgggcgtggtagccgggagcccgctcctctccaactcccctgagacttaaccctttggccaagagaggtcgaaggcgggcaggggtgagagaaccgcgaggcgcaggccgggcacccgcggaaagggggcaggtttcggggaagagcggggcgccgcacgtttcctgcagccgccagcatcagcgtgtcaggtggttgccaggcgggtgtgagcgcgcgcgcgaggcagagggggcgcgctcgcacaaagtttgtgcctgcggtgcacctcggtcgggctcgccgggctcgagggctggcgggcgccggggctacgaggcccgggggggagagagccggcaggcggcggcggtggtggcgggggcgatgcgcgcgcccggccgcgctaggtgagccggcaccgggagccggccgcggccatgggcaccctgggcaaggcgagagagctccgcggtgagtagaggcgcagtggccctcgggagcgcctgtgtcctttcttgggaaagaggcccctgcccgtcgccccaacaccccgagggaagttgagggcggaggggggccggggtcggccggagtcccgggacaccagcgcgacgggcggacgtgtccagaacgcccgcgcgcccggggtttcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcggctgacgtggggccattgttcatcatgtactccactctcacttccttcccaacctgaataaactgcaaagttccttacaccatttcagcagtcagatttactcggctttagcaggccaccatgactatttcctgaataaggatttttcttctttctgtttcactattgaaaaaagagggacgagaaacatgtttatcacaccaccttccttccttccatacctgttgtgcaactgccggccgagttcaagactgtttttctaatcttcaaagaatcatgttatcaacctgaaaaatacatgactgattctgaagtccttcccgccaaataaccaagcctaattcaatccccttaacagaccttccaaaggcaacgacaatatattgtgttctggaatatgttgaactgaaaacaatggcttaaaatcccaaagctgtaaaagtcccgttgagtctaatagtcttttatccattatcaagcagcattggttaagcccttaattgtatctgacactgtgctaggcagtgctcaagaagaattacagcgaccaaactctcccttccattagagcttacaacacctgagaaacatactgttcaggaaatatatatatatatatacacacacacacacacacacacacacacatatatatacaaaggacagggtgataaataccgaaggcatgcaggaagagtaagtttttataccatgtagagtttgagtaagtgcacctcatgggtgaggacataggtcaaggagaacagccaccatttgttcaagtccctcacgggccaagggaatgctgcgggaagtcagtaaggtaagatctcagggttttgtgtattatgtactgcagagtttctcatcacagtacatgaaagaggcaaaaaagaaaagacgctctgtgtctggaaggaacagaagccagcaccttttgtctgtctctcttcttgctctttggttatcagttgacccatctatggggctgggacatggaaattgggctacagaggaaatggagccaggaatcagcagcagactttatgagggagaaaagcccatagcaaaatatatgcctgtgcttccgtaggtctctttaagaggtcatctgacagtagaacagagtgaggctaatgcttctcctgaagtttaccttactggttagtttctcaggtttgtagagaaaagtggtgctttagattaaagcagtctagctagctttttgttaatgagtttagatgtcttctcattttaaacccacgaaaaactgtacagaagtgtggaggggaaattattatcattattattattgggactcttttgcctcagaccgtaatttcagctactccacccagcaacttgaataaaagagggaaagaaactgttttaaagagaaagactgaataattgttaatttagtttctactgcctctcaacctcaccttcttgctttcaggaggtttgaattggctacagctgtgctgtccaatgcactggccacatgtggctattttcgtatacatttcaattaaagttaaatgtaagatttcatttctaagcctcaccaaccataggcgaagtgtgcaatagccacaaatggcacctactgttggacagaggagagagcacttccattgttgcaaaaaagtcagttggacaatgctggagagggtagatgtttgtcgcaaaggaaaaaagaatagattttctacaaactgtgggatttgcattttgctagcatttctagataagagtctgagtattgcttaaagcatcgtgggcattcagaagtctcactgatggctatctctttagcattattaaccattaattaccacccacactgttctcagaagaaggacttatattgcttttaagggcagtggctagtacatataaattaagagcactttcaaaggcctctagcaagcctctcagtgtcacatacaaggttacagatctgtgactagaaacttacggccttgagtcatagttcattgctttaaccatgaaacaacccactcccgccttctgttctaaccagagatcatgctttacattctcagcatattattgctagttaatcctctcttcagctgagcataataaggcaaatcatcacaacctggttacacttatgtcaaatatatgtgaatcacaccatctgtttcagaggtagaaaagacctatgagatcatctgggcttttattttttttccctttacaagagggctgccagcatttggggccaaatggaaggcttcaaatgtctgaattcacaaagctctttccttatctccctctcaatgcaagacaacttctgacagcatcggaaagaaaactgcacacctgcctcagaacgggcccccccaacacacatacacaactccaccccagcaagcagacctcctactcccagtgagacgtgggaagaaactccatgtttcatcttacctattagtgtgaagggaaatgcttcctaatatcttctatttatggactgacttattttttcttagagttccatttgtattgattttcttttatactgagaacagctctgaaataggcaggtcagatattactctctccattgaacaaacaggaaaataaacctttgagaactgaaagaatttgccttgtgcccccagtctcaagagaggatatgctgctcctgttctccttcccctacccctagcagccacttgcaacctgggttggggcaagcctggatctctctcctaagacaggccttcctacactcaggggagacctgcatgccacataggacagggctgcacctggtgcccactcttctgcaatcctggtgtctccccagttagaaatgaaactccattcaatgtaagaaatattgattgcacccaatctatataccaggtgtctgcctgatattctctattgagcaaagtgtgaatcagtgaattcttgtgtgaattgtactaatgctatccaaagaccttccaaactagaaataccccaaaactaataagtatgttttctccaccatgggagcagttggatattaaaagcattttataggcctcagcttattgaaagtaaaacattccgtctcttttcaaaatgggagccgcaaaaggcaaacacacactcagggccatagccctctccgtaacaaaggaaagattaggtatttcttaccactctgcaacttggtctgtgcaccaaagcaaggtgcccagagggcaacaggagcataagaccagaagccaagggccatgacatcattggggatgcagacctaataacaggcaacaccaaggaacaaagtcagttgtagtgtcaggaaggggccgaagccttagccactgttgatggcaggccctgtgtgaagaacacagctttcccagaagcctcctcagtggaacctcccagtcgctagtagtcgtggctacaagatttcacgtgtaaaggatggtcctcgggggcacttgcatcctgaggcttctagtcatcagagcagctcccaggccgctcttagccctctagaatgaattagcattattataagactggacactatttattccaaggaggcctttgctgcatctttgatgagcaggcatcaccagttctccacgctggtctgccttctcatgagcatgggtttcagtgactgccaggcctgagaaaggaggagatgggaaatccccttcattcatatctgtgctctcctgcttggcagtgtttgttgcaggccccgctgtagagaacagaggcaatgcttatgcgtaagttagacagtgtctcaggaattctgagcagttcaattcagtaaagccatccagagagatgagttttacttctgagagagctggagacagacagtagtttaacacttattgtggactctgtaggatcctgagcctttacctaacttgacccaattaatcctcccaacaaccctatgaggtggttgttattttgctcctttaactaatagagaattgtagctcagggaagttaaatgacctgtggaaagtggttcagctcattagtgagagagctgctgagatgtgaactctggtcagtcttcccccgaggttcgcgttctttctgctactccagagattctccaactttggcgtgaggaataatcagggagtgtgttgaacattcaaattcctcacagtcaaccccagagattgccattcagccagcagtcactggtttggatggaggtgacccatgaatggatgttgagaaatactgtcgtatagcacacttgcttcctgaacatcccagatcatttttctcagacatcctaggaaaacctgaagggcacaaatctccagggaagcaatagagcatataggtttttcagctatgtgaactagaaaagcacatggtgaagccagcctcttggagatctctaaaacaatccagccagatctaatgagatccctgcctaagagcaggtctgaaaccctgggagcacttttatcagatttttctgcattcctatctcttctcaactgcagtaagccccctataaaatgtacagcacgcctgtctgttggctgtgtaaatagaatgtggatgtctgttacaactacagtttgattcttgcattcaaaggccatattcctagtgtacatttccacctttattcaacactccagtttcctatggtgctgggagggtctactccgtaacttatgcccgtccccatgggtcagaggactacagtagtggcttagctggggaggaactggggagtgcttctcctgagtacttacccaaaagtactactttggcaacagattatgtaaggcaatatgttgaactgaagtttatgaaatctgtgatgaaaacacattgggaaactgtgtgaaagcaaaaacagtcttttcagtaattgacagaaacagctgtgttggaccctgagacccctggagaaggtcatctacagttcgggccccagccgcagcccacctgctgatgttagaacttgtccactcctgcccggaacaattatagctgctgtgtcttgttctggagttacagtgagctttggctacaacctagttgggcttgccctagagtggctggaaggaaaagaacggggaaagagtgagaatgtaagcagagccagcttcctgggcatgccacctctgaaggcccacaggttcccatgcttggtttaatgctgtcacagtcttgaaatttttaataatttttgaataagggaccatcatttttaattgcactgagtcccaccaactatgtagtcagaggtctgtgtaagagccacaagaccagagggcaaaaataatttgccatatattgaagacacatagaacgatgtggatttatgtcttaatttctttcttcatagatgcaactgtgaaacaaaaattatttcattatctcctagcagtggtgtgctgggctggctcataccagctcacaagagcagattgttaaattttcaggaattttgcaagctagttattaaacacagccatgattgaaaattaagttatatatgcttacaattaaattatattaaaaacaaagataagaaatactcaaaactcaccacttcctaattcatgactacattttactattatctttgcttttgaggttatgtctgttatgtctacctggtacaaacgctatataatggtatgctagcatgcatcttttcccagctccgtgttcagtgaagtcatgttagtagcttgttagtagtctgttgggagtatttacaccgtggaaatcaacaaacatcactaatcagggcttccttttcaatccctcccctggagagcccattgttaaacatttaccagcacaccactgtttcccagatacagagggtgcttacataacaaaatgttgaggtgggaagggaccctaaaagctgagacttctattttttatctcttaattaagagaaagtaataattctgctattattttgctttcatctatgtatcttataaaacaacctctctgtgtgttcttcaaaggaaaggaacaatggaccttagagataaggaaatcatgtatcagtgtggttgagaagttttcttaaagaagtgacaatggaacatgaaaacagcatgagagattctcattctgaagtcaaagttatttcgtgtttgtattgttttaattcacctctaaaatatctcttaagattaaccagcctcgtttctgaccaaccctcaattttgtgaacttttgttcttcatgtattatatgctatctctattttgatttctgattccatctgcttaatcatttgccttcattacccactgcatggtaacaggcactactggtgtctataaccaagcttttgttgagtatgttttcataagtttgtttgcctactgtatttccagttttatgaacggtctgttcatatcctttgcctatttatcacttgctgctcaatgcttttattattagaggcgtgcaaaagctttttatataaaaagctgttaactctttgaatatcatttactataggcattttttttcctgttctcattttcatttttatgttggttttgatattgtcatgtatagaaacttcggatttttgtgtttaaatttgcccatttctatttagctttttaaaattctaaaccttaaaaaaatccctattccaaagatttaattaatagtccattgtcattttaatcagttttacttaacccagtgtataattccatatcatacattgtcgtggatgatcaatacaagcttgtcaataagttattgctggcaaaaaagaagccttcagttttgtttctgagattgtcatttccttaaaaccacagcgcttggactggtcgctttgtaactcagagcctccgtttctcgctgtgataccattaaaatgatttctgagacttaaagtgtctggaagaaggtgtaatggggtatctccatcacgatattaaacttgaagaaagtccttcaggaatttgcatattttaagaatgtgcttttggatatatttgaagagtcaatattcttaggatggagtcttagaaacccaacaaatttttaactcagtctttaaaaattattaatttagactgtttcttgttcttacatagactttgtggtaagatatacataagatcaaccactagcatagacttttaaaatattattttagtaatagctaacttttgagcatttactatgaataacacagtgtttatgttaatattttacatatgtagtctcatttagttcccactattttataagttcttgtatttgcaaagatctaactgtccctcagcatttatacttactttataaatgttaataacttttaaaattattcatgttcaccatagagaacgtagaaaatacagactggcaaaaagaaaaaaattaccgtcactcattttaccatcaagagcaagataagcactatcaactttcatgggtgtgcctttcttgattctcttctatggatatttacatgtattataatcacagtaactttttggtgataaactcactataactttttgcttcccataatttatatcttaaacaattttgatcttgaaatcaatattattatttataaagaggtatgctagcacacaaggttgctcttctattttaaaattgattttttaaaaataattctgcttagtcccttcaaatataggacataaaagtgaaggttgcttggcaactgaaatgatggtaatgaggaattaaagacattacaagaaaagaagagtactcagttcttttcaatgctacatgctaattgcagtaactatggctgattacagttgtaataaatgaaggaaacacaaaacttccattaaaaattcttgatgtgaacttttttttattttgtattacagtgaaagtgagatggggtttgctgaagagaaactttactttcagaaacaagaaaagatcttttgtctgtattaacttttttttcttttcttttctttttttttttttttttggcgacagagtctcacccaggctggagtatggtggcatgatctgggctcactgcaacctccacctcctgggttcaagtgattctcgtgcctcagccacccgagtagctgggtgtgcaccaccagagccagctaatttttctatttttagtagagatggggtttcaccatgttgcccaggctggccttgaactcctgagctcaagagatccacctgcctcgtcctctcaaagtgctgggattacaggcatgagccactgtgcccagcctattaaccttctaagggaatattaagttagcaactgggtgagatacgtagcagaagcacaaagatttggtacatctgtgattcttcagcagcacagaagagatggtgggcagtggtgtgaaggaagccatgttaactacttgtttttttttccccaaagagtagtcaagggccctggagagattgctgaggttctcactagagccttcaagcagaagatgcttcctaggatggagatgtacttagaaggacaccagtgattcattgaaatggacaaagggagtagagactagagggggaagagggaagcagagggaaagagggaagcagaggggaagagggaagcagggattgccggttttgtaacaaagaatgcagtcaccagaaaagtaaggcagtttgggatgaagccatccaagaacttatcaaaggtatatctttgccagaaagtgaggatttctagttggaggagcaaatggagctatgtctgtctcctcttcactgatctatctgaatcatggtataggacttggttttgtaatcttgtgaacagcctcattttaagggggaacccacaatattcaggaagccaagaaatgtccctgttaatcatctatgagtctatcttgctggaatgtagttatagactatggaacatccttaaatctgatgagcaattaatcactggttaattttggattcacttattaaatgccaaatgcataggggatttttcacactctctgcccttcctccttcccagttcatgagcaccacaattggattccatatttacttcatccaaacctaccttggtgggttcaccatttacctccagtcctggggagttcagtccagactgtgaattactgccatttctgaggggctgcttcccagatgggagccataggaccctcgcctctggccctggactcagtcttcgtttattgccaaggatgagcacttgctctcgggaatggatgctggggtccacctgactgtttggcttgctttaatccctaaaggaaaagctccctacatttattgtgtctgtggtccccccaccctctctgtcccagtgcctaagagtctcattaccttgtcagtaactaccagtgtctacctgagatggactaagcttcatttaactgagaaagtgcaccctcaaaattgcaaggagaaatgttggaggaggaccctctggattaaaagagacttaaaagacatttcaaacagtcatagtatgtgaaccttttttctaaaaattatgtgtgtgtacacatacacactcataggagtatagatggatccacatctgctgtatgctgatcattgttgcagctggctgagtgcatggaggtcccttacgttgttttgctcactatggtatacatgcttataattttccataatctttttttgagacagggtcttgctgtgtcacacaggatggaacacagtgatgccatcttggctcactgcagtctctgccttcccagctcaagtgatcctttcacctcagccttctgagtagctgggactataagcatgtgccaccatgtctggctaatttgtgtgtgtatgcgtatttttttgtagagacagggtctcactgtgttgctcaggctggccccaaactcctgggctcaagtgatctgctcacctcagccttccaaagtattgggattacaggcatgagccactgcacccgacctctaacaatatattaaaattaaaagtgtcctcaaacctaggacaaatagatgatttaggattacaaaaattcaaacggattttaggaaatttctctaaattttcttaggtggcaaaatagagtggctgtgtctgttttaaagaagggagaggaaaataaagaatgaaaatggttactttggttacacatcatgaaaataattcacccgtgtcatgtacttgacatctcgtgtcacagcgcattccccaatcagcactgagatgctcaattcctgggtatccaaaaagaccaaaaaaaaaaaaaaaacctggaaacttgtaatctttaatgctactgtcagaggcgggagttggagttgagtaagtaagagaatgtaatactctcctccacaccccatctcacacacacacacacgcgcgcgcgcacacacacacagttttgagcagggaaatgtcatgactgtgccacagctgatttcagcaagcggtgaaaagattatggaggccacgtcacatggcagtctttggaatctgaagctgagtcactgagtctgccatttaccacatgtggggcttgtttgcccgtttttaaaatggagaataatggtaaaaaattttaaaggtggttttactttgggtggaaatttaacaagattgtcttagtttgagttttcccaggagcagatcctgagacaaggatttttaagtacaaatagtttactttggaaggtggtcctaggaaaaactggtaggggagtagggaaggcagctcttggagggtgcattgccaagttacaactctgggagtcagagtggaaggctcttttcagacctatcttatctgagggaaaggaactggagcattgatgtaccaagtcccatcggtcattggttgagggctgcttttagagggtgttaagtttgcagcacatttggcctgccctgcacacaggtgggggtgtgaagggcttccagaaacctctcaggctggtggaagttgagttggcatgcattacaatgggaaggtctgagagtatgtgtgtgggaacttacaggctctgctacgaagtcaaaaagtaaatgttagatgggcaaatataggctacatgaaaatccacataaacagtttcaaagctagtttatagtcgtactcaaagtgtatacatgtagatatgagtattgaaggatgtccttctgcaggtgaaccatttatgagtggctgtggacattttcatcagatttaaacacaatctgtgtttttggttagacacactgtgggaaatagcataattagcagaattcaggatgtgaataacatagcacaaagaacttagacaaacaggacttcaataaaacgtaaagtctcgcacttaagtttaaaaatagtgcttcctatatgttctggatggggggaagctgtattaattgtagttcttatgaccaataccaagagattttagtagattgtaaattcaacatgagtcagtagtgtcgtgtgtcttccccagaatattaactttccaaaagttaaaataattagagattgcctcaacagaaatagcctttccatgttaagggagtaatgcctccattctatcctgaggtccagtcctaatgctgacacatagtaactttattcccttagccggtgtcttaatgtttcggagactcagtttctatcaacctgaaagttagtagatacttcccctggattgtcgtgaagtaagcatcttaccagaaagttagaatttatggcccagcacggtggctcacgcctgtaatcccagcactttgggaggccgaggtggcaggcgaatcgtgaggtcaagagatcgaaaccatcctggccaacatggtgaaactccgtctctactaaaaatacaaaaattagctgggtgtggtggtgcacacctgtagccccagccgcaacagaatactctggaggctgaggcaagagaatcacttgaacccaggaggcagaggttgcagtgagccaagattgcgccaccgcactccagcctggtgacagagcgggactccatctcaaaaataaataaataaataaataaagttataatttatgtaaaatgttattaaaattccaatctgcagtacatactcaaaaacagtagcaatcattattagtatagacttgttaagtgttagtgtatggctttttcaggttaataatgcagcttgccagaggatccaaaatcacatcatggagatacaagatggttataatggctatgccaaaaaaattaccaggatggtgtcataatagacacgaacagctatgagactagaagagagtgttataatttaaattttcccatgaatttgagctgtattaatgcagtgtttagtaaggaagacctgaaaagtctctcatttttcaaaatattaggacaatgatggaaatccaaccagaactatctttgggaatttattagaaataatatggagtatttcatatatctaaaacacaggaagagtacaggatgcctgcaggccttaggagtgcctgaaattaggtactataatacttttaggagactattgcatatgttctgtgtatgtatgtgtctcttctctgtctgacttgcttctctctgcttgtcagctcatcattttctttcactgaagatttgttttctacatggcactaacagctgtaaatcatgcatctcttaccattagaaatttaatatttttttccctcaagttcagtgaaaaaaaaaaaactgtcagggaagaactttggttcagatttggccaggtggctactgcttgaatgaattgactgtggccacagggttggagtcatttaataatccagcatttctctctaaaaccacatgacggaatctggggaaggagcgtttcctaaaggaaggctattgtgctgggcatatgaagcagtatctgtcataaccaagatctgaccaaacactagagtgcagcatgctattagattcaagtttagtttctggattttaagatgggaatggaaaggctagagagagtgcagaggagataaatagttaagaaattatacagaaataacatctgtgaggatataagatggcagaacctgaaaagaagacaaataagtgggttttcccctttgttttcttaataatgtaaacatgtatgtctcaatagtaataaccatagaagagctagtatgagttatttacctccagtgggacatataaagggtaaacaaatttaaatctaccaaagaactgggacttcccataaaaaaattaaacatcaaaaggagaactttcatatctgaccatagtggaatactggatattagaattattttcctgctaccaacagctataaaactggacaaaatatctgaagcaactatttttgggtctcagaaaacaagacagacatgtgattgtggataaaataaaaagatgtgaggttaactcaaaactcctcttggctttctgcctgagagcactttacaaatcatggtacaggaaactggagcccagtgagcagcatcttgccttgcggagtatcttagttcgttttctgctgctgcaacagaataccagactgggtaatttataaagagatttatttggcttatgattctggaggctgggaagtgcaaaatgaagggaccacatcttgttatgtcataacatggcagaaggcatcacacagacagagagagtgcttgcaagacagagaagaagggggccaaactcccaagataactaaccctttcccaagatatggagttaatccattcatgagggtgaacccctcgtgacccagtcacctcttaaaggcctcacctcctaatactgttacaatgacaatattaaatttcaacaaattttggagggacattcaaaccacagcacagagagaacagtttgtgttcagggattctgggatggctggcatttgtggagtggcatacaagagagaaggtatttccaaagactaaactgtgcatggatatgatgagactctacgacccctaatagttcctgggggtctttgagttaaaggaggtctcatggtctgggaaataacgcagttccaaccagccaaaatggagagacataacactttgggcattcaggtgggatgagaaaaagactacaatgtaggagttgggctactttagccctagaatatgagctaatcttgactcaccctaatgaagcctaaatctgagcttcaacaggattaatttaaggtcccatgaattaaataccaccataaaggaacatattaataattcaaattatcaatattgcacttacaatgcccagcatgtaataaaaattataagacagaaaaagaagcaggaaaatgtgactcataaccagaacaaaaaagatcaatagaaatgaactcagagatgacacaaatgttggaattagtagatagagaatttaaagcagctattataaataaatatgttggaggatttaaagtaagatgaatagatgtaagtaaagtaagatgaccttagcagataaattgcaacaattaaaggaaccaaatggaattctagaactgaaaaataaaatataccaaaaagaaaaattaactggatgggcttaatactatagtggatgcaaaaaaaaaaaaagaaaaaaagaaaaaaagaaaggtcagtaaagtcaatgacaggtcaatatctcagagagaaaatgctgaaaaaaaaaaaaaaaaaaaagactagagtttcagatgatgtaaccagagtttaaatggacatgaaaggacctggaataaccagaatcttgaaaaagaatgaagtggaaaatttacactacctgttttcaagacttaatataaagctatagtaatcaagtccatgtgatatacatataaggatagacaaatatatcagtggtacagaatagcacgttctggaagaaatctacatatacggtcagttgatcctcagcaaaggcaccagggcaggttaacgaagaaaggagtatcctctcaacaaatggtgatggaacaaatgacagtcatgaaaaaaaatgaactgtgacctgtgtctcacaccatacacaaaaaatgagatgaatcaaatgatgtaactgtaaataatgttaacctgaatgtaaagttaaaacgataagtcttctagaaggaaatttaggacaatgtttttgcaaacttagagtattttttagacaggacacaaaggactaaccataaataatatatttagcaaattggactttataaaaatcaaaaacttctcatcaaaagataccattaaagaaatgaaggaagaaaaatactggggaatatatatatgtnnnnnnnnnnnnnnnnnnnntatatatgtatgtgtgtatatatatatatacacacacatatatatacacacatatatatgtgtatatatatacacatatatgtgtatatatatacacatatatgtatatatctgacaagaacttcattttatgctagtatacaaaggaaaattccctgtggcccagatgaattgccattattgggaccctctggctcacaccagattgatttctgatcatgcttttgaaattagaattaaccaagccccatcaaggagtctgtaatataggcaggcaccaaatcagctgtgttaagtacttcccttgcatgttgccctgagaacaggcgaaagacttcactgccgatttctgaaattggaagaggtcttcatggggtcatctagtatagcttgtagatctactccagggcaaggatgaactcaatggtctaaatcagtctaatcaaacttgatctgatcccttgggagctttttaagaatgcaaattctctgctccatccctggatctcttgatggagtaggtattaggtaaggccttggaatctattttgagttccgttggtggttttttgtttgttgttttgtttaggccagtcaatgaagcagtgagagtggagaagaaacaaagaaacctgtaactggttgtgatcaattagttgtaaacaccacttcagtcagaccagtttttgttctgcttttgttgttattttttagtttagtgtgttgtttgtttgagacagggccttgcctctgtgtcacccaagctggattgcagtgacagtatcagcttattgaagacttgaactcctgggttcaagtgatcctcccatctcggcctcccagagtgctgggattataggcacctaatgggtaagctgccaccccaggcccagccttagttttgttggtaagctaatcaggaggtcttgaaaagtctcacctgcctcttagtctatcagaatctgacccttccttcaaggtccatctcaaatgctaccatctttatgaagctttagccatttcttccagtcaaatctgactttccccttcctctgaactgcccgtgtttacctccctctaggccctgactgtaccatgtactgtagtattgcctgtagcttcttcaggcttgggacagggtgcttattatatctgcaatcccacagtacctatcacagtgctctttgagcaaagaactctggtcttgtgatgagaaaagccaagtctaggatgccagctctgccacttgatggtattatccgtgggttagtgatttatccaggggtgacattcagaatatttatgtgtgtgtgtatatatatatatgaatgaataaatgacagggtcttgctctatcacccagtctggagtgcagtggcacaatcacggctcagtgcagcctccacttccctggctcaaatgatcctcttacctcagcctcccaaatagctgggaccatagtcatgagccaccatgccagctaatatttttttattctcagtagagatgaggtcctgctgcgttgcccaggctggtctcaaactcctgagctcaggtgatcctcccgccccagactccccaagtgctgtgattacacgtcaccacacctggccttcaaaatatttaaccagcatggcacatgtcccttcatttagacgcccgctggccaggctggggattagccctgtctttatgcttttattgtcggtaaagtggatacagtccctacccacctcaaaaggttgttgtgatggtcaaatgagataatgcatgtgaaagtactctgtaaagtacaaagtgctatacaaatgtaagtcagggttgcctggtggtatttctagtgcccgtgtgtggggttggttgcccagccctcaacatggtctcatggtctgctctgctctgctcagagcagtctcccaggagcaaaccaaggagttgttgagtaattgagcaggacactgcaaatctgagaaatcctggaatcagcctgttaggtcctaaggaaactcagaatatcagctccttcaaggatggcccctttttaggcctgaaaaatatcaatgtttcagtacatatattttggaaaagctaaataaaacaaaaacctaaaaaggctttttgaattttaacctaagttttccttatttgaggacaccttgttctattgcacaatgaccttaaaattcaggatccttaaagatatctgggcatctcagactcatctgattgtcaccatatggcaaggagctgctctgcctagatctgtaaatggagttaaatgccagagacattaacatagattaaagggacagtctaaatcttagtcactgctttgtctttatagtttcttgcctcctctttttacccttttacttccttaaaaactgtcttaatttcctcaccatcgccttcccacatgccctcaggtctgcagatcctggggatacaaatccttagccacttttctcttccaaatgcatttcactctttcctcatattcagtgcccagttactgttttgtgtttatcattagttgccagtcaatgttaatgtttgttcttatatgctttgatttaaatgaaggaaatggccccagtgtagtgtgtacagcagagaactagagactgtagggaacagacagaaaatagacacaacccttttacttactcttgaaggattcccatttaaaaggcaatgcagggatggccacagtgactcatgcctataatcccagaactttggccggccgaggtgggaggatcgcttgagcccaggagttcaagaccagcctgggcaacacagcaggacctcatctctacaaaatataataataataaaaaagaattagcctggcatggtgatgtgtgcctatagtcccagatacttaggaggctgaggtgggaaggttacttgagcccaggaagtcaagtgtgcagtgagccatgattataccactgcactccggcctgggcaatagagtgagaccttgtctcaaaaaataaaaataaaaacaaacggcaaagatgagttcatgtcctttgtagggacatggatgaaattggaaatcatcattctcagtaaactatcgcaagaacaaaaaaccaaacaccgcatattctcactcataggtgggaattgaacaatgagaacacatggacacaggaaggggaacatcacactctggggactgttgtggggtgggaggagcggggagggatagcattgggagatatacctaatgctagatgacgagttagtgggtgcggcacaccagcatggcacatgtatacatatgtaactaacctgcacattgtgcacatgtaccctaaaacttaaagtataataataataaataaataaataaaaacaaaaaaaaaacggcaatgcaggactgtggtagatattaataactttaaaacataatgataaaataaccagggtgataatttgtagccccttcttgctacttcctagctgtgggacattgactagatatttttacctctcttgactctgtttcttcatgtgtgaaacagagaaaacatcgatcatgcagaattgtagtaaatattgagagcatgtctgtaacatggcctagttcactcctggcacatggtggatggttcagtatatggtggcatttattatattctcatttagcatgcaggccagctctgggaaaccctcaatacccaggtagactatgtgctttttatctttacagctgtcagggtgagaggcagtggtatctggtggaaagggcagggtttacctcagaagactggaactcaagtcacagcactgtcactcataagatgggtgactttaggcaagtcataccaccttactctctgtttcctcacctataaaataatgcaaataatacccatctctcagagttgtgaggctcagatgaggcaacgtgtgaggagagtggtcattcataaaacgctaataaatagaggttattagtacttcagcaccagggtgagggtttcatgtgcctacgtgacaactgtcaggcaccgtaactatttgggacccacaagttaaccagacatccgtggtgtgaactcagttcagaaccttgttctcctcaaaagatattaacacttttttcttatcttgagtgccatctctggattatctctctgttggaaggggtgggcgtaagacattatgaagctctcattctgcaaagagcaaattgaggctcagaaacaatcagggccatcccagagccaggcagcctgggtttgaatctcaggtctactacttactagctgtgtaaacttggacaaattaccttacttccttgcctcagtttcttcatctgtcagatggcacctgtctcacagggttaatatacgtaaaggctgtcttgaaacagtgtctggtacacaggaagtgctccaagtatgttagcaaaaagagaagacgggggtggctaaaccttgaatgtagttcatttcttctggttagatgctgcatttcttccaacaatctcaaatatttctcctggtctcccccatcttccaataagtaacaacattgttagtttcagtgttgcattttggctatttctgtaggacagtgatacaacacatcaattcatgacttaggatgttctgaagcacattcttttttgtttcattttgtttatggagacagagtcttgctctatcccccaggctagagtgcagtggtgcaatcttggctcactgcaacctccgcctcccaggttcaagctattctcatgcctcagcctcctgagtagctgagattacaggcgcccaccaccacacccagctaatttttgtatttttagtagagacgaggttttgtcatgttggctaggctggtcttgaactcctgacctcgggtaatctgcctgcctcagcctcccaaagtgctgggattacaggcatgagccaccgtgcccagccccttgaagcacattcctattcagctcttgactactgaatagagaccagtttctttcctttgaatagtaagagattcctcactcaccggtgcagttctcacttcagagtggctctccaggtcctcctgctcacttctctctagcacctctgtaaactcttgagggttctggcgttgggggagtgcgcttaaaacctaggattgaagggaagcttggaaggctactaatatagttgggatgttgttcctgcccaaatctcatgttgaaatgtaatgttggagatggggcctggtgggagatgcctggatcatgggggtaggtttctcatgaatggtttagtaccctcctcttggtactgtccccatgatagtgagttctcatgagatatatgtccctctgggaagctaggacagggccccactgctcctgcttcccttgcctggctcatgtctatagtgctgcatgggaatggtcaatgtctatgagccatggggttgcgtgcatggcagctcatcaaagaatcaaactgtagcataactacccagccagatgtgtggcacttcctccctctccctcttgctcctgctttcaccatgtgacgtgcctgctttttcaccctctaccatgattgtaagcttcctgagggcttcccagaagcaaatgctgctatgtttcttattcagcctgcagaaccttgaaccaattaaatttcttttctttataaattatattttctttatagcaatgcaagaatggactaacacagccaccaactaactgccaaggaggaccccatgcttgaggggtccagtctcgctggcacagtgatgaactacagtggacagccactccttgagtagtggtcatagttaagggacaaaaaaatcatggttccagtctggaatagccaaacaaagaaaaaaaatagccagaacaaaggaaaaaaaaacaaaatagtgcttaaatctagcaagagaaataagaataattcatcactgttatagtgcttcacacttttctaagcatttttatgtatttaatcaaacatcatctaatcctaaccacaaccaaagaaggggtgaggaaactttcagaataatttctatctgatttcaaaagactctgttcagttactttttaccctacatggtgatgtgatgtttttttgtacgagactgttcattgcagagaattataagcaattaaagaacagtttctgtggtgaaaagcatattttacaataagactatggtcagtggatttctattttatgtcagcatacactgtttcccacaattccatcatgcactggaatgaggttatctattatctaggcttgtgggtctgatgggaccaagtcactcattgagaaaaattgtctgaggaaggctgaggtcatggctaaccagtaattctcagatgggccttatattattttgttgtgtaagtatttgggaagttctccaagttgcttcttcgtgcctattgggcatgtctgaaaatatgcaaaaaaggccaagaatttaatagataagaatgacgtgatacaaatatgctccagtgagcaaggtaagagcctgacccagattttcttcccagtttgtttatttctttttctttgggtccactggccctttgccagccctcctcccagcaagctgctggcagctctctgtgtccttctgggaagctaggacagggccccgctgctccttcttcccttgcctggctcatgtctatagtgctgcatgggaatggtcaatgtctatgagccatggggttgcgtgcatggcagctcatcaaagaatcaaactgtagcataactacccagccagataattcaattgttcctagagagtttgatgggacccagaagaagtagccaccaggtatattcagtcggcactgacttcaacaaatgctcttagagtttgaagtcatagcgttgtcccagagtcagctcactgggtctgctcgggacttgcagtacctcttccctgctcttctgtttatttcctagccccagtccccaaaccccacccacagacttgtgtccaatttccagaactgaagaggaccaacttccctcctgacttctgagactcatgattcttcagacatgacaagtccagatcgagactgcaatccccaaggaaggccagctgtcttgctcagcagagacaatacagctaaaagctctttctcactttaggcaattcatgcacttggttagacatttatagacttcaactgctcatccaaaaaatctaggtcattctttacatagagcttcacactttggaaggaaagccaggcccagggaggagcgtttctgttgatgtctggtttggctgaggcagtagagagtgcttctgctgtgggaagagggagagatggaccagcgcaggcactgtgggcccttaggggacgtgaattttcaccccctggccactgactcacagagtctctgagtaaatggtgccaataatagctgccttgtgttgatgtcatgaaaagtggtgggtttaaggattaggctttctaaggacatttttaaagtatgtaccataattccagtgagaagggctgggtgggtctgttgggggtgtagggcttcctggggaggaagaaagaatagaggtgtgggtgagaggtttagccatgtaacatggatggccaaaatggtagagctcttccaagtatattcctacctgcctcctaagccccgaggagaaggacatgccaaagaaagagccttgggctgggagtgagagggcccttcttgtggaggttcctctactcaccatggctgaggcatgttgcttcagttttctcatttttaaatttcagctcatggttctgctgctgcattgagctgctgtacaatgcaaatgttcaacacaagtgaagctgtttgttgaacctaagtgccacaaaaacgtaacatatcattatcaggtgttctcacccagagagaatagtgtggttcttcagccactcgcttgcttcagggatggtttgtgtgggcatgtgctcattttgtacaggtctgttcctgtgtacctagatgctgtgcaacttgaaaggcctgctcctccttcctgctctactactctggccccagcaggacagtgaatatcaatagaacagaggcaggaagcatgggttcttttccttcaagtcttttccacgttggcttctctgcaacaggagttgagggaggcttggttagaacaaatcacctttgtctgggggtgggttaaccagatttttccctcttctgtgtctgtggccttggttgtggcaccagctgtcatcactgccccagcagttgggtgggagagaagagatgagcctggccagcccctctcctgctttagtaagactccgcttaaaggcctgttgtaaaagtttgaaattgcaggtcagggttaatttaaagcttgtgtattgtccatgttatggtgtcccccagccattacaagtaaataattaaaagccaattgtaaccaagatattcagagctccataaattcctggacaccataatatgacaagaaatagacactagtctaactatatggcaggctgtcctatgtgggccagggtatgacataccaggttatcccagaaagaagaacaggacaagctttacaaggaactgagcttcccttctcccaaattctcaccttatattaacatttttgttcttggtttagagcaccaaccacttcaagaaactgctgttgcaatgtggatttctctgagaggattcacccttgaagtccttgtctcctgcagaggaatttgttgatctggattaactgtccagtcattgggcaaggcccagagggcatgagattaggagtgagatgaggagtggaatgggttcaggaacacctggggagcaaggaaaccagacaggaaggaatacaaaaggaagcccagcaagcaccagccctcttgaggaggcttgcagctgctgtgggtgcatgctggaggtggcccacacctgtcctgagagctgactgcaagcatctcttcctaggtgcatgttcagtgacttcatgttggtagcttgaaactggccatagtggaagtatttacaccatgcaaatacgtgaacactacaaaccagggttcctctcacttctctcccaggagagctttacattaaactcttgcaagcatcctgctggtggcaaccataatggattctcactttccctgaaaagcaggacttaatccttagcagatcacttgctttctcccgattgttctcctcccctgagtcttgaggggctggggactaacagagaccaaagtggccttggtgatatgtatgaagtggctcaggtcatagacggtatacaagttcaaagtttgtatcaccacattgtttcttcacatgcacttcctgcctaagttgctgccgtccgctctaaaaaactaaacaaacaacgaccagaaaacaaactctactgatcttattttcagcttgccaatttttatacagtctccaaacaggatttaatgaatgtaataatcttgctgacaaataggttttacttctttggaatatttatcacatagttatttatttagaattctgtgtgtatacctaccaggttcaacctagacccagcctaaccatgtttctggagatactgacctccattatcaacctcagccttaccacaggctctgctctaaccttgcccctaggttttctgatcctagctttcccattaccaccctctggcctctggttgtggcacacctgttatttcatgttaggccctcaatgctgacagcttgcctatccttcatatgctgatctgtctctggtacactcaaaataccttcacacatcaagagatttccttggaaaccaaaacaaaggagaagaagtgactgttccggagttgctgcctggtgctggacgtttgttttcatgtttcatgttcatcttgcagcaaggcatttccatctcatcccccagacaagccttcactgtaggaaagctggcccccacctcttatcagcaaggagcagggtctgcatcaccaccctttgccagttttctctcacgagactctgatcatcagggagcaggtcttctctctcagaggcaaggagcttatttcaggcaataacagcagttttcatatggttcttcagatctcctttagtacctaggacagtgctttccatagggtagattcattatcaatgttggttagtggtgtcaaaaattatttctacttgaagtagaatgaacagttgctatatagaatagttaggaagccatatcctgtcattggaggggtccaagtagaggccagacaaccacttacctgtgatggttttaggagggaataatgcatttggatagaaagaagaggtagaagatggctagccttttccaccctgattgtgatctcataaactatgggatgccagcactgagtctaacggtggaaaataggctgttggcccagagacagatgactctccagaatccgcttagtttttctgttttcttgagcaagtggtctgcaggttgagtgagtctttaattaatatgcttctctagcagcttacattactcccctagtcaaatggcagagtatgtaagatcaacattgtgtaccccactgaggcttcaaccctttaaagaagtcttttcctgtaagtgtaaggagaagcagatggtaatgaaaaaatacgcacattttattatgcgttgcacattttacttattagaatttttagtatgacaccctgcattttaaaaagcctaaagatgaaaacaaaatggaattattctttgaaatatttaaatcagcttgcagcaattatctcaaaatatgaaaataaaatctagcagcctggaaggtagatcttccttgaccacccactttgaaaatctcgtctttcaaagggaggctcttcctctcaaaaaggaagaagagcatgctgtacagaatgagggcaggaagggacgtatccccgatgaggttgttcaaaaaggaagaagagcatgctgtacggaatgagggcaggaagggacatatccctgatgaggttgtatagagctggagcttatgtgtgggagagctggtggtgggaatgagggcaagtgactacactgaaccattctctcgttgaaaagtagaaccaggactggagaggagttacctcggagttctggactgggtgtagagagagagtgtttctgtctgctctttccctaaccacatctctgcctcccttggctgagtgagtcatcctctgccagccttaccatttgccagcactcactcccacagagaccatgtgaggattaacaagccgtactttgggaacgtcactgaaactgtggaaaagcagtgcaaggtaaaggtgaagtgtgaatatgattgtgaatcttaagcacagaaccctgagttcttaaaggcaatttttaagattagtatccatcaaccaaagttcacaagagtttttcagaaatcaccagagtacaaaagctatttcacgaaatgtgcagtggctgtgaccttagtgagatttcttagacttgtagccataaggactggaagagttcgtaaagctcagctcccactttattcttgaattccttatcctgacgaatggtgattcagcatgcagccaggtatagtggaaagagaaggggctctggaatcagacagaccttgggccaggtcccagctcctccacccattgtccctttgacctagaacaaattacctaatctctctatgctttgatttcctcagctgtgagttgtgaacaatgcttgttgttgagagttagaacatggttaaagtgtttagcacagctcctggtatttagtagggcttcaataaatgatagctgctatgctaattacaataatgcttattaagtgttgctcttcaggctcttttttaatatctctgtgatggcaatgcttccatcattagacagtgctgatggctagaattttctgccacatgttgtgcccaatcctatttcctataatttctatccatctactctggtgctgccttttgtggccccatagaacaagtctaaaccaactcccacaaagaacacttcagatatttgaagacaattttaatctcttccccaagttttcttcatggtaaaccctttagttcctggaatccttccataggtgacttagttttgatctcacccaggacacgtctaagtcccttttcctcacatatgagtatctatgggaagatgctagccagccataaagggaaagttgagatggcaagttttagatgccatccatactgaataagctggcttttgtccatggttcttgtgaacattctaatgcataccctacaagtatatttcacagttccttcttttcactgtagtttcaccagagtgttcaggaatatgaacactgctacctgtgaggaagnnnnnnnnnnnnnnnnnnnnttgcagttcctgccctttgactttatattcagtagtgtgacttgctttggccaacagaatgagtcagaagaaacagcacgccagctccaaacctaggcttcagaggccctgggtatttccagttactcttcagtgttctgccatcatcatgagataacctacccccactagcctactggcccaaggaagcagggaggcatgtaggctagggcccccagcagcacccagcctgcactagctgattgtaaccaactcacagaaacttgagcaaaagtaagtgattactgttttaaggcactgagttttggggtggttggttatgcagaatttttgtggcaagaaataattattatggaaattatgtggggccagaaaacataaagtaatactaaccctacctggacagagtacaagtttagaagaattaatgaaagatttacaaaactataaccaagctagatgaacactttttaaaaatgatttaccaaattgtaactttgaatttcttttgcaaactgtgaccaggaagaagataaatgtgtatattacatttcacgaatgaaataggtaatgacgaaagcaaactcaatttctaaatatctgtgaaaagttaacgtgtttcctattcgatatagttcactcatttactcaagaaatgttgaatgaatcatgtgtcagtaccattctaggccctggaaatatagttgtggaaaaagtggacaaggcccaggtctcatgaaacttgtattctactggagatttagaaaataaaaaattaaataaataaagcagataacttcagataatggtaagtaccatgagaaaactcaggcagggtaaggaataccttaggtagtttagaaaagacttctctgaggatgtgacattgaaactaagaccaaaatgacatcagtaattcaagggaagaaagactacattgaagaaaatagcaaatgcaaaggccctgaggtaggaataagctgggagtgtttgaggtacaattagaggtgtggagaggagcaatgtggtatgaaatgaagtggatgatatttaaagaggccaggacatgtagtgcttttttggccacagtaaggagtccgttttattccaagtggaatggaatccactgaagtgtactaagtgcatgacttgatttataggttttaggagtttgtcctgacttctgtatagggaatagattgtaggtggacaagagtggaagcaaggaggtcgattaagtcattgcatcatggtggctacaactagggtgaggccaaggatggagagaaatgaacaggtttgagatatatattggaggtagaatcaagacttcctgatggattggatgtgaaggaacatgagaaataaaggataatggctaggtttttagttggggtaactgagaggatggttggtggtgccatttctggagatgaggcagatgcgaggaacaatgaactcaggggagggagagatcaggagttttgtttgaatgagttaagtctgaacttagacgttgaattggatttgccaggtaggctgctggacatactaattgggtagcgaaggctgaagataccagttgggcagtcatcagcatatagatggtattttagccaagagactaaatgagttcatctagaaaatagtagtgaaagtgttttatttttaatttaaaatttaagaagttttaaattttaaaaactgtcaaaaaataaataaaagaaaaagcgggaggactcaaccacagagcatgctgacatttaaaagcttagcagaaaaagaggagacagaagaagagcctgagagagaggctgagagagtgtgatgctatggaagccaagagaagaaagtgttccaggaaagagagtcatcaacttgggttgtgttgggttgaatgctactgagtcataaagtaagataaggatcaaggagtaactgttggatttggcagtgtggagctgattggtaactttgaaaataaaagatttagtggaataatggacacagaagtcaaatggaatgattgaaaagtaaatgggagaaaagaaactgataacagtgaggttttgctaaaaatgggaatagagaaataagtagctagagaggatgagagtttaaggttttgttttatttggttttgaattggagatgcagaggcatatttcaatgacaatggaaataaacccacagagagaaaagttgatattgtgggagagaaaatggacaaatgcaggatcaacgtccttgagaaagggggagacccagagcacagtgaagtgttggccttccatgctaacaggagagggcaggggataagggcaacagagtaccagtgaaatggtggatttggggatgggaagatgaaagacactgtcagtttacatatacatatatatatacattttaatatatacactttaattattgagatgggctcatgctctgtcacccagacagagtgcagtgatgttatcatagctcactgcagcctcaaactcctgacctcaagcgatcctcccaccttgacctcccaaagcactgggattacaagcatgagccactgtgcccagccacttatattttctcaatgagatatgactttagatcgtcgtttgaggagccaagacttctgaatcctgagcccaaaagcactgtgtccttcatttaccatttggtacatttgaagcagagtgaatatgataacccctttaatataactttaaagagcaatacagatgacaaaacaattcatgtatattctttcatttgatactcttgccttgaataattgaagttcccagtctggaacagaattcagttcgtataaatgaagacattgtaatgaagggactatttacagagatgagagtggaattaagagatgtatccagaaactatcaacactcaggagtcattaccacccttggggccagggggccaaaggagattaatagtattagatccaacgagagctggtgccatgaagggaggaccaaccagcatgatcattcattgaaaagatatgtagtcactgtcaggggagtggtgtcaatgcagagagggaatgaaaaacaaatatcctgacttccctccactcccagtctcttgctggtgcttcccaatggctaaacccaactggaagccagctggcaagtgagtgggctgatatttttcatggtgaaagaatagatctggcagagaataaccagcagagctcctaacacttcatgccataaatgttgaaaagattttgaaaaccactccaaggggaatctttttacccaatgccagtgtataaatgcatcttattattttgtgccagctgggatttagaaaacctagctaaccatgttctttaatacaaatcatcatgagtacttgtaatccacttgcaatcttaaaatgtaatgtttgcccatagtcttcttttatttccatccagaggcatattaaccataaaactggagaagcatatatttcagggctcctcacttgcatgagccccttccaaggccatgggacggccctagaaatgtattcatatggtcatttgtttttgtaaaatttgtaaaggtaagatattttaactgcaatctattaaaaaccaacttttctcactctgaccccagagaattctctccctgcccaccccccaaccagttatatgaactttaggccccacaaaacctggatctgcttctgctttcagtgagactcaagtgtgctgatgcagattttatccctttcccgattttaccactgtggagaggaaaaggggtagttaatgagcatcaaaatggacattctgcaagggaagaatgtagcaggaggatgagaaaaacagaggggggctgtgctaggggcagtggaagaaaatcactgtgcctgaaggattgcacctgagtcacagagggtttgcaggtgtctaccaggtgactagtttccctccagggcctaactcaggtgctgctctttatattttcagatgcagatggaaacctgtgtcgaagtaaccaactgttgcaagtcatgctgaccatgcaccgaattgtcatctcctctgcagaactgctccaaaaagttatcaccctatatcctttaacatagtgactggcaatcccaaaatgggatccacccaaaaagtagcttgaaatttgaagtatgcttttatttttattggtttggaataaccctgagtggcaaataggttcatatgtcctttcaggggtatgggtgcatgtgttgggggtgtgttcatgtatcctctgttgggtggggcaatgttattgatgctgattgctctggggggtggtcaaagaaatcaatatgcaagcacaatcttcaggctcttaatagtaaaaaatattttttctgtagagtgtgcaaaatagatattcatcctgtgcaaattgacaaaggtgcaagcatgactcaaggataaatttctttctggccttcctgtccaattcttcaactttctccaggttctgaagaaagattcccagtgccacagcatctggagaatctgctggtgccttattgcttcaggcaggaggactgactatgtgccaagcaaaacctgctggactttaaccttattacgggatatgaatcaagtagggaggagaaagctcctgcttgctttttctcactgatgacactgtaagcagcagcccccacaaaagaagagttgtaggcggagtgagaccgtttagcacccaaggcgcaggtccctggtactgtgtcatgacttgtagctgctctaacacttttccactctcctaattccccgcgtttcatcttacagcacacagaaaaaataaaaaccatcaggactgaatcccttctctatacctactcatgagtctttacctctcatctcaaaggaggtgttttccagtagcacacaaagtgggggagcattgcgagaagtgcacataaataagaggtgcaggtaataagtgggtgcctcttctacagagaattttaaaccatcatgaaaccaactcagtgtctactttttattaatttcatgtaccagtgattataaacaatgtcagtgattaaatattcctccctaaaaacttatttgttggcctagggactaaattgttcctggggtgtctgggcacagtagctcacatctgtaatcccagcactttggaaggccaaagtgggcagatcacttaaggtcaggagtttgagaccagcctggccaacatggtgaaaccccatctctactaaaaatatgaaaattagccgggcatggtgacatatgcctgtaattccagctactcatgaggctgaggcaggagaatcacttgaacctgggaagtggaggttgcagtgagctgagatcacaccactgcactccagcctgggcaatgaagtgagactctgtctcaaaaaaaaaaaaaagaaagaaaattgtacctcggggttcctgcccttagtgcactactggctgcctacatattggggcagaccccccctccctttcccatggtccctcgtacttctcacagaatcttactccaccagctatcacccctcctatacttttaaactctacctcttcaatggcacctgcccctcagcctaaaacacattcaagtctcctcatctaaaaatcaactcttaaccctacctccccttcattccattgttagggttaaaaatttgatgtgaaagcgtcttaaaatagtctacactcactatctccaatctctttactactcctcacttcgtaactgtgttaagttggcccccagtattcgaactttcctctgatgtcaccagtaacctcctgattgcaaagcccaatggctttttctcatccttgtttccattgacccccagaagcattaggcatgactgacaaccccgttctcctcccagctctccctccaaggctcccggaacgacaccctcctggctttcctacctcttgggttgggccttctccagcttttcatctagaggcttcttcgagctctgcttacatatggtgtaatgtcctggttttcctcttactcagcttcctttctgtgggtgatttctcaccagaattcctaccactgtttccaccattcttctgtgctgatggtgactttcaagtctggatttctctaacttaaacctttccttttttttttggaaattggtgcggggagaggggtctcactatattgcctagtctggtctcaaactcctggcatcaagtcatcctcccacctcagcctcccaaagtactgggattccaggcatgagccacggcacccagccatctaacctaaaccatttttcttaggtttataccagtttgtcctgctaacacttaagactttaatatatgcattagcccactgtccccacccacagccactacctcattaattctgcttcgacaccagtacagccttgttttgcctaagacacattctgagaaatacatcattgggcgactctgtcattgtgtgaacaccatagagtgtacttacacaaacctagatggcatagcctgctacacttctaggctagacggtacagcctgttgctcctaggctacaaacctgtacagcaggttactgtactgaatactgtaggtggttgtagcacatggtaagtatttatatacctaaacatagaaaaagtacagtaaaaatatggtataaaagattaaaaaatgatatgtataggggggcacttaccatgaatggagcttgcaggactggaagttgctctgggtagtcaggggtgagtggtgagtgaatgtgaaggcctaggacattactgtacataactgtaggttttataaacactatatacttaggctatactaaattgataaaaaatatttttctttcttcaataataatttagcttactgtgactttatgttataaacttaatttttaaaactttgactctacacagtgtacagctgtgtaaaaatattttctttatattcttctgtaagcttctttctgttttaaaaatgtttaatgtttattaactttttaaactttgttgtcaaaatctaagacacaagtatacacagtagcctaggcctatattgggtcaggattatgaagacaggatgaggcaataggaatttttcaacttcattgtaatctcatgggaccactgtcatatatgtggtccgtcatggaccaaaatgttatgcagcacatgactgtattttcatggtcaatttcagttaatagtgttagtatctattcttgcctaaaccagtaacatcagaagcactcttgacttctcccctgctttcacctcctacagtctgtcacctgatcctagggtttctacttcagaaatgactcttatctggtctctgctctccattcccataccatgccttagttcatgtctccgtggtctctctcctgaaccactgtcccactccagtctttgtatctacatggtccgcctaccccgtctcatggtagctacccttgaaattctttcctacaaagcaaattgggcaggccattgtttctgagcctctgcagactacggagttaatgtcaactccttagcttgccagcaaaagggcctcctcagtctgttcccagcgagtttttcctgcttcattccgtagctctctgagaaaccctttcccttcctcactgaacttctcaatatactggatgtaatggggccttttatcattcctgtgccttgaaagcctttctaccctctttgtttagaagctctttcaagacccttctgggaagcttttctagacttttccagcccttctccccttttaaaaatacttctaatgttttaaaatagtattattgattgacaatctatttaattcctttgattttagttttgtactgcttaagtcaaagtgcgtttctcatatctctggcctggatgtaatctgcattgaaaaactcacagaaagtgtgaagtgtttttattctgttagctaaataaatgtatctacctaaacttcagtccgttttgcaatgtagtgcctatgtactctggtctttatagatgaccgtttcaagtaaagtacagaacgtttgtgtctagctgctgtgatttcaatttggttaataatataaaagattgcaagggtactgaaaaattgattgaattacaaattaagaaagatatatttttgtattttaaaagtatgtacactgtaacttacctatttgtgtgtcgtctcccccgctagactctgtctttcaagggcagggagcaaggcttatttatctttgtatctagaacttagtttagtggctgtttcatggtaggacacaataaatgttgcattactatgggtgcaaacattgggatactttttatatttacaagaacttttacctgtgatatctgggctttgctcaggtgaagatgtaacctggggtagggaaagggattctgagagtatgaaataatactcctgtaatgaaagccaggttaaacattgaaggcaaaattattttctttctttacgcttagtttccctgttctctgacctggaagtaatagaatttttagttaaataagctcagatggtctcctgattaccattgtgaaaagaagagagggataaatttgaaaatgtgctttgaatagtttaggtgcctgaaaagtacagtcagaactgtactggtactttatagccacagtactagctatgaagaaaagaaaaaggtatggggtctgagggttccagcaaacactgaagtttaccaagatcagcagatgcctgagcctcttactatttagcctgcatgtgctggtgtttgcttcagctcctgaatgaagtgagaaagagggtgccctgctccctgtggggggcagcctttgccatggcataggggctctaaggacctctgaatgatgcccaggctcagcactcacgtgtagactgactggatttacaacactgacgctgcaccacatgcagccaacgtgcactgtcagaatatacttttgaagggaaggataaggagccactgggagaaggtgaatgacacggtaaaagtcaccatgtcgatttaatgtatctacttagctttaaaacagaagtgtggtttttgtgccttcccctttaaaatggaagaataaaaatttcaacaagtagaacaaatgataaaaatatagaatctgagaggtatttatctatgtgccttttgcctgaatctctttgcattgaagtgatgcattttcttagtgatgtggcataaagaaacataaagccatctcattctcacttctacttttccacccaaagaaaggcaggcataaaaactttctacttcatgaagtttgccagttccctgcacttatttttatgtcaattacctttgttgatgtgtagggttttttgggtttttgttttgttttggtgctctgatctaaagggcagattttataggcagtatatgtattaaaatttaatttttaaaactagaagtcattttattaaaattacaaattttataaccatagttcttgtttagggtttcaagtttagcttgcaaatcttactgtttccataagtctagcatgtttcagcaagcatttttaagggactttgaaaaatgtttcgttaatttgaataatgttaattaaatattcccaatgattttaaactacagttctgcattttatatcttagataatttttaagtgcttcagatacctccctgaattctaaatagttttttataactctaatagattaaatttataaacagtaaagctatcattatcttagatgttccaaagctatgcataaacttaataaggtttcaatttaaaaccacaagtgtaaagcacttaattatatattgcaaattgaagtttcaaggctatcattctaatatgcttttaaacattacaagcatatacaatttcaaaatgcacagatctccttcctgacaaaaaagatcagtactatgactttgactctcttttgcttttctttatttaactctaaattttccaaaggttaaaatatatacacccacagaaggaagaccagtcctgtcccagttaattaaaatgtttgctgggttgttcactggattcctctcatgggcccagctggaattcactgaaccctatattgtagtcattatgcacagcttttagaaggaaaacaaggcatggcctttacgggcgggcacagagcccacatagcctgatgcctcagtctgttgatgggaaatggcaggacctattcgggctcatcactgcattggagttctcatctctttgactcttaaaatagatgaatatttttttccatttatctttaaagacatgtgaacttgatgagatcttgctattctttcatattcttggaatgctcagaatgaaaaggatccttaaggtgacctccagttttgttttcgattattcacacggtttatctgacttgccgttacaatctatgaggtcagtctactgacatcctctaggtgtatatattgtaactttcatattattgttcttcattatcatgacatatctgaatattgaatatgtattttttcctcttcgaattcactgcatacatgtgtatcagttaaaagaaacattgtaaaagataaatggggctgctgttttttcttttttttctgcttcatttttccttcataggggctgctttttgagcacaggcaaggagtcatttgccccttcttcactttttataagttacctgtctcaggacctctttacatgattcatttcttagttctgcagtgctgctgcttccttccgtaagccaggtcgacgtgggctggagagaaaattaccatcatcgcctttctaggcaataatatgcatacagctgtacacatcaagttggtttttatcctttggccagaaagataaagcatcacattttcattttttagaaaaaatattttgggaggtagtttcagcaaatacttccaaagatgaaaagtcgtttggtttctgtaacagaggtctccatttcccttaaccacagccctacctataaggatgctttggcaaagaattcaccaggactttgcctgaagatctgttattttgtaaggtaatgtttctttatgtatttcaagactttgtggagcaaggtgaaatgaaaggtgaagcaagggactttccctgcctttcctgacctctatagaacacctttggacagatggaaaagggtagtccttcataacagtgaattttctctggtgtacttgagcttaattattttataccaaccttttttcagtctttggtatcaaatgacatgaaggagggaatacagaaataattaaaggtctgttattttctttatttttgttcttaattatacaagtaatatagctcattatagaacatttttaaaaatgtagaaaagaatataactataataatgatcactcatatccagttacctattttggtgtatttcctttgtcttgttttcatgtcaatttttttgagatgaaaatatatatacggttttatatcttatagttttcacttagctttatagcatgagaatcttctctagtcattaaagactttttgtaaacattctttttaatagccatgtaatattcgaatatgataaagcataatctatgaatagattgtctcattttggacatttggtttatctatagttctctcccttataattatctccaacccacatgattgtgcctgaatctttgtcatggctcctttgattatgctatgccttatcctaccacagcatttgtgtggagggacagaagattttcagtggatgggttttcttccttccctgctcccaccccagctccttcaatatactaatagacgaatcagactttgtctttttctgagttctctttgtggcagtaaattccttttggaacccaacaaattgtgagtccttggtatcagttttggattgtgttttttaaccccctccttgtaggtattggataacagaattctgggtcatgtttaaaatggacgccagcttgacagacactatggaggagtttcaggaactggtgaaagctaagggtgaggagttacattgccgcctgattgacacaactcaaatgtgagtgtcaaggtcttgactcatctttcgaaaccacctccctcctgtaatataatcccagttgcttgttgggcttctgacccccagcggtgactgctgctctctttctccactctgagaagcccctcaaatacacaggttcaaactgcctcaccaaagtgaaggcttggcatttaacagaaaagcagagaggcctcatggtgataaagcagtaggtgacatatccaggagcagaaaaagtaagtcccagtcaaaaagaaatcaggtagcaagatattgactaaaattaatccagataatgaaaaactgaaagtgcaaatgactgaacccacgcttaatgccaggaggcacacctgaacttgtaaatgggacaggactaaaaaatgtattcaggagaaggcttataacatatatggatgtctatgaaagacacttagacttccagagctggatgggattccaggaatgttttaaattattccttggaattcttatttataagactgacccattctgggaaaatgagtgcctttcctaattagggggaggggaatgtatgctttgtatgccagggttttcacagtgtggctgctttattttgaaatagtacaaatccctaagaaatagaattctagaactgatatatattctagagatcatttcatccaacatcctgatttttctgactgggaaattgaggctcagcaagaatgtgactcatctagggtccagctagttaagctagtgacagagcagcagctagcctctgaggtcctgtccatgatgcactgtagccacgtagaaatgatttcaagattacattccagagccccaaataagtctgtttatcagtttggattctctgtacttctctgcttaaaattacacaacttgaaagataagagattattcaaagtaatagtttcttcattttaaagatgaaattagagcccagggcaattctcaaccccagctctccttgtcccagtatttcctagctgacttttcttgaccaaaattttccacattatattctgtaggaattattagtctgtggggatattacttggccagatataactgaggaataatgagttaaactttccttttgcagtgcttttcagagtgtgtaatatgctcactggccaaagaggctacagaatttatagcacttcccaagctcattgaccacagaacccttttatcaagagacaaggttcccaggaataccagtttggaagacaggcaacctgctgtctttcaaaatggggccgcttccctttgcttgtttagtgaaggaaactgaataagaaatgcatgggttgattacaagaaaataatgggggcagggcgcactctagggtcagctaggcttccttggtcatttcagtagctgaggacatttgaggaaaatgacacaactctgccaagagtgaccatatgtttctacgcgtgattccctccctttatgacatcttgctgtggttctttgagctctctttctggcatgaaaactgtttcactgccttgggatttccaaccagatagagagtccctatcattcacacaagaatgaaggaacacacaagcagaatggagggagcagacataccagatgatacacaaaggagccaggaccaaaggcaaggaaactgaccgatacctgagactccttccttcccactgccttaaagtaaactcatttatcctgtacccaactgcacacttaaaaggctcactgaaaaccagcaagacctcctggaggctgccatggaaaaaaactgatttggagaaactctgtgaatgcactgttttggcattcacaaggaaagttagctaatggtgttttgtatattcttgtgagaaatgttaatggatttacttgcaaaaagcgatttattccttttccctgtcttctccctttcacatttacccacaaaagcaatgcccgtgactggtccaggaaacttactcaaaggataaaatcaaataccagcaagaaacggaaagtctccctgctctttgaccatctggaaccagaagagctatccgagcacctcacctaccttgagttcaagtctttccggaggatatcggtatgtatgcaaggggcaggagaaaaatcttccctgggatatttctgaaaataagatgataattcaacagcccatccgcttcataaccttagaggccccctcaagtcgtggcaggctttcctgccagacatcatagagtctgaaaaaatcagtaccatctgaattcctttgattgtgactcctgtgcttctcccatctctcttcttccatgcccccgccccataccatcccaccactcactcaagttaccatactgtgggcacacatcacacacacacacacacacacactctctctctctctctctctctctctctgtctctctcattctaccctcatacccctgataatcctcatacccctgataatcattaggcttcaacaactctttttaaaatcttcctcaaaaaaaaaaaggggggggggtgcgggggcggggagaggatatgtcctctcagagtttgaattcattctggggtaagctttgaatggctctgggaaatcccaaaatagattctactgccctagcccagaacatacctaaatccttgaagtggtcctggcccagaagtcactgtgattctagagataagctgtgctgacccaaaacctttcaactggggcaactaagcagagtcaaagggagagagatttcagttgatcatcaggtacagaaagagtacaggttcatcctttcctcactgcaatccatatgtgatcccaaagaatattagttctatgcaagagaacttgtcaacatgtcagatgccaacagaccctcactggctaatgtgctttcctgagaaatgaaacccttattccacttagcccctacccctaccaacagatacagtcttcacctccgtgctaaaaatagtgaccacctagttgctgggtccatttattaaaatgaccagtattctcctggtgaggggatggaggcccagagggctgacttgaacaaggtcgacacagctgattacagtcaaagctggggctaggactacatgcctctctcagtcactcagcaccaatttgttgagctcagttgtgtctggaaggagacctgcaaatcaggttacaaaggttattttacattttcattcataatattgacagcccttctgttttcacgcagctgtttggtcactcagccaggaagctcccagcttccatttggaaataacttctccaagcattaactctccattctctgcacccctcagtaccccagacccaaattgaaaagctctgcctcaggagttcccatttggcagtgcctccccgtcacagggaaggacagcagtcagagctgagccactgaaaaaagccatttatcacacaggaaatctgagctctgcaggggtcaaactggcaggctgcttggtcaggcctgcaggatgtctgcttgatgccaatgctcacatcagtggaggcagaagtgaaaaatcagtgcagaacgaggaatcccagccagtgtccccaggggttgaacagtgttctatttgcaagtgaaaacatcagtttcaaccttcatttcttttgagtggcttggtcccttcatagaagactatctcagggtttttttgtttttcctgtacagtgctaaacagttttaccaaacacaagttttctctccaacatgaggttggagggaaatttatctgtgctgtgaattgaaaggcatttgatatcttctgtttattacaaaactttaggggtagtgaggatgttactgggataattgttttaaaaaaacaagtggatttaaagttatatttatagtgggaggggggtattaaatgtattcactggaatatattaattgaatgaatatattcaaaatatatgcaatgagttgtggctactttcttttagaaccagtaagatgtttgctttatatatctctcttaaggagcgattttggtcctactcataggttttccacccatcagcagccatatagcacagtaaaatggggctcagttaatttgcagctattttatttgggttgtgacttctcatctatatatttactacttaggcagaactaaggtgtactgtagtaataaccccccacccacccacctcctgtacaatctcagtggcttaattaagcaaaagtttatttttcactcacactgcatgtctaacatgggtcagcagaggctgatcagagttccccaggaacccagatgatggaggcttcatcttgccaggaatttccaagatctctgcagcagtaggaaggcaacatggcagaccactcactggctcttacatctttgcctccaaagttacatcgcttccactcaacattctgctggctgaaccatgtcatatggtcacaccttctttcaaagggaagagttgagaagggaagagttggaaataattggggaaaagcaccaaagacttccataggaaagttgaagagaaacagactgtgatttgagcagagggattctttgtgacagggacacaatagctacaaacatcacttagactagatcttcaggggacatttccagttttacacatgttgtttcattgccaactgtagtcaatgctattgtcaacttgggaaaccatgatcagcaaacatatagctaaccaaatttttaagtactccatttgcctctgctccagttggtgagtagaaggaaatacaaacaggcttgtattagcataaggttcataactactccattagcgcaaccttacatatatgtaacactttaaaaagttaaagctttcacacattatcttctttgatcttcataacaattctatgtcctagatagggcagattttatgatcacatttttaaggtaagaaaacagctggggagagagagatttgtttttgtcaggggaattaccttttattcccttaaccttagcagcaatactgatctttattctgtactgtattctttagaatttagaatagtcagtaacaatatctactgaaatacagcatttggattaactaatgtgtctacacatccacttattcctaataactttcgatgtagagaaatcatgctgtgggtagaataaggaagatttccctcccatcatgcttgttggcaagtggccaagatgcagaagagcaccaggagctcctctgttccatggcagttcccagccatcaactgagcagactggacttgtcccttaaatcttctggaataccagagtacagtactgataggttttttttgttgttgttgtttcttttcctgcagttctctgattatcagaattaccttgtaaatagctgtgtgaaggaaaaccccaccatggagcgatctattgctctgtgcaacggcatctcccagtgggtacaactgatggttctcagccgccccacgccgcagctccgagcagaagtcttcatcaagttcatccaggtggctcaggtgaataactggtttaagacatttggcttgggctataaggtaaactttctatccccttttcctccagcttagtctattaattagagctgttttttccctcctgaaccatggcgagggggtggagaggtttgtgtgccttcaaccagatctagatatggtgacttgtctcttcttccatacaaggacagtgtggaggggagggggccatacaggccatatcaggggtcaggatccagttttagatctgtttagacctttaacatttttcaaaagatgcttaccagcctacattattttcccgagtctggcccacatggcaaaggaaagggcaattctaagatttactggagctggaccatcctggattgtcttaggtctttaagcccatgcagtgctgaatggctgcatttaatgtttgaggggcattttataagaggaaaacaagtactatgaacccatatttgaagttccccagagattctagcttctctgtcccagttactgtcctatataggcactggcattgcatgggaaaataagacaaagtccttaccctcaaaaataaaagtctggtaaatttggaataaataaaagattacacttaataatatctttctccaactctggatggtctagaccagtgtttctcaaagtcaacagctctgactttggatcacctgctctgatattaactaaaggtatattaaaagtacagatctccaagcctaaccccagatccaggcaatcagaatgtctgggttaggtccagaaaccattgtgttaaacaaatacttgaggtgattctaagaaagcactgatctagaaggtggtccacagatcagcaacaacaaaaggagagagatgtaatgcctcccagatgtggaatccaccagtctgaataaagcagaaggggagacatggacaggaaattgcaatgcctcgtaactagtctttaaccagcgttaagggagactcacggcacagagacaagaggcagcctctaagctccccatataactgacatgtacagtgactctgctgtcatctgtcttctgtgtcacagaagctccaccaactacagaacttcaatacactgatggctgtgataggtgggctgtgtcacagctcaatctcgaggctcaaggagacaagttcgcatgtcccacatgaaatcaataaggtcagtgctactgtcttctctggggcccttagcagcattctcaagatgtgtgccaacattttctccttggtgggcagcccagagagcatttccaaccacaccatcccttgtcaaccaggctaagtggcagggaggcaaaccttaaggaaatccataggatggagaagtcacattttttagagtaactgtgattttgtctggcctcagacagtgtcactgcaaacattcctgctggaccagttgaaacaatgtgtgcctcttcccatgttcataggccatggaatattcagttaccatctttgacactgattccctcgctccagctccttgctctaaaatgtgttctcaaaaggaattgtggttcggttgaccataggtcagtttgcacattgagtgtagttatatagtgatatattaaaaacttagctatccagaacccttgaagaatgacattccggatagttgaattttaccagataattggatatgagttcttcagataccattttgtaatacataatgttttattaatgaatatttttcttaaatgtcctgtacattttcctacattattagattttacagaatatacttttatcttttatgacatagggctgttttgcttgtttctcttttttatagaaacagggtcttcctctgtcatcaaggctggagcacaggctggcacgatcatagctcactgcagtctcaaactcctgggctcaagcaatcctcccacctcagcctaccaagtagctaggaccatgggtgcacaccattatgcccagctattttttaaaatttttgtagagataagggtctccctatgttgtccagactggtctccaactcttggcctcaagcgatcctcccatctcggcctcctaaagtattggaattacaggcatgagccactgagtccagctggagctgttgttataaatataaaccactgtaatataccgaggatataaatgtatggcatgggttagataatgactgctctttgagcactttcatgtaagaggaccttactatactcaagccccgatccttccaaactagcatggagaggaactctctttttagggagagatacctaagctcattaccccatctgtttttcccaggtgttcagctcccttttggggagtcttttattatctctgttatcacaatgctgggcctctggggaggccccccacttcccagtggtctgatcaaaagggcatcatctttagtcacctcttcattccttaacggttctgctgaaaccaggtggaacagttgaaaagattgcccacatctcagaggtgacagagagaaatagtcacagagattaagaagccttcatgtcatttagcttataagagagagcttgctcctcttcagcttggggtccccccacagcagtgcttcctgtcggtagctacttgaccctcagggtggtctgcatagtgaattagtaagtccagggttgaagcaaaagtccccaagttgttgatttcaccttcggaggggaataaaaatatctttatcatttttgctgttacactcttgtcttgtgagccccttccatgcctagggctcacctgcaccattggtagaggtttatgaagaagaagctctcttgccatctcccagtgatttgaaggggtctgactccaagaactccaagttcttcattgtggagaaatggtacttcgtaggccacaattttattaagtttgggcacagtgtctaaaagggttacagtagtcccccttatctgaggttttgtctcctgtagtttcagttatctgaggtcaactgcagtccaaaaaaaatttaatggaaaatcccagaaataattcataaattttattatttatttattgattgagacagtctcactctgtcacccaggctggagtgcagtggctcagtctcagctcactggaatctccgcctcccaggttcaagtaatcctcctgcctcaggctcccaagtagctgggactacaggcgtgtgccaccacgccgggttaattttgtatttttagtagagacggggtttcaccatgttagccaggctggtcttgaactttggacctcaggtgatccgtccacctcggtctcccaaagtgctgggattacaggcatgaaccaccacgcctggccaattcataagttttaaaatgcatgctgtgctgagtagcatgatgaaatcttaagccatcccattccattctttctgggactccttcatatcagtcactaagtagccgtcttggtcatcagattgactgtcatggtattgcagtgcttgtgttcaagtaactctcactttgtttaataatggcctcacagtgcaagagtaatgatgttggcaatttggatatgccaaagagcagccctaaagtgtttcctctaagttctttacttaataaggaaggaaaaaaatcatatgctgaggttgctaagatctaagtaagaaggaatttcatctatgaaattgtgaaaaagaaaagaagttcattctagtttctcttttgtacttcatactgcaaaaagttatggccacagtgcatgatgggaatggcattacatttgtgggtgggaaacatgaacagaaatgtgttccacttgacagcaatcgggtttgttactatgcacagtttcaggcatcaattaggcatcttggactgtatccccctaaggataagagaggactccttatgttgtatgataacatgattggcagacagtcacttcatgtctttgcttctgagaaagctggttatcactcatggggaatggattctgtgaactgcttgctgacttgaatgacaagtgattgaaaagaaaactagatctggctgctccctttctgtgctggtgagcagccgttcccacttccaggtttgaagcagggtgtaacctctaatgtcctctctcctgtcctttgctcagaattgatctagtctattcagtctttttagttcaaggttttagtctgtgaatggaatgtcacttgctttctagtcataggcccattctgagaatcttgaaaggcccatcaagcacctcatagagaataacacacaatagactactgaagctccactcttaaaatacatgctcttccccatgccagcaacatagtcagcatttcctgacatcacatttcaactgttaatcaatgcagtgtctctggaagcattcagaagacaccaaggaagggaatcacatggcttggggacaggagttagagggatagtgttcactatatattcttgtacctttttaatttttgtatcaggtccttgtttttgaaaagaaggaaattttaacataaaaatgataaaaccccgatttataatgtttaagttatataacagattcaagcatatcttgtgtttataaatatattctgtgatatttgacatagctgaggttttaactggggagtcataatctgtaccttttacatgaattaccccctgctcaacaaattctggatggggtgagatcatggcacaggatgcaaacatgcaaggtcctcattacagacaatgcacactgcctagcgggtacctgtgattggtctgttctgctttgtaggttctcggtgagatgactgagctgctgtcctcctccagaaactacgacaattaccggcgagcctatggagagtgcaccgacttcaagatccccattctgggtgtgcatctcaaggacctcatctccctgtatgaagccatgcctgactatctggaggacgggaaagtgaacgtccataagctactggccctatacaatcatatcagtgaattggtccagctgcaagaggtggccccacccttggaggctaacaaggacttggtacacttgctgacggtgaggctcacactggaggacaattactaagcactttctgtgtgccaggtgccattctataccccttaccaaatattagctgttagtcctcataaaggctctatgaagcagatcctattactatctccaacatatagctagggatactaaagcacaaagatataccttgccaggagaccacacattattaagtagcagagccttgattcagacccaggtggtgggactctagagactgtgcccttcagacttctaggactgtttcactacctctacaaaagcagtcctaagctctctgggaggagctgatggcaaatcaggatacaagtcttggtaacagatggagagaatgaatgtgctctcataaaaagggcaggcagtaatttaaaaaacaaacaaaaaacacccagggttattatttggttcctggcttagatctttgctcttggagatattcaagtgaagatgaacacttgtcaatggtgtgggagaccaggatttgcattttgcatatggggtgagatcagatgatgaactcccttccagacctgcaattccgtagtttaccagctgtgtgactatggacatataaccgtccaagattcctctcctcaaacgaattagnnnnnnnnnnnnnnnnnnnnccagttctaaagttacacagtttttaacctgctgtttttggagagtagaataatgatcataacctctttctgcctcacagcagcattttgatagaaccctgggcttcacatcagctggtgtgtgatcctagccctttcacttattagccaggtgaccttggcaggtctgtgtctcagacatcatttgtaaaaacatggagtgaatcttaacattctttggattataaatcttgtgatgaaagctgtgaaccttcttcccagaaaaatgtacataagccatttatttttaaatatgcatgtaatttcaagttctgaaatccttgaagcctatccatagactcaaggttaagaataagattattcctaaggacttctctcctaaaattttatagttctaagatacatgaaactcactatttttttttttttttttttttttggagacaaggtctggctctatgacctagactggagtgcagtagtgcaatctcagctcactgcaacctctatcttccaggtccaagccatcctcccacctcagcctcctgagtagctgggaccacgggcacacgccaccacgcccggttaacttttgtattttttgtagagacagggttttgctatgttgcccaggctggtctcaaactcctgagctcaagcaatcaacctgccctggcctcccaaaatgctgggaatacaggcatgagccaccatgcacccagactcattaactcttaatagcaattaatatgtcttaccatttaaactggattttattgctggactcaaatttaatagtctcagactatacacaccatcctttcagatcatctgtctgctttgagagagaacaagtgatgtattagtcatctgtccagacaaggcctttggcctaagctctatatagaggcttagatttaaatcatagttaaaaagagggcatcctgagatatgtccaaaattaaaaacatttcaatgagaattaatgcttgccctattgcaatagtaggtgttatacctgttttgtgacttttgaaaacaaactgtttagaacctaaaagagtaaactactggcaaggaaaatccaagaaagaaccatcagctgtgggagaggcaaacagcatcttagcaatgaaccctgttctgctttgatctgcagttatccctggatctttactacactgaggatgaaatctatgagctttcctatgcccgggaaccaaggaaccacagagctccagtgagtttttcatattaagactccacatgtaacaggtgctttacaagcttctcctcgagttcattcatcctcaggaacagactttcagttcagtttaatacatgtactgtttttcttagtgctcaaccttatgctaggaacagagaaagcttttcaacatatgtctgaggaatagttcctgtccattaaaaagctgtgatatagttgaagggataagcctaatgtgtgaccagtgaataactagtgaacagtaaataactatatcatcagaatgccaggtgtggtggaatcagtcagtggtttacaaagtagagaaggaagatactattgtgcaccagagtgacatcccccccgcattaagaagagtccccacataaatttcttttctatgattcattgatgataatgagagtaatatgcgtactaatcagaagctaaatttctgaagatttccaggttggtagatagaaaagccccattttcctgtaatgttctgggtgaaaagaacagtctgctgagtcttttgacctcctatgctgagaagtcctcaaaatagtacacagtcctggcactgcctgcagtaggaacttcacaggttatctgccctaccctcccacaggcaagtaaaatcacttcagtctcctgggacgtttccaaaccccaaaacaagtgatactcaagggaagagagttgcccacacttaagaaatccagctcatctattggggtggctaaattgcactcctccacacagaaagatcaagttctagctttctattgtaatgaaagattccactgaaaatatttggtagattccattttcaggttagaggcatttcaatggaaagggtacattctgttttttcagagagattttaatttgggctgagtttcaaatacagtcatgcaccacataatgacattttggtcagtgatagacctcatataccacagtggtcccttaagattataatggagcagaaaaattactactgcctagtgacagaacaattgtaacattgtagcacaacacattactcactatgtctgtgattatactggtgtaaacaaacctactgagctgtaaaaagtctaggttatacacttacgtacagtacataatacttgatagtaagtattaccggtttatgcacttactatacaatactttttatcattattttagagtgcattccttctacttagaaaaattaactgtaaaacagcctcaggcaagtcctccagaaggtgacagctccatgcatgttattgcccctaaagaccttccaataggacaagatgtggagtggaagacagtgatattgatgatcttgactctatatagacataggccaatgagtgtaattgtaccttagtttataacaaagatttaaaaaattaaacatttttaaaatagaaaaaagtttatagaatatggctataaaggaaataactggtacagctataagctatacaatgtgtgctttaagctaagtgtcataacaaaagagtaaaagttaaaaaaattaaaagcttttacagtaaaataaggtaatttatcattgaagaaaaaatttaagaaacttagtgtagtctaagtgtacagtatttataaagtatataggagtatacagtaatgttaggcctccacattcactcaccactcacgacttgccacagtaatttctaatcttgaaagctctattcatggttaagtgccctatacaggtgtaacattaaaaaaaaatttctataccatatttttaccttttctatgtttagatatgttaagatacacaaataccatcattacaattgcctacagtactgagtataataacctgctgttataggtatgtagcctaggagcagtaggctataccaaatagcctaggtgtgtagcaggctataccatctaggtttgtgtaagtacacactgtggtgctcatacaatgacaaaatcacctcatgacacatttctcagaacatatgcccagtcattaagtgatgcatgactgtatttagaaaagagcttgtccaggcttccgatgatttttcttgtgccttcctgccttttagctaagcttttccttattcacatttctactgcaaaatgtgactggagaatagagaggaaacataaatgatccactttactctttgttgatagctctgacaaagggtttaatggagagggaattgcaactcaggcagattgagaatttcaaattatctgtagctgcagataatgtatgtgaagagcactctggaaaccgtaagcacaatgccttgttagccaaaattattagtagagatttcaattgcctgtgggttctctgctccttgccactgaacataattgaagattgtccataaatgtaaccgtcaggtagtgggaaaagaaagagctataggttataatattgcattgtagtcatgaggatttctctaaatatttcattttagccactaacaccttcaaagccaccagtagtagtggactgggcttctggagtgtctcccaaacctgatccaaaaaccattagcaaacacgtccagaggatggtggatgtaagtacagctgtgttcagcacacaaaaactaggcattgcctggctcagttttgtatgtggggtaaagggagaggaaagcacaatggtggaaatgtaaaggcacgaaacttgaaccacttacttctcttactgtggctttagaacaattcaaaagttacattttgacaacacacactggactcatatgaaggcagttgtgcctcctcttcaagacctagcaaaagagcatatgcttaaaggttgtcagttgatttaggagtacagaagtattgggatgcatttgagtatagtaaggggtaatcaggtaaacctaaaactgaaaacctttgtactgcttaattcaattctctgtgctaattgctgaggaaggggtatatattctcatacttatgcatgtatcctcgtggacaactcacatgtaacaatggaaaactaagagcgtaacggtgagaaacaagaggattaacagtggggacagagcacttccaactgggctgtttgtagaagcttctcaaagaaggtacaactggagctgagtgatgaaaaaaagggtagagtgaaaggagaacatccctctgcgcagtgaactaggagtagccagcgtgatagtataattgacgtgctaatgattcaaagtacatggccaccccccacatgctgctaccagcaaaggcctgagatgtgacctgccacatctttgccacagctaaaggagcaggtttccctgttcctctcgttcaggttgttaaaaggcttttatccaactgccccagctctttgtcatttgactaaagggagagaagaccggtttctctttagtaatcaccaaaaaaactcctttttcacagtctgtcttcaagaactatgatcacgaccaggatggatacatttctcaggaagaatttgaaaagattgctgcgagttttccattttccttctgtgtgatggacaaagacaggtgagggtttgtacttaggaatatgtggttatgagcccattggtgagaataggtttataggtatgtcactagaagaatttgaaaactcagatatgttgctgctgtgatcacttaaagaacagaccatgaaatatgcattcttttaaaaatattctgggcctgggcacagtggctcacgcctgtaatcccaacactttgggaggccgaggtgggcagatcacctgagctcaggagttcgagaccaacctggccaacatggtgaaaccctgtctctactaaaaatacaaaaattagccaggtgtggtggtgggcacctgtaatcccagctactcgggaggctgaggcaggagagttgtttgaacccaggaggcggaggttgcagtgagccgagatcatgccactgcactccagcctgggccacaagagcaaaaacctgtctcaaaaaaaaaaaaaacaaaaactgaattgaacattccataaatctgccactttataaatagtcaactataaataagaaaaagtttagtcttccttcttgctttgtcattacagattttgggaaacaactaatacttattcatactttgcatttttacttttctcaaggttaaataaattctatcttggttctctataggaaactaatcatatggttagtgggttccagttaggtactgtctaaagtcagaaactgtagcataagacatttccctccctatacacatgtacatgttacattgtttctttttcaagtcttatagatagtggtcaagttagttagggaaacctagtttggccaaagaacacctctgtggaaatgagtaatgctgccttacctacttaccacatgtcatcttgtatccttgttaagagtagggcccatggaagtaatcatgaggtagcacataccatattaccactgaggataaaaagaaaggtgagtttctaaggctagaagcccccccttgctacctgcctccatgccccttatactcacatccttgccttggtcatctgccggcagggaaggcctcatcagcagggatgagatcacagcctacttcatgagagccagctcaatctattccaagctgggcctgggctttcctcacaacttccaagagaccacctacctgaagcccactttttgtgacaactgtgctggatttgtaagttgttcttagggtgctccagggctgaatttggggaagagtgtgggatactttaagacaggcacagacctcacaatccttatgaacccatcccagcttggagcccagacagacacctagaataacctagagctcaagcgtgtggtttttacctgcactcatcatctctcgcttcttcctgttttttcttttctattgcaatgaggccttagataaatggtaccagaaatgctgaattaggatatacttttaaagtataatattcatgtgctgtttcaagtgttataacaaagacatatgagataccttctgtctttaggagataaccttggctatgcccctcttccgttccactcctgaccaatcgtttccccctaaactcgggtcctgatgcaaggctctatatccttctcagtttggagtcctgaggaacctgtttgcccgatgattcatccatttctcgagaatgtctgggtcataaggctgctagtgagagccaggtgtggtggctcatgcctgtaatcccagcactttgggaggccaaggcaggcagatcacttgaggccccgagttcgagaccagcccacctaacatggtgaaaacccgtctctactaaaaatacaaaaaaatttagccaggtgtggtggaacatgcctggtagtcccagctacttgggaaactgagacaggagaattgcttgaacccaggaggtggaggttgcagtgagccgagatcgcaccactgcactccagcctgggcaactgggcaagactgtctcaaaaaaaacaaaaaaaaaaaaacctgcttcttgagaaactttgatcagcataaactcttctcatggatttaaggtcagaagggacaagacatgagagataaatgaggtttccttcccacttgagctagagagtaaaatgaaggaaaataaaggaatgtcaccttgtagcctcacaccagatggatgaatgacatgtggtgcattctgtctcttgtttcatagctctggggagtgatcaaacaaggatatcgatgtaaaggtaagactcaatattgttgacatattcctggtgtatcagtccattctcacgctgctatagagaactgcctgagactgggtaatttataaaggcaagaggtttaattgactcacagttccacagggctggtgaggcctaaggaaactcacaatcatggcagaaggggaagcaaacacatccttcttcacatgctggcaggaaggagaagtgctgagcaaaagggggaaaagcccttatgaagccaacagatctcatgagcagtcactcactatcatgagaacaacatgagggtaaccgcccccaggattcatttacctcccattgggtccctcccatgacacatggggattatgggcactacaaggtgaggtttggatggggacacagagctaaaccatatcagctggtcttagagtcccacctctaaaacattttttacccatagtagttgtccatttagtccacaacttctcagcagagttcagagtctcatccccaaagtggtttccctcggacacccccggtgaatgaccgccacaccgaagagagaaatgcctggttgcacagataggcattttctctgtataaaatcctctttctgtcgtggctggcctagaacagggatagcaggtaggagatggtgctctcatatagtcatggaagggtgggtccccagtgaaaaagatagaatctcttctgcaacagaagataaatgattactaaaggcccttgtcagctttcctttatcactcaggacataactgtccttccttgtgactaggagaattcaggagtgaaagagaggaaaccttttactgcaagaaagaaaataagacctaacagctgagtgtttccggagggtctccctagagtaggcagaatgtatgggataccaggacaccatctcttccctccaagatatcaggatactgcttctgatgctgagattcactgataagggctacatcaagagtgtgagctctgggcttcaccaagtgagaagaatgctagcttcattaggaatgttaagtgtcttagctccagaagatagaacagacatgtgtgacaagaaagcactgcatgaatttggttgtgagacacactggggaagagagaaaagtgaaagacttcttgacccaggatgtcttgtccacagactgcgggatgaactgtcacaaacaatgcaaagatctggttgtgtttgagtgtaagaagcgagccaagaacccagtagctcccacagagaacaacacttgctgtggggccagtgtccaacctttgctcattgggagccaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacttagcagcaggaagcagacttagccacagacagagttctactagctgagtgactgtctatgatagccccaatttttctccaggagaggaaccccaagccattaatttaagaccaggtcctagtctgaggaaccctgaggggccaggtagcaggtaattgtcaaaattctagaaacagaaggctaaatgtagaaaggaagggcggggggcaaactcccactcaagtggagcttgcagattaaaattccaaatcatacaaggaaaatcctaggactgagacaaaacattcaacattcaagaaataaactagcaaattcacttacattaaaatgcaaacaacagtacaataaggaaatgactttgagtatgtttgagatgccccagatctaaagtgcaaagaagcagaatagactgtctctgtcttcatggagtagttctagttagggggaagataatatacaaatatagagcagtttagaaacaatgcaagagtatatgctaagagccaaataggttgcagtgacagcaaatgacaggaggacatagcagagagatcgctgtactggggctgttgggactttatggagaaggtggaatttcagctaagtcttgaaggaagggtagaattaagttatgggaggaggacagagcacattccagataggatgtacagtaggagcaaaaggccaagggcagaacagctttagtactattgggatagtgggaaaaaaaaaaaggtgttaaggcgatttaggtaagagatgaagtagaaaaatgagacagtctagagagtcttaaatgacaggtgcctgtctgtatgataaaatgaggagctatttaaaaaagggtaacatgaagggcttgttggggacggttggggcacaaggcttcatagtgctatactaggccctgatctctgggctggctggttagccagcatgtcaaaacactgatcaccttgactaactaaagaacatataggtcttcagcaaaaatccagtgcttattaggttagtgccagtttaatataagaagctgtgtgacttctaagtagaaccaaaaagggaaataagaaatgagtttatttatataaagcacttaaaatcgggcttaacacgtatgtaccatatgttaatatcattactcttttgaaataagctccctaaagtggtaaggccactatcgttacaacagatgcctagagaaaaagtccatatagtatacattctgcatttaaagcacttctaatgttcagtggtaaatatccacatgcatttattgatcaattagatcaaagcttaagtgcttcacttccatgtaagaaatgcacattcctttttatcacatcagccaagtaaaaattttctgtcttcctaaatctttccccttactatctatctaaacacaggctgacttcaaacttttggggtgttttgttcttagggggaaaaaatcctcttagggtcttttctaagaaagaatatgctaatcaactaagaatttgatgttcaacttttaatagaaatcacaaacaccattgtgaaaaataggcctgtaccctgtatttcattcatgcactctgtattttcagagttacacataaccttagggcaccacaattctgtcacataaaatgcagattttcaagtggaaaagacagcagagaacagcctgaatctgaggcctcaaaaaggaatccctgaaggggcagttgttagagatttctcctctccaggccatctctccccttttccaaaccctgccccacagtggtaagataagtacttgtcaggaagtagaccaataggtaggataaacatacatgtatcatgggcaacaaaatgaaaattactatattattataaagttgctaaaagtcaaggtctatttataatggcaaaaatgactattggatatcatccattcttagttatttctatctcattattatcggggatggtttctgcttatcaaatcaaaatttccagtgatttcttttagcccattactatctttctcaatctcatcaactttcactttcttgaaacttgtacctctcctaatttctgttaacactgtcatctctcaggactcttcctgcaattttaagggctttctgttgctttttgttcttactgctttcttccttttgctcctcaaagtgtatagtgcctgaatttctgtcccaagctccctgtatgtctaggaattcaacctaaataatggaggggattatattcataatttgacaatctaggttggtaaaaagaatgtataactgtattacagaaaagttggaaaatggagatataaaaaataatcacccataatactcctccaaaaaaaaaatgtaattattttagggtgaccataacaatttaaatatttgagcacttaaataactatgtaattacaattttgagctttattggataaatattaaatgttaatttaaattatgttctctttggcaagaattaaactaagatctttgtaagatttctagttttacaactggttgattctggtcaaatactaattagaaaacttttttgttgttttttaaagccatcttgactatactaatccaatgtcttcaaagtcagactatccaatgttttaatcactgctgagtctttccaaaaagtaaactgagatgatcttcagtttatcttaaagcctatctatcgcccacctcaaatacatctgctcttactttacttttccaggaaattactccttatggctaacattactaggctggatcctgggtagtgggtcttagttaaagaaaaccagagtaacttacctttttcctctcagtatcaaacaggggcaatacattttaaggtacatttccacaaagctaaaacttctttctcatggttaagctgtgcccactgtacaaacgggttcccagagagtacttacctgctagagggtgtctgtatcaggactgagacatgaatgtggagagctcccaaattccagggtccaaaaaagtatttatggagcatttctgtctagatattgttcttgttctctttattttatgaaactctgtggcactgaggcaggggcttcaacttacctccaaaaacagaaaccctctaagcaacctttgtgcaaacagaagatgctctttctcagggtggatgtagcttgacaccagtggccatgtcttggccaaagcccctggatttagccctcaccccctaaactgggtgcctgaaaatgggtcctctttgaacatatggaactccagtaacaataagaaaggtctcattgaaactaatgtctcagtcttgagtctctgctttcctgagctagagtactagcatgtcctgtatcttcctacagcacctgaggaaggaccttttacattccctaatggggaggctgtggaacatggtgaggagagtaaggatcggaccatcatgctgatgggagtgtcctcacagaagatttctcttcggctgaagagggctgttgcccacaaggccacccagactgaatcacagccttggattggcagtgagggcccttcaggtccctttgtgctgtcttccccaaggaagacagcccaggatactctatatgtgcttcccagtcccacctctccatgtcctagcccagtcttggtcagaaagcgggcttttgtcaagtgggagaataaagactccctcataaaatcaaaggaggagctccgtcacctcagactgcctacctaccaagaactggaacaggtaccttccttttcattttcctttttttcagactatcttagagaagtggggccaaaccaggaaagagcatgtggactgaagattcagatcaggctgattacaagcagtctaaaacaaaaaaggaggaggggagaaacagggagggagaaacagggaggaagagagggagggaaggaagaaaggatgattgattccagctttctcacaacccactgggggccttggttcacattacacaagtagcacaggctatacagggctccctatcaccacacaggtggtggcatttcagagtgctggtgccagtgcccaaagccctgtttagtaggctcacagagaaaaaccacagtatctactggttagctttactgtgctgataccactccttttctagatggaactaaaatgaacttgcctaaatcctccttccctagaggtctctttaacatgttcatcagggttatggtttaggatcatcatggttacctaagcatcttcctaagagaagttagtgatcttagtcctatagcaacaacaacaagagaaaggtgagtgtattgtggctcaccatagaaaacgcctccctcctaaatataaacgaagagaatcttttctaacacatcagggaatatgctgatcttttacacatattagaatagtgaaagcaacagtagcaggcaaacacacagtggaatataatatagagcaatataatctataaaatgttaacaatcatgacaagaggagctgcttttcaatgttaggctcacaatgtcctaattatcaggtacctaacagagacaatggaaaagacaaaataaagtttaccaaggaaaggagaccaagagtttggaaacatggtgccaaggtttgagagaagggaataatgacattaaaaacaggaaaatagggctgggcgtggtggctcatgcccccagcactttgggaggcagaggtgggtggatcacttgaggtcaggagttcgagagcagcctggccaacgtggtgaaaccccgtctctactaaaaatacaaaaattagctgggcatgatggcaggtgcctgtaatcccagctactcaggaggctgaggcaggagaatcacttgaacccgggaggtggaggttgcagtgagctgagaccaagccacggcactctagcctaggcaacagactccatcttaaaaaaaaaaaaaaaaaaaaaaggcccggcgtggtggctcacgcctgttatcctagcactttgggaggccaaggtgggcggatcacgaggtcacgagatcaagaccatcctggctaacacggtgaaaccccatctctactaaaaatataaaaaattagccaggcgtggtaatgggcgcctgtagtcccagctacttgggaggctgaggcaggaggatggcatgaacctgggaggcggagcttgcagtgagccgaaatggcaccactgcactccagcctgggcgactgagtgagactccaactcaaaaaaaaaaaaagcgggtggggaggagtaggagacgggaacagcagaaggaaaaagagccaacagccaactgtcaagatactcaattctgaaggttcaatcattactatacttctttttgtttcgagtacagtacacaactcacagggctggctcaagaggttacctataattggtaagaacctacaaatggtaagaaactactgtcccatggcatagtagtttcttaattatagataactaagccattttagagacagggaagcaaggatacgttaatatcaacactactattcactttattacaggaggaggaatgcctttctggcttttcccaaaaacatcaaggtttgcactgtgtttttggagacctgtcagtgcaaacacaaaaccaatatccagctagtagaattccttatataattctacattctacagactgaaaaactgtccacgagggcttcaggattccctgcattgtcctcaatgctctaccttccctgtcagacccccagaaactgaattagagaaacatctgaagaaacaagttagataacgtatgtggaactcttgatttggtgcttggtacaaagaacataatattaagagaaacatacgaaaaaagaacaacagattttctggatgaatggtactctcttgctcagagttattgttaagatgtgctgtaaaaaccaagtcaatgagaaggtggcaaaacgtgggttagacaaaccccttcctctttagggatagaaactgccaaatgcaacttctaaaaatgatgaaagaaacctcgaaaaatgaactcggtagaatagaaagaactttggtcttggaggcaaagatttgtgttttcagtcccagacatttcttacaccagctgttaaactctacagcctatttggtccttgtgaaatacagggctgggattccatgttctgaaaggtttgcctcaaatcttgacattttacatgccgatgaaaaggaaaaatgtggttggcaacaatgctttaagaagtggctcgcagaaagattagaattcctactcagcaacatcagagccagtaaaccctctcaccattttgaccaccgcctctctttactttttaggcttgtcagatagacctaaggtccagaattcactgtgtgtattttagaggaacaattatgtgtcccactttcccattaagtataatccttacaatgactagtctatgtgtaattcaacagtcctatccataataactagtcaaattaaatcagtatttacaatatataacgtatattaataagaataaatattatgtattattttaagtataatgtaccactgaaccagcatgggacaaaagaataagcaaataaaagcttttatgtttagatataccaaggctcaactctgcagttttatactatatggcaacatttgcctttataagattgaggtatacaacctattttcagggtgtttgtgtaggttaaggcagtccattatgtcacacagcgcaggcacatagcaagtgctcactattatatggcagctgagacagctatgtagataattcagattgagaaacaaccccagtgtatcccaaattacccagacactggctatatataatattctcttggagtaatcagtataggataacatannnnnnnnnnnnnnnnnnnnnnnnnnnnnnnnnnnnnnnnnnnnnnnnnnnnnnnnnnnnnnnnnnnnnnttggctctataatgataccactacaaattagaccactaaatctcaacttaggggtggggtgaaattcttaacatcatcaaaaagttaaatttgttttcaataatttgtgggggggaaacttagataaaattaactaacaccttgcattacagaattctcagtcatgctttcatggctcagacctgaccagagactgtttctgccaagttgagatctcccgcgagaaaacatccaaaagttttgtcattatctacctattgctcggaaatggtttattctgcctgctaaccactcacaaactttgatatgataacaaagactaactgctgcttacaaatgctcgtttgatatttaacttgctattttctattcagggcaaaataactatcttgaaaatggttgttaattctcagccacagtgaataggaaatgccaatcaaaagtagctctcaatttgtaattcatttgctattcattgctgctttattaacatacctcattctcctttccctttaggaaataaatactctgaaagcagataatgatgccctaaagatccaactgaaatatgcacagaagaaaatagaatccctccagcttgaaaaaagcaatcatgtcttagctcaaatggagcagggtgactgttcttagcccagaaactaagtagcacaatctgtagatgagtatagtgatctcatttcctaaactgtaatgcacagacctgaggaactttacactgaccagctttaaaacagtactttaaaaggaaaagcctgttactgtttatttacctaaaagattcctaatgtgcagcactgttttctctttcagttagttgactcaaagggggaaaactaaagaatgcaaaacttttgctattcataccactgatgttcatcaaaagtatgcgatctaaaacatgactatcatttcctgacaatggggcatctcggtggcctgcctggctgattcttccttaaaactaaaatctctggaaaatggatttgcttcttaccctgtgttttctgcaaactgacttactttgttccagccaaagcttgctaataatagaaaactacccatattccaaaagtagatttcctctgtatcccagcatactttgtgaacctggctccttcttcactacctcagatctaatcaattagtccatgtaccctccttcctcactacagtcataacacatgagcatatctacctagaagccaatttctactgatgtagccacaactttttagaggcctattaaacatgacgttatccaattgcaggtcaacttatagttgtagccttacaacttacaggcatcagaaaataagtaatcaaattaggtacctggaaacatagctattaccatctcatattactgtctaattaaaataaacataacgcaaacatgtttgtccttatatattctacagtggatagaattaggaattgatggcttaaaaaaaaaaagtctatgaagagtctgtttaactcttcatgttccatctttctcttctgaagtaaactattttgaaagttctctttttgaaatgaatttgtgcttaactgtcttcactattaatactatttagaaataagctaattggatcagtggcttaaataatagctgactgtgtgtacatatgtatataatatgtatatacaatatcaggcatgcatgtggcttggaattttgtttcctccataaaatgtggaagtgaattaaacaagttttagtcatttatacaaagtcacaaatataaagttcagtttgtcacaagattaaattgctcacaaggtaaaattgtattgtttggcaaaatcacaagtaacaatcctgtgagttttctattatgaaggttaataataaatgggctcatttagttgcctgggcacctattcacaaattcatttgtcagcctctttttagttctcttaaaaaaaaaaaaatcatatgatcattttcctttttgggggtacttagcttccatgcctataaagtctggtaccagactgacttgaaattcataaacaagttgtccaattgccaagaatatgttaacaattaaaagttccaaactaaagccagtagcaccaagtcttcataagaatacaaagtatacatacagtattgcttacctggaggattcagatcatttaggaattctctttgatgaaagatcagttcccatttgagttcctccttgcactgagttttagtgatatagaactagcttgtagttagtgtttcattacattataaagaatagttttacacacgtatttaccgttttccaaatttaaactcagaaatacccaaagcaggcctgcttaagcccactacctggcatataaacttatagtaacactttgttactttctttttaataggacaagcatgagttaggacaaactctaaaaattcatattcttcactattcttgttttcctttgattgatatagaccaaagatggtgtactctaattttttaaaacagtaatggaacacaatttttttcattcttcctcctctccattcgaagtaaagatccccagttagtttttatataaataatctatagggattcaaaaggtgtcacagtccacttaattagtcaaattagcaatggctaaacagtatcaagtactgcagaatttatcactgaaatggataagaggaaatagtttagtcacaggtttttacagtccagcaagggccaaagaggtatagtatacaagttaatagtatttgtgttgagcaacatggggctagtgggatcacagaaatctggaaaaaaaaaaaaaaggctttggcttatcaagcctagtgtaaatttctgcatctcacacgactttagtttggccaggtatttatctgccaaaacaaggacaaatcttgttgtattaacagcagggtcacttctcattttctttgctgacttacctttttactgaccgttgtgaatttctgtctcaaaatgtataatatagaaatgcaagaaaaaaacaaatgtacagattgtaaagttttttgatacctaatgtaagttttctttgtgtaatatttatatgataaaagacattaggatccctacaacacaaatgtcttgtgtttcttctgcttcgtgaccccgtaaacactttacctgaatttttcctatattccacagctaagaccactgccctattctattaatcaaattgagttttcctggaaggaaaggcaaagcagctattcagtttaaaattttctacatctttttacaacacgaagaagtaacactacagaaatattcaatctctttccatcttattcataacttacagtggtccccaaatattaagtctataaatacttaacattaaaggag

SEQ ID NO: 16199 - DNA, 22205 bp, Human
ttttcagtgtttcagagtataacagcagtatgtctgtctgcatatctgcccacattctttttgtttgacattattataatacttaataaatgtacatattttcaagatatctgcccaaattctgagggtcaagataaacattaaaaaccggtccttatctgagatccatttttttttttgacattgactcaaacattttgtaactcagtctgtacccattactcatggagaagaatgaggtttcagggccatcttgcctgttgttttgtttttatcagtaagtgaattcttaacattagaaagattttctaagaataaatgtgtattgaacatctgtggttgccagaattacatgagttaggagcatttgtgacatccctgcaaccaattgtttacaagtgaaaaacagacagatgtattgaggttaaatctgtttatattagcttgtgctcattttctgatttttttggactaaaaaatgttttcgctaaacaataaaggaaacttcatagattcttgtcattaaaaaaataaagtgaagctatgctgcaaggttaaaaattatattctgtattaaatttgtatatatatacttaatttttaaaggtacatagtaggcatatgaatgagtaaatttgtacatttaatgattgtttttcaacacatattttatttaactcaaataatatgacagactgcataaaacaaagtaaaatgaaaatctaaatttgggtccctggttactccttttctaccttaattttctattatgaaaagccccatttttcagaaaccacttaacacctcttattttgcataaggctagatattgctttctataacaactatagcccccttaacttcttatatttcttgaataaatcagccacttttattcagtaaatacatattcaatgcctagcctactagatgccagaaaaaaatgctaattacagagtaagaccctgttttcaagctatttataatttaaaaagtactctggacaagcaaacattgatttacaacacagtaaaataaatactagttaggagaaagttcaaagtttaaaagtcactaagagaaacatagagtcttgtaagagtgagcctctcaaaggaaatgtaatctaacagtaattaatagagaaataagaaataacagggttggaggtgttgatggggtggagcaaaggataattttcttaagtgacagagtaggtgcagaaaaatgaaaagaaaggtaatgcatttgtggattccacaaacccttggccatttatttttctaattctcttgtgtaaattccaagtgttggtagctatcattacctgaaaaattcacagtatgctattttgtggttgggagcagagagaagtcaggtttctaaaataataatcgaaaggtgagtgatgtttacattctttctttagctgtcatctgctttttaaaattttcaggtctgcttaagagttaaaggcaaagagtttaaataggtgttttccaattgacatgttaagatacaacccaatgacttctttggcaggtcttaataaactgagctaggtctgattgagggtccttgctgtcttatttctttcctcattggcttctctttcttcactccaataagtttattcttttgaaagttaaccatagtcatgctattatttgtcaatgagtgaataagggattctcccttcccagtctctcttcccaggcctcttctttctcatcttttccttttctccctccttcttccccaacccctgacggcagacttgggaatttgaatatgagccaaataattaaaaaaataacagcaggatatttctacatctccatgaatgaacatgactctgtgtggttactgcagctgcaggtatgcatttacatctacattaactattgcatcatggacttcatgaagccaagcccccaaattaatctccacctccttctctggcattcaggatataaactcaccagaaacattccaaatgcagaagtggttctcatctttttttgcagcttaagatctgccttggtatttgaagagatataaactagatcaatttctttcacaggatcaactaaacaggttgtacttttttattattaatatcaatacttagattttagatatataaaatatagaatgaaaattatgtattacaaagctcttaaaaataaaatatacaaagaccaaagtcttgattgatactttagttaattaatgatgtgaagcatttaaaaccttttaaaataatttgttgttaaaaataatattttacatttatgtagtattttgttgcttattgctttaatgtaaaattacagtaccattgctatcttaaaagtgctgaatgctggacgtgttctccattttaccaatgagaaaataaagcaaggagggtagaaggaggtagaatagagattgacttttagttttgtgttcctgtgataaggggtcttgcaaataggggcattactttcatgtaagaaacttcagataaatatgacagaaatccaaagtccttggtaaataattaatatgtaggtcattgacatatattgccttttaaatctgtgaatccttacttagtagaaactagagagcttcttgatctaataattgaacttaacaaatatttctgaacatctactttgtgtcatagtgctggagattgggatagaaacatgtacaaaagtcactttgccctcatacaggtaaatctaagaaagtagggactataagaaccctatgtatctatatccaccatagtattctagcactgactacagggcctaggaaaagggtaggcattcacatagggagtatttgctggataaaaggcaggttggaagatgcaggaggggagtatgcagaaagaaaggaagaaagagaggaaggagagcgggaaggaaaaacactttctgagtttaattgaatttataagtcacaattttaacaacttttttgatgtttatttctgaacaactgacctacatactcagaataaaaaattgacaatttctaactgaaatagatcttttgagaaaatggggatcacataggaagtaaatccatacattgtaatatgagacaatttaccaaaaggaatagaatgagaaaagatattttattacatgccacctactttgcctctcagaccaaaattgactatgaaggagtagctggaagtcagccaaccacttaatgataaatctaccactcccagctgactataagccaattcttataaacttggctgaacaccaagaaagtaattcacatgagtaagcaaaccaataggcaggacaaatcgtggtgcattttatacacatttcttctagtgaaagatctattttctgagactaaggagaaggcttggggaacaagtgatttattgataaggctaatatgcattttggaaatagaaatctcatatttttggtgacattacatctgatatgatgtagaggaaggttttttaaaagttgagattgtcctaagggctggggcaatttatgtgtgtagaagaacttatcaggcaggtttttgggcaaatgtgaacaggaggaagatctagaaaggctaatgtcaggaaagacaaaatgtgttgggaagctatgtcagaaacttgaaataagctaagtttggcagttgaaaaaacaagatactaaaggaatttgaaagctaatgaaagaaagtatgcctaattaaaaattctgttagtaaccttgaacatgaaatagattgtcatgggatcaggagatgaattaggaaatgataaccatcttgcttaaccttatcatttttagccaagtcattcaatgggagtatccactaccttattgatcgaatggggaaaaaagtaattttaaaggtcacagaggaatcctttatactctcaagattccatttctttgatataaccattacagtgtaattaatttcatcttttcttttaaatacattcaccaagcatttggtttatttaaaaaaatgatacatattcaggaaatcaaaaatctctgacttagatacccggcaataataatcaaatgtaatgatctttattgttatttgacatatacataattggataatttgctaaaataactgtaattctggacctctttgtctttttatatgccccagcaattttgaaagaaattgaaggttctgtggtttttatttatcacggaataaatataattgaatatatccacatttttatttagttttaagcattttacttcataatcacttgtgctttcctattcttttatgtgttagacatctttctaataaggttaaaaactctctatgtaccaaaactatttgatatgcaactttactatgtttttgccccatatgtgcaacaactaagaagtgctaggtatgtaggagggtcccgttatatacatagttgttaatggtgaaatattgttaagtacatacaaagtataaagcagaggttttttttcagtgtaccacaatgaattctgaacttgactattatgaaaagtttgaagaagtccatgggattctaatgtataaagattttgtcaaatattgggataatgtggaagcgttccaggcaagaccagatgatcttgtcattgccacctaccctaaatctggtaaatctctttgttgttcttttttcacctaaaaataacaaacacactgtaaatggtaaatattaaggtgttcatgtcgtacacactcattctctatattaagaacagatgcggtagttttgatatggacatagaaaaggtagctctattccatgaccacaatttttacctgtaacttgaatagtacattgagaaatggatgttgttgagcacagttagaaacttacataatatatactaatgaacctgtattcatcccataatgaaaatttaaaactaccaactgtttaccttatgtcattaatgttgtcgtatatacagcgtatgaccaccatttttacaggtactctaaaactctctttcagctcaccagccctttaagtctatctacaaaactccatttttaagcatagttctggagttttacaactgtagacttttagaaattagactagtccgaattcatatttcttcatctggttgttccatttaccacttaaaaataaagccaaacacactaagtatgcccttagttatcttttttttttttttttttttttttttgagacggagtctcgctctgtctcccaggctggagtgcagtggcgcgatctctgctcactgcaaactccgcctcctgggttcctgccattctccttcctcagcctcccgagtagctgggactacaggcgcccgccactgcacctggctaatttttttgtattttttagtagagacgggttttcaccatgttagccaggatggtctcgatctcctgacctcgtgatccacccgcctcggcctcccaaagtgctgggattacaggcgtgagccaccgcgcccggccgcccttagttatcttgactctaaatctgcttctttattttcttccctattggaataaatggcagcacaatacctgtcatctgaagaggaaacccgtgagctattctagattcaatctctcttgcttattcatctggcatttgtaatcagtcaaaacgttttggtcatttagtctggtagataggtctcacagtcagcctcttaacaggtctcttgtctccctttctattgatccctcctccgctactgtgtttattctggcactagagaaattcttctaaaacacaatcctgataatcttgctcttctgcttaatataatatatgtcagtaccttttcatgatttttataaaaataacttggactctttagtgtgaactacaaggcttgttatctgcttgcctgagccccaactcctctcttcagatagaccctttgatttacgtcttatagtctatttccaattattttccgaaccactataccattcttaagtaccaactttagattaaaaagagagactgggcttctgcctggtagaactgtttcttacctcccacaagtggtgaatttatgccagtaattattaaggctaagctgaaggatcacatcctctcaaaggcatttcttgtcaaaatgtcatgtcagcagcaacaacagtagcagcagaacactgtgttatagatttcttctttgcagttatttaaatccctgtgccatattatacaatagtatcaataaaaacaaaatttattgtagctattgaacaatgtcactgacttcaaaaggcctttagctccctaaggacaggaaccagatttatcctttgctaagttttctgacctaggacccaacatgagacataatataccatcagtaaaatttttgattggaagcatgcttattcaagtcttcttactttttagatgtaaaaattaaagtccaaaactgttagcagcttgcacaatgtcacaattcatcatgaacaaatttggacacaggtctcaggtgtgctttactataatatttatctttatctcttgaggttatttttgtgttctaaacataaaatattatagaaaatatttcctgagtctgtggctattcagacaccctttaaatagtattgcattggtaccttccaactttttccatccataaatgcagcactaatgtcatcaactctacagggtcagcaggagactcaggtttatttaatttttacaggtacaacctgggttagtgaaattgtgtatatgatctataaagagggtgatgtggaaaagtgcaaagaagatgtaatttttaatcgaatacctttcctggaatgcagaaaagaaaacctcatgaatggtaacgttcaagttgattttaaaaactatttgcatatattctaaggtgtgtatgtacatggtacaagcaatgagattataagcaagaatggcaattagtatcaggtcttctacataagacagcatataaatttaaatttaaatttaaatcttgacaggctttgcagtatagtatgtgtacagcatatgtctggaatagagtgaataaggacaattcttatatgccttcagcagagtttagtaatatgtaaacatttatttctctgtgggctaaatgtgatgatattttaaatatggagaaaaatacccataaatttttcaatgatatatgcaaaagtatatttaccacagattcttttaatattgtggaaaattggaaacaacctaaatgctaatcgacaaaagaatagttaaaggttgtgtaataacactataaaatcattaacatttttggatgtttcttgaaattgcagtttaaatataatattttgagagaaaaagatagttagaagctatcaaaacgttcatctgtgtgcatggtattgggatggctgtaaatttgagaatataagtagatttgtatagaaggttgcttgccaaaatatgaatgatatctctcaggtgatgaaattttatttcattttatatttttctatgtaattttctctatctatatttctttctttcatagtaagtattattatgaacacaatatagaatcttttaatttttaatttttgtgaatatatattagatgtaaatattaatggggcacatgagatgttttgatataggcatgcaatgcataataattacaccatggaaaatggggtgtccattccctcaagaatttatactttgtgttacacacaatctaattacaatatagaatcttagaattacttctattttacaaatatctatataaatccacataaatagttacaatttttgaagttgcttaacctttacttttttaaaaatcaggagtaaaacaattagatgagatgaattctcctagaattgtgaagactcatttgccacctgaacttcttcctgcctcattttgggaaaaggattgtaaggtaaccagagtcaagtgttctcaaaacttcatccaattccaagaaatgatagagtgatctcatcagttatacacacttgtttatttattctttcattgaatctatagacacttaacaaatgtggaataaatacagtcaatattgtcagagagtctatattttaattccaactctgtcttttgccagatgtggttctaaaaagtccagttagactccctaagcctaagtttttacatctgtagaagaaagataataataacatctttttcatggaattgttataaggattacatgataatgcttataaagtgcttcacctaattcctagcatattgtaaacaacaaatgttagctacttttgtatttgttgttattactaattgtattgaatatcctccctttgcaaaatactgtgcttggtgctgttaggcatgcaaatgaaccataaaaggataggtcagataactgtcatataataactatgtattgagtgcctattatgtgttagggacataagagtaagacacatgcaagccttgtcttcatggacacctagtccatttcagaaaaaggacaggttaacagacaagacaaaaagtatcataggtcaagtaagagagagaattcaaactcagacactgggggtagggaaggcatccaggagcaacatctcagctgatatttgaatgatgtatcagtgtgatgacaattcagagatgatctgagggggcatctaaaatcagttcagcttggctggaagattaagtgtacatattggctaaataagtaaaggcagattagctaggaacggattataagaaatattgaaagtcaagttaagatgtttggactctgacattttaatggtaatgaggagtaatagacatattaagctgacggtttacactgtcagttttgctctttaaaaataatattatacatgacctcaaaatacagggaaaacatgaagtctgagaccaccaattctgttcttcaagacctttctctcaccagtgctgttcttcaagatcttatagtattatttgcagtcatcactaacaaaaaggggatatatcccagtcattaaatatttccattttgtaatccgttacatggcatatttgacatttcctggagatctacagacaaaaatcaaagattgccaggttagtttgtttttatcattagcaatcctagatagacgatatacgtcctgctgaagtcattccatgcataagggctgtctcattagtaaagaccagttatgtactttccaggagatgtgtcattattattttttaagagatttgaccaagacacttttttcctttggaggatagtggtggacttgctgttaactccttacttctcaaatggaaacaggtaccagacatttataatagtccaagccttcacaaagctgcttatttttcagagtttatcaaagactaggagatagttggagggattcatgtttggagtatttccagggttatttacagagaaacaacaacaacaaaataaaacaaatagatacaggatatttgtaaatatcctttatgcaaatagatacaggatatttggaatgatggagcagaaactgtaagtgataaagagaagaaagtgacaaaaagtaacaggctagtagataatataaataactgaggccaacggatttgagccattggtttgattgtaggagaggtatgtggaataactgatggggaagaaggaagaagcgggattttttggaagaaaagattatggctcaggataattcttcaaaagtgaaacctttatggtgaaggcaagattcagtatttggttacaaaagtggttacaaaagtctgaagtaacatagaagtaatgatcaatgactacatgaacttagagaatcaagtagatcacacacaccaacaataaaattacacagaatgataaaagaatttgaatggagagtgaaaccatgaggcaggtgttcaaatcttcagttaaagcaagggaatggccacaagcttagaaatagcatcagataggagaggtatagattagttagttaagtatcataggaatagaataggggtctttttttaattatacttcaagttttagggtacatgtgcacaatgtgcaggtttgttacatatgtatacatgtgccatgttggtatcctgcacccattaacttgtcatttacattaggtatatcttctaatgctgtccctccccgctctccccaccccacaacaggccccagtgtgtgatgttccccttcttgtgtccaggtgttctcattgttcacttcccacctatgagtgagaacatgaggtgtttggttttttgttcttgagatagtttgctgagaatgatggtttccagtttcatccatgtccctacaaaggacatgaactcattcttttttatggctgcatagtattctatgctgtatatgtgccacattttcttaatccagtctatcattgttggatatttgggttggttccaagtctttgctattgtgaatagtgccacaataaacatacgtgttcatgtgtgtttatagtagcatgatttataatcctttgggtatatacccagtaatgggatggctgggtcaaatggtatttctagttctagatccctgagggatcgccatactgacttccacaatggttgaactagtttacagtcccatcaacagtgtaaaagtgttcctatttctccacatcctctccagcacctgttgtttcctgactttttaatgatcaccattctaactggtgtgagacggtatctcattatggttttgatttgcatttctctgatggccagtgatgctgagcattttttcatgtgtctgttggctgcataaatgtcttctcttgagaagtgtctgttcatatccttcacccatttttgatggggttgtttgtttttttcttgtaaatttgtttgagttttttgtatattctggatattagacctttgtcagataagtagattgcaaaaattttctcccattctgtaggttgccttttcactctgatggtagtttcttttgctgtgcagaagctctttagtttaattagatcccatttgtcaattttggctttgcaaggacttcatgtctaaaacaccaaaagcaatggcaacaaaaagaataggggtctttaaagtgcaaaatttttaagacagattacaatcacaagtgaatcattgggaaactggtaactttgactcaagagagatgcagtgcaagtcatatcttcaggaaagagctagatttcccttgaggacaaaaaaatgagcatgtacagtaaaaagtttgggatattgaataagatctgccaaaataaagaatataaactaatagaagtttagggaaagagagatcactctttttttctatctgggaaaataaaaagcctcatggaggaccagaaggcaagctataaaatacagatagcattttgagaaacagaaaacattcaagaaagacagactagaacaaagaagacaaggggtgaaaattctgaagtaaattaatgcatacagtggcaaagggttccattcagctaatagatgaaaagaactaggaagggttataagtaagattggaaaagttcaatatggctaatgatggattttatatgaaaaatgttcacttttattctgcagtttttagaggcttttacaagagggctataaaacgagagctatacatctaagaataagctagatttctacaacattgttagaaaatgtcatcagtaagacaatttagtagctttagtttagtggtattccataaacagtggatactcaacagcatcctttcatgacattgcttaggtgcctgagggcctaagtagaagcccatgaggatactggactttactttcacagatcttttcgtgtaacattgagtatcagacctagagtaggccacagatgatctaacacaaatcatttgtttagtaaagaaaacatttaggtcaaaaattactgtactgttttttcttactgccaaaactagaaactaaaaccacagttttctgaaaactaattcattggtatttcttctgcatgtaaaatggaaactaacaaggtgttggcagaggttatattttcacctcataaaatgtttttttcctgtaatattgaaagtgaagagacctcagaactatttttttttaattatgtggagtgatggtgtagtataaagaccagagcactgtatagttgactgaatgatatgccaaatggtttactctcattgatttactctcaatgctatattatcactaaatttcagcttaatctcttcacttatacattgagaataataaataatgtaactgacttaatttatattgataaaatttacaacactcaaatgaggtattatgtgtgaaaatggcataataatgttgttctgtttgtagtgagaacaaagagaacaacactacaaaaaccactgtcacctcaggttattgaagatgtctttataaataattgtacatgtcttatgcattttgtaaaattaatgtgtattatgtttatatttgaaaatgtaaatcctttttaaaaaaatcttgatgagactgtttgaaaaaaatgttaagtggtttaatatacaatttcatcctcttagataatctatctttgccggaatgcaaaggatgtggctgtttccttttattatttctttctaatggtggctggtcatccaaatcctggatcctttccagagtttgtggagaaattcatgcaaggacagggtaggaacagcttctttacactgaattttttttcaaggttttataagacaaatgccatctccaagtaaaagtttttaactgttctggtacgttttcttccctgattcatagttaaaacacagaaatctaaaggcgcctggaggtttagagcaagcatactgtgtccagatgtagaaggcaaattgcagaatctgagcactctggtccaacacctaaaaataaatatatagaattatgtttgggagctgggggtagcaattttattctccaagattgagactcagtgtctgattttctgccttgtctctttttagtagaaacaaatgttttacaccgtattattacaactctattgaacaatgggttggggagagattagagaagagagaatgttcacttatttccaataaaattgccaggttctatatgaatatggaatttacaaagaagtttgactatctacaaaactcttcctcattctacccagagtgcaatctgaatattttaaccaggtttctcaaatttgttaagagttacttgagcagatattctggaaaatttttcgtttttattaaacacttttactaaagtgtttagatttgaggaagaaagggtgcaggatagtctagtattctaaagaaggccattctgatcatgtagtaacaattataaagaaaaataataatgtgttttcatatccacagatgataatattgactcaagacaaataaggtatatgtgctttgtgtttgttgctacattttgggaaaatttttgctaaagcataatgagtaatacatatgtcttaagattgtcaagacctccactgcagggcagagaaatataattttgcatcactgcaaagggagaaataagatcactataaatttcactgtagaacattttctgtaaggaaaaattccctaatggagtcaaagaacagaggaggcatacaatgacttcaggcaaagcagaaccttttgactcacacaacattatattattttgtcagctttatattttatgaaacatttttactatgagtgaggcaagagaaagaaaaaggaagagacagcatttggttatattacatcatttctaaaatctaatttcctggagtgagaatgacactaagggtacctacgagaacattccttcccatgtaaactaatagtgtaataaatactcatatagttactagttttagttgccaaacctagtttgtaaatggtaaatttgagaccagaactatattcttatgactatcagaccactgatagtttcactaagtcaactcccttcactaacaatttgattctacacacacacacacacacacacacacacaccagtttcaacaattttctcataagctttaaatcaaattgatgagagaactttccctgtttttctgtcataaactacattatctgataaagttcatactatttttacatacatagattatttaacatactttgcctctcttgctgcagagaactttgcttaagatatacagctgatctattctaatttcatgattatctatttatatttatttgttgttattgttgcttgaacactagttttcgagcagttttagagatgataccacttttacactgtttttctctctaattttagttccttatggttcctggtataaacatgtaaaatcttggtgggaaaagggaaagagtccacgtgtactatttcttttctacgaagacctgaaagaggtgaggaactgggaacacataagcaacttggtaatttctaagatgttagcatttgaaaatactctggatacaaaaatattcctttaaataaatgatgacagccatctcgtaaatttttaaaaggaaaggaccaaaataatacagatactttagcatagatttgaagctagcaaataaaaatattctgaaaataaatacattttaaaccacaagtctcaaaaatttcaaagaaaaaatttgaaagaacttgacttcatgaatcaataacacacacacataggcacacacacacacacattcacacacaaggaatcaacatgggcaagcaattaactggtctgcaaatgtagagatgttgcaattgttagataggtcctataaaataaccatgcttaatatgtttaaataaataaaagatgaaattttaaaaattacaaagaaacaaaaactattaaaattgacagagcagatttgaaaaaaaatagccaaatacaatttctaaaaataactaaaaaaatatgaaaaattaagagatgggttcaataatagattagacatggctacatagtgaattattgaagtaaaagatggagctaaggaaattctatagaatgtagcacagtgagataaataggctatttgatgaaaagtaatggttcttactaagtattagcatttaaaaaataaaaatgtttttggtatataagatacagtgataatgtctcacatatatcaactcaaacttccagaagaagagtgtaaagagaatgctaaaatatcaatacacaaattttttatggccttaaaattttcttataatctaatttttcttcagctttattgttagtgtaattcaaaataaaaatcactatgagatacctgttttacacccactacactgataacaatttaaatatctgacaataacaaatattagaatgtgaatcagtgaaaagtaacacactgttgattgtagtgtagaaagatacaaacactggaaacaacttgtcattatctagcaaaggcaaacatgcacatagtttaagaccctgaaattctactcttagacatatactctagaaaaactctgacttgtgtacattaggttagatattcaataattttcatagtagcattcttaataactgcaaaaattgaaaacaacccagatatatataccaaagaatccatatataatgtattttattgtattacaattagatattatattataatgaaaggaagtacactaaatatacacatcagctaggtaaaatcaaactatatgttgtctagagattcatacctaagtttgaaacctataaagtagagaagataataatttgaaattagcagtttttttccttttcttttcttttttttttttttttgattgttttgtttatgtgggatgggagtagaggtgaagggaactcaaaagaaaaaaaaactaagaaaactgtgaatgttctatttcataagttaagtagtaggtaataggtgctgtatatagttttcctctttaaatgagatatatacatatatctcataatttttaaaacatagaaaacataatgagtttctttattaagaggtgagaaattttctctattttcttatcctttactatcaccaaaaaagcaattgatatccatgtcttattcatatatttgaataacctttaaaatcctttatggtatttcagtaattttagagtgtttttggtgagcatttatttaaaataaaatcataaataatattttataaattaaattatgtatttatagaatttaacactagatcaaatttgaataagaaaagcagtcatgatctacagtttattatattatccaatactgtgttctgtaattagactattaatgacagtgaatttgaaatacacacaaacaaaattaaatagttactccaactctcttcctccatttcaaattgtccatgtctacttactcccgattttggtcaataatagccatgtttaggtttcctctatatttgaattaataaggctaagaatgtacaaattaatttttatttgtttctacaatgtatccagtagaaagaaatcaagacattatcactatatatatacacatatgtctgtatatataaaataagattttgtgtatatattatatatatatacacatacatgtgagatgcctattttgcacccatatatacatataatcttttttcttgtgtcttgaagcatcatctttttttaatttcaatttttaatttttatgggtacatagtaggtgtatatatttatggggtacatgacatatttttatataggccaccatgcgtaataatcacatcaaggtaaatgaggtattcatcacctaaagcatttatcatttcttcatgttacaaacattccaatgatagtttttaattattttaaaatgtacaataaattattgtctactgtagtcaccatgatatactatcaaatactaaatcattctatctagctctatttttgtacttattaactatccccacttctcttttgagtaagatagacaagtaaataaaacattacaaaaatacacatgtggtaaattagatttatttaaacaattatgggagcaaaacagggtcatctacccaaaattagaatagccaaggatattatcctaaataagttgataaataagctgaaatcgaaaaggcaaactacaatttattgagcagagaatttagaaacagcatttgattggcatagagagaaatgtgcacttgaatacacattgcggttagtattgcaaatagttgcactgagagatatagctgaataatggtgtatattataggagtggcacagatatggggatgtttgtagctatggtgtacagacaactgatgttgcattgtgagtatttgactttttacaccttttcttaatctttcttgtttctttgtttctcactaattacaccaataaattaggagaaaaatgaaaattgcctgtatatctttatcccccaaacttgatttttcacaggggactttaggttttgagtatgatgtttgttttcatagacaacatctattaagtgtgattatgcatcaaggactacaataagcattcacaaacatctcatttagttttttgaataatcttaaagtatcttttataagcattttatggatgaggaaaattatacttaaaacagcttttataaaattcccccaattagatttctcattagaaatctaattctaatatcagtaggagaaaagagaaaggtttattttttctctttcatttagatagtgatttattcagttttagcaatttagttctcaaaacattttctctccctaggatatcagaaaagaggtgataaaattgatacatttcctggaaaggaagccatcagaggagcttgtggacaggattatacatcatacttcgttccaagagatgaagaacaatccatccacaaattacacaacactgccagacgaaattatgaaccagaaattgtcgcccttcatgagaaagggtgagaaaaatgtggtttgcctcgatactagaggaagtcacaaggtgacatggttataggcaaaaatctagtgaggtattttaatgcctatgaacccagcttaagttttcttcagcagtctttcatatttgaatacactctttaagttacacttctattacattgcaattacctgttgattatttattatatgcatcatattatgttaaaataactagcagactcctcaatctcagcattggaaatagtatcacactctactagctgtaatttaccaagcctatgtgcctcagtgttacaacatgtatcatatagttcctttaagttctaaccagaaattccgcagaaagattttattcctctctctttttgagttgaagaaataagtttagaatagtttgtcaacattttttaacaagtggcaaacacctttcaagggtaagtggcaaaaaatagaaattcaaatatagctctgtttagcaaaaaatatcaacatataaggagaaaaaaattctatttggggggagacatagcctgatgagatatagccagttaacaaatttaaaggcatgtaagatattcagatattcagagcactgggacaccagtctatttatatatgaggaagcagaaacaaacagaatagaatcaaatcttgctctttgaaccatactgtcagtgagagtcagggaatttgtaaaataacaaacctgccactggggaaaaaaacaaaacagaacagggatccactgaaaagagattcagttctcaaactatattttaattatgtactcttttgattatatgtttcctttttcaaaattctacatataaatgttacagaggacttaaaacagttgtcttgcttgcaaacggtgacttgctgctgtaccctcagaacctatctgatttttttaggatacacatgttctgtcttctggtttttgggttatttcagtgggaaagtttagagctccttgagcaagagggcaagtgaactcttgaatagtttaaaaaagaaggtgggctgggcgcggtggctcacacctgtaatcccagcactttgggaggccgagacgggcggatcatgaggtcaggagatcgagaccatcctggctaacacagtgaaaccctgtctctactgaaaatacaaaaaattagccaggcatggtggcgggcgcctgtagtcccagctactcgggaggctgaggcaggagaatggtgtgaacctgggaggtggagcttgcagtgagcagagatagctgcactgcattccagcctgggtgacagagcgagactctgtctccaaaaaaaaaagaaaaaaaaaaaagatgaattccttctgcaaggtgagtgttggaagtatgttaaaaagcaaaacaggaaaagcctgctggactattataattacccagatgagaaacactctctggctggcagtagcagaagtgtttaagaggcagtagatataaagaaagcctgaatataatgaattagatgttgtggttaagagaataacgtccaagcttatgtgtagatacctggtgttgactctacacaggtcattaaaatgtaaatggagaaaacacaatatgctaaggaataaaatgaatttatttttgaactaattgtatttggaaaatttggacatttttcaggtggcaaaatcatgtaggcagttgtatataaagcataagtctggattttagtgctatcagcattaagatgatatttaacaccttgagagtgggtaaaacatggatcttatcctgggagccccaacagctgagatgaaacttcagaagaaaaataaagtaaatggcataagaagaaagaatcagagaattaaatttgttgtttttttaaaccaattaggacaaatccatctttgtaagcccaaaaaagtatatcattaaaggtatacatttgattcctaaaattgagaattacaagtataatatttgattaggtgttaatgaaagtgatgaaattagcaaacctaatgattctttttggaagacttaatatttattgagctttcttttttgttacaggaattacaggagactggaaaaatcactttacagtagccctgaatgaaaaatttgataaacattatgagcagcaaatgaaggaatctacactgaagtttcgaactgagatctaagaaggtctttctttacttaacatatctgatattaaagatttcttttcattattctccactttttcttattttagattgctagaaaagacataatcatggattatgttgacattttctttttaaatttttgtttaactttttttttttttttttgagacagagtctcactctgttgcctaggctggaggacagtggcacaatcatggctgattgcagccttgacctccttgactcaattgatcctcccatctcagcctcccaagtagctaggactacagacatgtgcaaccatgtttggctaatttttttaatgtttttttgtagagatgaggtcttattatattgtccaggctggtcttgaattcctgggctcaagcttcccaagtagctgcaacaacaggcacacaccaccatgctcaactaattttatttctattttttgtatagacaggggcttgctatagtgtccaggctggtctgaaacccttgagctcaagtgatcttcccacaccagcctcccaaaatactgggattacaggcttgagcctccatgcctggcccaggtaacatgtttattgagctgtacatgcatatgagaaataagaaacttttttttcctactatcatctcttaaattttgttttctttttcttttgcttcctcttcttcttttctattttttataaatatcatgcacaactataacctatgggaatgatgtagtaacacagattattcatcttgttagagttgtattaaaaataaacaagcatttcaaattatttttgtgattgattttccatttagtaggacattagtatataataaaaatggtgcatgaactttgaagactctggaagaaagaatgaaataatatataaatagggggcataactatagctatgatttccctccttattttcttttattttctttttttttgagacggagtctcactctgtctcccaggctgcagtgcagtggcgtgatctctgctcatgctcactgcaagctccacctcctgggttcccgccattctcctgcctcagccttccaagtagctgggactacaggcggccgccaccacgcccggctaattttttgtatttttagtagagacggggtttcacagtgttagccaggatggtctcgatctcctgacctcgtgatccacccgcctcagcctcccaaagtgctgggattacaggcgtgagccaccgcgcctggcccattttcttttactttcaacaaaatgagttaattttaaatttaccttagtctaactccaatttttcaacataacacaacagatttccaaacatccaaaaataattccaatgagtgttatttatcttcagctagtttgaaatatttatgctttagggttccttctgtcctatatgcaatccaacaaatgtaaatattgtaaaataagttttaaagaataagatatttggcagtaaaatataacaaaaacagaagaaaaaagaattaaaattttttattgttttttatttaaaacatcttctatttttaaaattgtattctttttctgtactatgtttagtcaatgcttcctttcactaacacagaggagacacaagatcattacatatttacttagggtcttcagtagaatgcttatctagactacaatagactaaaaggccaaatctggggagaaatccagatgatttattttcttactttttggagaaaagtccatggatttctgagcaccctattcaatagttatagtttttaagaatcaaagcttttttttaatgtttaatatagttattaattatacaaaaattggagagtcttggaaaatattaagatattgttgaggacagtgtttaccgggggaatcagaatcaatccctgaaaacaattgttttacattttttatgtgcccatttagtcataatttttaaaatttcacattataatgtccaataacttttttagaatgcattttgtaagattcatagtgatgttgcccacattataattgacgtaagtaagcaataataaacctacgtatatttctg

SEQ ID NO: 16200 - DNA, 9391 bp, Human
agagcgtctccatgctatggttgcatttccgttttctatgaatgaatttgcattcaataaacaaccagactcagttcttggggcccttgtttgcactccctctgggtggagctgttgaggatgaggggagaggcggaggtcttccatttccccattcttcaagccatggccctactgggaactgcaattccttgattctcccgtttttcctgtccctccagcaacagcattaattcagtaaacatttaccggggcactgtgctggacagaggccagttcctggaaaagcctttcccacgccatcccactgcagacatccctccttacctccccaggaacagcagtctctgcccacctggccccgcccaccagactgaggctcacttcacctctgacctgagcggcccccagctcaccaggccacaggcccaagcagtgctccctgatgcggcgtttataatccgctcagcgtgcaggccgaggcaggagggtgatgaaagctgggcaggctccaagaggagggagttttgatatgtccctgaaagattcatttagacttcagtcggctaaggaggacatgatttgggggccaaggaatctgttgaattcagaacacaaccagaggtctgcagggtcagggatggaggagtgggctttcccctcgccagggcccactcctcttcctgcttttcctgcaggcgccactgggaggtgctatggctgtgcctcccctgggctctggagcatgtccagttgcagtgggcagaactgcggaggcgggcccctcctctgccaggcctggcagccccctcctagggccttgtttggctaggggtggtgccgggtgtggcagtgtgtgtgtagtggagagtgttaggtcttccctaccaggtgcccttgcaggggagtgccacagcagtcagtccagggatcccactgttagtctcaccttttttaacctcttatctctccccaggatccctgaagccaggtacgagcaagatgagagtgggttatctctggagtgacagaggctggtctgttttccaggctggtagggactgttcctaaagggaggaagggatgataccagcctcctgagcctccttctcctgcgttagtgtctcaggccctgccaggccttatagaccctcttattgacactgcccactggatggggaccggagttggactcagcttctgccgaaccctcaaatcccagccccaactaaagcatataactcaagacctacctgcactgaaagctcttctcaacctgagcagggtggtccaattgaaagggtgggtctgaccacctctcctgcacccatgcgggttggcagaggtgtgcaggatctgccacttaccattcaccatgtggccttgaggaagacgcactcggggcctcagtttcctcatctataaaatggggatgtaattacaccctcacactgtagctgtgagtattcaatgagagcactgcaaagggcctggtgtggagtaggtcctcaggaaaggttggatcccatgtcccatcagagctaaaagccccaggaggagagggtggctggtttgtccccacaaacccctgggattcccggctccccagccccttgcccctctctccagccagactctattgaactccccctcttctcaaactcggggccagagaacagtgaagtaggagcagccgtaagtccgggcagggtcctgtccataaaaggcttttcccgggccggctccccgccggcagcgtgccccgccccggcccgctccatctccaaagcatgcagagaatgtctcggcagccccggtagactgctccaacttggtgtctttccccaaatatggagcctgtgtggagtcactgggggagccgggggtggggagcggagccggcttcctctagcagggagggggccgaggagcgagccagtgggggaggctgacatcaccacggcggcagccctttaaacccctcacccagccagcgccccatcctgtctgtccgaacccagacacaagtcttcactccttcctgcgagccctgaggaagccttgtgagtgcattggctggggcttggagggaagttgggctggagctggacaggagcagtgggtgcatttcaggcaggctctcctgaggtcccaggcgccagctccagctccctggctagggaaacccaccctctcagtcagcatgggggcccaagctccaggcagggtgggctggatcactagcgtcctggatctctctcagactgggcagccccgggctcattgaaatgccccggatgacttggctagtgcagaggaattgatggaaaccaccggggtgagagggaggctccccatctcagccagccacatccacaaggtgtgtgtaagggtgcaggcgccggccggttaggccaaggctctactgtctgttgcccctccaggagaacttccaaggaggtgagtgtgtgaacgcacctgtgttggagcacggtgtcccactctggcgggtccccagggcctgagcagcagcgatagccctgtgacaatgtgaagggccacagaactcttgtattccagtcaggggcaaagagtggagacggaaggcctgtccttctgacaagcagccccttccactgtctgacagtgggaggtcacccccactgtagcagaggggtggggggcgggtactgccaaggaggagctttggagtgataggcggggcaggcctgggacccttggtctttcccaaagggtggttccctttcaaagttgctattccaaaggtagcagtgaggatggcacaaatttatgtagccaggccactcctgtttgtccgtggagtggagaggagccaccctcctgccctctcagaggtccaggtgtgctcactcctatttgggaagagagaaggggcacagcagccctgcaggggcccctggctctgctcgtgtttctgggcttctgctggtagggggtgcgaccttcccgtttgaccctggactttctttctccactgcccactttcacccactgggcagctcaggggaggggtcctggcaggagccacagggcaggagggtccatgcctgtccatgctgtcctgggagtgtcttgagatgcccctgggggggccgccctgtaatcatcctcctctccccctccccactggctcgaaggcaggactcgggaggcttcatcagaggactctaaaggatttctggggattctccacttttcgaccctgacccaggaggaggaaggggaaggatggtggtgctgggtgggagtggggatggtgtgtgcttcatccccctctgaccgaaatcctaatcttgtctctagatctgggggctgcagtgttgtgtacctgtcacccttagccttgctgctttgacctgtattgtctgttctgaccctcctgagactggaagctgggggtaggggacacactctccttccatcctgttcctcaggagcccagcaggggtgcagaaggggaaggcagacatgagggcaggtggagtgggggtagaagcagggccagagacagaaggtggatgcctgtctgggatggtggtgcaaaggctgagacagaggctggggtggatggaagccaggatgcagggctaccaaaatcacctggtcccagctgacttgggggtttggaccacagttctttgtgcaggagtccttgggtggttggggagcgggggtgggacacacagggtgaagggagggattggctgtttgtagctgaacagcagaacagagcactctgcctttggggtctctggcatcactggcagggagaggggtggctgggccaggagcccacctcatccccagtgctcagagaactgggtcctcagaagtggtcccgcccccactttacacataaggaaacagacgcaaggaggagagggatgcccaatgacgggcacttcgatgagtccgtgtgaactctgttccgtgtgagctgctgcgcgctcagggaatgattgtgagaagcgggtggaggctggagtgggcagcaaagaactgacattttgaggtcagtttttcactccttggtcaagggcaggctctctccctggtcattaccaggagcctggctccgggcagcaaagaactgacatttcgaggagctctgctaagggccaggcagtatgtgagggagttcacagacaccgtcccattttcacagccctctgaggttggtaacataacccccacttcacagatgaggaactccagcccagaaagcctgtcagccctgagaaaggaagggcagggcatcgggctgggcagctggcctgggaccagtggggtgtgatagtgttggctctgcttcccgcgggtggggtgccagtggggaggggtctcaccagagagggagccgggggagtgcgctcctgcgtccatcctcagaccagcgtgtccctcccaacctctgacccctctgaggccaggggatgggttcggcttcctttggtacctcttttggaagtctcttcagacaaacactggagagaaggcacagcaccctagggtgacatcagtggacaggtcagtttcctgttcctgttcccagccacccctgtctgtctgcccagggacctacctgcctggcccactcctgctgccacccctctccatgagtgggactcctgagcagtgccaggcccaggccctcagggtggcagttgctggatggggccaggcttcccattccctggcaggcagactcttggctctggaagatccctgggggactctgacttcttggttactcaggctactccgtaagggtagccttacgagagcgtaagggcatgaggggaagtcgatgggtagaccaggtgtctctgatttctctgaggaaatgcagcttctttgccaagaactcttgggctttggtggcttcgtcgcccttgcctggggtgggcgagttttagtctcttcagctgcagaccagaagctgagctgacctgaaaagagctggagttctggagttcgggcttccaggccagggcctgcttctgggtgagagtgggaggtaatggttgcttgaggcagaggcagtaaaccctcacacccgcagctggacaaaggcaccagctggctgtattctgtgggggcaatgtggcttctggaaggtctctccagtggctctgtagctggtcttggcaaagaatgttctagaccaagggttgtcaaactacagctcatgggccaaatccagcctgctgtctgcttttgtaagtaaagttttattggaacaaagccatgttcatttgttacatattgtctatggctgctttcacactgcaacagcagagaccatgtgtcctgcaaagcctaaaatatgttctgtcttatcctttacaaaaacagtttactgacccctgctctagacctccaaagacctggtatcctctttcctggtgttcaagttcagagaggtgtctggagtaggggctgagcctggcctggatgggcagtgctgtgacaagtgtctaggatggccgggtatcctgcacagagctagaaggctgcctggcacgggtgaaagcagagctgctccctgaccctctgcccctccctcctccaccctggcctgctttagctttccccagacatggccaacaagggtccttcctatggcatgagccgcgaagtgcagtccaaaatcgagaagaagtatgacgaggagctggaggagcggctggtggagtggatcatagtgcagtgtggccctgatgtgggccgcccagaccgtgggcgcttgggcttccaggtctggctgaagaatggcgtggtgagtggcaccctgggctagggcgctggggggctggggtgtgccaccctgtgagtcctgggccaatccctgagctgactgctaagctgcgtcctatgccctatgcctggtagattctgagcaagctggtgaacagcctgtaccctgatggctccaagccggtgaaggtgcccgagaacccaccctccatggtcttcaagcagatggagcaggtggctcagttcctgaaggcggctgaggactatggggtcatcaagactgacatgttccagactgttgacctctttgaaggtagagaggaagaggctgggggaggaggtgggcaggaggacagggtgctgggacagggagagggaatgaccagaatatgccacaactaggggtgtgcttgcccgcacacagcagggatgggatatgccgagaataacacgccacgctcacagggcccactgagaggcctcccttgaattggggacaactcttggccctggtttggccatttttttgtgagagacgggggcaggccctggcttggagtcttgtttatacgttcttgatgttcatctcctctctcctgtcttctcacaggcaaagacatggcagcagtgcagaggaccctgatggctttgggcagcttggcagtgaccaagaatgatgggcactaccgtggagatcccaactggtttatgaagtatgtggcccccagggagcttgggtctccgcatggggtgggaggtggcttgttctaaggagcttgcgggaaggattaggggaagcagatagccaagaaaggataaagtgagggtctgggatggggaataatgggtccttaatactccttgacccctccctttccaccctcctgcgctcagtctccctagcctatgaggcaagctagattagggaaaaaaagtgcaacaggaaggcaatgggattgggctaggacgtaacagagggatcagaaaacgggtggaaaacacacagttctaccaagtctttatcctggttcctcctcttctaggaaagcgcaggagcataagagggaattcacagagagccagctgcaggagggaaagcatgtcattggccttcagatgggcagcaacagaggggcctcccaggccggcatgacaggctacggacgacctcggcagatcatcagttagagcggagagggctagccctgagcccggccctcccccagctccttggctgcagccatcccgcttagcctgcctcacccacacccgtgtggtaccttcagccctggccaagctttgaggctctgtcactgagcaatggtaactgcacctgggcagctcctccctgtgcccccagcctcagcccaacttcttacccgaaagcatcactgccttggcccctccctcccggctgcccccatcacctctactgtctcctccctgggctaagcaggggagaagcgggctgggggtagcctggatgtgggccaagtccactgtcctccttggcggcaaaagcccattgaagaagaaccagcccagcctgccccctatcttgtcctggaatatttttggggttggaactcaaaaaaaaaaaaaaaaaatcaatcttttctcaggcctggctggcagagtttgatttgccctggtcacttttgttatggtttcagatctgcgcaggggacaggcaggcatctcgggcttgtatgtgttcctggctgccgtcctctgaaggacccttcatgtgccaagattccaggacagtcagattctttcagaggaaacaggccatagaacaggagagtgaatcttggggaccgaagggaaaaaggagccactcagcagcatgcagtggctttggggagacagaggaaaggagagattgcgagtggcagaattgtttggaaggtttttattttggaaaagctgtgcagaaaaaaattcaagaaaatgttgctgtgaaaagagaaaaacaaatcttaagcattaaaaaaaattcaaccaactagctcagaagaggggagaaggccaaggttgagagaagagtcacagcctgtcaggcagatagctggcctccggcgggaaggccatttccctgagcacttgcagaggaagacagggtggtggcaggactggagtggcagtggctcccaaggctctctcctccaacatgtgcatctgccatctgctctgcagtcctgccgcaggattccctagtgaagcagctcaggcctgggggagccgtgtgtatcccagctgtgccggcagcatcataccaatcgtgggggtggtgaaggagccaggggttcattcatggttggtttctgatcaggcatcttgggaatggataatggaggcagccgctttcaggacaggcatgtccaggggctcctcccagcctctaccccgaagtcctcttcccaagtgaccccagtgatgtttccattgagatgcgctcctggctatggcaggcaccttctcaacttatatgtgggaaggggtcccccatgcttgggggacctaggcagctggcttggcccaagagagatgaggatggaggccaaaccaaaggggggcgccaatcccctgtccaacaccttctcaccaaaagctcccgtttggctggaggcagaccctgtggctctgaccagacttctctggcagcaatcctccaccatttgtatcttaagaaggccctcaccctctttgagtggagtcagaggatgcctcagattccagatgtaagcatcagaactgctttctgtcaagagctccctaattttgggaaagaagagcctgtcccacactgtcaggccctgaggtcagcagatctgctcctccttcccgtgcggtacgtctaggtgctgatgagggcagtccagggcgctcttgttctgggacaggctccagtccccttgctccagcaggtctggggcaaggaggtcagaggtggtgggagggcccctgctctctgtttccacttcgtctggatccttgctgctgcaaagtggcactgattctagctctgtcccttcctccttggctttccggctccgatggggccagtggcagggtccactcctacaaacttgattggaagccacattcctctggctcaaatatacttccagcatgtagtaaacggtccagaagacggtgaaacagcctaccagcaccagggtctggggccgaggcaagcacctacgtgaggcactgtttcccgaagcctacagcctttctcagcccaggacaatgagctcagaaagtctttttccttctagggactgcctttttcacccaaactgttccctctgccccctcccccgacaaggcctgtcctgtaagagttaggctagcagggtaggagcaatgctatgaaaccactgctgggacccaggtcttcccagtccttcaccccgcaggtcaccctgagaaacacactaagaactccatcccccagacaggacagtcccatctacccgcagcttgagtcttggccctagtaccttgagggtgttgggggtgatggtgtaaccatcttcctcaggaattttcagccccggtgggcagggcagggcgaagtcatcgt

SEQ ID NO: 16201 - DNA, 78850 bp, Human; identical to SEQ ID NO: 16013

SEQ ID NO: 16202 - DNA, 78850 bp, Human; identical to SEQ ID NO: 16013

SEQ ID NO: 16203 - DNA, 78850 bp, Human; identical to SEQ ID NO: 16013

SEQ ID NO: 16204 - DNA, 78850 bp, Human; identical to SEQ ID NO: 16013

SEQ ID NO: 16205 - DNA, 115814 bp, Human
cctctgcaaccgtgctttagtgagacaacaaatagtcaacacgtacaaaagctcagaaagtgctgtggaaaacatcagctagggagagagggggctacttgagacaggtcagggaaggcttcccagagacgtctgagctaagacccgagcactggagcatgcctgcctgggatgtctgtgcctctgaggtttccaaggaagacaactgtctttgcataagcccatggctgcccttgggggaaggggcccaggggacaccactaatggttgctgtgatagcatcattgtggaatggagtggaagctgccttggggccagagtatctgtcccccagcactcatttgcaggctgtgtgacactggccatctgggtttcttcccctgactcccaaagcccaggtccagttcactgcactgtgagggttcacaggtttataacaggataaactacagagagaggtcagtgcttcctggtatactatgcacagctgcgacactcaataaacagaagttcactgaactgcaaggtcactgctgctgtgacaggagggtcatatggatgtgtgtatcttgccagtggctgtggtgaaaccctgcttgtggagaatagacataaacacaccttctctctctccctctctgtcttcctttcacctcccctctccctccaccccttccatttcctattctcccagcatgttctttccactcttcctcacctccttccccttcacctccttcctacaccattcctttttccatctctttcctgttttcctaacttgttactctcatctttttctttcttttctgttcttcctgacagctccccttcctacctcctctcccttcaccctttctcctactctttcccctcctctcatttctacctctctttccttttcacttcccctctccctcctgtctttctcctttttcttttacctctgtgcctccctctcacctcttcccacaccacctcatctcctccataactaactcacctcctttttgtttgtttgttttttgagacagggtctccttctgtggcccaggctggagtgcagtggtgccatcacagctcactgcggcctcaacctccgaggctcaagcgatcctcccacctcagcctccccagtagctgggaccacaagcagcgccaccaggcccggctgttttactttttattttgtagagaaagggtctccctatgttgcccaggctggtctcgaactcctgggctcaagcgatgctcccgccttggcctccggaagcgctgggattagaggcgtgagccgccgcgccgggcctccccccttcccctccgccgccgccttctcatcgcccttcctccttcctcctgacgccccttactcccgatcacttctcattcattcaccagcttccagtcctcgctccctcacctcttttctttcctactcgccttctcctcctgcccctttatcatctctccttgtcaccgttcttttttgccaatcctctcgttccccttcctttcctcatctcctctcttacccacgtcatctccattctcgtgctccccttcacctcccgttaccttgcgcttctctcctctcatctccatcaccacctctccccgctttcgcctttctttagcccccgcgtcccctatacccttcgcccatgcccactcccctccccaccttctcttcttccaccctccaccctcgccttctgtctctcgcccacctgactccgctccgcccccagccttaggctccgccccgctgggggtcacggggccgacggacgctaggcggccgtagcggcctcgccagtcacgtggtcacgtgacgcgctccaacatggcggcgccgtggggccgaggtgtcgcttcctgacggggcggcgcggacggacgcggccggtgccggccgggacgccgggcccgcagcctagctcgccatctcgctcacgccgcccgcccgcggggccgtcagcccccgccgggccggggccatgcaggagagccagaccaagagcatgttcgtgtcccgggccctggagaagatcctagccgacaaggaggtgaagcggccccagcactcccagctgcgcagggcctgccaggtggcgctcggtgggtgagccgctcccgccctgccccgcgctggcctcagcacgtcggccgttgccctatcctactcggccttggcccggcctcctggcctccgcttccccccgatcccgaattccacccttccggcctcctcctcattatacccccggaggaagtgttgcccgggcagctcgggactggcccaaggtcacctagcaagttggtgacaaccagagcttgttcctcagggttccagctcagggcttttgccacgattccttgtcgccctgtttcctggttcctcccctcaccacctccaagtcctagaaacagtagcccttgccccaagttttttcgttacctgagctctgctgattggggttcccctaggtgaacagagcatgtaggaagagccgtccaactggtttagggaaacccctgattcttgttttggaagtgcccgttggagaatgttttcctttggtttggggatctcccatagctctttccctcaaggaaggattgtagaaggtgttctggatctcccaggcattgtagtgagcaagacatctgcttattcctagcagtccactaaaatacaaggtcttcagcgcgaagatacttgtctgacttattcattgctgtatcccttgcgcttgcaacagtgcctggcgcacagtaggtgctcgataaatatttgctgattgaatggaccctcagattatggaaagagggagaattctaactaatagttaaaggcttgataattgatagcaaaatcactatcctatctttcagttttaatcatttaacaaatatttatcaagtgcccactgcataccaggtactgagaattcagtggggaacaagacggacatggtccttacccctatggagcttatactcgaatagaggagacaaaataattaattaagaaaataggtgaggtattttggaatactgataaatactattttgaaaataaaacagcaagatgtgataaagagggcttgaggactgctttccatggtcaggaaagtaatcttttccaagaggaaaagtaatcaggtggtcaggaaagtaatcttttccaagagggtgacacttgagctgaatactgaaaggcaagaactatccaccatatggagtttcagaagagagttcttggtgggagaatccatgcatttgaccagagctgttttcaagctaattcactgccccaacgtctttggtttggaatctgtaaaggcctgtttttcctaacaaaatgagcaaatggaaagtttgatttttagtcacatagtttgagattgttatcacctttctcctttcatttgctacaaagtatagagtagtgttcttttggcatttagaaataggctggtgaactttgcacttccctggaaagaaggtccctggctttcatcagattttcagagggccctgagactccctcaggggccaactattgatgcagaggtggtagtctagataatctggaaacagttgctagtccgtgaaattcaggatcagtggaaggaatttactgagatgtagatttttaaagcttttctcttccaataaccaaggctgttgggtattttatcagcaatgtgggataagcactgcaaagcagtttgttaggcaagagcctggtatttataactccacgttgaaatctgcctggactctatcttctcgatattgttgtggaggtttcagaatagttatttggcagaagagtttttattttttcttcagaaaacttcttaacataaaattttcaccaaagtgtgcatcatattattggaacctacttataaaattttcatctgggtcatgaagggccattaacgctgagaatttaatagatattttcggatcgtatctttgttcagaagttcaagttttcctaacacaagtagtggaatgcatgttttcagtttttagtagtgaattgtaaaaaatggcctagataggaagtaatttgactacaggttatatgaatcacaaattggggttgtgccaatggcataataggaactgtcataagggaacgtatgcatattgttaagtgaccatcttttttaagagaataattgtgtgtcattgctgttaaatagaaatgactgcttttacttagagtagaacacatagcagaatgcctggtgatatttctctctgtctctcaaggcccagtcttgtgtccagtagtcccatttaagaagagaaatttggggccaggtgcggtggctcacgcctgtaatcccagcactttaggaggctgaggcaggcagatcacgaggtcaggagatcgaaaccatcctggctaacacggtgaaaccccgcctctactaaaaataacaaaaaaaattagctgggcgctgtggcgggcacctgtagtcccacctactcgggaggctgaggcaggagaatggcgtgaacccaggaggtggagcttgcagtgagctgagattgcgccactgcactccagcctgggcgacaaaacaagactctgtctcaaaaaaaaaaaaaaaaaaaaggctgaaacgagccagtgtataaggagcagctatgtggtattttagagattaccatgtatagattgttgttaattgtgataagaggaactgtaaatgacggctcaaagttgaaatgcttggatgatagagagcatttacaggaaacagcttctgtgatatgattccaccagctgtagcatattaggggagaggatcagggctgcagggactgtatagtgtagatgttagctaggagtgtattctttgggaccctagacttctgtgttcaaacctcctgccttccacttgctacgtttgtgatcttggacaagttacttccttataggattattgtaaagattaagttaattgacatgtgcaaaaaacttggcatgtagtaggtgctcagtaaatgcttgctattacttttttattattattattttaagctgtgacaaaccacagcagctgtaattactctggtttgatgttcttaaccttagttcctcgttcaggaatgacttactgctctatttggtttgtagatgcagtaaataagaatgtaattacgtgattgaaaggctgtgttggagtattaacttcctaaactcaatgaagacaggggttgtcctttgtaaaaattgtgataatcatgatggagcagatttggagtaatctcaatgattcgtccgcactatacaccaaaagcataaatagggactgcccaagtaggggatagtgcccttccaacctttatctggagaaatcaagacagcctgtgagagtattcatcgccccaaggatactgttgctctttaccttgttatgaaactttgatatatattaataatcttcaacctttcagccctctgttggagaatataattacattcttaaacctcccttttataattgtcttatttaagactcatcttctcccatcatgtatctttaagttatgtttctgctcttaaactatatgaagtttggaggcttaataggataatctatttaaaattcgatatggaaaaatttatctatggctgggcactgtggttcatgcctgtaattccagcgctttaggaggccaaggtgggcagattgcatgagcccaggagtttgagaccagcctgtgcaacatggcaaaaccccatctctaaaaaaatatataaaaattagctgggtgtggtagtgcatgcctgtagtcccggctacttgggaggctgaggtgggaggatgacttgaacctaggaaatggaggttgcagtgagttgagatcatgccattgcactccagccgagacagcagggtgagaccctcacacaaaagtgctaagtaatggctaggtgctctataattactagttgtcattattctcagccattatcaagaaaatttaaaaagaatagtaaacatacgtattttcatatgaaattgaatgacttttaaagatcacatgttgtattatatctcctatgtactaagcatttctgagttccaggcacagtaaagtgggcttttcatgcaatttagttctcactattatcatcattcccactgaggcccagagaagttaagttggccagggtaactcagtaagtgatggaaccagggtataaacacaggcaatctggctccatagtccaagatcttaactattactaccatgttttcttgcttctccatatgaaagttgttatgtttgaaatactcagtagagtttttaaaacaatcagtataccgcagtggagtttcaggagactgtattttctatagctgaattttgagatatgtttgaaagccttgagtcaaaaagatcacagctcttttcttcaggtttttactacatatatactaggtttactttaattaggggctaatggaaagaaggaaatgagagtaaagagctggttacacataagtttcatttgagttattcagtttttcttttttttttttgagacaggatcttgctctgtggcccaggctggagtgcagtggtggggtgcgatctcaggtcactgcaacctctccatccctggctcaggtgatcctcccatttcagcctcccaagtagctaggactacaggggcgtaccacccacctggctaatttttctgtttttagtagagacggggtttttctgttgtctgggctggagttaatcagtttttctaattgatgatatctcttcatcagcagtaaactccctcttattaattctggagttgtgacctgttattaattctggattgtgattcatttctttgggtacagcaggcaatgggagaccaaggctaaggaagagagcaacttgcccatccacatccacacagctgggtggggaaacgtagctgcagcacatgatgtagcttcacatagatcataacatccattcttagatttgctcctctgtttaatatacgagatttaggatgtggatgggtcattggtgaccttagcttgagcttttttgatgctgtgatggaggtgaaagccagactggcatgggttgaggcgtgggaggtgaggaaacagatggtgagcatagtcagctctcccaaagtttggttgtgttgtaaagaggaagaaggagtggctcctgggagttgtttgtttatttaaaggtagaaaagattttaactttaaatattgttaagggatccagttaaggaagtatattcctaaatcttagttgtatatgaatgtgtgtaagacatacaaatgggcatttatcatatggacatctgtgtgtccatatgatacataaattgctttttcttccatatgatccttttattctaattttgatgtgttcagaaaaaccattctcatcatgaggattactgtgaaacttgaaaaatataaaaaacatctctaaattgatgtaacgtggcggggcatggtggctcacgcctgtaatctcagtactttgggaggtcgaggcgggcggctcagttgaggccaggggttcaagactagcctggccaaaatggcgaaaccccatctgtactaaaatacaaaaattagctgggcgtggtggcgcacacccgtaatcccagctacttgggaggctgaggcaggagaattgcttgaacccgggaggtggaggttgcagtgagccaagatggcgccactgcactccagccttggcaacagagcgagactctgtctcaaaaaaaaaaaaattaaaaaataaataaataaattgacataacaagactttaaattgaaatgcagaataaagcctttaattttagcaaattctagtgttttgatgagacatttcgtttataagtgctatgtatcataaaaattttgagaaataacaggactcaggaccctggaagattactttttgttgaaaaccactgtggattcttcaggaggaggttatctgtctggaagcagcatcaaaaaactggattgttcttgattattgaaaagcatttatatgtaggattggcagagagttgattgagactttgaaagtttgatttgcttattgatagtccagtgatccctctttgggccgcagtttcccaaggtgataaagatagtaatacctttgtcacaggattattgcaaaggttaaatggactagtgcagtaagtaactggcacagtacctggcacctaacagatgacctgctgaaattcagaggcattggtgttgcaatcttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccgcaatctttttttttttgagccagtctcgctctgtcgcccaggctggagtgcagtggcgtgatctcggctcactgcaagctctgcctcctgggttcacgccattctcctgcctcagcctcccaagtagctgggaccacaggcgcccgccaccacacccagctaattttttgtatttttagtagagacggggtttcaccgtgttagccaggatggtttcgatctcctgacctcgtgatctgcccgcctcagcctcctaaagtgctgggattacaggcgtgagccactgcgcccagccggtgttgcagtctttaaaggaaaaggaactgaatgcttgcctttctctacctcccctattagttggtttatagacctttttgtaagtctccaacatgagtgaagcagtggttggatagaatgaatttagagctctatcctgtacttgtaaatctcaggggagagtctgaaagcagtgctagggaaaacagtaagaccattcttcatgaaaaagagtgaacttgtgaaaatgtgtacttaatcagcaagaacatggagtgtcctatataaatagctcagagctgtgtttagctcttgccagtttcaccaggcttagggggcctgccaggaaaatacttgactttctttccagcaaggttatcctagaaaaaatagttttgcatttgctgattcatttctgaaattttccagtgagaagctcatttctgtttagtgccttgggtgtaaacaagccttctggcttgatattttattaggttttatacctttgtgaggagaacagccttcttgtgctaggacacaaaattcttaagttttccttccgtcctagggagtggtcagtgtatatttgtcgttctgaatatagcccttttgcctgttgactaaaccagacccaacatttattcagaagatatttatttgggtgtcacccctggtgtcatgatgcagagggatcaaaacaaacaaggaccatgttctgaaggagtttgcagttgaatggggtagatgggcattgttcagaggatatgccctctaggtcataataacaacccgagaagtactgaaggaaagaaacctggttctgccagggcagtgaacagtggggtgagggaagacttccctgaggaagtctcactcattcattgagaattaatgatgagtgagaattaagtagttgggggcaggaggcatttcagcagagggaacaacctgagtgaaggctctatggcagagaggaaaacagttgttggggaaactgaaagaggccagtgtgtggttggaacattgtacttgagcaaagagagtggagatggagtgggagtgggagaggtaggccaagaccccaacatgcaaggcctggaggtcatggctaggagttttattttttaggtcaaaggcagtgagatgacactgaagagttttaaaccgggaagcaggtgataggatgaccaggtgtattattttggaaaaatcatttggaccactgtgttcagaacatcttaggggaagaccagagggattgccaaggaaccaatgaagagactgtcttagtccattttgtgctgctttaacagaatgctactcactgggcgatttataaagaacagaagtttatttggctcacagtccaagagcatggcactagcatctggccagggtcatcctatggcggaaggcgagagaggaaatgggggttgaactcatctttttatcaggagcacactcatgcagtaacgtattagtccattcatgagggcagagccctcgtgacctaatcacttcttaaaggctccactcttacaccatcacagtggcaattaatttgcagcagagttttggtagggacattcaaaccatcgcaggcagttaccattgttcaggtgagagatattggtggcctggactagtggtgacagtagaaatagagcaaagaaaatgaatttccaacctggttagaagatgaagccaacaaaaccttgtgatggagcgagtaagagcatgggaaagaggattgataagcttgactctccgatttctgactcacccagctgggtggatggtgcctattttttaagatgggaatgtgggaagaggactacatggagtggtggagggaggaagttgatctgagttgggacttggatgtgtggagtttggtctgcctttgagcattcagttggacatgtgaaatgggaagtggccagttgtatgagcctgatgttcataagagaggtctgggcttaagataggaatttgggagtcagcagagtctaggtgggaatgggaagcctggtgagacggtatacagagggagaggcaggaggcctgggcctgagaaccctccaggccttttctggctgggcagaggaggctgagtctgcagacgaaatagagcagagatgggtaagaagcggaggaaagatgaggaaaatatgtggttatgaagcccgaagtcgagaaaatttgagagtgaggtcagtaaggtgaaatgctacagagaggtcaagtgaggtaaagactggaaaaatgcccatcagatttagagacatgtgggtcattggtggccttagcttgagctgttttggtggcatgatggaggtgaaagccagactggcgtgggaggtgaggaaacagacggtgaacatagacaactctttcccgaaggttggctgtgggaggagggagatgtggatgttaaaagtattttgttttttcttttttttaaggtagaagagacttgaacttgtttaaatgtcattggggagggagccagttcaaggagaggtttggtaatgcagaaagaagaaaggacagtgtttcattttttcaacaaatgttgagtgcctgccactctgtgctgaagaattctcagtacttgggaattcagcagtgaacagaacaggcaaagtgtctgttgtcatagagtttatgttctgctggggaaggcagatagtaaatgaactgatatataatatgtcaagggtgataaatactaaaaaaagactaaaaaaatgaattagtaaagtgagagaacaaaccaggtaaggagatacagggtgacaagggggtggcagtattaggtgctgaggaagtcccctgaggaggacatcagagcagagatctgaaggaagtgagggggtgagccatggagatatctggggggagggagggcattcccaggagcaggaatagctcatgcaaaggccccggggcagaaatgtgcttggtgtgttcgagcaagtaggccagggccagggtggtagaaggtgagagcagagggatagcaggggccagatcacatagaggtttggaggccaagatcgagagttttaattttacgcggagtgggatggaaagctactggagcattttgagcaaaggagtgttgtgatctgagttacattttgagggcatccctctggctgctgttgagaaaagctgtggggtggaagggaggataattgctgaagcatggagaccagttacaagaccattgtgatggcccaggtgggagataacagttgcttggcctagggtgatagtggtggcctagtgtggtaagaagggatcaggttctagatattatggatagtgtgaagttcctgagaaggcggatagggatgggaggtgacagaggtggaggggttggacacccactcccttatagcaggagagagcagagagtaggcccgaagtgggtcaggttgtaggtttgctaacagcaagctgagggagtctccttgtgcccacttctaatttctgagtgaagtaggaggccactccattggttgtgagtaaagaggacggcagcagaacagcgatgattgggaggggagagttgggccattgagggtggagaaatgtgcagtagccatcgtggagagtgagaggtgaccaaattactgggcagcatttcaggtttcattcgtggtgggtaattggggctctgtaggcctgccaacctgccctgttgtcagaggtctgcttaggcggagacaggtgaaaaggggacgctagtacaatctaagtttgggattttgccagaagttaagactaaaggtcagagagagtccaggctattgattgcgtgtcatctgataatagtcctgctgatgggatctaccctggaaaatgaggaaaaaggaaagccgagaggttggccatctcaaggtttgacaggacaaagacaggttctactgggagcaattgagagggtcagctggaaggagagaagaggaaggagctggaagttccccagttccatatagggacaagagtcagtgtgaccagcctcaccaggctggcttggagtggaggaggatgtggtaggtgactgggagctaaaggaatttaggggcagcgttggtttctgtgggggaagcctgcgacagatagaagtctgaggagtgtggaagggttactgtgggatctgggggcattggccactgatgggattgttgggcagtgctgggtttgaggttggtgatggtgattgttggacttgccttgggagtggaagagagaatgcgagccagtgtcagaggtgctggtgaatggaggtgtgtgacccgagcggtaacatccagaaaggatttcccgcaaagacagcgcggcttttcagctgcagctgccccaccctgctccagtctccctcatttccagcctggaaattgttgctaattgccccattggcagttgggaaggcaacgcctgttaagatgtggagcaataaagtggagcaggtatgctgtgccgtatgcccctcttcctgcaccgtcctccttctgtcatcgttgagtggctcaggagtgctggccctctaacagactgcctgggcgtggatcctgactgcagagtagcacttctggctgtgacgtgggcagatggcttaacctccctgtgctcagattcctcacctgtaaaacagttaatggatgattagagtgttcctgcctccctgggttgtggtgaggactgaatgagcacctgccactaggaggcaatcagtgagtcagctatcatcattattattattagggttccactcattctccttttcccttggcattgcttgatcccacggagatcccactagagattttgctttaatactgacttgttttaaaataagagcaagagaactgacatttattgaccacctgctgtgtgccagctgccgccttagtcaccaccaagacctctctcatggcggtgtcaagagaattatctgcactcttggtgcctagttatggtctctggagcatgtggggctgttttttatcactcccattttttagaataggaaatcaagattcagggaagttggccgggtgcggtggctcatgcctgtaatcccagcactttggaaggctgaggcgggtgtgtcacctggggtcaggagttcaagaactgcctggccaacatggcgaaaccctgtctctactaaaaatataaaaattaaccgggcatggtggcacgtgcctgtagtcccagctatttgggaggctgaggcaggagaatctcttgaacccaggaggcggaggttgcagtgagccaagaaggcgccactgcactccagcctgggcaacagagtgggacttcatctcaaaaaaaaaaaaaaaaaaaaaaaaagattcagggaagtttaataacccaataacccatctggcatcattcagctaatagatgtctgtgccaggacttgaacccagctctgtctcacacctgtatcttttctttctgccatatcaggctgtgccatgctatctgtgaggcaccctgccacacacactttttcgctgttcctttttctccctccgtttaaaaaaaaaattattacacttttaacttctgggatacatgtgcagaacaagcaggtttgttacataggtgtacgtgtgccatggtggtttgctgcacccatcaacccgtaatctgggttttcagcccagcatgtattaggtatttgtcctaatgctcttccttccccttgcctcccacccctcaacaggccctggtgtgtgatgtgtgcctccctgtgtccatgtgttctcattgttcagctcccacttatgagtgagaacatgtggtgtttggttttctgttcctatgttagtttgctgagaatgatggcttccagcctcatccatgtccctgcaaaggacatgaactcattcttttttatggttgcatagtagtccatggtgtatatgtgccacattttctttatccagtctatcattaatgggcattcgggttggttccaagtctttgctattgtgaatagtgctgcagtaaacatacatgtgcatgtgtctttatagtataatgatttgtaatcctttgggtatatacccagtgatgggattgctgggtcaaatggtattcctcattctagatccttgaggaatcgccacactgtcttccacaatggttgaactaatttacactcccaccaacagtgtaaaagcgttcctatttctccacatcctctccagcatctgttgtttcctgacttgttaatgattgccattctaactggcgtgagatggtatctcgttgtggttttgatttgcatttctctctttttttctttttttctttttttattgatcattcttgggtgtttctcgcagggggggatttggcagggtcacaggacaatagtggagggaaggtcagcagataaacaagtgaacaaaggtccctggttttcctaggcagaggaccctgcggccttccgcagtgtttgtgtccctgggtacttgagattagggagtggtgatgactcttaaggagcttgctgccttcaagcatctgtttaacaaagcacatcttgcaccgcccttaatccattcaaccctgagtggatacagcacatgtttcagagagcacagggttgggggtaaggtcacagatcaacaggatcccaaggcagaagaatttttcttagtacagaacaaaatgaaaagtctcccatgtctacctctttctacacagacacggcaaccatccgatttctcaatcttttccccacctttcccccctttctattccacaaaaccgccactgtcatcatggcccgttctcaatgagctgttgggtacaccttgcagacggggtggtggccgggcagaggggctcctcacttcccagtaggggcggccgggcagaggcgcccctcacctcctggacggggcggctagccgggcggggggctgacacccccacctccctcccggacagggcggctggctgggcggggggctgacccccccacctccctcccggacggggcggctggccgggcggggggctgaccccccaacctccctcccggacggggcggctggccgggcagaggagctccttacttcccagtaggggcggccgggcagaggcacccctcacttcccgcatggggcggctggccgggggggggggctgacccccctacctccctcccggacggggcggctggccgggcagaggggctcctcacttcccagtaggggcggccgggcagaggcgcccctcacttcccgcatggggcggctggccgggccgggggctgaacccccacctccctcccggacggggcggctggccgggcggggggctgacccccccacctccctcccggacggggcggctggccgggcagaggggctcctcacttcccagtaggggcggccgggcagaggcgcccctcacctcccggacggggcggctggccgggcggggggctgacccccccacccctgccggacggggcggctggccaggcggggggctgaccccccccacctccctcccggacggggcggctggctgggcggggggctgacccccccacctccctcccggacgaggtggctgccgggtggagatgctcctcacttcccagacggggtggctgctgggcggaggggctcctcacttctcagacggggcggctgccgggcggaggggctcctcacttctcggacggggcggttgccgggcagagggtctcctcacttctctcttttttttttgagacggagtttccctcttgttgcccaggctggagtgcattggcatgatctcagctcactgcgccctttgcctccagggttcaagcagttctcctgcctcagcttcctgagtagctgggactacaggcgtgcaccaccacgcccagctaatttttttatatttttagtagagatggggtttctctatgttggccaggctggttttgaactccctacctcaggtgatctgcctgcctgggcctcccaaagtgctgggattacaggcatgagccaccacatcgggccttgatttacgtttctctaatgaccagagatgatgagctgtttttcatatgttttttggccacataaatgtcttcttttgagaagtgtctgttcatatccttcgcccattttttgttgggattgttcttccctcttttaatggaaaaaaaaaagattgcattatccagatatatcaagaacccaacttttaggttgggccatatgagactactgctatttgagcatttccagcctgggtgagagggtgagactctgtctccaaaacaaaaacaaaaggtgctggtgtgcttcagactgtgccttctctccacctgcacgggctctgtcctgctctaagcccccattgctgctaggctggattattagcagtaacttcctgattggtttccctgcttctgtcctggccaccttcctctttatcctcacagcagccagagtgatctgtccgaagaaaagttgagtcaggccgccctctcccagcccctccatgggcttcctcccatcccttacaaagatgccgttatcatctgggcccctactgggcctagtggagaagacttttcaagagtgtctttctttctttatttcttttttattagatggactccaagtctttttaccatgttgctcaggctggtctgagctcctgagcttaaactgatctgcccacctcagcctcccaaagtgctgggattacaggcgtgagccactgggactggcctcaagatttttttttcttcaacaaaagagtagtttagaaagtgcagcaattcctaattcttgtgggaatacttaagggtaaatttagaaaaccaaagaaaatctgtgaacataggatttgcaactggagtttcttgggtttctgcagttactcttccaggtagcaactctttcctggtcacaggagagggctgctctcttcggtccctgtgccctgcactgctgctgctgccagtcctgtcaacgcttgctcattcccattccaaaaccaggttttacctttgctgtggtcatgccaggccagaaacagactttggagatttcagaaggcttgtaaactagccttcccagctggatgggttcacagagcagtaaaacaccagtgttttgaaccgtggttgtagctttcatggttagtgtcagtgctaggaaaaccacacatttaaactcttctgcatttatggtttacagagtaattccatatgcttgttcgagagtcgaggtatccaggagaacacagactctggagcctgattttctgggtttaagtcccatctccagtacttaataacttgtaacctctgtggatcttgattttcatctataaaatttataatggagtttggccttgaacttcagtcctctggctccttagttctttgttctttggctggacaacatttcgcttatagaaaacttgatgttttgtcctcatagcactgatcacagtccttaaaagccacttttagcccctgcagctacttttctgcagccactgaagcactttctcctcggctcttctccatcccttaaagcaaaattggcaaaccggtagcctcagggctaggcagcttgcaaaccagtcttatttaagccataatattttttaaatatatttttattgatacatatagctgtacatatttttgaggtgcattgataattggatgctttcatatagtcaaatcagggtagctgggatatccatcactttaaatatttattttttctttatattaggaacatttgaattattctttcctagctattttgaaatgtacagttggttaatgttaactgtagtcatcctactgatctaacgaacaccagatcttattttttctatttaacataattttaaaacaattgaaggtgtttgaattacaatcagaggtttcacttaaaatctggatttcgacctctggaaaaatcagaacaactagcacctgtgagctgagggactctaaagattccagtcagctggagctgaggagctgccgcaccccttcctgtactgggtggagagggggtcctgtcattctttgatcttacacccaccgtgttttttcttgacatttcccgtctggcctccatgggcctttgtagttggtgtaacttttgtgtttggtttgttttatgggttttttttgtttgttttttttttttttgagaaagtctcactatgtcacccaggctgaagtgcagtggcaccatctcggctcactgcaattactgcttcccgggttcaagcgattctcctgcctcagcctcctgagtagctggggttacaggtgtgtggtaccacgccctgctaattttcatatttttagtagagatggggtttcaccatgttggtcaggctggtctcaaactcctgacctcgtgatctgcctgcctcggcctcccaaaatgctgggattacaggcatgagccaccgcgcctggcctatagtggcatttcaaaacagattgttttagagctcacagcccagcaccaatgctagcgaagacctcattgctttagataggtttaggacttaaacttgactctaacaaggtaatggtgattggaaggaaaacctacatttgagtttgggcagcagcacccctctggcatgtcacagtgacatatcttgtcacccaagcagagccttggcattatagatacaggtttctaaaagctgatagcttggctgccagcctcatgggctggatcacccacaacttcatgggcctcttctagtggaagctggagcatttccttggtgaattcttttccctgaggggcaagatccatgccacacagctctctgaccctgtgtgtcacaacccttatggtccatgagcaaaatggttgctagtagtcatttgggcatttctcttctgttttcttatgtgtgtaataagatatacaaagtcgggcttgaagattagaaattgctacttccagtgagtcagtttacttggttttcacatcttcaagttgagtctagaatggagttacctaagaaaaggaaatttgcagccttcagtaccgtgtcctggggttgctagaataactagtgccatatccactctactggctctctagagattgtgtaaaggaggctggccttttggagatgatctgaatacatggtattgaggacaaacctccttcccaaggctgatttgataatatgtgagtttgtgggtctaacatgtagaaatacactcaactgagtggatgtggggtaattctgtgtatttagacagggtgttttgttgttttaatggtacgaaaccttgttttcctggaaataacactatctctgagattgtgatttctgaaaaatgacattttattcctataaccctgccaagggtagtgcaacctctgtggttaagattttaaaattaattttaattcaaaaaagtcacacgtgccttagcacaatgtgaatgtacttaatgccattcaactgtaaacttaaaagatggttaagatggtaaattttaggttatgtatattttattataattgttttaaaaagtgctgattaagaaaaagtatgtatgcttatcatagaaaatgtgaaaaaagaaaaaatcatcatcccactacttagacaactttcaatattttattggtttcaatactttgttatattcgtttccagtcttctatgcatatttgcacacagttgagatgttgtgatattaccatgttattgtgtcagctaactgtcatgaacatgcattctgcagaacaagaaacaggtaagaacgtggctgtagagccagaaagcctcggttcaaattctggctccctagttcttgatgtgcaacagtagccaagttacctaacctcctgtgccttggtttcctcatcaaaatcattgcttctcatcaagagcagttttgctcaggagacacttggcaatgtctacagacgtttttggttttcaagatggcagaggggtcaggggtgctcctggtatccagtggatggaggacagggatgctactaaacatcctagagtgcacagggcagcctcataacaaagaattcttcatccccaaatgtcagtggtgccaaggctgagaaatcctcctctaaatgagatggatataataagagtatggacctcataggatcgttgtgagggctaaatgagctaaaacacttacagtaatgcctagccagtcactccatgtaagtgttagctattattattgctgttacaattatttctttcacttcatatcagcatttttgtatttaaacatctcgttaacaatcttttcagtggtctccaaatatcttttagtaaagttttcctttacataaatgttgcattttcctaatgtgttttttcttccttccttaccagatgaaattaaagcagaaatagaaaagcagaggtaagctatagcactacctccttgctgagatacggcatgaagggagtaggtagcaactgggggagcctctttctctgcttggtttctcatatttctaatcctcaggggtggcacacactctgcaagcatggtgctaggcacacggcacaactctgtgtatgtttgaactgatgctaggttcacaggctactgcctcagtacttgtatacttggaaggaaggatcaagatcgaggtaatgctgttgtatcttttcttaacagaacaggcaaagcccttgtctcttgtatggcctgcttccttaggcatgaggacagcttgcaccatgagtggttactcctgatcttcatagtaaggaaggccgttagtcacgtttcagagatatagctctggcgtggctgccaccaggattcagtccaggatgttgttaattcagcatgccaatcagagaacttgctctctgcatgtggcacttcagtggtgtttttgctaatgcatgtattcaacttttaatgcctagccccaggatatagtttgcaggcactttaaattaaatggttgcagatggaatgggaagttagagtaaggtgtagaaaattcatttcttctcccgaccctctcttgcttttctcctaggcttggcactgctgcaccaccaaaggcaaacttcattgaagctgacaagtattttcttccattcgagctagcttgccagtccaagtccccaagggtagtcagcacatcccttgactgcttgcaggtaccatgtttaaacttcgtgttgtcaagggggttctctccaagccacagttggtccttacacagaactatgctggggaccacgctggcactcagtgctgtcagaggcgatgcagaaaggagcagtttaacgtattctttttggagatctcatgagggagggaaaagagaaaggtgtgagctctttagcttaaaaccagaaattttttcccctagaaatatcttatttgttcatgtcttgtgtatgtttttctaaatgaaacctttagcattaattggaatatttgacacacatgggcacataaggcatttttatacagcctcttttttattttttccattttgtagagatgcagtcttgctatgttgcccaggctggtcttacacttctggcctcaagcagtcctaccaccttggctttccaaagtgctgggtttataggcatgagccaccacacctcctggctcagcctttctttcttacttggtttttttttttttttttttttttttttggagatggaggtttgctcttgttgcccagactggagtgcaatggcgcgacctcagctcactgcaacgtctgcttctcgggttcaagggattctcctgcctcagcctcccgagtagctgagattacatgcacccgccaccaagcccggctaattttttgtatttttagtacagatggggtttcactattttggtcaagctggtctcaaaagcctctttcttaatggcgttaaaattcatatcaagtagagaaatagagacagttgaatctgttgtttttggtagttatgtgctataaagtcacctcccatactgaattagcaaacattgaatctttgttcctggaggaactacagggttaggttcctgcaagcctttagtcttcatgtgtttctatttaaagagactatctaatatctattgttgatgcattaacattgaactcaggggccacggtgctataacacatgcctgaacaaagcttatctaacacacataatttctgtgtgaggcacatcaccaccttcttgctgttaggaacactggaaagcacatcagcacaccctcggggtccattgtaaacagcaaaatcaccaacaaaaagcaccaaaatgcaaaaaacacagcactaactacaccactaaaaagatacttgttttcagtaggagagtgaaacaaggaggcatagtgttgccttgtttgacctcaggaacatgaacatcaagtgatttcaaattttttactgctctgtgcatgtctacaaatgaccaaaaaagccccagacgtattgatttgggcttataaataaattttagtgagtaggtgcatttgcaagtatagctgcaaataatgaagactgactgtatttagagtcacaagtaactttgttataaattaccttttactgaagaagaagcaagagtagagaagttaaggtgacttgtccagtaatatacaggtagtacgagaaacaggactataacttgggtttcttaattcctggcccaccattcttgtacttttgctcaggacctactccttaggtttctgattaccccaaagaacatttattctcttttttgtttattttgagtcagggtctcactctgttgcccaggctgtagtgcagtgccttgataatagctcactagagcctctaactcctgggctcaaacagtcctcctgcctcagcctcccaagtagttgggattataggcatgagccaccacacctggctcaaagaacatttattcttgacctcagtgggcagtccacatcaatgaataaagtttaataaaatttaaaaatatgttgaagtgatccacagcttgccaatactttctagaacaggaatggtgaccagattctgtattctgattgctgtgtagaagaggtgtctgaagaggtgtacagctttctcgagaaagagtactgtgattgattggttttatctaccaaggcacaggactgcaaagtggcagtgagcatgccacatttttggcatctctggtctaatatttactctattaatctctcttctttgttacatgtacttgagaattgatgagagtttcttcacggaaacaactcttccaaatgcaaagccattttgttattcagtgtaattctgtacagattgtcctatgtgagacatacagtgagccaagaattgttaaatggcaggcttcagtcctacttctatcctaaaatattttttgctgtgaacgtgttctgaggagatttggcagaatttgaattttagttgttctctccgcatgttaaggttttcttttgaagggagtgctgataatgtaattgacgttctaagaacagtggctgacatgcattgagctcttagcctgtagtgggccctgtgtgcttcattcaccgtaccgtgtgtagtcccctcgacagccctctgaggtacttactcttgtcctcattttagaatcaaggaaaccaaggcttagggaatgaagtgaccagcctagtccaaggtaggctgcagtgcagtggcgcgatcgtggctcactgcaaagtcaagtgattctccccgggctcaagtgattctcccacctcagcctctcaagtagctgggaccacaggcttgcacaaccacacccagataattttatttttatattttttgtagagacagggtttcaccaagttgcccaggctggtctagaactcctaagctcaagtgatcctcccgcctaggcctcccaaagtttggggattacaaacatgagccactgcacccagtgggtttctaggacttcttgactctgtgtctgtgttcttaaccaggggtcatcagctttggcccatgagccaaatctggcctactgtctgcttttgcaaataaagttttattggaacacagctgtcttagtctgcttgggttggtgtaacagaatatcatagactggatgtcttcaacaacaggcatttatttcttacagttttgaaagctaggcagtataagatcaaggtactggctgatttggttcctggtgagggtacactccttctggctgcagacagctgtgttctcacgtgtcatggagagagagctaggtttctggtttcttcttagaggacactaatcctgtcatgagggacctaccctcatgactgcatctaagcctgattatttctcaaaggcccagcctcctaataccatcacattgcaggcttaaggcttcaacatacaaattttagggggacacaaactttcagtctgtagcaacagctatgcccattcgtttatgtattacctgtggctgccttcctgctactgtgacctagcggagtagctgtaaaggagaccaaatgacccgcagagcctaaacatttagtatgtgttcctttatggaaaaaggttgctgctcttaactggcccctgctcttgactgtacccatgtggttctggcctgtttagtaacagaaatcgtttgtttctggaactccttgcatctgagtatgatttcaaacggaaacacaccctgccttgtttcaacccactgtgaatcttgagtcttatggggtatggttatctctctttttagaatggaagttctggctgggtgcagtggctcacgcctgtaatcccagcactttgaggcaggaggatcacttgaggccaggtatttgagaacagcctgggcaacatattgagaccccatctctacaaagtaaagtaaaaataaaaagttagctgggccatgtggtgcacacctttagtcccagttactcagaaggcagaggcaggagaattgcttgggcccaggaggttgaggctgcagtgagccgtgatggtgacacctaactctagcctgagtgacaaagcaagaccctgtctctttaaaaaaaggaaaaacacacagaaaggaatggaagttctctgagatgtaatagattctctgagatgtaataggtacactaggatttctttgtttagtatacaaaatgagtcatcctttttatgacatgagaaagtggctcggtgctccctgggctactgaatggaaaaaatgtacttccccatggtggctgcccttgccaagcctgtttgactggcttttcccagtgtgggcaaggtaacctctgtcttagaaatggaaggccagcatcggggtaaagtttggtttgggcagaattgaaaccagctgcagatacatcagtgctatgccctgccattccttgagcttggcgcagcagtaggagtggcaaaggtgcttctgggattgatttgccataagcacagttagctcaggcttcctctccactgggagaagcctggagacttcccctgcggcttgcttctaccaggtgaaaaagattctgtcttccctttctccagcatttggtctgctacacgcttccccgcagccagggctcagtgtaaggggggttaaggtcagtcttgtctaagctactaagtagtccccaagtttttctggtcacatatcaattttatatatatatatatattttttattttttatttttttagagaaagataggtattttttagagaaaggaaacacctttcattctgttacctaggctggagtgcagtggcgtgatcaggcttccgaaaaccccgacttccccaggctcaggtgatcctcccatctcagcctcccaagtagctgggaccacgggctaatttttctattttttgtaaaggcaaggttttgccatgttgtccaggctggtcctgaactcctgagcttaagcccaccttggcttcctaaagtgttaggattacaggcgtgagccactgtgcccagccagtttttttggttttttttagagacagggtctcactctgttgtccagactagagtgcagtggcttgatcatagctcactgcagcctcaaactcctggactcatgtaatcctcccacctcagcctcccgagtagctgggactacaggtgtgtgccgccacacccagctagttattttttttactttttgtagagaccggggtcttactttgttgcccaggctggtctcgaactcctggcctcaagtgaataataaaaccatttttgaggatatcctgccaatatattcatatttctttaatttaaaattataggttagggccaggtgcggtagctcatgcctataatcccagcactttgggaggccgagacgggcagattgcctgagctcaggagttcaagaccagcttgggcaacatggtgagaccccatctctgctaaaaatacaaaaaattagctgggtgtggtagcacatgcctataatcccagctacttgggaggctgaggcaggagaatcacttgaacccaggagatggaggttgcagtgagccaggattgtgtcactgcactccagcctgggcaacagagtgagactctgcctccaaaaattaaaataaagttatgggttgggcatgatggttcacgcctataatcccagtgctttgggaggccaaggtggaaggattgcttgagcccaggagtttgagctcaacatagggagacctcatttctacaaaaacctctttatttacacatgttcctgttattaaagtatatatatggccaggcgcagtagctcacgcctgtaatcccagcactttggaaggccgaggcaggtggattgcctgaactcaggagtttaagaccagcctgggcaacatggggtgcctgtactaaaaatacaaaaaattagccaggcatagtggcatgcgcctgtggttccaactactcaggaggctgaggtgggaggatcacttgagcctgggaggcagaggttgcaatgagcagagatcgtgccactgcactccagcctgggtgacagagtgagaccccatctcaaaataaatatataaataaataaattacatatattgtaaagcatacaaaaatacaactttgacaggacaattggaaaaatataaataaaattctaacattttctttttacatcccagtgaaggctgtaggaaaccattaatctaagctgccctgtttataccataaacattatcttttagctcttatttccagaaaacttttgattttttaaatgcacaatgaaaaatcaatttttaattatgtaagttgtacatgactacagtctctgttaaaaggtttttagaactttacagataaaatgaagttccttgggccaccagccccaaacccaattgcctgtttaggtgtatacttttctttcctctctttttttttcaataagtgatatcacttgtacaagtttctctgcagctttttacattcaacaccgttatcaggctctagctatatctctccatgtggatctagtgcattcttttgactggcatatgacgtgtcatgccaccattccatctctcgctcccctgtacagaggcacacacagggttatagtgaacatctctgtgcaagcctccttggagacatgcctcagtttctctggtcagaggtgactctttggattcctatcactgaggcaaagtaaatagaaccaacttcagaagagaccagtgaggtagaagacttaatttgtaccaaatatattcattcatgtgggtgggataacttgtaatacagcttacttaccctaacctctgtttattacagtacagaggtacagtatgtcctattctgtaccaagaaaccaaccgcatagcattttccttcatgcagtgagtcctataaaggcctgttatagtgtattatattgtcatcatcttcccctccatggcagaatgtccctgtgcaagccctgactcatgtgtcagtgggccagctgcctagaggcctccctccctgtccgtcttcccgccgctcattgcgttagcaaggaacaaggtggggacatctacctgggggatagtgggagatagggggcagtatctacaagtcacacacagccctgtaggtcccagttaggactttgagctttggtgcacctccctggagaatatagactctataagaaaaataattacgtttgtcttactattgtatccccagtgcccagaacagggtctgtcacaaagaaggatgagaaagcagaaccagaaagatccacaggatacaggaactctcctttctcctggccttgtctcactgcacagatgaggggggaagtcatgcttaaaaccctttctgatttgaagagtaatgtgccccttaaggagtctggagaggggaggatactttctgtccttttcatactttagttaaagtgcgaaagtcgtaatccatgtccagcctgctttgtggcatcagtattgcagcctacttttcagcattcacatttgaggagttcctagaccaccccacttgcaatccagtgcacaaaacagacttgagtctgttagatgtaagaacaagcaatgtcaaaaccagagctcattttccaggtagacagccctgccctcctaggaagcctgcacctgcagcagcaatgtgaggggtgaggtaaagggcatctggacttgcccttcacaggccacacccctcacctggagatttgggggttggacttgagcagcagagtgtacgcaggcctctctcctgctccttcagttactccatccagtagtattgcatttctactctcagccactctctcaatccatttttctttctgcttgttgagtggtgacacttcactagctaaggaaggggaaaagccattgagaaacggtgtcggacctttgcagagcggccagtcttcctcccacagtggtggctgctctatagataacctcaggaacctgagtccccctggtgggggcagaagcatgtgaccagtagaagccaaaaaggggaaagaacagaacagcagttttaggagtcttcaccaagtcactggaggcagagaatgccttagagttcacatgtatatgtgccagatgagtgattcttttatctgatcaaccatcaatataacgtggatagcttggagaaaaacactgattcctgggctccacctggaagttctgcttcagtaggtctgggtcggagtccaggaacctgtgtttttagtgagctccctcaggtgattatgtttctcagccaggcttagaaatcatcctgctgctgacctttgaggttccttccagctctgtcctccatgctgacatcccggttgtgtgtgaggtggcacagaccaatttgtaacctctcagagagggcacgttccaagcagctgctcgtgggtgacacacactactattgatgtaggtgtgaaatgcagatgaagtttttacattaatttttggggtagaaaatacactgacaggattcaacgttgaaaaaaatgaaaagatgtactacagagtgtcttagtcccaccccagctcacagctacttagttctcctccctcaagcaaccatgttattagtttcttaggtatctttccattgaaagaaaatacatattcatatatatatataattttaacagctttttgagataaaattaacatgcatacaattcatccatttaaagtgtaattcaagccaggcgcggtggctcacatctgtaattccaacactttgagattacaggcaggaggatcgcttgagcccaagagtttgggaccaatctgagcaatatagcaagaccccatctctacaaagaataaagaaaaattagactagcttggtggcatgtgcctgtggtcccagctactcaagaggctgaggtaggaggattgcttgagcctgggaggtggaggcatcagtgagccatgaccgtaccacttcattccagcctaggtaacagaataagaccctgtctaaaaaaaaaaaaaaaaaatatatatatatatatatatatatatatatatatatgtatgtatatacatgcacacacacacacacacacaaaattttgtgatttttagtttattgacagagttgtgcaaccattaccacaacctaactttagaccatttttatgttatcattgacgatcactccctatgtctccctacgccgcccccctaactctagacaaccactaatctctctgtcttgagtatgtgtagctattaattcctcaggcttgcagagatggttgcgtactggggagtgctctataccttgcatttttcatcggatactgtatcaccattccaggcatcttttgctgtcaggcgacaggacgaaggttgcagtcacagagtggttatgcctgcctggctcctggggagcagaggactctgtaggaactggaagtgcctgtcttttgctcttgtgggctgccacggaaggcctcagtcctagccaagcagaaatgtataatctctgttctttctctctttagaaactcatcgcatacgggcacatcactggcaacgcccctgacagtggagcccctgggaagcggctgatcgacagaattgttgaaaccatttgcagttgttttcagggccctcagactgatgaaggggttcagttacaaataattaaggtatgcctatttgtttgcctgtctggtttttaaattagaaagcaagtccctgtgggaatctggatttctaatttactatgtgttagttgtctcaggtggtgctgaggtggaacagaaagatttaagcgtcacttagatcttttgttaggtgtcagaatttattagcgtggactgagacaagaaaaatggaaccaggtgtgttttcaaagtaaactgttcagctaataacaatgtaaatttcttgtgaattaaatcgtcttgaaatcctctggttaaccctggattcccagtctgggtttctcagtgggtctttgttgatattcttatctctgacttgcctctgtcctacttccctgttcgatttctgctgccaggaatggtttggcacagatagtaccatctgcttgtctgagaacaggatcaggacaggtgtagccaaggatccaaatattaagtcctgaaagtattaacattatgaggggagggctccatgctagataaacctttcttaaagctcccttgaaaacccactagggaattgggaaactgaccacatcgaaacgtatattttctgattaatctgggtgagatcacgttggagtgttatatgtcatgagataattgtctgtattattcattttaggtttttcaatcagtatgaaaattcagaagtttggccttttttttttttttttttttttttgagacatagtcttgctctgtcgcctaggctggagtgcagtggtgcaatctcggctcgctgcaaactccacctcacaggttcaagcagttcttgttcctcatcctcccgagtagctgggactacaggtgtgtgccaccactcctggactatttttatatttttaatagagatggggttttaccatgttggccaggctggtcttgaactcgtgacctcaagtgagccaccctgcctggctggaagtttggctttttaaaaagtgagccagtagaaagcctgcttcaacacaatttaattgtttcgagtgatttggatttcatagaactgttcattgtttttcaactaacagccataggagttggctcttcataataatcacctagtttaatttgcagagccatcttacaatttatttgaaaaaagcacacagaaaagaaaaacaaaaccagaccctctagaaaagtgtggccataggagggcaggaaggtgatgtgcgttcctgatggtgaaggtcgcggatttctattttaggctcttctgactgcagtgacttccccacacattgaaattcatgagggtactatcctgcagacagtgagaacatgttacaatatctatttggccagcaaaaatctcatcaatcaaaccactgccaaggctacccttactcagatgctgaacgtcattttcacccgcatggaaaaccaagtggtgagtgacagcacttacgtgctaggggcaagacatcattgctctctgaactctatcatgtgtgaccttggtgcctgtgaagaatcactagcattttaaagctaccccttcttcctgtggattctctgtactgtgcttttgttcttgctttaaaaatcagagaaactaaagggttttgaaatttgtgttcagaatttgtttggagactgtcaaaggaatttatttccttttaaatatgttatccttttggctggaatttttctttctttctttctttctttttttttttttcttttttctttttttttggagagagggtcttgttctgttatccaagctggagcgcagtgacaggatcatggctcactgcaggcttgaccttcccagctcaagcaatcttcccacctcaacctcccaagtagctgggactacaggcatgtgccaccacacccagctaatttttttattttctatagagacagagtttcaccatgttgcccaggttggtctcgaactcctgggttcaagaattcctgctgcctcagccttccaaagtgctgaaattataggcgttaaccaccgcgcccagcccaggaaattttttaagtaataggctggcataatttttcttccttaccaaaatgctgtatcccccttttgttgccttttagttgcaggaggccagagaactggaaaaaccaatccagtcaaaaccccagtcccctgtgatccaagctgcagcagtatccccaaagttcgttcgtttgaagcacagtcaggcacaaagcaaaccaacaactcccgaaaaaacagatttaaccaacggtgaacatgccaggagtgattctggaaaagtaagcacagaaaatggagacgcacccagagaaagaggctcatcactgtcaggtacgggctgatacggtatggctctttttccaagtgtgagagggaatcagcctgtgaggggcagaagaagtgtatgtcataacatctgaaggaaacctctgataacagcttatctctttctgggcctttccctttgcttttctcttagggaacacaaccagtgaggcatgatgtcaagtgtcccgttgtcagctgtgctgttttctctaaatagtactgggatgtatctagctgctacttcttcatgtcagcctcagtgcaacaggttcaggttgggacacttatctttcagtagttaattgattgggtgattagtcactcagtgtccacaggaggacaagggcttagattctcatgtctacactggatctccatgccttgcccagtgcctagcagtagccactcatagatatccatggaaggagccagaaggtagcaggtggatggacggatagacagatggacagatagctttgttttcttcttctggtgaccatgtacatcacttgtttttgttgggtttttaagtgagagactaacccacacctgattatattcttaaagtaaatgaaatgaaatactggattgagttgttataagatgatacttctgactgttcatatctctccctgggcagtttgtaggaaccagatccaaaattggtattttttcaggaatttcctttcccaagtgattctgtcaaatgcttcttcactcaagcaggttgttctatacaaaatatctgacctgtcttcataactgatctcatttcttcttcagccacattactgataatgatttctgttggtagtatgttccctactggagtgcacatatttgagcaggttttattcctttataatttaccagactgcttgatgtacatgagaacagaccaagtgttgttgctggaatgttgtttggtattcatttactcaaggaaagcacaaaagaaaaaattgccaccaagaatggtgttgtgtctcagggtgagcacggagttgccttctacttacttctgctgtcgagagtcctaaggaaggtgctcagaatcccccggcccaccctctgtgtctgttatcatctttgcctttgtaactctctagggaaaggaccaggtttttactgtaacccttattaagctgtgatcagtcaataaatattaatatttaaatacactgtaataagcatagctgtgcagatataaaaccaagtctctctgacctgcataaaagtgcttccactttagcccattttctgtacagcagccaaagtgatctcttaaaagcgtgaattagagcatgacccctgctcaaacccctttggtaattccccatcctgtgccattctgactgaaatccatgccctgtcctcatagcttatacctctctttctcttttttgctacacagtgcacaggtgccctttctggttattgaacggctgtgcttgtttctccctcagtgcctttgcacttactgtcccttccctgcctctgaaccccttgtatcttcaggtctctcagttcagactgagagaggcttctctgatcaacttctgtagctcctcatcatatctgtcccattatcttttatttttttccatagtacttacaatacctgaaattactgaagggttctgttcacttgttcctgcactgaagcctaggctgccctgctcaccaccatattcccaacacctagaatggtgcctggcacacgcagcagacattgagcaaatacattttttgaatgaatggggaaaaaacgttattgctagaacataattttgtagaaacgcagtaacttgaagttctgctctaacaaagagaaaataatttgctgttagcatgttgctgtggattttgtggccaatacttggtgcatcctgtgagactttcccaggaacatgggaatcagattgcctgggagaagcaaaccccagacctgcaaatagtgggtcagaacggaagtgtgctgttacctttaaaaagagcaagtgggctgggtgccatggcacacacctgtattcccagttacttgggaggttgaggcaagaggatcacttgaggccaggagtttgaggctgcagtgtgtctgtgaatagcctctgtgctccagcctaggcaacaaaacaagaccccctctctaaataaataaacaccccatctctaaatcagtcagtcaatcttaaaggagcaaatgacttccagttctcaggactaggctctaaagaaagaacaggtccttcagaagagggagttgaacaagggagacacgtacccaggggcggagtccaggcatcaaggcccagtgaaaggcctgagctctagtgcctctgtggctattatttttacatattactaaagtgcatggatgttggacacaaccatggggctctcccacagactgtcctgtagtaatcaccatcacatggccaaccctaactggacactcactgtactgctgacttggcattcaacataatgttttccaatttaattaactgggaatcccccccacagccttcctaggataatttgcctcccatgttatttgtgtagatgaagagaattcaccaatagacctggacatctgtggtggctcacgcctccaatcccagcactttgggaggccaaggcaggcgggccacttgaggccaggagttaaagtttgtttttaggattctgacttttaactcccagcatcagacatcagtgtgtgtacatttttacagatactgtgtagaattacctatgtgtttgtgtggatttcttagctcactttttgcatctttttttttgagaatgagtctcgccatcttgcccaggctgtagtgcagtggtgagatcttggctcactgcaacctctgcctctgcctcccaggttcaagtgattcccctgcctcagcctcccgagtagctgggaccacaggctcacaccaccacgtctggctaattttgtattttttagtagaaacggagtttcaccatgttggccaggctgatctcgaactcctgacctcaggtgatccacccgtctcggcctcccaaagtaatgggattacaggcgtgagccaccacgcccaaccaggatctttgttttagacagcaatatgttccaaatgcctggaactgtgccggacacatacacactcagtttgttgattgaatgaatcttaccgccccaccatcccccatgctccctatttaactggacagagaacagggatgtggggaggccttatctcagactcctcccattttttccccattattcttagcatgtgacttctatccttagggtcatcttatggctcaggatcctgtcattttgttccaggtaggaagaaagaggaagagataggactgaagaactctgccagctgagtcaccccccttctaaagaggagtcttctggagcttgttgccaaccctgataacttatgcttacccctcattggctataacttcatcacatgatcaccctttctgcaagaaaggctgagaaatgtaggcacattccctcccaaaacaaaattcaggatctgttaggaaggatatgagttagagaactggcagtgcctgccacagagtgttctccagctggctagggagggaatggcagcaaggtttctcctatgtgagcctattcaaggtggccctcttattttgcttcggggcagagtctgaaacagatagggtctggtgcctaatcagtagtggtggtgatatcccagggaagagcagaaccagtggtttttaagtagattctttgtacctctcaaaggtttgatttgatttaattatcaaacactttcacagcatgcttgaaacttagatacaatggacttagtagtggttatcacaacatccagaaaagcctcttctgagacctatccaaggctgtcatgtcagcaggggaagcagtccacagttactgggtggagtcttcctgctttggggcctctactgggatttttccttagcagctccctcttcaggaaccttctgctggtattcgggctttctgactctccttagctcttcctggcctgagaatgttttgattttgcataagtactattatggatcctgcctattaaggaatatgagttatatactctatccctccaaaaaacgttgctcttgatgctgtttaaatggaaaaactgcagtgagggaaagaggagatccatgctgatgtgaaattttgtttttctccttaggaatgaaagatagtgaaggttttaactaactggaactacttgcagtgtgattcgttggaaattttcattatggatttagtctgcagggccaggcgggtgacagaaatgagcaggcttctatcatgaggacatcataaatgtcttcacacaagcacctacatataaacacacaggcctaataaaaagtagcatttgagagctcacttttttcaggcactgttttaaatgctttatgtgtatcattctcacagggctttgtttactggtaaggaaactgaggcttggggaggttaagtaacttaagtccccacagtgggaagtggcagagcagggacccggaccaggcatgcaggctccagagccctcgctgttattcatcatgctgaattcacttctacaagggaacattttttctctgatgttcttttttttttttttgagacggagtctcgctctgtcgcccaggctggagtgcagtggcacaatctcggctcactgcaagctccgcctcctgggttcacgccattctcctgcctcagcctcccgagtagctgggactacaggagcccgccactacgcctggctaattttttttttttgtatttttagtagagatggtgtttcaccgcgctagccaggatggtctcgatctcctgacctcgtgatctgcccacctcggcttcccaaagtgctgggattacaggtgtgagccaccgtgcccagccttctctgatgttcttaaaacaccctgcccagtcagcctcccattttctctgctcttgacagacatgttactttcctgcttactgtgtagtaacaacagtggtccaagtgtgatggcacctcgcatttggccccaagggaagggagtcgattgggagtggtgaggactgaggcaacagggtatcagctgagttcatgccctggctgaagagggcagcttcacctggttccagccagttgtggcccagtgttgccacatagttgggttttttaaatagaagcccattctggtttttgtgagtagtctcctggtttttaaatgttggcagctaattcagaagttttaaaaagcagcacataggctaagcaatacatatgtacaggcagaggtacttgccagtcaccactctatagcctctggtctaactcactgaggctgtagcttctttgataaaatgagttgatatttcttgggtgttgaatgtaaatgaggtgctgtgtactttggaatgtatgatacagattggaaactgtcaccataattttattaatatcatagcatcagagaaggttgggactggaaaggaacttggaaatatctagtcatatgttttccaaattacaagaggtgagatgtcatgataagtgaacccttccttccctccttccttccctccctccctcccttcttccttccctccgtccctccttccctccctccctcccttcttctctccttctcttttcctccctccctccttccttccctcctttccaccctccctctttccctccctccctctgtccctccttccttccctccctccctccctccttccttccctccctccctctttccctccttccctccttccttccttccattttgagacaggttctcactctgtcacccaggctggagtgcagtggcgcaatctcaaatcactgcaacctctgcctctcaggctcaagtgatcctcctgactcagcctcccgaggagctgggactacaggtgtgccctgctgatttttatactttttgtagagatggggttttgctgtgttgtccaagctagtctcaaactcctaagttcaggtgatcctccccacctcaacctcccaaagtgctgggattacaggcatgagccaccatgccccaccagaacgttttatattttaatggttatttattttaatatgcattcagaaaatataactaatgtatgaaaactgttattttgtgaattttattgcttaaggtgagttaaagagcactagtaaatactcgcagtcatgcattgcttaacaacagggatacgttctgagaaatgagtcataggcagtttcactgttttgcgaaagaatattatgggtatacttacacaaacctagatggtatagcctactacataccatatgtatagcttgttggtatgggcatatggtatagcctattgctcctaggctataaacctgtacaccatgttactgtattgaatactgtacgctttggtaacacagtggtaagtatttgaaaaagtacagtcacaatgcagtacaaaagataaaaactgatatacctgtatggggcacttaccatggatggagcttgcaggactggaagttactccagtgagtcagtgagtgagcagtgagtgaatgtgaaggcctgggacatgaccgtatgccactgcaggctttataaacactgtacacttaggctaccctaaatttataaaaataattttcttttttttttttgagaccgagttttgctcctgtcgcctaggctggagtgcagtggcacgatcactgctcactgcaacctccacctcccaggttcaagtgattctcctgcctcagcctcccgagtagctgggattacaggtgcccgctaccacacctggctaatttttgtatttttggtagagactgggtttctgttgttgaccaggctggtctcgaactccagatctcaggtgatccacccgccttggcctcccaaagtgctgggattacaggcatgagccactgtgcccagcctataaaattaattttctggctgggcgcggtggcttatgcctgtaatcccagcattttgggaggccgaggcaggcagatcacgaggtcaagagatcgagaccatcctggccaacatagtgaaaccccttctctactaaaaatacaaaaattagctgggcatggtggtgcacacctgtagtcccagctactcaggaggctgaggcaggagaatctcttgaacccgggaggcggaggttgcagtgaaccgagattgtgccactgcactcgaccctggcaacagagcgagactctgtctcaaaatataataataataataataataataataattttctttattcaataataaattaattttagcttactgtaacatttttaccttataaacaattttttttaactttttggctcttgtaatagcacctagtttaaaacaaacacatggtacagatgcacaaaaatattttttctttatattcttattctatacttttttttctatttcttaaatttttaggtttttaaaactttaaaattatttttgttaaaaactaagccacaaaacacacagattagcctaggcctgcacagggtcaggatcattcatatcactgtcttccacctccacatcttgtcccttggaaggtcttcaggggcaataacacacatgaagttggtatctcctataataacaatactttcttccggaatgcctcctgaacctgcctgagacttttttacagctaactttttcttttttaaataagtagaaggcaatgacaataaagagtatagtataggctgagcacggtggctcacacctgtaatcccaacactttgggaggctgaggcaggcagatcacttgaggtcaggagtttgaggccagcctggccaacatggcaaaaccctgtctctactaaaaatacaaaaattagctgggtgtggtggcagacgcctataatcccagttactcaggaggctgaggcaggagaattgcttgaacctgggaggcggaggttgcagtgagccaagatcgtgtcactgcactccaacctgggcaacagagtgagactctctcaaaaaaaaaaaaaaagtataataaatacataaactagccgggcgcagtggctcatgcctgtcatcccagcactttgggaggccgaggtgggtggatcacctgaggctgggagttcaagactagcctgaccaacatggagaaaccctatctctgctaaaaatacaaaaaattagctgggcgtggtggctcatgcctgtaatcccagctgctcaggaggctgagacaggagaattgcttgaacctgggaggcggaggctgtagtgagctgggattgctccattgcactccagcctgggcaacaagagtgaaactccgtctcaaataataaataaaaaataaataaataacaaactaataacatagtggtttattaccaattattatgtactatacagaactgcatgtgctattcttttatatgactggtagcacagtaggtttgttcacaccagcatcaccacgaatataagtaataagttgtgctgtgacataatgacggctatgatgtcactagacgataggaatttttcagctccatttgtaatcttcctggaccactattgtatatgtggttcctcattgaccaaacgttgttatgtggtgcataacagtatatttaaaatacataataatatataatattatagtggtgcatgaatgtggcaaaagccatgaaggtggtttgagaatgactaaagtttgagtaacagtgatctagtctaaatcatcctttttagatgaagaagtgagtttagcaattgtgactgtttctggggttttctaatttcaagttccctttgccttctaggaaaagcttataacatcagtatttcccacacgaatttactttgccacgtagatagttccagagtgttaagtgcccagtggaaatgaaaatacttagcactgccctccgggaccttatagatcaagcatagaactcataaaaatggtggctgggttgaaaattctcattaatacacagtcaaaggattattttggttttgcttttttaaggtgatggcttttttggtcaacgtgatgttttataaatgagtaatgttaggccaggtacaatggctcacgcttgtaatcccagcactttgcgatgccaaggtggtagatcacttgaactcaggagttcaagaccagcctaggcaacatagagaaacctcatctctactaaaactacaaaaattagccgggcgtggtgaggaggcgggaggattgcttgagccaaggaggtggaggttgcagtaagctgggatggtgccattgcactccagcctgggcaagacagcaaaactctgtctcaaaaaaaaaaaaaagtaatgtttacttctaaatatctggtcaagaactgtttactttacgtaagctctttcccagagctagttttctgcggcggggggagtaagagatactgaacctcttctacttaaacagttaacattttacagaataatttcataaaagtttagtaaatccttaactatcacattggaaatctcatgccagattctgggtttacagtgtgagaaggcgaagcagcagaaggcatgtcatttaccaaggctcgttggtccccgaggctaaggcacaagagaaagctccatttgttctgccaggaactctggctggataaaatcgagctcctgcctccaagttgggggtggtggggagggccctgggccgagccactgggacttaggaaggaagagagtagtataagccagtggggttttagtgttccacaaagggaacctcaaaagcagaacagatgctgcctaagtttccagatttcaaggaagttgtcctccattgacacaatcagatttggccttggggagaacttatttgcaccctttgccttctgaaatgtaactccccataatctccttttcctctcttcctttgtttttcctgaaaatgcccacgtgtgttttgtatatttggatgtgtgtgtagggactgatgacggagcccaggaggtggtgaaggacatcttggaagatgtagtcacatctgccattaaaggtaagaaccaaggacaacccagcctttcctcttccctcattcctccaaaaagtcctcagcaaaatattttagtggtggagtttcctcttccctgccctaagaactggtggagctcatggaaactgaatcttcccacgtctgcccatcttttatatgggattcaaaaatgacttgtttttactgactgattttagtctcatttgggttgggtttaggaaacatagtctgggccaggcgcggtggctcatgcctgtaatcccagctctttgggaggccaaggcgggcggttcacgaggtcaggagttcaagaccagcccagccaatatggtgaaaccctgtctactaaaaatacaaaaagtagccgggcgtggtggcgcacgcctgtagtcccagctattcgggaggctgaggcaggagaattgcttgaacctggatggtggaggttgcagtgagccgagaacgcaccactgcacttcagcctgggtgacagagcgagactccatctcaaaaaaaagacacatagtctgactgtgttaggcttagatgctccacatagagatgccaagggccattccatatgccttgtagattaggggatgtccaggtttttctaggagtgggctggagccctgagatccatgtccattggagctgagttttcatggccagccattgatgtgtcaaggggacagtccacatgtcagcaggtatcaggtgtacagggaagctttgttttgttaggcttcattcataagtgcctcatggtatggtttcagtggaattaaacttgtatggctcagaatgactgttagatgatcttttttctttgtttctgcccaaaatctcaggtcagtgggtatatgttgaacactttgttccaatgccagtaaattatgaatttgtccagaaatcaaaatcttaatgggttttcatcagcttttttttaaatgaaagagagtaaaatgaaacagagtacaaatgatctgactgtatcacatataatgttaagtattgtttcatgaaatgtgtttcagttacttatgtgcccatgtctatactgggatacagttttataaattaatttcttacagaggtcaagatttgaaagccacttttctaagccctatctttttgtttaggtaccacaaagctatatacatattctattatttatttaacttcttatagaaatgcctgtaaaatagaaaaattttatttcatacctttagatttgtttctgggatctatacaagaagtcatcacataatggatgtttgtcttgtttactttgtgtcctccagccgctactgcagagcctggtacataattggcacttgataaatatttattgaatgaaatatgctttgtagggctattattgaaaattgttctcattgtttcatgtccctttatagaaccacattataaatttttcttagagtttcattgctctgctgatcatcagatatgctttccttcattaaatgatgaaatctgtgtaattctttattttaattcccttttttcacatggctgccaagaagctcaggtttacattttttctctgtgactaaggttttctgtcataactggctcttctctaattcctttattaatggtactttaaaaaaatctgtacctttcatgtttagctgcttctaatctttttcaaaagtgaatgggggtgggtagggctgctgcattgcacagttctggaggcaccattgatctggagagaattgtatattgctgtggccctggcagtggggctgtggataacaaacactcgtaaggcttaagcatcactttggccaaggcttttccaggattatgtcagtcatgggctggtggcacaggaaaaggggaaaaagcaacagctgggaggttcacagataacttctttttggtgtcaggcagccctttagggtaagtacagtactaatttggctatgactttgtacttgtgttttaagaagcagcggaaaagcatggtctgacagaacctgagagagttctaggtgaactggagtgccaggaatgtgctattcccccaggagttgatgaaaactcacagaccaacgggatagccgatgacaggcagtccttgtcgtcagcagataatctggtatgttggtgatcatcctctgtggacttattgccatttttactttttcaaaagatgcagaattaagtctttcctcaaaagaagcaactaaaataagcaagccctgttcctttattagtcacacagtcctgggctgatattctttgtattagcaggttcagttcttagaacgtgctaatgttgcttggtatataacatcattattaaaccctgtttactcagacttctaatacttaaatttcttgccacttttcttctctctcaaaatagtatacattcattatagaaaaataaaatatatagttacccgtctttccttctctgtattgaaaagtcagtatgactgtattgaaagccatccataacccatagattgcccttgttaacatcttacttaaatccatctagatttttctccatctcacgtatttttccacttaaatagaataatacagtatgtatcctgtgttgcaacctgctttttaaacaatttatattatgaacattctctcaggcccatagatatgtctgccacattatatttttaaatagccttactgttctcttaaaagttgctttaaaattaaatataaacattcaaaataggaagtaatatgatgtgagtgtccctctagaccccattttctttgtctttttaccagtgtttctcaatctttttcattattgccccttcctccaagaaaactttgtagacattttttcctaatcatcattccccattaagttgtaatgccagcaataaactggatatccatatgctacatgtatatctgtgctttatacataaaaataataagggtttgttgttcttgttgtttgtttgagacacagtctcactctcacctaggctagagtgcagtggtgtgatctcgactcactgcagccttcacttcctgggctcaaatgatcctgccacttcagccccctgagtatctgggactacaggcatgcaccaccatacctggctaattttttattattatttgtagagacatggtctcactatattgcccagggtgatcttgaactaggctcaagcaatctgcccacctcagcttcccaaagtgctgggtttacaggcttgagccactgtatccaaccagaataatgtttttttccccccttgaggatgcgcttaaatctatacaagggactcgtgttatatgctaagctgcaatttgctttgtttactcaacactatatgatgggcatcttcccctgtcagtatatgtagagctaacagaaatttttaatggccatgtaaaattctgtatggatcactgtaatctattaaccaattccctattgggtttttagattattccagttttatcataggaaatggttctataatgaatatccttatagataactcttaattctttcttaggaataaatgcctgcaagtagtattgatggttcaagagttggaagttttagctgagtgtaatagcatgcttctgtattcccagctactcaggaggctgaggctggaggatcgcttgagcccagaagtctagccaggggaacatagcgagaccccatctcataaataaataactgtagcaagatcatgtctcataagtaaatgaatgaaagagagtgggagttggaagtgttaaggcttttgacatttaacaccaagtcagtcttctgggaaggtactacttgaatacctgtccacctttaatctctcaatacccattttcccattccctcattaaaactaggcagcagcctttattcaaatctttgctagtctgataggagaaagctcctactctaatgatgagtaataaggtcatttagatttctttatcatttgcatctattggtacattgcttatccatgttgttttcattttggaggaaggttttcatatttccttaatgaattatgagaacttttatatgtgggggatattaatctttattatatgtttttaaaatttttattttatttttttgagttggagtctcgctctgttgcccaggctggagtgcagtggcgcaatcttggctcactgcaagctctgcctcccaggttcatgccattctcctgccttagcctcttgagtagctgggactacaggtgcccaccaccacgcctggctaattttttgtatttttagtagagacggggtttcaccgtgttagccaggatgatctcgatctcctgacctcgtgattcgcccgcctcagcctcccaaagtgctgggattacaggcgtgagccaccgtgcctggccaaaaaattttatttttatgttttgcttttaaatgtaatttaccttttttttaggtgaaaaaagtttatttcgtaatacctatactttgttacccgtttatcctgcaatagttgcaatagtattcttttttttactttttttttttggtcacccaggctggagtgcagtgccgcgatctcggctcactgcaacctttacctcccaggttcaagcgattctcctgtcttagcctcccaagaagctgggattagcagagatgaggtttcactatgttggccaagttggtctggaactccttacctgaactgatctgcccaccttggcctcccaaagtgttgggattacaggcgtgagccattcatcgcacctggcttacaatagtattcttagaaatatctttcttacccaagctagtataattacctgtattagttttggtttttttacagcttaacttttgatcatttttcattttaaaccacccataccaactctgaagaacaaggaacaaggttgtagaattgctgtgatggcttctccatagctcctattttgtcatatccttccctcccccacatccctcatctctctattaaatagaagaatttgaatttccaagagataattacatttctaatttttgataagagttagcttttgttttgtcctctccctttttattttttgagatacggtctcactatgttccccagattggagtgcaatggtgccatcatggcttactgcagccttgacctcctcggctcagtggatcctcctgcctcagcctctggagtagctgggactacaggtgggtgccaccacacccagctgatgtttgtttctgatcctaggaatcggatgcacaaggacatcaagtggctgccaggttctcccacgttctgcagaaggatgccttccttgtgttccgctccctgtgcaagctgtccatgaaaccccttggtgaaggccctccagacccaaagtaagcagacagcagttcttggccaccttcagtccaatgatccagcagcacatggtactgtgtttcacacttcccttgttccaagaagtttcagtgtcatgtctctttgtcagtgtaagtgcaggaacggttttacaacttttcagactcatgcagtctctagagtcctttcatatggaattgtctctgtatccccaccaaccaagattttgcccagttttgcttttcttggcatatgaatgctaaaaaagtctgtttattgaacacataaaaaacacatttttactagctagtggattgaatctcttgatgtggggtgtggagggacaggatgcctgcaaacctcagttccctgttctgttggaaacctctgcttcatcgatacagatgtaagccccagattcgacacagggaagccaaacatttctttgtagtaaacaaactactacaaggatgtcagcgctgtggagtgaagaaagcagaggcttcagagccagagagagctgcatttagatcttggatcctccacttgagagcagttccttggctatatgacttgccaagcctcatctgaaaaatgggaatatggaaaatcatcttacaggattgattaaatgaaatatcggtgttgtcctgagcatggggccttgtactttataaattatctctattgttcctgtcattagtcattaataataatcctcaattcatctattactaatgctgctaatactgtgataggtattaggaaaataggctgggtgcggtggctcacacctataatcccagcactctgggaggccaaggcgggtggatcacttgaggccaggagttcgagaccagcctggccaacaagatgaaaccccacttctactaaaaatacaaaaattagctgggtatgctagtacatgcctgtaatcccagccactcgggaagctgaggcaagagaatcgcttgaacccaggaggcagaggttgcagtgagctgagatcgtgtcactgaactctagcctgggcaacagagcaacaataaattttaaaaaataaaaataggccgggcgcggtagctcacgcctgtaatcccagcactttgggaggccgaggcgggcggatcatgaggtcaagagatcgagaccatcctggccaacatggtgaaaccccatctctactaaaaatacaaaaaattagccgggcatggtggcaggcgcctgtaatcccagctactctggaggctgaggcaggagaatcgcttgaacccaggagacggaggttgcagtgagccgagatttgtgccattgcactccagcctggacaaaaagagcaaaactccgtctcaaaaaaataaataaataaataaaataaaataaaaataagtgttaagaaaatagttcatgaaaatgtaccatttcttaccatacctgaactccggcatgggcagtggggagggagggctgtgaggtaggtggataaagagcgccatcttcatggtgtgtgaaacagagtgagccaggtgtctcagcctcccacaagtgatgtaaagtcattgattcttgcagtacagttgcagaactcgctctccagaatcagttgacactttgctcctgctgtattctctactttgtgatggaaagagacaaataggagttggcagctcttgttctcaaagggcctgcgattccagaaggacccaactcatgccatctgccctcattctcctgacatttaggtgctattaattctttaaaattctactcattggtaaaggagcaaggccttctcaagaaacatactgtttgacattttttcttttagcactgttgtggtttttcattttctttgccagatcccatgagctgcgttccaaggtggtttccctgcagctgctcctctctgtgttgcaaaatgctggccccgtattcaggactcacgagatgttcatcaatgcaatcaagcaatatctctgtgtggccttgtccaaaaacggcgtctcttcagtgcctgatgtctttgagctctctcttgccatttttcttactcttctttcaaactttaaaatgcacttgaaaatgcagatagaggtacggattccaaagttttttcatttcattatttactattattattagtcattaattataatactcaatattgagaatgctgctaatattacactaagcattaggaaaatggttcatgaaaatgtttcatatcttaccatcctggaactcagaagtgggcaggggcagggagggtaaatggcatattcatcggctggcaccccagtaaatcagaactttttgaatgagtaagagaatatctttttataaaaagttactgcccccagcctgggcgccatggctcacgcctgtaatcccagcactttgggaagctgaggcgggcggatcatgaggtcaggagatcgagaccatcctggctaacatggtgaaaccccgtctctactaaaaatacaaaaaattagccaggcgtggtggcaggcgcctgtagtcccagctactcgggaggctgaggcaggagaatggcatgaacccgggaggcggagcttgcagtgagccaagattgcaccactgcactccagcctgggcaacagggcgagactccatctcaaaaaaaaaaagttactgcccccggatcttatgtgcctttcattttaaccaatatggtctgtctgctgggctcagccccctaaacatatctgtttggtctgtaaattgtttgaaatcatttagattagtcgccaaattgagaaatcctattttacatgaaaatccagatttctggtttctctccaaaaagtcacagtatgggtcctgcatttccacttggcagctccccagtgggccccaccctgccagccgtccccaccaaggccagggtcccgttgctgcccagccaggtgggcactccactcttcttctgcccagggtgctttacttactgcacgactgggttggctgctgaagactttggaggttttgagccctggttgaaactgttaattagtgtcctcctttgtctttatgtcatataggtctttttcaaagagattttcctgaacattttagaaacatcaacaagttcttttgagcacaggtggatggtcattcagactctgacgaggatctgtgcaggtatttccacctggggacactcatccactggacttctgatgctttaatttgccacagctcagattaagacttctaacccctccttttagagttttaaaggattggcaataaaaggctaattctaacctagtcctgccccacctctccttttttagaggatgaccaacttaggctggtttgccaaggacttcctggttttagcactaaaagtctcatgtcccagaaaccccctaatctcgtcaaactgggacacttggttacgttacctacaagctgagtactgttaatcacaggacctaagatactggtgctgccaatttttgattgggtgctacggtaaatgtggatttaccttacactatacaattgtgtggcctcaaagtaagcatcctgcttgtctggcatcaaatgtaattttgtaagagtgacacaactttaagaggtgggtcaggcaattgttaaccccttccttgatgagaaaattgaggcttggatgggtggaatgaactgcctgagatttcaatttgctcagaagcaggcctaaaaacaacctcctgtcttccagcttcctagtacttccaacatgtgtttcctgagtgagatgtggccaccggagtctgtagttcactggggaaatttgttggcaaacatcttgtttgataagaaaacctaactgctatttgatcagaatttctgatacttgtatgttattttccaagatgcccagtgtgttgtggatatttatgtcaactacgactgtgatttaaatgctgctaacatttttgagcgccttgtaaatgatttatccaaaattgctcagggaagaagtggacatgagctgggaatgacacctctgcaggtaaaaacactgtggacactcaattatattaaagtttattcattccaataaacatttattgagtgccaccacatgccaggcactgtccttgatacagcagtgaacaaaacaggaatgcatattcacacacttcctgccatcatgaaacgacattaaagaagtcagttcagatgatcataggggctgcagagaaaaataaagcagggacggcagagaggaagtgctgaaggtggggtgctgtaattcttaatggggccattagggtagtatcccttagaaggtgacctttgagctgagacccataggaagcaaattcattctcagtcacccttccaaagatagcgtggaaaacaggatcccagtctgcaataggggcaaaggagattggctagtagcagaatacctcattagagcacctacaaagaaaataggatgcttaactgtaggtttctgaatgaactggtcagagggtctccgagctccctggaattgtgtgtagaattttggtatatgggcatttttcctaaaagatggtcatagttgtcattagaatcacagagatctatgctgtccgagttgctgttttgaatctaaaatatttgcaatttttttagatgatctgcaactcatattcaacttgttatttaagaatgctgtttatttttgaaaatcagtatttttatttacttaaagggtgagccttaaaattgaatgcatttgtgggtatttaggggatacgttgtatccagagtcacttacagcataattcaaggttcttttctcctttttttcagtcactggttgagaccttgttatttattatttgagtgtgaatttttttttttttttttttttttttttgagacagaatctcactctgtcacccaggctggagtgcagtggcgcgatctcagctcactgcaacctccacctcccaggttcaagtgattctcctgcctcagcctcctgagtggcagggattacaggtgcctgccaccacacccggctgatttgagatggggtttcaccatattgtccaggctggtcttgaactccttacctcaggtggtccacccacctcagcctcccagagtgctgggattacaggcgtgagccacagcgcctgcccaagatcttgttatttttttaaaaatagaaaaatttaaaatttttttttaatcacataagcaatgaatgaaaacttcttttgaaaatccaaataacattgttcattttaggaaaacacatatcccatatttttgctgctggggtgtttataatgagcacctttagagatgtccagggcttttgcaatgtatccttgatacttgtcacttcttagctctgggtttgtttcattcttaatagcactgactgtcagtgatttctttcttagcctcactggggtcccagaaagcctcgtagatgtctgttctcttcatttttctgttaagtctctttcctgtgtgacttcgtcccttaggagctcagcctgaggaagaaaggcctggagtgcctcgtgtccattctcaagtgcatggtggagtggagcaaagacctgtatgtgaatcccaaccaccagaccagcctcggtgagacagcattgctgccacacccacctccattcataataggctcctacgactgctaggaacagttgtcttagtatagttgtcttagaattgaaaaagcctttttagtttgctaaatacctatattattttgaaagtcctgctttttattgcatctggagttgtgtgaagttatgctgtaacttcattgtttcaaatacagagccagttgctctagtgcctttttagtagttgttcattccctcactgattcaaagcatcacctttatgatataccacattttcctatgtacgtaagtctgtttctggagttttaatttttttaaagagacagagtctgtttccattacccggctggaatacagtggtgcaatcatagctcactgcagccttaaactcctgggctcaagcgatcctcccacctcagcctcccaaagctctgggattacagacgtgagccactgtgcctggccttctttctggattttctattctgttctgtttatttgtctgttttaacaccagtaccacacttgtttttggtatcttgtagggcaagtcctcctattcgttgttctttaagttgtcttgatctttttttgccttttttactctttcatgtgaattttagaattagctcatcaaggctgggcacggcagatcatgcctgtaaccccagcactttgggaggtcgagggtggtggatcacgaggtcaggtgttcaagaccagcctggccaacatagtgaaaccctgtctctactaaaaatacaaaaaattagccgggtgtggtggcaggcgcctgtaatcccaggtgctctggaggctgaggcaggagaacagcttgaacctgtgaggtggaggttgcactgagccgagatcgtgccactgcactccagccagggtgacagtgcgagactccatctcaaaaaaaaaaaagaattagctcatcaagtttcatgaggaaacaagtttttaagtaaagtatctgaatgatactaaggtttcatgcttataatccttatagtattgacttgttgctattacaggtttgggaaagggagccgtgcagccagacctagctcggctgtgtctgtgtcccacttgcttatttggcttcctttacttttgtttctccgcaggtcaggagaggctcacggatcaggaaataggggatgggaaaggccttgacatggcaagacggtgtagtgtgacgtccatggagtccacagtgtcctcggggacccagacaactgttcaggatgaccctgagcaatttgaggtcatcaagcaacaaaaagaaatcattgaacacggcatcgagctgtgagtggggctgccgttaactagcagggattctagcaaagccatattttctctgggaacctggaactgattcctaaaaaggaaatgcctgtttacaaaaggctggtgctggcacttgtagctaagcctgattgagccaggcaatcagtaaatgagcgtatgtgtgtgtgtctgtgcacacagagagagaaaactttaatacctttgtgtggttgatgcagccttttttccccccttttctaatgaaaataataaaaccaatttagaaaatacagaaaagtataaagtaagaatgtaaaaatcactcataaaattactgcctgagatggcccggcgcagtggctcacgcctgtaatcccagcactttaggaggctgaggcaggtggatcatgaggtcaggagatcaagaccatcctggctaacacggtgaacccctgtctctactaaaaatacaaaaaattagccgggcgtggtggcgggtgcctgtagtcccagctactcgggaggctgaggcaggagaatggcgtgaacctgggaggcggagcttgcagtgagcagagattgcgccactgcactccagcctgggtgacagagtgagactccatctcaacaacaacaaaaaattactgcctgagggaatcaccattggtgcatttttttccaactatatattacatgaaaaatttcagcataccaaaacattactgtttgtcttatttgttttatttttttaggcattttattttattttattttattttattttattttattttattttatgttgttttcttatactttaagttctagggtacgtgtgcacaacgtgcaggtttgttacataggtatacatgtgccatgttggtttgctgcacccattaactcgtcatttacattaggtattactcctaatgctatccctccccctgcgccccaccccatagcaggcccccctgtgtgtgatattccccgccctgtgtctgagtgttctcattgtttggtacccacctatgagtgaaaacgtggtgtttggttttctgtccttgtgatagtttgctcagaatgatggtttccagcttcatccatgtccctgcaaaggacatgaactcatcctttcttatgaggcatagtattccatggtgtatatgtgccacattttcttaatccagtctacaattgatggacatttgggttgattccaagtttttgctactgtgaatagtgccgcaataaacatacgtgtgcatgtgtctttatagtagcatgatgtataatcctttgggtatatacccagtaatgggatcgctgagtcaaatgctatttctagttctagatccttaaggaatcaccacactgtcttccacaatggttggactagtttacattcccaccaacagtgtaaaagcgttcctatttctccacatcctctccagcatctgttgtttcctgactttttaatgatcgccattctaactggtgtgagatggtatcgcattgtggtttggatttgcatttctcttacgaccagtgatgatgagcattttttcatgtgtccgttggctacataaatgtcttcttttgagcagtgtctgttcatatcctttgcccactttttgatggggttgcttgtttttttcttgtaaatttgtttaagttctttgtagattctggatattagccctttgtcagatgggtagattgcaaaaattttctcccattctgtaggttgcctgttcactctgatggtagtttcttttgctgtgcagaagctctttcgtttaattagatcccatttgtctattttggcttttgttgccattgcttttggtgttttagtcatgaagtccttgcccacgcctagttcctgaatggtattgcctaggttttcttctagagtttttatggttttaggtctaacatttaagtctttaatccatcttgaattaatttttgtctaaggtataaggaagggatccagtttcagctttctacatatggctagccagttttcccagcaccatttattaaataggaaatcctttccccatttcttgtttttgtcaggtttgtcaaagatcagatggttgtagatgcatggtatttctgaggactctgtgctgttccattggtctgtctctctgttttggtaccagtaccatgctgttttggttagcgttgtagtatagtttgaagtcaggtagtgtgatgcctctagatttgttctttttgcttaggattgtcttggcaatgtgcgctctttttcggttccatatgaactttaaagtagttttttccaattctgtgaagaaagtcattggtagcttgatggggatggcattgaatctataaattaccttgggcagtatggccattttcatgatattgattcttcctatccatgagcatggaatgttcttccatttgtttgtgtcctctgttatttcgttgaacagtggtttatagttctccttgaagaagaggtccttcacatcccttgtaagttggattcctaggtattttattctctttgtagcaattgtgaatgggagttcactcatgatttggctctcagtttgtctcttattggcataaaggaatacttgtgatttttgcacattgattttatattctgagactttgctgaagttgcttatcagcttaaggagattttgggctgagacgatggggttttctaaacatacaatcatgtcatctgcaaacagggacaatttgacttcctcttttcctgattgaatacgctttatttctttctcttgcctgattgccctggccagaactcccaacactgtgttgaatgggagtggtgagagacagcatccctatcttgtgccagttttcaaaggaaatgcttccagtttttgcccattcagtatgataattggctgtgggtttgtcataaatagctcttattattttgagatatgttccgtcagtacctagtttattgagagtttttagcatgaagggctgttgaattttgttgaaggccttttttgcatctattgagataatcatgtggtctttgtcattggttctgtttatgtgatggattacgtttattgatttgtgtatgttgaaccagccttgcttcccagggatgaagctgacttgatcgtggtggataagctttttgatgtgctgctggattcggtttgccagtattttattgaggattttcacattgatgttcatcagggatattcgtctaaaattctctttttttattgtgtctctgccaggctttggtatcaggatgatgctggcctcataaaatgagttagggaggattccctctttttctattgattggaatagtttcagaaggaatggtaccagctcctctttgtacctctgataggattcgactttgaatccatctggtcctggactttttctggttggtaggctattaattattgcctcaatttcagagcctgttattggtctattcagggattcaacttcttcctggtttagtcttgggagggtgtatgtgtcgaggaatttatccattgcttctagattttctagtttatttgcgtagaggtgtttatagtattttctgatggtaatttgtatttctgtgggatcggtggtgatatcccctttatcattttttattgtgtctgtttgattcttctctttattttcttctttattagtcttgctagcagtctatcaattttgttgatcttttttaaaaaaacagctcctggattcgttgatttttttttgaagggttttttatgtctctatctccttcagttctgctctgatcttagttatttcttgccttctgttagcttttgaatttgtttgttcttgcttctctagttcttttaattgtgatgttagtgtgtcaattttagatctttcctgctttctcttgtgggcatttagtgctataaatttccctctacacactgctttaaatgtgtcccagagactctggtacgttgtttctttgttctccttggttccaaataacatctttatttctgccttaatttcgttatgtacccagtagtcattcaggaggaggttgttcagtttccatgtagttgtgtggttttgagtgagtttcttaatcctgagttctaatttgattgcactgtggtctgagagacagtttgttgtgatttctgttcttttgcatttgctgaggagtgctttacttccaactatgtggtcaattttggaataagtgcaatgtggtgctgagaagaatgtatattctgttggtttggggtggagagttctgtagatgtctattaggtccacttggtgcagagctgagttcaagttgtggatatccttgttaaccttctgtcttgttgatctgtctaatattgacagtggggtgttaaagtctcccagtatttttgtttgggagtctaagtctctttgtaggtctctaaggacttgctttatgaatctaggtgctcccgtattgggtgcatatatatttaggatagttagctcttcttgttgaattgatccctttaccattatgtaatggccttctttgtctctttcgatctttgttggtttaaagtctgttttatcagagactaggattgcaacccatgcttttttttgctttccatttgcttggtagatcttcctccatccctatattttgagcctgtgtgtgtctctgcacgtgagatgggtctcctgaatatagcacactgaggtcttgactctttatccagtttgccagtctgtgtcttttaattggggcatttatccccattacatttcaagttaatattgttatgtgtgaatttgatcctgtcattataatgttagctggttattttgcccgttagttgatgcagtttcttcctagcatcgatggtctttacaatttggcatggttttgcagtggcttgtaccagttgttcctttctatgtttagtgcttccttcaggagctcttgtaaggcaggcctggtggtgacaaaatctctcagcatttgcttgtctgtaaaagattttatttctccttcacttatgaagtttagtttggctggatatgaaattctgggttgaaagttcttttctttaagaatgttgaatattggccctcactctcttctggcttgtagagtttctgctgagagatccgctattagtctgatgggcttcccatagtgggtaacccgacctttctctctggctgcccttaacattttttccttcatttcaaccttggtgaatctgacaattatatgtcttggggttgctcttctctaggagtatctttgtggtgttctctgtatttcctgaatttgaaagttggcctgccttgctaggttggggaagttctcctggataatatcctgcagagtgttttccaacttggttccattctccctgtcactttcaggcataccaatcaaacgtagatttggtcttttcacatagtcccatatttcttggaggctttgttcgtttctttttattcttttttctgtaaacttctcttctcactttatttcattaatttgatcttcagtcactgataccctttcttccacttgatcaaatctgctattgaagcttgtgcatgcgtcatgtagttctcatgccatggttttcagctccaccaggtcatttaaggtcttctctacactgtttattctagttagccattcgtctaatcttttttcaaggttcttagcttccttgcgatgggttcgaacatcctcctttagcttggagaagtttgttattagtgactttctgaagcctacttctgtcagcttgtcaaagtcatttccatccatctttgttctgttgctggggaggagctgcaatcctttggaggaaaagaggtgctctggtttttagaattttcagcttttctgctctggtgtctccccatctttgtggttttatctatctttggtctttgatgctggtgacctacagatggggttttggtgtggatgtcattttatttgttgatgttgctattcctttctgtttgtagctttccttctaacagtcaggtccctcagctgcaggtctgtgggagtttgctggaggtccactccagaccctgtttgcctgggtatcaccagcagaggctgcagaacagcaaatattgcagaacagcaaatattgctgcctgatccttcctctggaagcatcgtcccagaggggcacccgcctgtatgaggtgtcagtcggccctttctgggaggtgtctcccagttaggctacatgggggtcagggtcccacttgaggaggcaggctgttctcagagctcaaacaccatgctgggagaaccactgctgagagctgtcagacagggatgtttaagtctgcagaagtttctgctgccttttgttcagctatgccctgcccccagaggtagggtctatagaggcagcagcccttgcagagctgtggtgggctctgcccagttcgagcttcaccagcactttgtttacctactcaagcctcagcaatggcagacacccctccccctgccaggctgctgcctcacaggtcaatctcagactgctgagccagcagtgagcaaggctccgtgggcgtgggacctgctgagccaggcacaggatataatctcctggtgtgccatttgctaagaccattggagaagtgcagtatttgggcaggagtgtcccgattttccaggtacagtctgtcatggcttcccttggctaggaatggaaaatcctccgaccccttacgcttcccgggtaaagcgatgccccgccctgcttcagctcaccctacgtgggctgcacccactgtccaaccagtcccagtgagatgaaccaggtacctcagttggaaatgcagaaatcaccgtcttctgcgtcgatcacactgggagctgcagaccggagctgttcctatttggccatcttgggacggaatcttacttgttttatttacgtatatatttttctgaaccattttgaaagtaattggtagccatcatgagaccttaactgaatctctttgaaaaataaaggacattctcccatataaccacagcaccatcatcacaatcattggcaaatctttatgtttctttccagtcttttacacacatcaacacatacacaatcatatattccaacttgtaaatgattagttaacttagtaagttcaacttaagagttgaaattacagtactcacttattaactgacatgtttgatcttctcatttctactgccgccactccacctccctctagtgtattctgcccacagcagctaaagtaatctttttaaaacataaatcaagtcttatcactctcctgcctaaatcattccaggtttcctgttctgcaccatggcctgacccagcccctggcctcccttgctgatctcatctcctgccaattcccctgagtcacacaatgtattttcagtcccttgaacaccttcagctctttttaccatggtgccttgtgcttgaaattctcttggcttttttccatccctcagacttggtaaaacatctcttactcaaagaggccttcagcaactgcactatctaaacaggtcccaagttaagttctgcccttgcccctatttgtatctttcatgacgcttgccagtttgtgcttactcatgaatatcaccctccagctcaggcctggtaaataataagttgagtctatacattggttagctttgccttcctttagcaggaaataaaaaatgggctgggcatggtggctcatgcccgttatcccagcacgttgggaggctaaggtgggaggatcacttggagttccagaccagcctggtcaacacagtgagaccctgtctcttaaaaaaaaaaaaaagtagagaaagaaaaaaataaatacaaaataacatgcttaactatgtatttctctctcaaggaaatccaaaagtggacagtctaaggctgctacggtggcccttaaggacatcagagatccaggctccttttatctgtctgcttcaccatacttagccagagagggtggcctcatggtataagatgactgctggagtaccagccatcccacaaacattctggagaggaggagggaaagaacaaaaagagaaaaaagcagacttcccacctgagtcagctttgtttaagggtccttcctagaagtacccacaccacttctgctcatatctcactggctagaagtttatcacatggccatcctttatttaagggaggcagggaaatgttctttttattccacatggcagtgtgtccagctaacacgtagggttctattagtgttggagaaggggagagtggatatgaggtgacaatcagcagactctgaccaggtatagctgggtcagaaattgaaggtggaatttagaaaagctgccaggacagacatgaccttgctagcttatacgtgatggcatgttcatagtattctattattatttatctcaaataccagcttttgctatcctccagattttgaaataagcaacttgtgtcccatctctgcttgaaacaggttcaacaagaaacccaagagggggatccagtttctccaggagcagggcatgctgggaacgtcagttgaagacatagcccaattcctgcaccaggaggagcgcctggattccgtaaggcttgggggtgtagcacttgcatgtgagttctgtcaggtgattgtgagcccttaccagttttaacctcgagattgtctggccctaagtacattgtctgttgtccacccccgggttatacattgtctattgtccacccccgggttacagcagtcctgtgtatcccgttggctagtgttgcagaaagctctttgatgggaataaactagcctcccagcaggtggctgcatatttgctggaagagagtcagagctggaagtgttccttgactgctagaaagttcttacggctgcctgtctgcaactaacctccttagtgtgccccgtcattctctccattttaagtctcttgtgccccctcctcttccttcatccatgcaggacaggctgcttctggaatgggtgggtgggtgggcaggtcagggagttccctagcttttttaccagtccagcctattctgggcagttagggccaggctattctgactccaccctttggctgctggcttttgctgagggttcgtatttgacaatttctggatataagtgagtgtgtatgtttcagacccaagtaggcgattttctgggagatagcgcaaggttcaacaaggaggtgatgtatgcctacgtggaccaacttgacttctgtgaaaaagaatttgtctcagccctgcggacattcctagaaggtttccgcctacctggagaagcccaaaagattgaccgattaatggagaagtttgccgcaagatacatagaatgcaaccaagggtgagcgccgattttgagtcccttccagatcatctgtttgcctgcctcagaacgctaattctaatttggttggggtttaatctttgtatatctgtgccaagcaactgaagcttttgtttaccgtgtgccaggcactgtgctaagggattatttcacataagacctcacagcaacctgtttatgtccctattctacagacaaaaagattgaggaccagagaggttaacttgcccaagatcacacagctaaagcccatgctgttagcaactataaaagagtagtttcataagttgagaggagacaattgggcacctcttccctaatcaaaaacagttcccctgatttaatatatggggtagatctcaaggattttggtttttctttaattgcatactgatgagcaggttacagaaatagctacataactaataaaaaccaccaaagtacatgattttatctggggaccttttttgatgggcggttcgtgattttgtaagaagtggaaataggaaggggaacaaaccattattaaatacctcctgtgtgtgggccatgccatgggttttacatgcatttaatttaattaatggcaagcccaggaatagtatccctgttttacagatgaggaaattgagaatctgagagattgagcaacctgtccaaaattaatcagctagtaaggagcagagccagggttgaatatggatttctctaactcagaagctcatgttcgggctggatgcagtagctcttgcctgtaatcccagcactttgggaggccgggacgggcagatcacttggggtcaggagttcgagaccagcctggccaatatggtgaaatcccgtctcttccaaaaatacaaaaaaaaattagctgggtaatcccagctgctcagaggctgaggcaggagaattgcttcaacctgggaggcagaggctacagtgagccgagaccacaccactgcacaccagcctggatgacagaggcagactctgtctcaaaaaaaaaaactcatgttctctccactgaacattaaattagaaatatgtctgaatatgctgtgaccatgatgtggaaattgttcagtgggaactattttttttgagacagggtcttgctctcttgcccaggttgaagtacagtggggtgatcacagatcactgcagcctggatctcctgggctcaatcagtcctcccacctcagcctcctgaactgctgggactacaggtgcatgccactgtgcctggctaattttttgtataatatttctgcagagatagagtttcaccgtgttgcccagtctggtcttgaactcctagcctcaagggatcctcctgcctcagcctcccaaagtgggggatttacaaatgtgagctaccacacctgattgaaacattttaataactgttttgcctctcaggtcaactttgttttcatattaattgctcccagtcttccaagtgtatggcaggctgtccccaggaggtggcaggattggcaaaggcagcatatcatcattttaaccaaatggacattagaactctctatgaaggcataattagatgctgtttactttaaacgtatctcctatgtggacctgggagccttggtctgttttgctcagtcagtaaatatgtgacccagtttcatctcatattaaaagacctttgttgtgttcttcaaaatttctactgttcctgttatggacagtttggacagaacagtttctagcttcagcctcatatcgtatgaagctgtacatccacatgttgtccttctcttcttgcctaaggcaaaaaagtcagacttcaccaacatattgtttagaacaacataaatattttccatggtatttctactattaaatgttataatgggtaatatagactataaataacagctaaacagcagttttagtcatctttatatctcatgtctagcacagtacatggcacaaaatagatgttctcaggaacaggacaaggtgggggaggcactcaagcgcttagtgtgtgaaatatagtgagatgccctctctcagggtcagcaccaagtgtaaggtctcctgatgtgctcacttgcttcaccctagtcttggccccagatgcttcttagagtctttttaaaaaaaattatttgaaattgctttattcaaagaagcctcaatttttattatttatttatttatttttgagacagtctcgctctgtcacccaggctggagtgcagtgtcacaatctcagctcactgcaacctccacctcccgggttcaggcaattctcctgcctcagtctcccgaatagctgggattatgggcacccgctgccacgcccagctaatttttgtatttttagtagagattgggtttcaccatgttggccaggctggtctcgaactcctgacctcaggtgatccacccatctcggcctcccaaagtgctgggattacaggcctgagccaccacgccctgccaaagaagctaaaatttgatacagattgttaatgagctttttctacactctgggttgctaagtcttgttcagtgatgatgaaagcgtaaaaactcttgcctcatttggaatcaaggggagtagtcggctgcttttctcgtgaagtgtgtctctgttagcattgtaccttccaaaccgcatcaccatgaatattgatgtctcgaatttttttctccaggcaaactctgtttgctagtgctgacactgcttatgtcctagcgtattcaattattatgctgactacagacttgcacagtcctcaggtaaagcactttaatgatttacatgttgtattagctaaataagtggctttacttgggcaattggatgttttttaaatggtttttaattttttttaattacaggtaaaaaataaaatgacgaaagagcagtatattaaaatgaatcggggtatcaatgatagtaaagatctgccagaagagtatctctcaagcatctatgaagagatagaaggcaagaaaattgcaatgaaagaaacaaaagagctaacgattgcaaccaaatctactaagcagagtaaggtctaatggcaaattatttcttttagttctaattttttagtgtatcagaatgcatgattaaatactctggtgataaatttaatgtgcatagctggatatctgaataggaaatgtgattgaattaattattgtgattatgttgggacttttataatgtcactgtcttgctagatttctgatgaggagcaagaaggaatttaaaattagtaatctgagaactaaattactcccaaaaagtgttctttaaaacttttctttaattcagattgtgtccgccttgattagaattctattagttatggcccctggggagctgtcagtttcactgtttgagaagcagcaaagggtagtggtttagagtgtggctctagagccacactgccttagatcaagtcccagctcctctacttagtaattgtatgaccctgggcaagtgacttaccccctctgcctcatttttcccatctgtaaaatggtaataataatatttgtaatggactcacgagatggttgggaggatttaggagttaatcattgtgcatcttttgaaacagtgtatggcatgtagccagccctcagtgactgctagccacacctatcatgctcttactttacagatgtagctagtgaaaagcagcggcggctgctgtacaacttagagatggagcaaatggctaaaacagccaaagctctgatggaggctgtgagccatgccaaagccccgtttaccagtgccactcacctggaccatgtccggccaatgttcaaagtgagtatcctgagaacttagcaagcatgtggctaagcctgattctgaagctggccagcgagaagtactctttccacgctaaaactctggatgttattgaaatcttccttccatgatagctggtgtggacgccactattggcagcctacagcatcggactccagaactgtgatgacactgaagtggcctccttgtgtttggaaggcatccgatgtgcaatccgaatcgcctgcatctttggaatgcaggtaggtgtaagtcagcaacactccagagatactggtgggttgtgctcttttagatttggcaaaacttagaaattatcagaaattttcagttaatcaagactcttagcaagctacttacttatgcctactgacaagaaatccgtagctttgtgatgacagctcgttaggggcaaaaatggagatacggattaaaactgtctttaagaatgggtaggctgggcacagtggctcacgcctgtaatcccagcactttgggaggccaaggcaggcagatcacctgaagttgggagttcgagaccagcctaaccaacatggagaaaccccatctctactaaaaatataaaattagccgggtgtggtggtacatgcctataatcccagctactcgggaggctgaggcaggagaccggcttgaacccaggaggtggaggttgcggtgagccgagatcgcgccattttactccagcctgggtgacaagaacgaaactccatctcaaagaaaataataataataataataggtagggtccaagcttcttgactggatttgacaaagcagacttcgtgttcatctgcctaacttgcctgctttggtgcttaaaaatactatttcctttttaacatcagtttttattataatttcgcatatttccaactcttccctggagaaacaagtagttcaatgcaatatgaatatgtctgtaaacctttgaaacttgaaaagttcaagcaaataaatgaaatgtaattctgaaactgttacgaaattaggaggttgacaatcccatgcatcactttgtaagtcagaagttgcaccccatttatttttaaaaactcaatcttctgttcctattcattttacagttagacattttcttttataccaagaccacaagctttgacgttagaccatctaggtttcaagaccccactctgccacctctccaaccatgtgacattggctcagctaaagtctctctgagacaccaattcatttcctcatttgtaaacttgagaaaacagacctgcctggcagaattgttgcagatgtcaatttgtgtgacagtcttagtattcaacagacatagtggaacatgggacaggtgagtttgactgaagtcaattagaaaggagagagctgcttctcaaacatgtggcagtgcatagatacctctgcaagatgttccaaaagcaagagggcattagcatggaataactgttgtgctaatgtgcagaaagccagtcaatgtgcatacaaaaagtatcagagaagcccagtgtgccagccctgcagatgtgagaatggccacactaaggttggagtcacagtgttctctcttgggtttctgttacagctggaacgagatgcctatgttcaggctcttgctcgcttctccctactcacagccagctccagcatcacagaaatgaagcagaaaaacatcgacaccattaagacgcttatcacagtggctcacaccgatggcaactaccttgggaattcctggcatgaggtacgtgtctctttgaattgccttttctcagttaggatgactcctggcttccttttattcattgttgatctcatttggtcagttctgtttttcttgaagtcaaatcactgtacctcatgtatctggaagtcaccctctctggggctgtgaaaggcgggggcgagttcaggcgcaccagctcacagtgagcacccttgcacccagcagccagtgtcccccatgaagtgtacttctgttgttgcaactttctttccatattagtgccatttttttttttttttttagtccttatgtacctcttgggagcttgggagctcctgtgatcaatgtgtaattttaagacaaagccaggagcctgattagaaatggttgatagtcacaatgagctgttagggagagtgccagtgaattcacatgtttttaaaacagtattctaagattctcacccaaggatatagttacttatgtgtacaacaatgtatttaaaaggatatttgttgcagttttagttgttctagggaaaagtttgggttaaaaagagctagatgtcccaacaatataagagattgctactttttttaaaaagtatggtacagcattttttagaatgttatgtggccatttaaaataatgttgtggaaaaaaaagacaggcagatagtatgtgctctctgatggaagtacacaatactacctaagaaatgttctagccccaactcaaatctgaattgattcaagcctatattgccagtttacaggaaatacagtggacagagaagcatgttagatatgagggtgcagcttggaaattctaggtgtgacagacctgcagagcagatgaccaggtttttcagcaaaaaaattgcaagaaaaataagggaggagggttacctatgaattaaaagagatttcagaaaagaagataaaagatgattttaaagactattgtgggaaaatggtcacagtaaaattacaagttgttataagagattgtgaggcattgtctctcgtggcaaaatacacagagaatgcagtttgaaaggatagaccaaagcattaacattctgtctgagaaatagaattatggaaactgttttattcttttttttcttaatttctaattttttctgccatctacatgtattacttttttgtttagagagaaaactgtgaaagaatagagatgaggctgtggagaatgtaaaggacagtttgacatagaaaattgctgtcatccttcttccccatgtggaccacatggctcagattcagagtaaaggctctagagcctggcaactggggtctgatttggggctccacctcttcctgcctggatggcacaggcaggttacttagtcaccgagtcccaccttcttcatctctacaatcttcacagggtggttatgaaaatgaagagggcttgggactgtatttggcaagtaataagaactcaatagtgttacctgctgtcatctccgtggcgtatggctttgctcctcttcaccagcctttcctctctctgtcacaactctgagtagtccatgttagaaataactgagttatggctgggcacagtggctcacacctgtaatcccagaacttttggaggttgaggcagaaggatggcttgaggccaggagttccagaccagcctgggcaacatagcaagaccccatatctttaaaaaaaaattatttttttaattagctaggcatggtggttcatgcctgtagtcccagctactcaggaggctgaggcagcaggattgcttgagcccaggagttcaaggctgtagtgagccttgattgcaccactgtgctgcagcctgggcaacagagcaagacctcatctctaaaataaaaaaatatatattttgaattgtgtgctttttaaaatcatttcctgccttctaaggagccataatacgtagagaatcaatgaatagttgctttttcttctaaaacatttttttagcctgggaggtattatcaatatgaggttcctgctgccagccaagtatatggcagaatctagaaatgttaaaaattaattagctacctctgcggttgtcagaagccctgagaaatcagcttggaactaataagcccttgacctttcagtattggtgacgtacttgagattccagctgtccccagcttctgcaaaagggaggacattactagcttactaataataatttaatagtgtgtgaagaaatcaggggatgattctctttggtggaattaagtctatttctcagtcaagaagaaagcaatttataagtaaagatactcggcagtgctcagtggtatagtggagtcctggactctgggactgagttgtaaggtcagcgtaaaaagcaacactgaagttcagtcagaagttcccatgaaaattccttagggtttccctggaggtctgtgtgccattccttggtaagtttcatgtagccagtgtttcctctgacagaagttgggaccagtttctgtttctacagctgagcttcaggtaggagggcccgtgtgcagatctgcattctcaagcaccagaggcacccctcagtaccaggagatccagcctcatctcccactgcatgcctgatgtagagcatattctcattccttcagttaaaccaattaacgattgccaacaactttaagtgccagggacttaagtgttcagcagtgaacaagacagagttaatgccctcttggcacctaaggcaggaaacaaacaaatagatatatggtataatgccaaaaagtggtaagcactaagaaaaaaaaagtatgagcaggacatggtaatgggaaggtacgatctcacaagaaagatctctttgagagggacacacatgtctgagctgggaattgaaggagtgagccatggggagacaacattccaggcataaggaacagtgagtgccaaggccctgaggtgggacaagagatgacaagttaaaggagcaacagtgaggccaatgaggctggtgtcttgtcgtctcacgaggagggtggaaaaaggaggtgggggtgactaaatgatgtgcctattaagtgacatggtgggaggaatccgccgccccagtcaaatgctttttctctctttattgagagcttactaaatttgcataaacatctatatggcataactccattgaaccaacttttttttaatgactaacttaagattacagtgccctttttctagctgtaaggtaggaactcatttcttcatgccttctttctcttagatcttgaaatgcatcagccagctggagctcgctcagctgataggaaccggtgtgaagacgcgctacctgtctggatctgggcgtgaaagagaagggagcctgaagggccacacattggcaggagaagagttcatgggccttggcctcggtaagacaccaggccccacagctaacagtcacggatttgcaagctaacggggatgaaacccttcttgtctcatcaggactgtcctgtaaaccgtctcttccttttgtgccatctgacagtgttcatgaatgcaagtggacgtgctgctttggcctcttaattgtgattaaactgttgagtaaaatgtctattttaccaaagtcagtagggtgcattacttttctttctatacctatcactatattggggagaaaaaccatttgctttaaaatgttcagatctctagtgcctgacattagaggggtgtgtatttgtgtctctaggttttaaagggtaggttcaacatttcttccatctttattggggggcttttattaaacagtattcttatgcaagtagaattatttctctggctatacattggattgagaaactcttctgattgatgtaacatggtaataatagtaaatagggcaaacagatgtgccaagtcatattctgagcactcagtttatatattttaactcatttaatgctcaaaacaatccaatgagaacagggactgttatattccccattttgcaattgagaaaactgaggcacggagtgaaaagatatgagcagcatcatactgcaaaggagtggcagaggtaggattcaagccctaagccatccaactacggagtgtaggcttctaggtcccatttagtgagtggaatagtacagtgtcatggttaaaagtatggactctggaaaaatggggaattgtaatagcacccacttcttagggttctcgtgaggatgagtgtaatgaaagtctgtgaagcacaccaagcattcagcaggtgtgagccattaatgttctaggagctctggattaatatcaattgattcaaatttgttttcctaaatataggcctttaatactataaaaatgtaaaagattatagagaaaggtagatggttggtagaaacaagaaagcttatactaaggatatattttaaatgcccaatgccaaaacaaaactttaattttatcatcagtgggtttttgtttcttttttgaacttgcagagtcattcccatttatgtcccctgtccctgcgtgttgacataacaggatgctttgttctaaatacttgactgtttttgaagtactgctgattttgtgcattgtgtttcaggtaatttggtgagtggcggagtggataaaagacagatggccagcttccaagaatcggttggtgagaccagctcgcagagtgtggttgtagctgtggacaggtaatgattttattcttcagtgaccctgaactacacagtggtttggtggcctctctgtagttactggacatgaatgattcctaatttctttaactgatacaagtgttgttagctacaaattgcttaagtgtcacatttatttgcattttgaccttttagaaaaggtataactttaacattgtgacaaattatgtcaaaaataagagtttttcgcttatgttgatgttttaaattaccttgtttccttagtagaaattatttttttaaaaatcacaagaagagtttaggattaaaagcctacccatgctcacgcctgtaatcccagcactttgggaggtcaaggcaggcagatcactagatcaggaaatcgagaccattttggctaacacagtgaaaccccgttctactaaaaaatacaaaaaattagtcaggcgtggtggtgggcacctgtagtcccagctactctggaggctgaggcaggagaatggcgtgaacccaggaggcagagcttgcagtgagcggagatggtgccactgcactctagcctaggcgacagagtgagactccatctgcaaaaaaaaaacgcctacccatgctcatgcctgtaatcccagcactttgggaggcaggtggatcacaaggtcaggaaatcgagaccatcctggccaacatggtgaaaccatgtctctactaaaatacaaaaaaaaagaaattaactgggcatggtgacgcatgccagtaatcccagctactcgggaggctgaggcaggggaatatcttgaacccaggaggcagaggttgtagtgggccgagatcgcgccattgcactccagcctagcaacagaacgagactccgtctaaaaaaaaaaaaaaaaaagcctacccatgaatgagagttggctgagttgacagtttccttttttttttttctcccctcaaaacttttccattatttctctttactcaaaacttgacctaaaaatccaggagagatatttcccataaagaagcttcgtacttattagcaatcactctccgttttcttttctttccttcccccattccttagtcactgtaaccactgatctacagatttgcctgttctggacattgttccattgtccatctttccctttttattattttaatattcattatattctatttattaaccacgtagtttccttatactaacatctttccctttaattctatcctttttcaactcatgtatgttgcctctattgttaagtgcatataatgtcgtgtcttttgtgttcccatcttcttccactgttactgccttctgccttctttgtgttaaatagatattttctagtatatcattttacttctggtcatttcttgtactatatcttatgtattgattgattgattgattgattgattgagacagtctcgctctatcacccagtctggagtgcagtgatgtgatcttggctcactgcaacctctgcctcccaggttcaagtgattctgctgcctcagccgcccaagtagctgggactacaggcatgcaccaccatgcctggctaatttttgtatttttagtagagacagggtttcaccgtattggacaggctggtctcgaactcttgacctcaagtgatccacctgccttggcctctcaaagtgctgggattgcaggcatgagccactgcgcctgggctcccccgtcttttgatgtgtcactttctcttctgctcactataggtttttctgctttcaactcagttcactttccttgaaccgttctatacttgtaataccacatcatttatttcggtggaggtgtcagacctgatgtttcctctctaccttgtctgagagtttgagaaacttcagcttccaaatctaattaaaaagaaaaaacctgtgtgaccagagatcatctggcttttatgcccagtactaagacagaagcagaattgccctcagtctaccaaatctaatgtttattttttgtttttttgagacagagtctgtctgtgttgcccaggctggagtgcagtggcgcaatctcggcttactgcaacttctgcctcccgagttcaagcgaatcttctgcttcagcctcccaagtagctgggattacaggtgcccgccaccacgcccagctaattttttgtattttttattagagacaaggtttcaccatgttggccaggctggttttgaactcctgacctcaagtgatacaccctcctcggcctcccaaagtgctgagattacaggtgtgagccaccacacccggtctaatgtttattttgtctggaattatcttcctaggatttttactgggtctaccagactggatggaaatgcaataggtatgtatttgacttacctgtgaaaactgcagaagcctcacgctgtgaccgtctgactgttcctaacgaggctttgcttgtgttgttgggtctggcctgtagttgactttgtccgctggctgtgtgctgtgtccatggatgaactggcttccccccaccatcctcgcatgttcagcttgcagaagattgtggagatatcatactacaacatgaatcggatccgactacagtggtctcgaatatggcatgtgattggagatcacttcaataaggtaactcttcaaatttaaaaaccattcctgttaaaaaaaaaaaaaagtagacaactgaattcaaaaaaagaagtgataaataatttgccctgttttttagatgcctctaattcattttccctgtgcagtcaaggacagcttgataggagtaatatcatacttatatattggtagcattcatgtagaatgaattaaaaatccagtggtattgaaaatactttaatatcccacatgcaggatgtaggctaagaccacaaagattattacagccactagacaaatacactgatgcttggaagcattgtgaaatgaaatccagaaaggccttttaaatgacctaatgttaagttacgttccaggtagttttactcttcaatgtcactgcttcttgtattccggcacctattgccaccattcttctgaaacttttattgaaaaaattaatatttgggccgggcgtagtggctcacgcctgtaatcccagcacttcgagaggccaagatgggcagatcacaaggtcaggagtttgagaccagcctggccaacatagtgaaaccccgtcaccattaaaaatgcaaaaaaattagctgggcgtggtggtgtgcacctgtaatcccagctactagggagattgaggcaggagaattgcttgaacctgggaggtggaggttgcagtgagtcgagatcgcaccactgcaccccagcctgggtaacggagcaagacttcgtctcagaaaaaaaaattaataattgtttttaaatcagtaacaagccaaagacccatctgggttctaaaactgacaactgttgggaataaaccagactgaacttcttcctcgttaccagaagttttattatatacatacagacatatgcacacatgttgaataaataaaatgtcagatatgtgttttatcacggccaaaaaactgggaacaaagcaatcaaaagaaatgtatgtggccgggcgtcatggctcacgcctgtaatcccagcactttgggaggctgaggcaggtggatcacaggtcaggagatcgagaccgtcctggctaacatggtgaaaccccatctctactaaaaatacaaaagtttagcccggcgtggtggcgagcgcctgtagtcccagctactcaggaggctgaggcagaagaatggcgtgaacccgggaggcagagcttgcagtgagctgagatcgtgccactgccctccagcctgggcgacagagcgagactccgtcttaaaaaaaaaaaaaaaaaaaaaagaaatgtatgtatgtatgtatctgtgatgtcatttgcctcttaagggaaaggtaataataacagcttcctaccaaaacacatttcatgatctcaagaaaattttctcaaacctggtggtgaagagttataataccaatgcttaaaaatagtgttagtaaaaaaacaatccagaaattctgtacattgaatagaggaaaatcttaaaaagtagtctaccattggggtatagaataatcaatggggtgctggtaaatgatttgtagcatctgccagtttctgtgtgtaaacaccctgccacagccaatttaaagttagcaatatgatgtaactagggaagagatgggcacctcattacctcttgtggacaggtgctagtctactccaccactcccctgaaatgaagcattgtcatatgtaggcttgcttctaacttggtgcatcagctaatgaaagttccttgtttttccatcagctcaaattaaggcacctcacagcacactgtctgttttacaaaataatctgagtgcttcatgctgggcagtggacagatgagacccctgcctgcatggagctccctgtcattttatgataagataactgatgggaaaggatcaagcatgtcatatatcagggttattgagaaaacatggtcagggaaggtccctctttggaggtggccttgagaggcacaggagcctgtggatgatccaggggaactatttgttgagtggatggtatcactttaaataatcaactaactcagcaccatcttacccactattctgagtaaacaaattcctaattggaccaattgaaataattgatgtgaatttgcttgagaaagaaaatgtgaatcattgcgactactgtaccttgtattcttgtccaaacatgtgacagctaagccagaacaaacgctgctcatttattccacaagatcatttggctagcaactgtggaatcctttgttctctcagaaatgactagctaaaagtgttttggtaaacgttttcccaactctttaaagtctgcattttgtgttcattgggacttctgttttgggaggggaacatcagtttgctcaagttactcttcccacctgtgattctgttgtgaagaatctgtgtgtgccaattctcagtatgtatggaccacttacaggcaaggttgggacatagggtggcaggtgggaaccagacatttaattgtcatcaacttcattacaaatgtctgtttatttaatcagtgctgtttaagcaccaggtcatggaaaactcaggaactcttttttttttttttttttttttttgagacagagtttcgcactgttgccaggctggacggcagtagcttgatctcctctcattgcaacctctgccttccaggttcaagctattctcctgggactacacacatgcatcaccacacctagctaatttttgtattttcagtaaagacagggtttcaccatgttggccaggctggtctggaactcctgacctcgggtgatctgctcgcctcagcctccgaaagtgttgcgattacaggcatgaaccaccgtgcccggccctcactctgggactcttaactttttccaccaccttggaaagatgttcttcccattgtgaactggggcacttaagaatcttgcagatttgaagaaatagatatggctcaatccagctgtaacttagccctcaggttgctggcagagttgttcgcacagtcacatgattctcttgaactaggggcaccagccctgtgtcctggatgagcaaagcttcacactaagcatggtgtgtatgcctggagcatctgttttacctggatatttaagaaaggaatattctttttgttagtctctaattacattaacatactcccctttacacaaaaattacagctaaaacatctttggccaccctcccccacacatctggccctccccaaagctaattattcttactagtttgttgtatatctttccagacatttttgtattcatgtgcatatgtatgtactcatagaaatattacagataatattgtcttggtttgtttcgctttttaaaaaaattatacatagcattttgtaacttgtttcttccacttagcaaggaatcataaagatttaaccatgttagcatatgtagatttgttctcttttaagaaattgtaataaaatacacataacaggccgggcacagtagctcactcctgaatcccagcagtttgggaagctgaggcaggcagatcatctgaggtcaggagttcgagactaacctggccaacaaatacaaaattagccaaatacaaaaattagcagggcgcggtagtggacgcctgtaatcccagctacacgggaggctgaggcaggagactatctcgaacccggggggtggaggttgcagtgagcagagatcgtgccattgcacaccagtctgggtgacgagcaaagctctgtctcaaaaataaaataaataaaataagattaaaaaaatagaataaccatcttaacaattttaagtgtgcggttcagtagtgttaggtacactcacattgttgggcaacagatctcaaggacccttttcatcttgcaaaactaaaactgcatacccattaaacagtaactcccactttcaccctcctgaccacaggcaaccaccattctactctgtgcccctaggaacttgactactatgggtacctcatataagtagaatcatgctgtgtttgtccttttgtgactgccttatttcattcagcatagtaatgtcttcaaggttcatctgtgttgtagcgtgtatcagaatttccatccttttcaaggctgactttattatttatttatttatttttgagatagcattttgctcttattgcccaggctggagtgaagtggcaaaatgtcggctcactgcaacctctgcctgccaggttcaagcaattctcttgcctcagcctcccaagtacaagcaattctcctgcctcagcctcccaagtagctgggattataggcacccaccaccatgcctggctaattttttgtatttttagtagagacacagtttcaccacattggccaggctggtcttgaataccagacctcagatgatccacccgcctcagcctcccaaagtgctgggattacaggcgtgagccaccacgcttggcccaatttttatttttttaactttttttttttttttttttttagagacggatcttgctctgtcacccaggctggagtgcagtggcaccattttggctcactacaacctctacctcccaggttcaggcaattctcctgcctcagcctccccagtagctgggactacaggcatatgcaaccacgcacagctaatttttgtatttttagtagagacagggtttcaccatgttggccaggttggtcttgaactcctggcctcaggtgatcctcccgcctgagcctcccaaagtgctgggattacaagtgtgagccaccacacccagccccaatttttcattattacaaatgatattgctgcattctattaaaaataaaacattggccgggcacggtggctcatgcctgtaatcccagcactttgggaggctgaggcggttggatcacctgaagtcaggagtttgagaccagcctggccaacgtggtgaaaccccgtctctactaaaaatacaaaaattagccgatcttggtggcgggcacctgtaatcctagctactcaggaggttgaggcaggagaattgcttgaactggggaggtggagattgcagtgagctgagaccacaccattgcactccagcctgagcaacagagcaagactccgtctcaaaaaataaaataaaataaaataaaataaaacatcaggtcagaccacatatcaatgaaatggctcacttggagcaggcctctgcaagatatccccagatctcctggcagggggtgtgggtgggaaacattctcttgctgtttttagagattctccttgagagaaaagtctgaaaagcaccagccaaatatttacccataactccagttcctaaaagtaggcaaaccatagacaagtacaatttttaaggaaattgaaaagcctcaataattttgcagaagttttggagattgatgatatttattttatagtcatttgctttagatgacagacattgggaaagtgtgaaaaggctttccatagactgtaaaggcttttgacccttcatatatatatatttggagaaaattaaatagcaccttgggagatgttgtttaatggatatagagtttcattttttcaagatgaaaagagttctctgccgggcgtggtggcttactcctgtaatcgcagcattttgattgaggcggcctgatcacttgagttcaggagttcgagaccagcctggccaacatggtgaaaccctgtctcttctaaaaatacaaaaaaaagtagctggacggggtggcaggcgcctgtaatcccagctactcgggaggctgaggcaggagaatcgcttaaacccaggaggtggaggttgccagcctgggcaacagagttagactttatcttaaaagaaacaagaaaagaaaagagttctgattggcttcacaatagtatgaatgtatactactgaactgttcacttaaaatggttaagatggtagattttatgttatgtatattttacaattagaaaaattgggtatagttgcaagtttaatagcaaaagaaaaaaaaaagaaaagaaaaaaataggttgggcgcggtggctcaccctgtaattccagcactttgggaggccaaggcaggtggatcacctgaggtcaggagttcgagaccagcttggccaacatggtgaaaccccatctctactaaaaatacaaaaatcagccggcaggcacctgtaatcccagctacttgggaggttgaggcaggagaattgcttgaaccggggagatggaggttgcagtgagccgagatcacaccactgcactccagtctgggcgacagagccagactccatcttagaaaataataataataataataaaatgaaatttaaaaaagcagaaagtagcacattttaaatgcatatttaattaactatgcaatactgatttcgtcattacacttaaaataaaactggacagatcatagccaagaaatagcattttcttttctccttaggtgtgttttccctgaatgtttgttttgaaggtaggctgtccatctttgctgttgagagacccacgtcggtcattattacactatacctgtttcacatcagttcctgttcttgttcaggttggctgcaaccctaatgaagatgtggctatctttgctgttgactcattaaggcaactctccatgaagtttcttgagaagggtgaattagccaacttccgtttccagaaagattttctgaggccctttgagcatattatgaagaaaaacaggtatgtgttttgctctggaagacgcttggtcaaattccccgttggggctcccagaagccctcctaacactaaccacatgattaatttttttcctcccttgtcagtggaaacaaatagaatgaatagactgtgattcacatcgattttccttaaacaaatctcactaaaatctatgtgtagcctttcctaggaggacagatgtcaccctgcaacttgtagaaatatgtcgtgaaccggctgggcacagtggctcacacctgtaatcccaacactttaggaggccgaggcgggtggatcacgaggtcaggagatcgagaccatcctggctaacacggtgaaaccccgtctttactaaaaatacaaaaaattagccgggcatggtggcgggcgcctataggtccagctacttgggaggctgaggcaggagaatggcgtgaactcaggaggcagagcttgcagtgagccaagattgcgccactgcactccagcctgggtgaaagagcaagactccgtctcaaaaaaaaaaaaaaaaaaaaagaaaagaaatatgtcatgaaccccttttggggctggttctcagggagattaaaggaagagccactgcagaagcatcctcaaaccaggataagaattatgtgacccatcacttctcccccagggaggtcataaaagaggtcaggataccgggccctgtgaagcagccgtactgttcatttattcactcggcctggacttattgagacttgccatctgctaggtactataaagaagacattttaaaatcctgtgtttggccgggcgcggtggctcatgcctgtaatcccaacactttgggaggccgagtcaggtggatcacctgagcaggagttcaagaccagcctggccaacatggtgaaaccccgtctctactaaaactacaaaagttagccgggcgtggtggtgggcgcctgtaatcccagctactcaggagactgaggcaggagaatcgcttgaacccgggaggtggaggttatagtgagccaagatcacaccattgcactccagcctgggcaacaagagcgaaatgctgtctcaaaaaaaataaataaaaatgaaataaaataaaatccctgttttcattcagccttaaatagttgcacctgggtgtgatgggcatacaggagttcattatatattactctacttttctctgtgttttaaactttccataataaaatttaaaaacaaatctctgtttaattccaatagaaaaacaaataaatatcagtggtggtaatgggctctgaaggacattatatatatcaaggtaaggggatagggatggaagcactcttttatccagggcagccagctaacatgtgtttggtaagggcacccttaggaaaaggcctgaaggaagtcaggaataatctgagagtggccatatgctgccttggcatgagaattatgaacagggaagagcaaaagcaaaaggcccgtagcaggtagtgcttggcataggtggggaggccagtgtggcttgaatggagggaacaaggcaggtagtagaaggtgaagtccctcccagtggtggcagggtgcctagctcacataggagctgtcggccattgtcagcactttggtttgctctctgtgaaagatggaagccgttggaggtttttgtttttttttttgacggagtctctcctgacctcatgatccgcccacctgggcctcccaaagtgctgggattacaggcacgagctaccgtggccggcctgccattggaggattttaagcagagaagtgaaatgatctgacattttaaaggatcaccctgcatttatccatggaaaatgaggagcagtaggatgaggtaggaggccattgtagttgtccaggtttggaccaaggtgggagcagtggcagtgatggattagattctgtgcacatttggaaagggaatcttacaccatgtgctgatgaattggccatggagcataaaggaagagatgtcaaggatgacttttggacctaattcctcttgtctgctattcccctaaaaagtgtacttcagatcagcctggatctttttttttttttttttgagacggagttttgctctttttgccgaggctggagtgcaatggtatgatctcagcttactgcaacctttgcctctttggttcaaacaattctcctgcctcagcctcccaagtagctgggattacaggcatgcaccaccatgcccagctaattttgtatttttggtagagatggggtttcaccatgctggtcaggctggtctcaaacccctgacctcaagtgatccacctgccttggcctcccaaagtgctgggattacaggcgtgagccgccacacctggtgttgcttttttttttttttttttttttttaagaaaatgggagctcccaagctggatgccagagcaggctgttagggtagtgaataaaagggtaccagaaaagtttccttgacatgtctctctttctcctagtgtctgtatgtctgctttattgctcattttaagagaaccaaaattaaacccagagtctggcatcaccctttactttagcaaatacacaaaagtattttcctacctttaggaacaccattgagagtgcctgaggagactgagtcctcacatggccaagccacgtgtgcaagcctaattgcacggaagccctcaactcctaactccaggccttccctgcctatcctattcccagaaaaggggcagagtgagtttagaatcacatgttgccaggcactctcagatactgttggtggaactgtaacttaactgtaacatttctaaaagcattttggtgataagtgtcaagaatcctgatatttttatgcccctttgactcagtaattccacacttctgtaattctccaaagcagttaatgtgaaatatagtaaagcgttatatgtcacagaaaatagttttctagaaaaaaacaaactatctaaataaacaagtgttaaagtaaatgttggtaccggtacaacatgggatattgttttgctgttaaaaatgttcacaatgtttggccgggtgtggtggctcacgcctgtaatcccagcactttgggaggtcgaggcaggcggatcacctgaagtcaggaattcgagaccagcctggccaacatgctgaaaccccgtctctactaaaaatacaaaaattagccgggtgtggtggtgtatgcctgtagtcccagctactcaggaggctgaggtaggagaatcacttgaacctgggaggtggaggttgcagtgagccaagatcgcaccactgcactccagcctgaatgacgagagaaactccatctcaaaaaaaaaaaagttcacaatgtttataatgtgggaaatgactaatactttagagaaatggacaggttatagaattggacagacaatataatagagatagtgaaacgtgtatctctccatatgaaataccatatatcatgtaaaggtttttttttttttttttttttgagatgtcttgccctgtcgcccaggctggagtacagtggtgcaatctcggctcactacaatctctgcctcccaggttcaaactattttcctccctcagcctcccaagtacctggaatcacaggcgtgcatcactatgtccagctaatttttgtatttttagtagagacggggtttcaccgtgttggccaggctggtcttgaactcctgacctcaagtgatccacctgcttcggcctcccgaagtgctgggattacaggtgtgaaccaccatgcccaggtaaatttttttttatcatactttttctgtattttccaaaacttttactatcatcatatctttcttttaacaatcaggcaaaaaaacattataataaatatagttttgtcaacaagttgctttattctccatggggagacaaccatgaattcatttttattatatattggaagttacttatgttgtgtagtcagtcctttgttatctgcaggtgacatgtttactttgtgaactttcagctaatttttaactgttttgactttctccttgccttctctaaatggcctttcctgttattggttagtgtgagcctggaagacaaacatgaatgtcattctaagccagataaaatttgaaagtcatgagcctgggaggcagaggttgcaatgagtcgaggtcgctctactgcattccagcctgggcaacagagcaagaccttgtttcaaaaaaaaaaaaaaaattgaaagtcaaacctgtagtcccaaggccactgtactgacttttaaagatagtactatcgaagcagtaggcttatatagctttccttcttgctatttgtgagataataaggttcctccataattgtatgtcttaacaggttgagagacaattgcagctgttccagaaaatcagccattttctctgtcttcaggttttactttataataatttaggtaaacattgcaccttaaactatatatgtatactccaatccacatatatgtgtttatcacataggtatatccctacccaaaaatcttaagaagatacacacaagaatttagtaatgattatctctaggtggcagaattatattatttgaaatgtttttggccagaaaaactgaccagcagtgacttaaaccacaaggctatttattgttttcgtaacaagaaagaagtcagaggcaagcattcaactttggttccatggcctggatagcgaccatttatttgagacccaggctttttccttttgttcttccattcagagggtcagcttctcaaccttgagtttattgtttcgtgattgcaggatggtggttgtagctctatgcagcatgctaggtttggaatggaagtgagaggaaacggggcagagcccaaatgtggattgctgtgtgctataagaaatgtttaagtgctgcttctaagggatgagctatgttcatttctcttcccattctccaaagtacagacgatatggccgtcccattctttcctcaggtctcccaccatccgggacatggcgatccgctgcattgcccagatggtgaactcccaggcggccaacatccgctcaggttggaagaacatctttgccgtgttccaccaggcagcctctgatcatgatgggaacattgtggagctggccttccagaccacttgccacattgtcagtaagtggctctgttccctccctactaatgtcccacctgcaagtctagaagagtgtcacttgctgtctattttactacctacaggggcttccctaccttggctctactgtgatatagtaatgtgccaggccgtgttgtaagcgcttgatgagtattaatcttgatcttaactctgttttgactttctccttgccttctctaaatggcctttcctgttatcagtcagttggggtccagcagataaacgtgaatgttatttcaagccagatgaaatttgaaagtcaaatcaatcccaaggccactctaatgactatgaaagaattacagtcaatcctcattattggtggattccgtgtgtatactcactaaaatgtatatacattaataactccacaaccagtactcatggtgcttttgtggtcatttgccaacatgtgcatgcacagaagagcaaaaacttgagtcacccaaggcgcacgttcccagttgtggtggaagaaggtggcaccctgccttcttgtttgagctgtcatgacataaacaagtgtgcttaatgtggcctatcgagtgccatgtttttttacattttcgtgctttttgttggtgatttcactgtttaaaatgcccccccaagcatagtgctgaatgctgggtagtattctacgtgcagaaaggctgtgatgtgtcttatggaaaaaatatgtgtgttagatgagcttccttcaggcatgagttacagtgctatattggctgtgagttcggtgttaatgaatcaacaatatgtattaaataaggtgtcttttcaacaggaacacacatacaacaaggttatgtcttgatcagctgatgaaaatgttctgaccagagacttgcaggaatctagttccttatctccatattttccctaagagccatggttcagtattcttgaattcagtgtttatggcaactttatagaatgtaactatcaggaataatgagaacagactatctcattatttcccccatgttactaaagaggaaattgaggcacagaaaaataaatacaacaacttgcctgaggacacacagtttcgatgtagtggaaccaggacttgcactcgggcagtcgagcccagagttagtttagtgtccccctcctctggactgaccaggagtcctgggttctgcctgcgagcacgtaacaagatgtttacttcatctctatggaaatttttaggcatcgagttatctttgcacatagttggcgttcaataaatgaatgaattgatatttgggcctttacatcattgcttgagcgcaggaagactgtctagcccaagctgtacccagtgcattcattcctgagtaatttaataagaaaaactgtcttccaaagatactgacatgcttttcttagattttcacagttaattatctctgatgtatgtgtgtgtgtgtgtgtgtgcacgcacgtgcattttttcatccccatttctaaatcctggtcttatgaaaaatgtgccttgtgttcccccagcaactattttccagcaccattttcctgcagccatcgattcctttcaggatgctgtgaagtgcttatcagagttcgcctgcaacgccgctttccctgacacgagcatggaagcgattcggctcatccgcttctgtggcaaatacgtctctgagaggcctcgggttcgtttttccccaccttactcagatgggcagtgaagggaaaaggtcatggagcagaaattcttgctcctaacaaagagctttccagctactcttttagaaatgtgtgtttgccctaaattaggtgtttatttcaaaatgctgccatgacagggagttaggccttttcattatttggtatatgtgaaattctgtattttattcatactgaatctatggtattctacaaattgtttttgtagaagttagttgtattttagcttttgtattttggcaaagctcaagaagctagacgtttctatttgaaagaaaacaaacctcccttgtaggaaatggcattatgtctttgtaatgtgcctgagaaatcatatttaaaaatcaccttttgttttctcctgaaaatgatggggtttttgtttgtttgtttgttttgtttgatgtgtctcatctttctaaagaggcctatttggtttaaatgacagagtcccaaaacactgaaatagggtgaaaacaagtccatctaaactatgatgtcctgtgtagatctctacttaagtttcctttacagaaagagctataaacctgtaaggtgatatgtctcatctcttacaacagctcactaagatgtgatgataatgggagccaatgttgattgagcacttagtacttgttgggcaccattctaggtattttctgtatgttgattcatttagtccccatgtcagacctatgagatgtaattatatcccattgtacaggagagttactgaagcacagagagaaattgcctaacattacataaccagagttgctaaagaaatttcagtaccacttcaagagtggttacagagcagaggggtcaaaatcccagaaatagggcagagagtagggctatacatgcagactgtagaaagactgccaggtcctagctgtatgaccttgagcagcttactgaagctcttgatgcctcagttaattcatctataacctaggaccattgtttctacctgccacttggaatccttgtgagaattgttaatccatgaaaagaactttaacagtgcctggcccatagcaagcactcagtcaatagtagctgctggtattattttaagtaatgtgtatgacagtaacattccagaaagacctaagataatgatacatcctggatattttgtcaatactatttgacctttaagctcttcttagtataacacctcccacccccaggactcttgtgatctgccccccttcaacttgttctaaaacccgcagaggtccataggtttgtactgggaaactgctcatatgccctttgggacagataatgtctttgtgtagtctgttcccactgtacccttgctgaatggagatttttgggagagaaaaatgtgtggggccttaatctgcatatagttccctttcagttccttccttttgcatgcttagtttacacctgagatgtgatttttcatcctaggtgctacaagaatacacaagtgatgacatgaatgtagctcctggtgacagagtctgggtccgaggctggttccccatcttattcgaactctcctgcatcattaatagatgcaagttagatgtacgaacaaggtaaccatgttcccgtgcggtggccccttacatcactgaaatgaacctcagtcacttgctcacctgaccccactctcttctctgttgttctcttctccaccattctctcttctgtgcctgactttgtttcctccaggggactcacagtcatgtttgagatcatgaagagctatggccacacctttgaaaagcactggtggcaggacctgttcagaatcgtgtttcggatttttgacaatatgaaactccctgagcaactgtcagaggtaggtgataactacagcactgccctaggtatgatggagaggaaagcctttctggccggtatttgcctctgggggctgcatcatcgtctacccagagttcttaaatactgagcaacttaaggttttaaaaatggaaacacctttctgatactctcctaccagtatcagctagtcctgagtgactctccccatgttcagaagaatgagaggaaatacatctctgtggtctgctgcttggccctcaggcattgcaccttccagttcagcagggctcctgactggtcgttgtagttgttttgttcatatcaacctctgagcagtcagaaagtggaatgtctctggccccttaagggtttttaatgaagttgcatttggagatgatgttgaatattaagccttttttttaaaaggaagtttgatgcctgtaggtatttttatttgtcccttagaggtacagggatagtgaaagggtattctaggctcaggatttttagatggaaaagtaacctttttatttcttttgggaacaccattccttctctcaccgcaacataaaagtgacatatgcttaatatggaatattaggcaaacacaaaaaaattcttccttttaccatccaaaattagagttaatgtttttgcaaaattttctccatcttctacatggtttaaatatgattcggaggccaggcacaatggctcatgcctataatcccagcattttgggaaggtgaggtgggaggattacttgaggccaagagtttgggaccagcctaggcaacatagtgagaccatatctcttaaataaataaataaatatggttgaggtcatagtatagatagagttttctaatctttttaaatttaaatatgtttttcctcattataaaacaagtagaactacagaacacagacaaaaacaaagaagaatttaaacactcacagttgcggtttttcataggcagccaccgttaagaccttcaagtgttgctttcatctgtgtgtccacccacacatgcatttgtgatccacttttttcttctatgaaaatagaattccaacacacgtatataaactacttcttaaacttaatacatgagtattttttcgtagccataacttttcttctagaatgttttgtttgtttgttcctttgctttgtttcgtttttttgagacagagtcttgctctgttgcccaggctggagtgcagtggtgtgatctcggctcacagcaacctctgtctcctgggttaagcaattctcctgcctcagcctcccaagtagctgggactgcaggctaatgccaccatgtccaggtaatttttgtaatttaaatagagacaagatctcaccatgttggccaggctggtctcaaactcctgacctcaagtgatccacccgcctcagcctccaaagtgcagggattacaggtgtgagccaccacacccagcctttcttctacaatgttgttttaataatggctacaaaatagtcttagttgtggatgttccacagcttatgaacatttaggttgctttccggtttttctggacagcactgaaatgaacattttttgcagctacacttctagtggtggtgttttcttctttaaagacaagtggcccaactgccaggtttggggcctgcgtattactaagccttttgatacgtaccactaagctgacctgcagatatctctgtagccatttacacttctgtcagcaatgcatgagagttcctatttctccatattcattccaggtcttctcattttaatttgttttagtcattgctaatttgataagccaactgtatcacattgaaaaagtgtttcaaactgctagtgaggtggcatattttctctcataggattgatcattcttaagaattgccttttatgaattcttttatgaattactcttagctcatctactggattattcatctttctcctattgatttatgcatttttaaatatataaataatgtagcatatgcatacatgagttgcagatgatttgcccactttattatttccttttcattttggaaaatttagcttttaagtaaccaaatctatgcgttttttatttatttttttattccacttctggcttccacttttggcatcattaccataattttataaagatccctctgtatatcctctgtacatatgaatgtattaacatttttaagacgtattcttgatacatatcaccaaattgctttctacaacagttttgccaggagtgtacaagaatgcccatctcactgcagggagaatagcttttaagtgtcatctttttgttttcccagaaatctgagtggatgacaacaacctgcaatcacgcactttatgctatttgtgatgtttttacccagttttatgaagctttgaatgaagttcttctttctgatgtatttgcacaattgcagtggtgtgtcaaacaaggtactctttaagcctctaggcatcatttttcttacatagtctttaatgagaggttagttttttcaatatttaaaagcatggatgtagtgccatggagtacaatatataatttagttggtgaaatgtatacgttttaattacagtataaaaaacagtgccccccccaagtcagttcataaagcatttcttaaagatgggatatagttatttttgtattctacaagatgtaccttcatgtattatactgttctttttacttttgtatatgtttgaaattttctctagtaaaatgtttttaaaatgtattgtttcagtcaagatcaacagcttcatcaacagacaattattttagagtttgtcaggaaaaatacccagctagcacattagaactggattccatagataattttggcttagggcaagaaatttagttacatttttgaaaaagtgacttaattttaaaataaatgacaaaacatttgatattgttcaggtggcaaaaattggaaatgtaatgtatgagtgactaaatttttgaaaacctggtctaatgttttctctcttctattaccatttttcatacatgagccacttaatttaaagtagcaaaatgttgacctttcttctttagcaataaaactatgataaacaattttaactcttcaaaaaaattttaataaaaattttaatactgtctgtagcatggcttcattaattaaaagcctagaaactcaccagttgctgtctccaactcacaatatacagtatttgagacctggttggcatcaaaatagcagtagaagtttaatgatagatactgctttattttacagataatgaacagttggcgcgatcaggtacaaattgcttagaaaacttagtaatatccaatggagagaaattcagtcctgaagtctgggatgaaacctgcaactgtatgttggatattttcaaaacaaccatcccacatgtgtaagtgttcatgcagttgttcccgtttatctctgtgttcagtggatgtcttaaagctcctgattgcctttcacattgattattttttttctctatttttttcttcagtttgctgacatggagacctgtaggaatggaggaagattcatcagaaaagcatttggtaggatttggggtttttctttggttgtcttttcttttttctatcttagtaaaagatcaataagcctgtatagtttgtactttttttaatgggaagtgagtaaaattataagatctaaaaatagtatatattcataatatattttttagaaagtccagaaaagcattaagcaaataagtaacctcaccaagtaaaaagcacagtttacatttctagctgccgctttgtgtgaccgtgcatgcctaggaaaaccagccatatttgaaatgagggatcagttagcatataacaacatctgagcatttttccatattttaaacggttctttgagagcagtcttttcagtggctgcatagtattataatttctttacttctcccttatcggactctcaggttagttctaggctttcaacattgtaaatagtgctttggcgtaactgtgcttgtttgttgccctcctaaattaatagtgctttcctcttcaccaaagaagtggtagttcttactttttgtgtgagtccacataaagaagttttaattcagatctcacttttaaatactttggtttacagagaggagttgaattaacttttattcctaagtgactctaagaccattagattttaaaaagcatttgggatacagcaactgtcttctgctgttaaatttttttattttttattttattttatttttctcgagacagagtctcgctctgtccccaggctggagtgcagcagtgcgatctcggctcactgcaacctccacctcctgggttcaagcgattctcatgcctcagcctcccgccaagtagctgggattacaggtgcccgccaccatgtccagctaatttttgtatttttagcagagatggggtttcgccatgttgaccaggctggtcttgaactcctgacctcaggtgatccgccttccttggcctcccaaagtgctgggattacaggcatgagccactgtgcctggcctgttgtcaactttttaaaaaactagttactgcactagtaatttatctttgaacttgctcgcataaaaaatttgtcacacttattgttaaatcctaatatgtagagaaatgtcctctgggttggaataggaaaatagggaattttaatgggaggagaagtaatttaaattcttaatctctccattgcagcctgtgaggcatgctacattaagcatgtagtatcattttattttgagctaagcaaggcacttaaatacaggctggaccagccgtgttaaaacaggcacatctctgcccaaattatcatgaagaaaagtgagcattgtgtttccctctggtttacatttaggatgtggatctggaccgccagtctttaagcagcatagataaaaatccctctgagaggggacagagccagctctctaacccaacagatgacagctggaagggtagaccatacgcaagtaaggccactttttaatttgttttaaataagtaacatgtttatgtgattcatatattcagaaggcacaaaagggtaaacatgataagccttcttctgccctgtgcctcagtctgccagttctctgtagcagccaaggttacctgtttctctgtacctttccagagtcattttatccatgtgcaggcaagtacatgcacatatacattcatatacatacatatatagtacatacgaattttctccttttaccagttatggaatagtacattccatatacattgacatatacattcacacacatacatatatagtacatatgaattttctccttttaccagttatggaatagtatgccttattcttttttcagttaatatattttagagatcattcaaaatcagtacataaggagctttcacgttgttttatacgattgtctattattccagtttgtagacatgcatttattgcttaattgagttgctcttaacagacatttatattacttataatcttttgctgttaggagcaatactgcattgaataacccaatacatatgtcatttgtgaatttatgtaataaattcctaaaaatgtactggagtcagtggataagtgaatttgccatttttaaatatttccacattgctatctattacatttgtagctgtttacgtgatctttttagatgaaatacaactttggactaatttaacttggaattttcaaattatgagtcaaattgaatagtttttcgtatgttaaagcaccacttctgttttcttctctatgaactctgtaatctttgctcattttctgttgattgttggccccttttttattggtttggaggagctcttatgtactagaaatcctttttctgatatgagtttcaaattatttttgccaaattgtctcttaatgttgcttatgatgtgttttactgtcatttaaaaaaataagtttaacagctgtcatgtaccaggcactgtactgtgtgttccatgtgtattgtttcatgtaatcctcatagtagcctttgaagaggtactgtcttacgtttgagggaactggggcttagacagatcatagaacttgacaacatgtagtagagtggggattcagacacatttttggcagcctgaggaatgggaacttgtgaaggttgttctggtcctttgaaagttgtgtgccccattgtttgcctttatagcagtcccaccctgtcctcaacatgctaggccatagctgttaacattgaagttaacttctgaagcagcacatttgaccaaaacagtgtgcggtcacctttttctttagaaggaataaaagtagtcacccttgaaattcattaaagaggtatcgtgttgggactggcatgctgtctttcactaactgctgcagccagcttctctccaatgcccagtgatagaatgatacctttttcattttctctttttttagagacagggacatactctgtctcccaagctggagtacactagtgcaatcatagctcattgcagccttgaactcctgggctcaagcaatcctcctgcctcaggctcctgagtagctgggactataggcatgtgccaccacattcggctaattattttattttttgtagagatggggtctcactttgttgcccaggctggtcttgaattcttggactcaagccatcctcctgccttggcctcccaaagtgttgggattacatgcgtgagccaccatgcccaggctctttttcttcacgagctccagataaagtagttagtttctgtgtggaggccaagtatacatttctttcaataggagaagcactctccgtgcagtgagagtctacactctgagaagtacctaggactcaatccacctcccattcccccagggaacagtgcctttgctgctcccagtctcccagctcagccataagctcaggcagacaaaaatctttgcactattattatcgtttcctttttatttttggcccaaaatgttttaattgacttggcataagttgaatgtacatcttctggaactccactgtattaaaaaaaaaaatttaaaacaatctacatggagaattgttacgtgtttttataatttcataactggcgaggtgcagtggctcacacctgtaatcccagcactttgggagaccaggaccaatggatagcttgagcccaggaatttgagaccagcctgggcaacatggtgagaccccatctctaagaagaaaaaaaaaattttttttttaatgaaaaaaatgaaaaaataatttcacagccactttcaaaaacttaaagacaactcaacctccttgttttctatcactgaaatatttaatgttttcaacattctgattttataaaataagttgggaaaggaatctctactgttactgtagacaaaccagtgaacacttatgatgtatttgacatgggccacccttgggccctcagggattgagaacacaaagaggatatagttagtctactcagtaagcagaaaccacaccgctaatttgaacagggaaaattcaatattaagaattgttggggccgggcgcggtggctcacacctgtaatcctaacactttgggaggctgaggcgggcagatcatgaggtcaggagttcaagaccagcctggccaacatagtgaaaccccatctctattaaaactacaaaaaaaattagccgggcatggtgccgggtgcctgtagtcccagctacttgggaggaggcaggagaattgcttgaacctgaaggcggaggttgcagtaagcaaagatcacgccactgcacttcagcctgggtgacacagcgagactctgtctcaaaaaaaaaaaaaaaagaattgttggcgaggcacagtggctcatgcctgtaatcccagcactttgggctgaggcaggcagatcacctgaggtcaggagtttgagaccagcctggctaagatggcgaaaccccatctctcctaaaattacaaaaaactagctgacacagtggcgcacacctgtaatcccagctaccagctacttgggaggctgaggcgggagaatcacttgaacccgggaggcagaggttgcagtgagctgagatcatgccactgcactccagccagggtgacaaagcgagactccgtctcaaaaaaaaaaaaaaaaaaaaaatgttaactagtcaaaggttgttaaccactaagaggaataaaagaccactcttaagggatacagaagtagaaaatgcagaaagcaacaaaactgagcttcttggccaggcaagcaatggctcacacctgtaatcctagcactttgggaggccgaggcaggcagatcgcttgatattgtggcacaggagttcaagaccagcctgggcaacatgaggaaatcccatctctatttaaaaaacaacaacaacaacaacaaaaaaaaaaaacccacaagcttctggcctcttcagaggggctggctactgcaggaacctgaaacgtcctctggttagggcacagtccagtggtggtctttaggagtagcccactgggtggcagagaaacttgctggaggacacagaacctgcatagctgattccctcactttcttcaggtctttgctcaaatgtcacatttttatagagacttttcccaactagtttgcttaaacgtgcagtcctaccctgacactttctatccctgtctctacctatcatcaatatttaatatataatattcttaaaatatttcatttattgtctgtcaacaccatgggagcagagatttttttttgtccagtttattcattgctgtgccacaacatcaagaattgtgccttgactgggtgtggtggctcatgctgtaatcccagcactttgggaggctgaagtgggagcatcacttgaaaccaggagttcaggaccagcctggagaacgtagtgagaccccatctcttaaaaaaataaatcatgccttgcacatagtaggagctcagtggatatttcttcagtattggctgaatcattattagggttaatctttatcatctaacatagatcagaaactgtttgccagcctcctcatcaagtgtgtggtccagttggaattgatacagaccattgacaacattgtgttctaccctgcgacgagcaaaaaggaggatgcagagcacatggttgccgcccaggtaagaacaggaggcctcaggaagagcatccctgtccatagggaggttgctttgatgtagtggtgtgcggaagccagcttgtactggctttccagagcctgtcatgctcatctctttccaacctcacattcagtgatggcatgttgatgcttaaaattggccttgatgggagttatttacatcagagaaaaacagcaaacactaaacatcagggcttcattttttttatgtatataccccagagagtgagtttatgagcataccactgctcagatgccaccccactagtgttagttatcacaggaactattccccacaattgatatacagttttttttctggtttttttttttttgtttttttttttgtttttttgagacggagtctcgctctgtcgcccaggctggagtgcagtggcgcgatctcggctcactgcaagctccgcctcctgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggcctgatatacagtttaatcacaaataagtgaggaggaaaagatatatataaagatcccagtttttccttcaagaatttcgctttttttgttttctatatgcaactttctacatatgggattcttttcctttttttctttttttggcgagacaaagtctcactctgtcacccaggctggagtgcagtggtgcaatcacagaatcacaggtaactggggtttcaacctcccaggctcaggtgattcccccatctcagcctcttaagtagctgggactacaggcacatgccgccatgcccagttaattttttacattttttgtagagatggggttttgccatgttgcccagcctggtctcaaactcttggactcaagcaatctgcccacctcagcctcccaaagtgttgggattgcaggcgtgcaccaccatgcctggcctacatatcagattcttgaaaacatagagaattcagtgtccaaaagttggacagttatcctacaccatgggttacaaatgtcagtgcttcaggggctagcagatcctgtgagagtgagtgagtgaggcaggctgggtaaggattgtggtaaaccagaaatctctagcccagtcaaagcggctgccacctctcagctttagcgcccgattaccatccaagtgggttaagttgtgacagtttctcgtgtttcaagagtagccaaaatcaagattttttttcatagaggaagtcatgttttaaatactagcaaaagtaatgtaaattttattactgctggaaaaaatacagctgtgagccagaggctgtccttttgattttaaaattttaggcagcttgttcagtaaagtttcctagggtttcatacatgtttcaagaatgcattcctgggctaggtgcagtggctcacgcctgtaatcccagcactttgggaggccgaggcaggcggatcacgaggtcgagtctgagatcattctgaccaacatggtgaaaccccgtctttactaaaaatacaaaaatgagctgggcatggtggcgagcacctgtaatcccagctagtcaggaggctgaggcaggagaatcacttgaacccgggaggcggaggttgcagtgagccaagattgcgccactgcactccagcctgggcgacagaaactcttgtctcaaaataataataataataataattcattcctgtaatgaaataattggagacacacacactcctgcttatgcagtggaggcagcactgatgaaactgaaactttggccagccaagcctgccatcatggaacggctcagtgtgttccttcaccagccagtgagcagagtctaaatggaaatgtttcagggtgttggggaataagtgtgtcttatagacagggatgacttttggagagtcatgactgccgttgtctgcaatcacaatgcccagagcattccatcttcttcattagctcttctatcctctgtcctgtcctctagcaagacacgctggatgcagatatccacatagagacggaggatcagggcatgtataagtacatgtcttcccagcacctcttcaagctgttggactgtttgcaggaatcccattcattctcaaaggccttcaactccaattacgagcagcggactgtcctgtggcgagcaggtaaggccacacagcagataagatagatggccacactggtcaccttcctaaaacattaaagtgcttggaaaatgcccaaaattttaaacatagctagaataacttaacagatattttcatgcttgagggggagagaagggaaatgttggataggtttcatcccagtacatggtagattctcagtacgtatttgataaaaagacaaattgaggccggatgcggtggtccatgcctgtaatcccaacactttgggaggctgaggcaggcctcagccaagatcacttgaggccaggagttcgagaccagcctggccaacatggcgaaaccccatctctactaaaaatataaaaattagccaggtgtggtggtgcaaacccataatcccagctacttgggaggccgaggcaggagaatcgcttgtacccggaaggcggaggttgcggtgagccgagattgcgccactgcactccagcctgagtgacagagcaagactccatctggaaaaaaaaaaaaaaaagacaaattgaaagttggagaattgaattgatctagcaagtcaaaacattttatgggctgggtgcggtggctcacgcctgtaatcccagcactctgggaggctaaggcaggcggattgcttgagcccaggagttcaagaccagcctgggcaacatagcaaaaccccatctccacccaaaaaaaagtatatgaaaattagctgggcattgtagcacacaccatactcaggaggctgaggtgggagaatcacttgagcctaggaggtggaggttgcagtgagccaagattgcatactgcactgcagcctgggtgacagggggagaccttgtctcaagaaaaaaaaaagaaattttacattaaattaaaagttaaatatgacataaaaagtgtggtagtctaggaaaaacagaaaccattcatcaattttccaagccttatatttactttcctacctccaaaaataaatacaaaaaccctggaggtaaatacattttttttccaagatggtggtgggattctcattattttgaactttgcatacaagtgatactttatataatttttgtattgttaatttttaccattactttttttttttttttttttgaggcagagtcttactctgttgcccaggctggagtgcagtggcgcagtctcggctcactgcagtctctacctcccgggttcaagcaattctcatgcctcagccttccaagtagttgggtttacaggcacatgccaccatgcctgactaatttttatatttttagtagaaacagggtttcaccatgttggcctagctggtcttgaactcctgacctcaagtaatccactcatcttagcctcccaaagttctaggattacaggcatgagccactgcacctggccttgttatcattactttttgtccccaaatatttattttaacccacaattaaagaatgtcatttttctctacagccttaaaatatccagctcttttatgcctttgcctgtaataagattttgtttgtgagagtggtttgcatatctcttaagctgattggtactagtttgtttttaagaatgtgttcttttttttttattatttatttttttattttttggagatggagtctcactctgttgctaggctggagtgcagtggcgtgatcttggctcactgcaacctctagcctcctgggttcaagcgattctcctgcctcagcctcccaagtagctggaactacaggcacgcaccaccacgccagtggtctcactctcttgacctcatgatccacctgccttggcctcccaaagtgctgggattacaggcgtgagccgctgcgcccagcctagaattcttaagagctgttacatttgaaaagacaaaactaatggtttcgccagccaataagcaaagtctaaatggagagcaggccaggcaaggtggttcacacctataatcccagcactttgggaggctgaggcgggtggatcacttaaagtcaggggttcgagaccagcctggcaacatggtaaaaccccatctctacaaaaaatacaaaaattagtgaggcgtggtggcgtgcgcttgtagtcccagctacgcaggaggctgaggcaggagggtaacttgagcctgggaggtcgaggttgcagttagtcaagattgtgtcactgcactccagcctgggtgacagagcaagactgtctcaaaataaaataccaataaataaatgaagaacagtacagggcattgaaaaatgaagttatcttatacagaggatgacttctggggagtcgtaactgccttcatctggtatcacaaacgatctgtattaagaatatatataaaatgtttcaggccaggctcagtggctcatgtctgtaatcccattcctttggaaagctaagacaggaggattgcttgagcccaggaatttgaaaccggccagggccacatagtaaaaccctctctgtacaaacactaaaaaattagctgggtgcggtggctcccgtaatcccagaactttgggaggccgaggcaggcagatcacttgaggtcaggagttcgagaccagcctgaccaacatggagaaaccctgtctctactaaaaatacaaaaattagcccggcatggtggtgggcacctgtaatcccagctactagggaggctgaggcaggagaatcgcttgaacctgggaggcggaggttgcagtgagccgagataatgccattgcactccagcctgggcaacaagagtgaaactgtctcaaaaacaaaaaaaaattagccaggcatggtggcacacatctatgttcctggctactcaggaggctgaggcaggaggatcattgagcccagaaattggaggctgcagtgagctatgatcatgccactgcactccagcttaggtgacagagcaagactatctcaagaaaaaaacagatgtttcatatttcataaaataactagatttctagtcatacacagttatcagcattatcttagaaatgtgcactaattatatgactgtctgatctctaggttttaagggcaagtctaaacccaatcttctaaaacaagaaaccagcagcctggcctgttgtttgaggatcctgtttcgaatgtatgttgatgagaaccgcagggattcctgggaagaaatacagcagagacttttaacgtaagaaaattagtttctgattagatttctatctgctatatacaaaatgcatcacagcaatactgtggattgaaaagagtaagagaaaaatacatgctgacactctgacaaatttttttttctttctatttggtgactctcccatttcacttttcttaatgccctgaagagggcagagcctcatctgtttcactgttaagcccttgcttgagcccaggagtggaagggtgctgtgagctatgcatagaaacatggacagtgaaaagtgctccgagcggtcagcaggctggatggaagtcctgactgtggctagagccctgtggccttaggcaggttactatccctcttgggaccaggtcctctttagaattgttgtcagcaataacatcccatcattccttctttccaagaagagtgtaattgaaatcatataaccaggatgtgcctacaaaattatctagaaatccaccaatggggagagagtggaatactgatgaggaagccccagccagaaaagtaggtctttgtcactcagcttcctgggcatcagcaagattctgatgcctgagctttcttttcttcctctaaggtataaaaacagtaacacacagtgctggcaaatgtgtggtaagaatgcactctcctgcgtagctagttggagtgtataatggcatgatctttctggaaagtaggtgagactatataccaggagccctaaagtgttcattctctgtgactcagtaattccactgttatggaatctgcttcagaaaatattttagaaataggaaccaggaataccacatggaatattcactgcagacttatcaggagaaaaaattttaagcagctcaactgtggaatgaataactaagctgtaatatgtcctaaattatgatattatgaaacatagtcattaaaagtgaattttttttttttttgagacggagtcttgctctgtcgcccaggctggagtgcagtggtgcaatctcagctcactgcaaggtccacttcctgggttcaaccaattctcctgcctcggcctcctgagtagccaggattacaggcgcgtgccaccatacctggctggttttttgtatttttagtggagatggggtttcaccatgttggtcaggctagtctcaaactcctgacctcaggtgatctgccgacctccgcctcccaaagtgctgggattacaggcatgagccaccgtgcccagcctaaaagtgaaatttttttttttttttttttttttgagacagagtcttgctctgtcactcaggctggagtgcagtggcgtgatcttggctcactgccacctctgcctcccgggttcaagtgattcttctgcatcagcctcccgagtagctgggactacaggcgtgtgccatcacacacctggctaatttttgtgtttttagtagagacaaagtttcacgatattggccaggatggtcttgaactcctgacctcgtgatccccccacctcggcctcccaaagtgcagggatgggcgtgagccactgcgcccggcctaaaagtgaaatttttaagaaataattttacttaatgtgggaactttttcataatacaataatttttaccccaaaaaaagctgcaaaagtgtttttacttggaattttcagcaattggggcattttatttgtttttttagagtcagggtcttgctatgttgcctaggctggtctcgaactcctgggcttacgagctcttcctgcctcagcctcctgagtagctgggactacaggcgagcaatttttcttttgaaatcttagcaaaaaaaaaaaaaactggaaggaaatatgccaaaatattgtcatgtatcccttagaatgatgtagctatttttctttataatttttttcataattttttacatatatcagttaccttacaatgagaataacaagtcataaagtgaaaaaagaattaattaattaaaggaggcaccaatggctcatttcagcttaagcccaaaagacaaatacctacagtctcataaagtttctctaaaggagatatgtagggccgggcgcggtgggtcacatctgtaatcccagcactttgggaggccgagccaggtggatcacaaggtcaggagtttgagaccagcctggccaacatggccctgtctctactaaaaatacaaaaattaaccaggcatggtggcaggcgcctgtaatcccagctactcgggaggctgaggcaggagaatcacttgaacccaggaggcagaggttgcagtgagccaagattgtgctgttgcactccagcctgggcaacaagagcaagactccgtctcaaaataaaaaaaagagatatgtaaatgtcaagtttttggcatgttttttaaaaaagcaattaaatgtgattgtgaggagagaaaggcagttatataattatgagtaataagctcttgtgctacagacattgattgagttcagccctagccatgtgccaggactgagccaagttatgacttaacatatttacttcatttaatcctcacaacaaccccttgagtttggactttttttttttttttttttttttttttttgagatagtctcactctatcgcccaggctggagtgcagtggtgcaatctcagtttactgcaacctccacctcctgagttcaagtgattcttgtgcctcagccacctgagtagctggaattacagatacgcaccaccacacccagctaatttttctatttttagtagaaatgggggtttgctacattggccgggctgtctcgaactcctggcttcaagtgatctgcttgcgttggcctcccagagtgctgggattataggcatgagtcactgcacctggccaggcaattttttatctccattttatagctgaagaaactaaggctcagtgatttgcccaagatagcacagccagagtgggtgctcaatagttattgcagtggctgggctcagaggctcaggctcacatctataatcccagcactttgggaagccaaggcagacagattgctgagcccaggagttcaagaccagcctgggcaacgtggtgaaaccccatctctactaaaaatcaaaaaaattagccaggcatggtggcgcaagcatgtagtgttagctgcttcagaggcagaggtgggaggatcagcttgagcccgaggaggtcaaggctacagtgaaccttgatcacaccactgcactccagcctgggccgcagagcaagaccctgtctcaaaaaaaaaaaagtaattaaaaaaaacatgttaaaataattttaaaaatagcacaagaatgaatagttctcccctgaatgtgagatgttaatcaattgtttgatatgcctccccctctctaattcttctagtgtttgcagtgaagctcttgcctatttcatcactgtgaattctgagagccatcgggaggcctggacaagtctcttgttgttacttctaactaaaaccctcaaaataaatgatgaaaaggtatgaacaagtaaactctgaccaattttcactaggacataaagtttgggttggctttttactcaagagtttgcagtaactattttctcagttctcccaaggatggttacgtgactagcaccattctagatgcattggagagaagttaatccgttatggacaatgggtgccacaggatattagggctttttgcctggaagaacagtagttgagaacggctgaagtgtagacctcatgtgttgctgttaggaatggtatggtgagtttcagtgcaggaagagagggttaagattgtgaagcaccagttttgacctaggaacctgctttacaaaataaaagagctgttgacttttggcagcaagactatccaaatttaattaaagttaaatataactgaaagaagctttaatttgcaaggtttcttcaacttctttttttttttttgagacagagtcttggtctgtcacacaggctggaatgcagtgacgtaatctagctcactgcaatttctgcctcccaggctcaagcgatcctcccacctcagcctcctgagtagctgggaccacagacacgcgccactatgcccagctaagtttttgtatttttggtagagacagggtttcaccgtgttgcctaggctggtctcgatctcctgagctcaagcgatccacctgcctcggcctccccaagtgctgggattataggcgtgaatcactgcgctcggccccaactttctaatagcaagaaaagcaccaatattgtaataagttccagggtgagattaacacttctgaaaaactggtgcccaaaaaaaaaaaaaattgtctaattttatctgtttctctcccacctcaagttcaaagcacatgcttcaatgtactacccctacttgtgtgaaattatgcagtttgacctgatccctgagctccgagcagttctgcggaagttcttcctacggataggtgttgtgtataagatatggataccagaagagccatcacaggtaccagcagcactgtcaccagtgtggtagccctggctgcccaggccagtgctgcagctctgcagaatgttcagcatgccatttctgactggcacatctcgtgaagtttcatagaaacaaggagttggcatcttggatctcagaatggcctggaaacggatggcctctacgctgttccatcacagtctccaactaaggcttatggtatttcattaaactgttgcatacccagttagcacagtaggtggggagtctgcttcatttctatcattccatttttctgattaaactgtcaaatctgtcattgcatatgccatcgttttctagcaaaatcccatgattggctataaacgttttgtaagaagtcactctccttgaaaatactgaacatagctgtataggtttgtgattattagagaatatgttaataaaacttcttgtaacggctaactgccacctaaaatatgctgggttttctgttgtttgagtgtgttagagaaatttgaatgtttttgtcagttacgagtcagccgtaattagattagtttaaggacaggtcaggattagagaagagttgtttttgtgttttgttaatgtctgagtgatttttaaagtattttacaaaaagatattgaaaatttggttgaaggcagagtttagtaattaagttagaattaagagttttgcgaggttaaaaaaatgtgcctcgtggatctccctgttttagtaacatggagagaaaaagtctacacgaaaaagtgaacaatttaatgaagatgattagccttccttgaaataagtatttgtggatgggtgttaaattaaaatttccagaatacactgtccatctcacacactctgaaatctaatatatgaagtagtaatgaaaatgaagtagtaatttaaccagagttcatttatccttgaataaacctttttattttcacctcagaaaagtgagtgtactggcagttagtgtcactgctttgcacagtccccattaaaggaccctccagagagggacagtaactgtgcatgagaagccgctcccataagcctcctcagccagatgtcatgggtggaactggagctgtgtcggggccagcacagctgaactgtgacaatggcaggaggtggcatgtgcccagcacttccattaatctgagcctaggagttgaattctttggcaaggttggattctgaggtccttattatgttaatgatggtgcaatactctcacctgcagtagaactgagttctgctgcagcttgtgtaaaagtgggcagtacacaagtacgtcccaaagcctgtgagcagtatacgtggatgctcacccatgagaaggagcacacacgcctcattctctgccctcacccactgctcacctagagcatcgctgagcgttagacaaagtgttacacagaatgattaaaactttcagacttctacctatgctctttagtcctgtaaattgggttgtattgatgtcaactctggtgccttagaagttagtagtttgggaacctatctgtaaaatcagatgttttttctttgtagagaaggatttctggtgcttttgcttactaagagaccgatattcttaagttgttttcttgttttaacagccttgagaaatgtttggttttggccagcagaattcttgtctacttttttctttcccaaaaagtgttttttaatttctctaccaaagaaaaaatgagcaggtttaggtttttacatgacttatatacattagataaaaggagctgtataatttagcaggaagggactatgggagaatactttactgtgagtggaaaatgttagcacatttgactggtttgccctggaatccactgcacctttacactgcaccatgaaacctacactccctggtatcatagcgcgtcatcacctcaacaagtcagtcgtctccattgatatttgtacaaaaggtatacatggggaacacgtgttcattcattaagtccatcttgcgtgcagctatatccctgattggttatttttcctttccttctgaggttctcatgtcattttcttcatcggatgtgactaaaatttttctggtgtcttctgccctctctttaattttgcctcttgaggggtagcagatgtgtcagtgcattttattacttgctgaaacattcaggcttacatttcttattagtttagtattttaaaagatttaattttctgaatgaggcatttgaattgtaccagcaatggacttttaaaaaattggatgtaaaaccattcagggtgatttttcttgtcagtggacagtgacgaacagagatttgaaatcccttacctccaataataagccattcagcctaaattcatttttatgaataaatctcttctttctcatggtaaatgtggcttgtgccactcaaacactagtgaaagggtatgtacaaccgcaacatcaggccaggacaccatttatttaaccaagtaatggaggagagtgaaacattttccaaggccttatttctttttcagaatgct

SEQ ID NO: 16206 - DNA, 54246 bp, Human
ctcacacctgtaatcccggggctttttttttttttgagatggagtttcgctcttgttgcccaggctggagtgcaatggcaagatctcagctcaccgcaacctctgcctcccgggttcaaacgactctcctgcctcagcctcccaagtagctgggattgcagacgtgcgccaccacacccggctaattttgtatttttagtagagacggggtttctccatgttggtcaggtctcaaactcccaatctcaggtgatctgcctgcctcggtctcccaaatcactgggattaccggcgtgagccaccatgcccagccctatcccagtgctttaggaggcggaggtgggaggatcacttgaggccaggagtttgcctgggcaacatagtgagagctcatctctacaaaaaaattcaaaattagccaggtgtggtggcaggtgcctgtagtcctagctactcaggaggctgaggtgggaggattgctttagcctaggaggtcgaggttgcaatgagctatgattgtgccattgcactgcagcctgggtgacagagcaagaccctgcctcttaaaagaaaaaaaaaaaaaaaaaaaaagccctggccaggcgtggtggctcatgcctgtaatcccagcactttgggaggccaaggctggcggatcacaaggtcaggagttcaagatcagcctggccaatatggtgaaaccccgtgtctactaaaaatacaaaaatcagcggggcatggtggcgggcacctgtagtcccagtaacttggggggctgagtcaggaaaattgcttgaacctgggaggcagaggttgcagtgagctgtgacagcaccactgcactccagccctccagcctgggcgacagagcaagactctgtctttaaaaaaaaaaaaaagaaaagaaaagcccttgctgtatagaatcccttaggttatggatggggaggagggcaggggtttaggaggggagaagcggaaggaggaacaaaataaagaagagacaattagttggagagtgataaataccataatgatatcatggaactaggcttaccagatcaaacactgggcacccagttcaatgtgaatttcagataagcaatgcatgatttttaagtataaatatgtcctacacagtatttatactagaaaattataaatttttttctaaaatttacattgacctgggcagcctgcattttatttgctaaacctggcaaccctaatttgtgtgctgggtggtggtgagtgggcaatttcagataggcctcttttgtggaggtgacatttgagctggaacctaaatgtaaagaaggagccaatcattcaggaatctagaacatcccagcacagggaacagcaagtataaatgctctaaagtggaaataagcttggagcttagaggaacaggaagaaggtggggtggcggagctgagtgagggtgaggagaggagggaagcggaaggtgatgagggcaggcaggctggcaggggccagatcccatatggtttgtgggctgtaataagagtaccaaaacttacataccaggccaggcgcggtggctcacgcctggaatcccagcattttgggaggccaaggtgtgcggatcacttgaggccaggagttcgagacctgtctggccgtgtctccctctaaaatagaagctccaagaggggcaggaagttctcttccgtcttagaccctatgtgcacgaccttggatcgatcaacattgaacacctcctacgtgccaagccctgacatcaaaatgggtcagaagccagcagccgctcgctgaatctgtgttcctctttggaaaacgagaaccgtgaagcctgctggcatggtcagagccaaagagcattgtcacttgtgagatcagcgcagaaacagagcggggccccgattggcccttcgaacttgggtggggccagagcattcctggccccgccccctgcagcgggccgctcgctcatgcgctctggcctcaggctcgctgtcgcgccattttgccggggtttgaatgtgaggcggagcggcggcaggagcgggtagtgccagctacggtccgcggctggggttccctcctccgtttctgtatccccacgaggtgaggcgcggggcgtgcacggcctaccagagtggctcttggggcccagctgaggaagggatgaggcgctcccggtactaacgagcgctagggagtgagaaccgcgcctctgggcgagagcggaatgtgggcccggggttcgggtggtgcgctcaggcaaggtcttcggcttccctagggagcgcttgccgcgcctcgcggcatcctaggtctctggcccaggtgcggcgaccccagggcctgtgagggctgagggcaactgaggcgcggcctaacgcgagcctgcggattgcccgccctttcctctccatcacggcgctgattggctgcgccgccgcctctccgctcgggaaggccgctccttattggtcgcgctcgcatgtccattctctgcgacggtggctgctagccgcgcgagctgggtgtgcggcggcgaggcctgcccgggcggggactgcgggcgcgtggagctgcggctgcctcgcgtcgtcccttgccctaactctagtgaagcccccgaactcacccttctctaacctctgtacttgtatccctgactgtaaaacgggcatcgtgatctcactttgctgaattgtttgtgagaattctagtcggtacacccgggacatagaaatcccctgtaacgcgggttgggggagggttccctcgttttgggagaaacgctgtgctgtggtggttcggagcatagactttggaattagatcgcctgggttcattccagacgtagcctctcgttaggggtgtaacttgaggctggtcacctcatctcactgagcctccatttccttagctgcaaaatggggttaataacagaatctacctcggaaagtggctttgaggatgcgctgagttatttaccgtggtttacaaaggttccctgggagctgacggttgtttattcatctctcccacccatctttctccttagccagtgtggctttctgtttcttccatattccagggttattccgatttaaaattatttgcacatgccttttgtttgctggggaagtaccaacatttttgcaaggcaggccgcctctcccaagtttccctcaccttaggcctcccctaaccaacctcttcttttgttttctttttctttttcttttctcttttcttttttttttttttttttttttttttttgagagagagagtctcgctctgcctcccaggctggagtgcagtggcgcgatctcgactcactgcaacctccgcctcccggattcaagcgattctcctgcctcagcctcccgaatagctgagactacaggtctgagactacacgccaccacacccggctaatttttgtatttttattagagacggggtttcaccatgttgatcaggctgtctaatcaacctgtctaggacctttctcccatggctctccatcaacatcacctggttttagttacttcatagcatttactaacacttacttattgcttacttgttatctttctcaactgctagaatgtaagctgtttgagagcaaggaccttgtctgtcttgcttacttctctctccctggtgggtgccatcccacctgtgcttgccacatggtagatgcacaagtattattcttccttggaggcacagaaggggaccctttagtcttggattccaccaattgctctttttctcaccttgggcccacatagtcatatctttggcctttctctgtgtgtgtctctctctttttttttttttttttgacatgctttcagaggatcctaatggacctcgtctctccgctcctacaaccctttatctttcacttcttaccatcagtgcaagggaagtctctctccccttctgattacttctgctggttggggtctgggacaggattggatggatgcaagagcagtgctctagttttggaattaatttgtttctttattcatttaataactttattgagcatccacttaatctctgggaatatagtgaaaaaacaaaaatggacaaggtcccttcccttgaggaccatgtattctcgtgggcgaaagaaaaaacattagataatttcagatagtgacagaattatgtgacaggtgaagaaggcttttctgaggaggtgacatttgggtagagaccagccattaaaaggtgaggggcagaacattccaggtagagggaatagaaggctcaaggctcaaggacaggaaccggcttggaatattgaaatatttaaggaatatcttaggttcctagagtgttacatgaagaagggagaaatatccaggacccggatcatagaaggctttgtaggcaatgtaaggagtttggatttgattctaagtggtatattcctatggttagaaagcagagggtaggttgaggtgttgggatatgttcttcatgtgtgggtgccagatagttttcattcattggatctctttccctcttcccaaatgtaaggcctcgggaatggttctctaatgtgttgaggacatatctaagaaaaaggcagacatcttggatcagcttatgtcacagatgtctgtgagatggctttggaaaacaaagcttttattccagaaatctccacctgtaattgagggcctgtgggaagatgctagacttaggtctggccattcattcaacaagaagaacttggagatttagatgtctgccataactgatttattgtgatgcttttttaagtttcttaattgtgtattggtagagatttccaaagatagttacgtggagaaagaaaagtatcaccccctcatttaaaggtgataaaaatgaattcttatcttctccctcccttttttttttggagacaccatctcactgtgttgcctgggctgacctgggctcagtctatcctcctacctcagcctcccgagtagctaggactacaggcgtgcaccaccacactcaactaatttttattttttttttgtagagatggcaccatgttgcccaggttggtctcaaactcctggactcaaccaatctgcttaccttggccccccaaagagctgggattacaggcatgagccaccctacttggccaaaatgaatgttttgtttctagtttgagtcatttttagatcagtaacactttttgcatttatatattgctaatatttcagagtgtcaaagtacctttacttgtggttgcataagataattagagcttgatcttgttgataattatgaatacctgtaaaatgttctctaaaagtccctgatttctcttattttctcaaattaaggataagcttagaattcggttttatagactatatctgcaaggcgatataaaaaggatttgttgacaaatagttccttaaagaatattcccaaagaataaactttggaaggccaaggtgggcggatcacttgagctcaggagttccagaccagcctgggcaacactggaaccatgtctacagaaacaacacaaaaattagccaggtgtggtggtgtgtgcctgtagtcccagctacttgggaggttgaagtaggaggatggcttgagcccaggaggcagaggtttcagtgggccagaattacaccactgcatttctccagcctaggtaacagacccagaccctgtctcaaaaaagagtattaagattctgggatctatgtagtattttaactttgagggattataacatgcatatttatataacccctcacttttttttaaacttaaaaatagtcctaccctagcatctcaacttaatcattttaggtttcattctattatgtggttttatttatttatttttattttattttattttattttattttattttttggagacagggtttcactcagtcacccatactggactgcagtggcaagacctcagcttattgcagcctagacctcccgggctcaagcaatcctcctgcctcaacttccctagtagctaggaccacaggagggtatcaccaagcccagctaatttttttttttttttttttttttttttgagatgggagtttcacttttgttgcccaggctagagctagagtgcaatggtgcagtcttggctcattgaaacctctgcctcccgggttcaagcaattctcctgtctcagcctcctgagtagctgggattacaggcgcatgccaccacgcccggctaatttttttttttttgtatttttagtagagacggggtttcatcacattggtcaggctggtctcgaactcctgacctcagatgatccgcctgcttcggcctcccaaagtgctgggattacagacgtaagccaccgcgcccggcctgagcccagctaatttttaaaattttttgtagagacaggatctcactattgttgccaagtctggtcttgaacggtccttggggtcaagtgatcgtcccatctccacctcccaaagtgctgggattacagaagtgagccaccttgctcagcctgttgtggttttagaatctagaaggttgtgtccacctctttctgtttgacacagtcaaccaaccaaaataaagatgaagaataatatttttgatggaaacatcaaaggtatctagctttttaaaatagtacaacaaatatataacgggtgctcatcactattgtaaggctctagggagagagcagtgaacaaagcacaaagtccctactatcagtggagtttacaatctagtgaagagagaagcacagtaaatgacaaaagaaattaatatgcctgataaaatgtacttggaaaatagtagagtaagggcatggagagtaactgaggtgaatgctcttttagataggatggtgcagcaaggcatctctgaaaaaaagatgacatttgaaaagagtccttccaggccgggcacggtggctcatgcctgtaatcccagcactttgggaggctgaggcggcagatcacctgaggtcaagagtttgagattagcctggccaacacggtgaaaccgcatctttactgtaagtataaaactcagccgggcgtggtggcacgcacctgtagtcccagctacttgggaggttgaggcaggagaattgcttgaacctgggaggcggggactgcggtgagctgagatcacgccactgcactccagcctgggtgacagagcaaagacccctgtctccaaaaaaaacaagagtcctgaatgagaatgaagtgggcagtgcaaaccttgtagctttccgtgggcagagctctgcaggcagaaggaatggtaagtacagaaccctgaaacaaaagtaaaatcactggcatgtttgaacaggtaatacaggataaattttatcttttttcagagacagagtcttactctgttgcccagattggaatgcaatggcatgatcatagctcactgcagccttaaaattctgagcttaaccagtccttctgcctcagcctccagagcagctgagactacaagtgctcgccaccatgcctggctaatttttatttattgtagagacagggtctcactatgttgcccacgctggtcttgaaatcctagcctcaagtgatccttccgcctcggccttccaaagcgctgggattacaggcatgagccattctgccaggccagaacaaatctaaaaattcactttcttgaagtacttttgaataaacaaatttaattgtggcagttaagttggtcatttgttcatctgacattcatgcaactgagttcccacattatgttggggctgctaatgattgatctgaagggatagtctccagtcttgactggaaactcatgttttgctgggtgactgacatgttgtgacttatcctttagttcatacaacaaatgcttactaaatatgtactgtgtgccaggtaatgctgaaggtcctgagcatacagacgaaagtccctgccctcaggagcttgcagtctagtgtgtgtatgagacgacaaagaagtttatttcaaatgagggtaattgctaacacagtaaaacaaggatgatgtagatggtaatcgtagaaggcctttttgaagagttgacagtgggctgagtgctgaatggtgtccattatcaaattagaggatgagcattattatggtcagggagaactcttgtggccagtttgtagaacagaaggcttttgtgcctggaatgtagcaagagccaggaggaggtaggagatgaggtcagtagataccagattgcttagaccctgctgtggtaagggatttggtggtggtggtggtggtggtggttgttttggagatagggtctcactcccattgcccagtctgtagtgcagtggcctgatcacaactcacagcagtctcaatttgctggatctacaggtgtgtgccaccacacctggctaattttttgtatatttagtagagacagggtcttgctgtgttagcccaggctggtctgaagccggctgaagcaatccacctgccttggcctcccaaaatgctgggctaacaggcggcagccactgcacctggccaggagtttgggtgtttaagacaagtaattatgaggaatctaaggagttttagttgagaaatatacaaatgctagagaaacataatgaagaaagtgaaatgcagatttattaagaagtgtatttttaaaaatcaagaaaataagccctgtgtggtggcatatgcctgtagtcccagctattccagaggctgaggcaggaggattgtttgagctcaggagttagaatccaatctggacaatacagtgagaccccctgtctctcttttttttttttttttttttttttaaagacaaaatagatctgtaaatctgcccctgcaccctccccacccaagtttctaacaatctgccttgcatgaatccccaaaggtagaataaatttgcatatggcaaagaaaggccaatttcctttaactcagatacactgatgttaatgatttaacttgaccacagcaaactaacttttttttttttttttttttttttttttgagactgcgtttctctcttgttgcccaggctggagtgcaatggcgcaatctcgcctcattgcaacctttgcctcccaggttcaagcaattctcctgcctcagcctcccaagtagctgggattacaggcatgtgctaccaggcatggctaatttttagtagagacggggtttcaccatgttggccaggctggtctcaaactcttgacctcaggtgatctgcccctctcagcctcccagagtgctgggattataggtgtgagccaccacacctggcccaaactttcatgatttcataactgatccaccatttcaatacagaaaaaaggaataggaaaataaatggattaaatcattgctttccaaagtgtgttctattgaaaaggagttctatagccaaataatgggagagactgggcaatcctcccaccttagcctcccaagtagctaggactacagggccacaccaccacgcccggctaattttttgtatttttagtagagatggggttttgccatgttgcccaggcaggtcttgaactcctgggctcaagcgatcgtctgcctcagcctcccaccagtggagactctggattaattgatgtgaaccagtaactttgtgagtttaaagtgctttgtattgtgaatctccaaagtggggcaggatataatgtgtagcattttccaaacttgtgatataaaaaaccataaagggtatagcctctcaatagattgtatgtgtggtttaatgggacttgattttcacacctatagagtggaacacctggattagagggagtgattaggtaggtggtgggatctactcagtcagaacattagcttcctgtgataaacacattttctaattaaggggaaggactgcagcatgtagaatacagataattctctttagaaggttggggtttctggctgttggggagtgccctgcataagcacagcattagataatattttcttattttctggctccccaccgctcagttgtcctctggctgccctcttttcacatcagcctttctattgtgttgtgagtgctttcactcttggtcagccgtctgtcatttccacctaagaggcagccttgggtaatagaaagagggtagacctacggagttggactgatttaaatctgatctttatttattaaccatatatagttaatatatgtcaacctgagtgcccttctttgtgtgtaaaatcattgtgtggaataaatgatatgaagcctatgaaaacatctagcatcgtgtgcctggttcatacatgtgacacttcccccattctgcaaaccattaccagcccaaaggtcctctactccactttcattacatttttacccacttaagaaaaccttcatgacttccccatacattaaatcatggcactcttcagccaagtatggaggaacctatatgatctggtcttgatctcctagcccactattctctcttcccatctctgttactttgctctcacaattcattttggcagatgcgccctcatcctactttgcctattcagatacacatatttttcaaggttcagctcaaggctcaggctctgggaaactcttggatggccacataaccccgtgactcccttcttaattttctaacgtttaaggtgctgtctttgtgattcatttggcacttcagaggacagatgtttcagaatttgggattttttttggatgcatgtactgtggattatacaacatccccagtggggcttggggtagcaccctgtaatcaaacgtattgatatttctttagtgaaacaaatttgcatactaagtgagataaatctatgttgatagcctcaggcagttcaggctggttttgctgccaagtgagtttgccacaaacttgttaaaaaacaaacttttaagtttttttatttttggatttcatcactttagtaaagggtatataggcctgtacttggcatttcagttgtgtcttgtcttctgaactattacagaagctccttctaggacaggaacttgattgcatattgtcataggcattttaaaaataaatgggtcccggtatggtgggtcatgcctgtaatcccagtgttttgggatgccgaggcaggaaaattgcttgaggtcaggagttcaagaccagcctgcgcaatatggtgaaaccccatctctacaaaaaatacaaaaattagccaggcatggttgattgcgcctgtagtcccagctactcaagaggctgaggtgggaggttggggcttgagccctggaggttgaggctgtggtgagctatgatcatgcccctgcagtccaacctgggccacagagcaagactctgtctgaaaaaataataaaattttttaaattccttactgtaaatgtataatagatatgtgattgtaagattagaaaagtatgaagagaataaaactctccttatatctatcaccgagatgttatcactgttctacattttggagtgtgttttttgttttcttctatatgtgaagttttttttcataatttgaattatgatatccttgaactttttccactgaccttttttacattttacaaaaattgtgtgtttagtttttttcttctttttcatagaagcctctggttaatttggtgcatgatttccctgaaagggctccactttcccatctacatgtggctatatatctaaaagctgcctaatggaatctaagcataagtggagttttctaaaatcgctttttttttttttggagacaaagtctcgctctttctgaggctggagtgcagtggcacaatcttggttcactgcagcttctgcctccaggttcaagcgattctcctgcctcagccacccaagtaactgggattacaggtgcatgccaccatgcccggctgattttgtatttttagtagagacgggattcaccatgctggccaggctggtctcaaactcctgacctcaggtgatccacccccctcagcctcccaaagtgctgggattacaggcgtgagcaaccgcgcccagcctaaaatagctttattgaagtacaatttacatactataagatttatccattttaagtgaactctttgggaaatgttagtaaatttatgtagattatgcatgtgtcaccacagtccaattttagaacactctgtcacccccaaaaagttccctcagtttgcacctaattttatcgtctcaccaacaagttggagaccataaagctcaattgataagattcccaggatttgtgatctgttggtaatcatgcacatctgacacttgtactctgtgtatgtgctgtttctgtgtgttttttcattttccttttaattgagtgggttcagactcctttttttcccatttttaatggacaaaattgtatatatttgtggtatgcatgttttgaaatatgtatacattgtataatggctaaatcaagctaattaacatattacttcacatgctgtgtgtgtgtgtgtgtgtgtgtgtgtgtgtgtgtgtgtggtgaaagcacttaaaatatacccagtaattttcaagtgtacaatacattattatagtcaccttgttgtacaataaatctcttgaactgtgtatttcttagcctatgttgttagtagttaaatcgacgtaggccatttagttagcttaaaatttgtgggctgggcacggtggctcacgcctgtaatcctagcacactgggaggccaaggcaggaggatcacttgagtccaggagtttgagaccagcttgggcaacattgtgagaccctgtctctacaaaattttttttttaatttgtcatctgttagatgtgaagttttttggtcagttataagcatattatgtgatttagttttgtttaagctttaaatatgaaaacttctagaatcataatcttagctgtcatcttctgaactctagaatttatctccctagatgcaaattcttagcactttgtagtatttgcgattacatgttgtacatgaaggaatttcttgtttctttaatctcagaactttatgtgggatatttatttgctgtttaaaattttaatttctcgttgtggggcctttttttttttttttttttaagacaggtcttgctccatcacccaagttggagtgcagtggcaccatctcagctcactgcaacctctgcccccaggctcaagacatcttcccacctcagccttccgagtagctgggactgaaggcacccactaccatgcctggctaattttttgggttggttggttggtttgttttgagacggagttttgctcttatcgcccaggctgcagtgctatggtgcgatctcagctcactgaaacctttgcctcccgggttcaagcgattctcctgcctcagcctcccaagtagctgagattacaggctcctgccaccatgtccagctaatttttgtatttttagtagagacgggattttaccatgttgaccaggctggtctcaaattcttgacctcaggtgatccgcctgcctcagcctcccaaagtgctgggattacaggcatgagccaccatgcccggcttcaatttttttgtagttttggtagagatggggtctcaccctgttgacaggctggtctcttaactcctgagctcaagcagtccacccacctcagcctcccaaagtgtcgggatttacaggcctgagccactgcccgggctccttatggggcttctttaataagttcctccagtgattttttttttcttaacctttattagccctttcccatagcattaaatcatataaacttcttggtgacttcgagcagtccttcagcttttttttctatgactatctttttgaaattttgggattttttttcatctcccttatcacaaaattgtctcactattgtttttgggggaaaaggcacatctcatttgctggactcttgtctcagagtcaggtttactgcccatataaaaaacaacagatggatgactttcagagagaataacccataatataaacggatttctttaaatgtaaatcactttttccgtaagtgaccagttatccaaaccttattttatattttagatcctatagcaatggaactcagcgatgcaaatctgcaaacactaacagaatatttaaagaaaacacttgatcctgatcctgccatccgacgtccaggtaaagaaaataaacgttttttggttgattaattccttcaggacaggtgagagaaacctatgtattatctgcctccttataaatatattttaaaaaattcatacttgggttctcaagcgtagtttataagtgttacagctgctataccatggtgtgttgtttcttttttgagtaaaatagcttttatttggcatcttctgggattaaaaagtactagttttcggataaaaagtactgacatgtttagaatgctttgtctttgaccttttccaaaatacccacttaaaacatgcctgctttaggccggatgcggtggctcacacctgtaatcccagcactttgggaggctgaggcaggcggatcacgaggtcaggagatggagaccatcctggctaacacggtgaaaccccgtctctactaaaagtacaaaaaattagccgggcgtggtggcgggtgcctgtggtcccagctactcaggaggctgagtcaggagaatggcgtgaaccccggaggcagagcttgcagtgagccgagattgcgccactgcactccagcctgggcgacagagcaagactccgtctcaaaaaaaaaaaaaagcctgctttagagataaaataattagggcatagaaaggagagtaattgcctaaaaagtgattaagtgaatgaagccaagtaatcagttactgtctcttaattttaattttctattgggtttgatttaactaatatattttaagacctagagctttttttttccttcctgaatctgaccagattccattaaaaacgtagaattaaaatattgaactcaggtgttcacaggactcagctgttaagttaaatgagggagataggccaagtggagactggtaatatcaggagaatacatgccctgattaagtggcaagtactttttggaactagctaattttggggattcagactagttttgcaagatcagatttccagttttgcttgaaaaataaggatatttatatgaagtgccctcatttttaaatgttagcaagtaacttcaaaagattttggggccgggtgcggtggctcacgcttgtaatcccagcactttgggaggccgaggtgggcagatcacgagggcaggagatcgagaccatcgtggctaatatggtgaaaccccttctctactaaaaaatacaaaaacttagctgggtgtgatggcacacacctgtagtcccagctgctcaagaggctgaggcaggagaattgcttgaacctgggaggtggaggttgcagtgagttgagattgcgccactgcactccagcctgggtgacagagcgagacgtagtcccaaaaaaaaaaatattttgaaacacagccagggttggtggtcacgcctttaatcccagtaatttgggaggccaaggcaggaagatcccttgagtccaggagttcgagaccagcctgggcaacaaagcaagaccctgtctctacaaaaaatttaaaaattagccaagtgtggtgatgtgtgcctgtattcctagcaactggggaggctgagacaaaagcttcacttatacccaagaggtcggagctgcagtgagttatgatcatgtcagtgcactctagcctgggtgacagagggaaatcttgtcttaaaaaaaaaaaaaaaaaggccaggtgcatttgctcacgcctgtaatcccagcattttgggaagccaaggcaggcggatcatgaggtcaagagatctagaccatcctggccaatgtggtgaaaccctgtctctactaaaaatacaaaaattagctgggcgtggtggtgcacggctgtagtcccagatacttgggaggctgaggcaggagaattgcttgaatccaggaagcggaggttgcagttaaccgaggccactgcactccagcctggtgacagagcaagactccgtctcaaaagaaaaaaaaaaattggacaggcacatttgctcacgcctgtaatcccagcactttgggaagcccaggagggcagatcacctgaggtcaggagtttgagaccagcctggccaacatggtgaaaccctgtctttactaaaaatacaaacattagccaggcatggtagcatgtgcctgtaaccccagctacttgggaggctgaggtgcaagaatcgcttgaacccaggaggtgaaggttccagtgagccaagattgcccaactgcactccagcctaggtgacagagtgagactttgtctcaaaaaaaaaaaaaattgaaatacagtgcaagccaaactacttctgggccagatatatcttgtgagcagtcagttattgatccttgatatgggccatattaaaatgctcttgacctgtttcttcaaaacttaccaatgtgcatgctcatagaggatgttggaagggttccatgaggaagagaatgtgtgttatatattatgtatgatgactagaatcatgaacatgttaatgcatctatcctcttctagaaaagtctttgtgatttttgagaggaaaaattagtttattagtgtataaagaagtaatgtgttcctggataaagggaagttaatggctctaatctttaatcttcttagactttcaaagaaagctgttgccaacactattaaaaattttttttttttttttttttttggagacggagtctccctctgtcgcccaggctagagtgcagtggcgccatcttggctcactgcaagctccgcctcccgggtccacgccattctcctgcctcagcctcctgagtagctgggactacaggcgcccgccaccatgcctacctaattatttgtatttttagtagagacagggtttcaccgtgttagccaggatggtctccatctcctgacctcgtgatccacccgcctcagcctcccaaagtgctgggattacaggcatgagccaccgtgcccggtggaaaaattattattattatttatttatttatttatttatttatttatttttgagacagagtctcactcttgcccaggctggagtgcagtggcgccatcttggctcactgcaagctccacctcccgggttcaccccattgttgtgcctcagcctcccgagtagctgggactacaggcgcccgccaccacacccggctaattttttgtatttttagtagagacgggtgtttcaccaggttagtcaggatggtctcgatttcctgaccttgtgatccactcgtctcggcctcccatagtgctgggattacaggtgtgagccaccgcacccggcaattattttttttttaataatgtgtgaggcaagagttctgttgctttatgtattcaggacagagtataaaaataatctggtatttctgggaagttaggaacatagcatttctcagggatcgagactgactgactagactgactcaactagaccttttgagactccttgagtgcgcagaaacatatgcatgtgaatattgtgataagttgaaagaaatgaacacagaaaggaacagactcaaactcacttcctggatattgattacaatttaggaaagagacttggcaatttatatgggcttttcctcaaatcatggatgtagtgtgttgccctgtacaaaatgctggctactaagtggaggaaacaaattgttctgtactcatataaaaccatagtatgtcccctcctgaaaaacatttttcagtttaacagtcttcatccttcaagaaagacatgataagcacaaagcaaggagagtttgaaaatatcagtgaaactcttgggactcagtcagaaagagggaaggtgttaaatgatacatgaaattaatttttcaaaaaatattggaatattgggtgttgccctatgaagccaaaggtagaaaaaaattaagagaaatactgtactgccatcacatgtgatcattaacctaggaaatttatcccagaatgtaatctgggttgaaaatctattggtaaattttttggataaattcattgctggtattaagaagtttttaggtttttttttagttcgacaagaaagcttagggctggtaaggtaaaataaggactgcactaaaactttcagtagtgaagcctagctgtgtgatcttgaacaagttacttaaccttagtgccttggttttttaaatgctatctacttttctgggtaatagtgacaactaaatgaaattttataattttacatatataatatatatgtaaatcgttggacccatttggctaataataatatattaggatgaattgactcatttgctcttcatcactagcctataaaagaaatattactactaatagtactaataatactcctttctgaaataagacctgggtatatgaagtcttgaagccacttaatctgcctgggaagcagcttctcttgcagatgagatgatcatccaattaggccactgtataggtttgtgagaatcatgtgagttaattgatggtaaagttatttgaaaactgaagcattatataagtttaatgtaacatatataatccacttaatagataagaaaagtgaggccctgtagacccacaaataacctaatcttttctctttttttgatttttttttatatatatatatttgatatatataaggtggaaagatttttatcttagtcttttaacatgaaaattcttttacagctgagaaatttcttgaatctgttgaaggaaatcagaattatccactgttgcttttgacattactggagaagtcccaggataatgttatcaaagtatgtgcttcagtaacattcaaaaactatattaaaaggaactggagaattgtaagtattttgtgaatacataatttaataccctgtatgtttataaggtttatataagcagtgttcttcaaagataaggcacgtgcttgtagtcccaactactctggaggctgaggcggaaggatcacttgagtccaggagttcaaggctgcagtgagctatgattgcaccactgtactctagccttttagtgacagaatgagaccttgtctcaaaaaaaaggattcagatatggatcaaagataaaattaaacaggacccttttccaaagcttctgttatttcatttgaatttatataaatttgtccagcttcatacctcgggttgctagggagtgagacttggtcttaatctccattatgtttggaatttatgctttactcaccgcctactgaagagacattgtgggaagacagtctgaataaatgaagtgatttctgatgttggaaaaataaagctgagaagaaatcagatacataaaacatttgcagaatgcaaaataatttagatttcaactttttgataaggtattttgccctatgtcttgtgggatatgtatatatatactaattttgagattaaacctattttataacaggtttaatgattagtaaattataaattaagaaacaggcattttttttccttagcttaggacagtgattctcaactgggggcagtttggctcaccaggggacatttggcagtatatttggagacatcatagctggaggattgctactggaatctagtgggtagaggccagagatgctgctaagcatcctacaatgcacaagatagctttccacaacaaagaattatctgagccaaaatgtcagattgagaaagcctggctcatgatagagaaaaagatgaggcttttctatagtgatagcagttatgatgttacaaagtattagcagttgacaaaaatcatcagtttatctaaaaagtcaactttaaactgctcaaaaacatcttagagtcttactttttttctcattccataaaagagagagtaaatattgttttaagcctgtatgatttctcaagtatcaccatgagtggtaaagaaatcttagaggccgggcttggtggcccatgcctgtaatttcagcactttgggaggctgaggtgggtggattgcttgagctcagcaattcaagaccagcttgggcaataaagtgagatcccatctttccaaaaaatacaaaaattagcgaggcatatggtggtgcacggcctgtagtcccagccattagggaggctgagatgaggggatcacttgtgcctgggaggcagaggttgcaatgaactgagatggtgccactgcacttcagcttgggcaacagtgccagacactgtcttttaaatctcagaatgtttaaaagtccatctctactggtagacatgccagccctctccctctattttgatttgtaaaactagtgagacttaacagaatctctttgggtgatataatctaggatgcattctaactagtaatggtcaagaaattttcacagagggctgggtatggtggctcacacctgtaatcccagcactttaggaggctcagatgggaggattgcttgaggccaggagttggagaccagcctggacaacaaagtgagacccctcttctctacaaaaaaatttaaaattagccaggtgtggtcgtgtgtggtgtgcatctgtggtccttgggaggctgcagtgggagggattgtcttgagtctgggaggtgaaggctgcagtgagccaaggttttgtgctaccctccagcctgggtgacagatggaaacccagtctcaaaaaaaaaaaaagaataaaaaaaattggaaagatttttgttctaaagtgagagttaaattgaagcttttgaggatgtgtatggattaagtagcatatatctgtaaagattttaattatgtgtcctgattagtttacatatgaaatgaaaaaaaaatttttttttttttttttttttttttttgagagggagtcttgctctgttgcccaggctggaatgcaatggtgcgatcttggctcattgcagcctctgcctctcaggtccaaatgattgtcctgcctcagcctcctgagtagttagtgttacaggtgcccaccaccatgttcagctaattttgtatttttagtagaaatggtttcaccatgttggccaggctggtctcaaactcctgaccttgagtgagccatcgcacctggcctaaaatggaaattttttttttttttttttttttttttgagacagagtcactcttgttgcccaggctggagtgcagcggcaccatctcggctccctgcaacctccacctcctgggttcaagcaattctcctgcttcagcctcccgagtaactgggattataggtgcctgccaccatgtccggctaatttttgtatgtttagtagagacatggtttcaccatgttggccaggctggtctcaaactcctgacctcaggtgatccacctgccttggcctctcaaagtgctgggattataggcgtgagccactgcgcccagtctaaaatggaaattcttaattggcatcaaggagtaagggaagttcactaatttgtatgtaaaatatttgcatttgggaggcaatgtacgtttttctgggaaaaggattcacgctgtcatcagattattgaaggaatctgtgacccattcatgtagagggaaactgaagaaagaccaaaccttcctctatttgttttcttagaaaattagtaaataaaaaaacagttatgttttacctaaaatcatgtggacatgaatgtggattttgtgttacttcctcagttactgctttgcttttaggttgaagatgaaccaaacaaaatttgtgaagccgatcgagtggccattaaagccaacatagtgcacttgatgcttagcagcccagagcaaattcagaagcaggtaatgtcgctccactttttagatgggctcctctgtaaagctctgatctaattaatcttttcctctcctagttaagtgatgcaattagcattattggcagagaagattttccacagaaatggcctgacttgctgacagaaatggtgaatcgctttcagagtggagatttccatgttattaatggagtcctccgtacagcacattcattatttaaaaggtattgatgcatagattcatgtttttaaaatactttctaaagttttatttgcttgtgtaaacagttgtgtttttgtgactgttgtcattcctttgaatctgatcatcttggaatgagagcagaagtttctgtattgcgtttgtttcttctcaactaggatgtttatttcatattgctctattacctgtgaaatacttagtcttgataaactgcttgatccctttaaaaagaaaactggctgggcatgatggctcacacctataatcctagcactttaggagggcaaagtgggcggatcacctgaggtcaggagtttgagaccagcctggccaacatggtaaaaccccgtctctactaaaaatacaaaaaaaactagccaggcatggtggtatgtgcctgtcatcccagctactcaggaggctgagacaggagaatcacttgagcctgggaggtggaggctgcagtgagccgagatcaaaccactgcactccagcctgggcgacagagcgagactccgtctcaaaaaaaaaaaaaaaaaaaaaaaaaaagaattccctttgaatttcggaatttcggaaacccatctattcatagatgtccaatcagcatctctccttgaagacctaaagtgagtaaataaaaaaaacttgtaaatttatctgttttaccttaattttctagataccgtcatgaatttaagtcaaacgagttatggactgaaattaagcttgttctggatgcctttgctttgcctttgactaatctttttaaggtatggaatgcatcttggtgatatttttaaattaatattttaaattgcttgaatgtttgtatacatgttaagagaatgctttgaaagcttatttgatagataatgtttagagcatttcttttgaaaaatttcaaacctacacagaaatagagatgctatagtgaactcccatctattattacacaaatttaatggttagcaacgttttattttctctgttccctttcttaggaatgttataaaagcaaatcccaagcatcatatcatttcacccaagtattttaaagtatgtgtctctaaaggaagaaatacatatttttatttgactatgtttggagtttaattaattatatatttatacattattttacagtttacaggatactttcctgaatgtgttcttggtgtttgtgaaaatcctataagatttaaagaaatatatatatactttttttcttttttcttttttaaagacagggtctcactctcattgcccaggctggagtgcagtggggcatgattatagctcactgcagcctcaactacccaagctcaggtgattctcccacctcagcattccaagtagctgggactacaggtgcacactaccatgcctggctgctttttctctttttttttccctctctctttttttttttttttttttttttttgagatggagtttcgctcttgctcactgcaacctccgcctcccgggttcaagcaattctccgagtacactgggattacagcctgtgccactgggcctggccagtaaaacctgttaatcgcatttagaataataaagaattggaaacaacctaaataccaagtggcagatgaattgtttaataagagcatataaagatagttttgtgtaatatatttttatatatgcacagattgggaagacgtagttcagaatattaacactggactttttagtgccattatgaacagttcaaaaatacatactttaacctattttccacaatctcttaagtgactgtattatttaaaagccaaggctgggcatggtggctcacgcctgtaatcccagcactttgagaggccgaggcgggcggatcacgaggtcaggagatcgagaccaccatggctaacgtggtgaaaccccgtctctactaaaaatacaaaaaacaaaaacaaaattagccgggcgtggtggcaggcacctatagtcccagctacttgggaggctgaggcaggagaatggtgtgaacccaggaggtggagcttgcagcgagccgagattgtgccactgcgctccagcctggacgacagagcaagactccgtctcaaaaaaataaataagtaaaatatgaatagtctcagcttagtgcaaggctgtttcactaagatcagcatgctgggtttatgatgcactaaaaccatgttgctaaattcctttccaaggccactattgaactctgcagtacccatgcaaatgatgcctctgccctgaggattctgttttcttccctgatcctgatctcaaaattgttctatagtttaaactttcaggtaagttcatttgatttcttgcttttggttcttactctttgattttaaatagagttttctttctgtttgataaagacttctttgccagcattgatttttctgaaagaaaaggttttttctgactctatttatctatagtgttctgttctacagtagttctttcagatgctaatgagatgtttcatggaaaaaagcagtattctcttatatctagtaggttagcaaaaccccacatcctaactcactcttggagagtcaccctgtacactgttttactggtggcattaagaagctagatttctgaggccttcctctttcgttcatttatatgggtattaacatttggggaatcatgttttggttaggggttgctgtccagcttatacaaaatgacttttattggaagccatatgagggagacaaaagacttgaagtaccagactttgaaaggggtaggaactagtagtatttcagaggaaacatagccacagggctatagcagggaatgcctagttaccctgttgctactgagatagtggcctccaatcattctttctgttcttaatcattaattcaagattcaggaccaagaaaggggtgttaattggtacaaactgttgctatactgcgatgcaaggagggcctagcccattcattgtttgtagccagtacctggacttatcttcacaacatgaataaactcatagtggtagggaaagcattccccaaaaggaaattgggttgttttagctagaataggagatgaacagcccaaaaggacatgtcccacatcagtgttcagctggatagcagtttgagaagttcttacttaaatgagtactactatttttgcttacaccttttgaattctgagaagtcaggtttaatgaagctcttgagaacttgtctggcagggagaccaaggaaagaggcataatctaccctcaggggacttgtaccctcattaagaaggcagtactatgccacaagaaatcagtaactaaaagacaattagtttatctgccttggtggtcatcttacaataaacgtagttcagaaaagaaaggggatgtattagtatgcactgagcttgagctttgtaaggaaagtcttcatatagtcttagctgaaccttgaaggaagatttagattaggatgagaactagaggtggcatcatttatagcatacaaacagaggcagaagtcagaatgctttatgcagctgccagatgtagctggagcagagaattcttgtcagaataggtaatgctcaggctgtgaagcctgtgtataaaatgttttgtccacgtggtaagggaacttataaaagtggtgttcttaatattttaatcaaaagtttcaagtcagtgtttattctgtaggatctccctgaattttttgaagataatatggaaacttggatgaataattttcatactctcttaacattggataataagcttttacaaactgatgtaagtatttaaaatgttgcctgagtggtctttttctttcattaagagttatttggctacagtctggaaacctatttactcttgcattgttaaaagataaaatttcaatactgtaataatatttgattctatttgatgttacatgtttggtgtgtgtagtatacagaattactcttatcatgggcttggcttaagccatagtgtacatataaggctgtttcattacattattgaaagtaggtctttaaagtagtgacattatggatatttcatgaaataaaattatttttcattgaagatactaagaaaacttaaaactctataatggtagcccctttttaaaaatcatctggctaggcatggtggttcacacctgtaatcccagcactttgggcggccaaggtggggaggatcccttgagcccaggagttcaagaccagccttggcaatgtaaggagacccccatcactacaaaaaataaaaataaaattagccagatgtgttggctcatgctaatggtcacagctactcagaaggcttagttgtgaggatcccttgaccttgagcccaggagggcaaggctgcaatgagctgtgaccatgccactgcactccagcctgggagacagagggagacctcgtctcagaaaaagaaaaaattatccacagctcgagaaagagagaaaatggtaaaagattgtaatttgtaaatatttctgatatgggttttatattgtgtacttttaaacatataacacttattctgtgctactcatttgttaatatatttatgaccttctttccgaagagacaaaagacaaaatattaaaaatatttcaataccaaataaactaaaaattagaattggtgattcaaatcaggttttaagagtggggtacagaaagaaattgttactatcgttgtacaacagattttgtctcagagtttgactatattaataggaactttaaaagatgtagctctcataaaataattatttcagtccaatgggagggaaaaacactccttcagaaaacaaaacttttcttcacacaaaagtcacaaggaaattttttggatagaattcttacaaggacctttttgcccagttaaccatgtgctaccttgtgctactatttatgccttaagtaatcagtgtgagggagttttggttttggctttggtttttgttcttactctgatgtcttcccttgtctcactctgtcaccaaggctggagtgcagtggcatgatcatgacttactgcagcttcgacctccctgggctcaagtgatcctcccacctcagcctcccaagtagcagggactatgggtatgcaccaccatgcccagctgattttttttattttgggggcttgctgtgttgcccaggctagactcaaaactcctgggcttggcccgtcgcagtggcccacgcctataatcccagcactttgggaggccgaggccatcctggctaacacggtgaaaccccgtctctactaaaaaaaaaaaatacaaaaattagccgggcgtgatggcgggtgcctgtagtcccagctacttgggaggctgaggcaggagaatgacgtgaacccaggaggcggagcttgcagtgagctgagatcgcgccactgcactccagcctgggcaacagagggagactgcgtctcaaaaaaaaaaaaaaaaaaccactcctggcctcaggccatcctccagcctcagcctcccagagggttgggattaccggcgtgagccactacactcagccagaatatactgtttgaatctaatacggaaatattttgtaattcagcaacttatttgaaagacttggtgaaaagattggtggtggcatagctgtagtttacaataactgatttgatttggatttaattgataaagagtctagttcaggaatttcagttactcctcttacttatgttagcattagagttgtatgttggagtttttgttttcttttatgtgaggatgaagaggaagccggcttattggagctcttaaaatcccagatttgtgataatgccgcactctatgcacaaaagtacgatgaagaattccagcgatacctgcctcgttttgttacagccatctggaatttactagttacaacgggtcaagaggttaaatatgatttggtaagatgatggtggagacaaataattaaaagacattctctccctatctcctccaagaaataagctgttgagttttgcttttaaaaatattcttgtttttgtgttttgttccagttggtaagtaatgcaattcaatttctggcttcagtttgtgagagacctcattataagaatctatttgaggaccagaacacgctgacaagtatctgtgaaaaggttattgtgcctaacatggaatttagaggtaattatggcaaaagtatattagtataaatctactaagtctgtgtttgttttttgtaacatattcagtctaattcatttattactggataaaacttgtatgtcatttatttcttattttctaaaccaagacagaaaatgtagtatctgtaatgagttttgttgtgccctgtgagggttttctcatggaaatattaaataagacttcaaaaattcctttacactaagaagataaactatctggaatttctatttagagaaagaatttgattttgtttcatttattatttcaatgaatttttagctggctttatttatttatatatttatttgagacaggggtctcgctctgtcacccaggctggagtgcagtgatgcaatcttggctcactgcaaccttagcctcccaggctcaagtgatcctcctacctcagtcttctgagtagctgggaccacaggcacacatcaccatgcctggctaatttcttgtatttttggtagagacagggtttcaccatgttgttcagggtagtctcaaactcttgagctcaagcagtccacccgctttagcctcccaaagtgctgggattgcatttctgagccacctcgcccagaaatagctgtttttaaacaatcgacttgagaatagaaatgataactttataaatacaaggttgaagcccacttagtttgtgcttaaggttaaactatagtgctaagagcctatatttataaaatgtatgtccttgttctaacagttgtgaagaacaagtaatgaaggtgggagggattgtgttttttgttttggggacagggtctcactgtgtcacccaggctggagtgcagtagcacagttatggcttactgcaacctcaacttcccaggctcaagtcattgtcccatcccggcctcctgagtagctgggactacagacgtgcaccaccatgctcagctaattttttattttttataaagatgggggtcttcctatgttgcacaggctggtctcaaactcctagcttcaaacaatccttctgcctcagcctctcaaagtgctgggattacaggcatgagccaccatgccaggccaagattttgttttatatcaaaatagttattagatcagtggttttcaaattacatctggaacaaaataaggaaattaaggacaatatagcgtgagattttatttcctgttgtgttttcataaaaatatgtttaaaggataaatcttctggctgggtgtggtggcccatacctttaatcccaacactttgggaggctgaggtgggaggaacacttgagcccaggagttaaagaccagcctggccaaaatggcaaaaccttatctctacaataaataaattagttgggtatggtggcatgggcctgtggtcccaggtactcaagcagcttaggtgggagttttgcttgagctcaggaggtggaggctgcagtgagacatgatcatacaactgcagtgtgtgtgtgtgtgtgtgtgtgtgtgtgtgtgtgtgtgtgtgtgtagactttttttttttttttaatttatatgataaaaatagagatgagatctcgctgtgttgaccaggctggtctcaaactcctgggctcaagcgatcctcccatttcagcctcccaaagtgctaggttacacgcgtgagccaccatgccggccatttctgacattgtccactctacttatttgttgttgaaatgactttaatgaaataatagtgattaaaattaggttgttggtattttaatgttcttatttggtgaaattaaaagttagcattctgatactgatccctaacatttttgacagttgcaggtataatccaattctggggaaactgtcacattagaacaagtgagcctatctcatagttgtgtgaattacctaatacctcacctttcagggtagcatttgctgctctagataatgattaagagtatatgaagtagtcatctgatgggaacgaattctttgctgtagaacaaggcagttttacatactcttctgcattctcagctgtaaagtacagtgacgtcttttggagtgttatctgaaatatcatctctccttgtagctgctgatgaagaagcatttgaagataattctgaggagtacataaggagagatttggaaggatctggtgtgtatcttggttttttagttactagtctcttagcaagccagttttaaggtggttctctttctagtaaatgggagaagtgggattgagaataagagtgttttttcagcgggctttcattgagaactgttgtctttcttcaacttgtcttaaaaagctcttatatgacctgaatgaaaatatcaaaagttgaatcatttgtctgttcttacatagtatttatcaaaattctgtgattctgtgacctctttagtttcattttgattttgtatttcttgggggcgggaatgtttttttcattgtttgtgttgctgatagctattgggtggccctttgtttttcgttcttttttttccgttttacaatcgtagccaaattattccaggcaatttgttttcttataaattggatcagcttgttggtggttgttttttttccccataatatattttcttttcatttcatagatattgatactagacgcagggctgcttgtgatctggtacgaggattatgcaagttttttgagggacctgtgacaggaatcttctctggttatgttaattccatgctgcaggaatacgcaaaaaatccatctgtcaactggaaacacaaagatgcagccatctacctagtgacatctttggcatcaaaagcccaaacacagaaggtaaatatttttaatgtggttttgtttctaaaacagacatcagtgacacccacacaagtcaaaaagaaataacgtctctgataatagagcttactctgccagataacctattctgattaagatttatataatctctgaagatggctttatgttgatgtattgagcacttaagtttcttatagaccagaaaattgatagatggccacacttgttaccttagctgagacccgctgtatcaaatatgcttaacttaaacttagctgttctttaattgaggaaagtttctttattgtctattagtatagtcttattttacatttttatatttttgagatggagtctcactttgtcaccaggctggagtgcaatggcgtgatctcagctcactgcaacctccacctcccgagttcgagcgactctcctgcctcagcgtcccaagtaactgggattacaagtgtgcactaccacacctggctaatttttgtatttttagtagagacaaggtttcaccatattggtcaggatggtctcaaattcctgacctcgtgtgatcctcacacctcagcctcccagagtgctgggatacaggtgtgagtcaccgtgcctagacagtatagtcttattttatattttatacataagcaggttgtgttttgttgttgttgttttgttttgttttgttttgagacggagtttcgctcttgttgcccaggctggagtgcaatggcacgatcttggctcaccgcaacctccgtttgccgggttcaagcgattctcctgcctcagcctcccgagtagctgggattacaggcatgcgccaccaccctggctaattttgtatttgtagtagagatggggtttctccatgttggtcaggctgttcttgaactcctgacctcaggtgatccacctgccttggcctcccaaagtgctgggattacaagcatgagccaccatgcctagcctaagcagttcatgttttgaagtgttcctctctctctttttttttttttttttttttttttttgagacgttgtcttgctctgtcatccaggctggaatgcaatggcaacatctcagattactgcaacctctgcctcccaggttcaagcaattctcatgcctcagcctcccgagtagctagaattacaggtgcatgcaactacacctggctaattttttgtgtttttagtagagacggggttttgccatgttggccaggctagtcttgaactcctgacttcaagtgatctacccgcctcggcctcccaaagtgctgggattacagccgtgagctcctgtacacagccagtacagtctcattttatacataagcaatttgtattttgaagtgttcatctccattttaacatggttttctaaaattgcctgaatttctaatgtgatagatatatacaggtattttgttattttactatgttatgaatttgcttttcagcatggaattacacaagcaaatgaacttgtaaacctaactgagttctttgtgaatcacatcctccctgatttaaaatcagctaatggtgagttgtgaaattcttgctttttttacagcttgccacactatacctgaattcaaaaaacagcttcctatccttgttcccttttgttcttttttttttttttttttttcttttgagatggtgtcttactctgttacccaggctggagtgcagtggcacagtctctgctcactgcaactcctgcctcctgggttcaagcgattctcctgcctcagcttcccaagcagctgggactacaggcacgtaccaccatgcccggctaatttttgtatttttagtagagacggggtttccccatgttggccaggctggtctcaaactcctgacctcaggtgatccacctgcgtcggcctgccaaagtgctgggattgcaggcgtgagcctccatgccctgcctattatttcttttattgaataaaatctcaaatggtttccccagatcttgtccatgtgaaattaattattgataaagaaaatattgcttgattaggaggaaaataggaataaatacaactaaactgtaactcagctttgctacctagtgtataaataaggattatacattggcttccttttcttttttatttgaaagacgaattcttaaaaattggagtacatttcaaagtactagaaaattgataaatattaaggatatcttttggccgggtgcggtggctcacacctgtaatcccagcactttgggagactgaggcgggaggatcgtgaggtcaagagattgagaccagcctggtcaaaatggtgaaaccccgtctctactaagaatacaaaaactagccgggcgtggtggcgtgtgcctgtaatcccagctatttgggaggctgaggcaggagaatcgcttgaatccaggaggcaggggttgcagtgagccgagatcgtgccactgcactctagcctgggatacagagcgagactctgtctcaaaaaaaaaaattaaggatagtttctgatgtttatgaatgtattgatctagatccagatatattcctttttaaaaaaaatattttaatgtaggaaatttatgtacacccaaaggtgaagagaatattgtaatgagctcccatgtgaccatcatttagcttcaagaattattaacatttggtgatctattcctttcattaatttatttccctacccactagaataatgtaaagcaaattccagctagagagacatgtttctaattcagaatagcttcacttctgggaatgtaggtagacatgctcaccgatgcatggtccagctcatttttactcaattatgtaatatgtgttccttagtcatgaaacaggcatggggaaaaataaaatcatttataatcctaccaaaattaatgactaaatagtaaatcataatataattaactgtgctttaattacttgacattttatctttttttataactctgatgatgtcactaatttggaagtaatgatccttaccacttaagtaactgtggctttctgtttttttatatagtgaatgaatttcctgtccttaaagctgacggtatcaaatatattatgatttttagaaatcaagtaagtagctttttatttgttacacgccacttaatctctttaagagttttattatgtaccaccttctcatctactgtgcagtcattttatatccacatctaacaaaattaacaatgatttctttataacttagaattttagaccatgcttaattttcctcagatgtctttttgcaataatagtaatagaattgggatctagataatgtccacacattgcttacagttgattgtgtcttaagtctcttaatttacaatagagaggtccttctctgccactttttgtttgagatggagtctcattctgtcacccaggctggagtgcagtggcaccatcttggctcactgcaacctctacctcctgggttcacgtgattctcctgtctcagcctcccaaatagctaggattacaggcacctgccaccacacctagctaattttttgtattttcagtagatccggggtttccccatgttgaccaggctggtctcaaactcctgacctcaggtgatctgttcacctcggcctcccaaagtgctgggactacaggtgtgagccactgcacccaactgccttcctttccttttatttatttatttaaaaaaaatttttttttatttttttgagacggatctcactctgtcacccaggctggaatgcagtggcctgatctcagatcactgtaacctctgccttccgggttcaagtgattctcctgcctcggcctccctagtagctgggattacaggcatctgccaccacgcctggctgattttttgtatttttagtagtgatggggtttccccatgttggccaagctggtctcaaactcctgacctcaggtgatccaccagccttggcctcccaaagtgctgggattacagctgtgagccactgcacctggcctctaccctttcttatgcttgttgttggagaaaacactcatttatcttagagactttctcacattttacttttggctgattgcaccttgaatctctcagtattcaaggggtattggttccaggacgcctgaatatcccaaaattgatgaatacttaggtcccacatttgggcctgcggaatcctcatatatgaaaagccagccttccacatacagattttacatcccaggaatactgtgttttctatttgcatttggtctaaaacaaatccagccaggcatggtggcttgtgcctgtaatcccaacactttgagaggctgaggcaggcagatcatttgaggtcaggagttcaagaccaccttggccaacatgacgaaaccccatctctactaaaaatactagctgggtgtggtggcacatgcctataatcccatctactcgggaggctgagacatgagaatcacttgaacccaggaggcgaaggttgcagtgagccaagatcatgccattgcactccagcctggacaacagagcaagactcaaacccgtgttgttcaagggtctcctgaagtttatgttgtccctctagtccccatatttctatattggtaaatctgggggcttgattagacttagattccttggtcgggggtgacacaagaaagcatcataggtatactttctgtttcattttatcaggatatacacaatatctggttgttttttttttttttattttttttgtttttttttttttgctcactgcaagctcagcctcctgggttcacgccattctcctgcctcagcgtcccaagtagctgggactacaggcgtcaggcaccatgcctggccctggttatcaatttttaatgatgttaagacagatcagtggattcagatgaaggagaacgttacattgtcaacattttttaaatagcattttaaaaattgagatatactttattcttttttttggagacggagtttcgctctcgttgcccaggcaatggaacgatctcggctcaccgcaacatgcgtctcccgagttcaagcgattttcttgcctcagcctcctgagtagctgggattacaagcatccaccaccacgcctggctaattttgtatttttagtagagacggggtttctccatgttggtcaggctggtctcgaaccccctacctcaggcgatccgcctgcctcggcctcccaaaatgctaggattacaggcatgagccaccgcgcccggccttattcatttatttttgagacaaagtcttacagtctgttggccagtctagagtgaactactacaatcatagctcaatgcagccttaaacttgtaggctcaagtgacccttttgcctaagcctccctgagtagccaagactataggtgtgtgccacaccacctggctaattttttatactttttacttagtttattgtttctttctttctccttcttttttttttttgagaggtagttttgctctgttgcccaggctggagtacagtggtgtgatctcggctcactgcagcctccacctcccaggttcaagtgattctcttgcctcagcctcctgagtagctgggattacacgtgcctgccaccatacccagctaatttttgtcttgttagaagagacagggtttcaccatgttggccagactggtctcaaactcctgacctcaggtgatccacccctgcctcggtctccgaaagtgctgggattataggcgtgagctaccacgcccggcccatttctttattttttgaaacagggtctcgttctgtcgcccaggctggagtgcagtgacatgaccacagctcactgcagccttgaactcctgggctcaagcagtcctcccactttcagcctcccgagtagctggaacccaggcacgtgccaccacacccagccatattgcattacttttaaaaaatcaattgagaaaaattatagagaatacctgcttccccagttagagtatgttggaattttgccaatcttaaatggtatctcattgcagttttaatttacgtttgttttattttgagttcagttaagcatctttccacttgaagggtccattttcatttcttttcggtgaactgtgaattcatcttcttttgcccatttttctatctgattattggtcttaatttttagagaacgtgtagtttttcttctgattctgaatgcctaggtcactttaattgtactgagaaaaaaatcaaaacttgcactcatcttatttctttgatgtctttgcccagtaacaatggtgccatcttgcaaaatattttaaacacacaagcaggaataaaacaatatgatgattactgaaataatcctcacaaatcttaaaactccaggccatatttatgtatacatacatatacaatggaggtattccaggtgctccctgcccagtcagtccctttctctctataggtaattactgtagtgaattcggtgtatttgacacccatggaagtgcttttcttacgctttcactacgcatttatgtttctgcaaaaattatttagtattatgtaggttttaattttttttttttagatggagtcttgctctgttgcccaggttcaagccatgctttttttatactttcactatgtgtttatgtttctgcagaaattatttagtatgctgtaggttttaatttttttttagatggagtcttgctctgttacccaggttcaagccattctcctgcctcagcctcccaagtagctgggactgcaggtgcccaccaccacgcccagcaattttttggtagagacagggttttgccatcttggccaggctggtcttgaactcctgacctcaggtgatccacccgccttggcctcccaaagtgctgggattacagtcgtgattcaccacgcctggcctaggttttaaatttttgtttgtataaatgacatcatactatgggtttcatttttctgttttttgttacttgtttgttttgagacggagtcttcgctctgtcgctcagtgcagtaacacaatcaagtcatgcagtggcacgatcttggctcactgcaagcttcacctcctgggttcatgccattctcctgcctcagcctcgcgatagctgggactacaggctaccgccaccatgcccggctaattttttttgtattttttagtagagacggggtttcactgtgttagccaggatggtctcgatctcctgacgttgtgatccgcccgccttggcctcccaaagtgctgggattacaggcatgagccaccgtgcctggccttttctgttttattttgagaatgaggtcttgctctgttgcccaggctggagtgcagtggtgcgatcatagcttacttcagccaggaaattctggactcaagcgatcctcctgccttagcctccctagttgatgggattacgggcatgctccaccgtacccacctacatcatgactgtttgtccttaacatctttttttttttcttttttcttttttttttctgagatggagtcttgctctgttgcccacgctggagtgcagtggtgcagtctcagctcactgcaacctccgcctcctgggttgaagccattcttctgcctcagcctcccgagtagctgggactacaggcgcatgccaccacgtctggctaattttttgtatttttagtagaggtttcaccatgttagccaggatggtcttgatctcatgacctcgtgatctacccacctcggcctcccaaagtgctgggattacaggcgtgagccgccactgcgcccggcctaacatcatttttgagttattcatttagtgcctaaagcgatccagctacctcagcctctcaagttgctgggactacaggaattcactaccatgcccagctaattttttatttaattttttcttaatagagatgaggtctcactatgttgcccaggctggtcttgagctcctgggcttaagcaattgttctaccttggcttcctgaagtattgggattatagacaggaatgaaccaccacacccaggaggcttttctagtttagactaatgaatgtttcaaatttagaggtttttaatgaagattgttctcgtatttgttgctttttgggggtgggaagagaacaaaaaatgagacacaaaaaggttaaataactttttcaagaaatatctgctagtgatgattcttaagtttggtgaaatcttagtctccttctctgtgatattattattttatggtatgttgatttatctgcaagatgttatcctcatagttttgtgctctgaaaaggagaatttagaaagtggaaattgaaccattatgtgcaagtgaaagttttggtttctgggcagcagcatctcctattataacagagcttaaaaatagcaaattgttctttaaatcaacaggtccttctcttccaattgtcttttactcaaatatggaatcattgcatttagagcatgtatattattgtgttttttaggtgccaaaagaacatcttttagtctcgattcctctcttgattaatcatcttcaagctgaaagtattgttgttcatacttacgcagctcatgctcttgaacggctctttactatgcgagggcctaacaatgccactctgtgagtattttattctaaagttttttagcctggggtaggggctgtactgtgctggtcaaagatatctgaatgttttcataatttcactagtgggaaaacaaatgtctgctttctattcctttatactctgtttcattctaaaagcatttgaggctgcttactaaaataggtgcattatgacaatacaatttaataaactggagccaaggaaagtaactgagataaagttaataaacagaaatgtgtgtcaaaggatcctatatagtagtccaagaaactccaaattttatttggagtctcttagcagccagggcaaagagggaaacttgggaagttaaaattttcacagggtctatgagataaaagttaaagcagagaatactgtacaatagtagtagtagtgttctcagcaacaatcatgtaacagttattttcatgtggctatttgcgtaaggtcacttatttctgagatatgacctaaccgaatgaaagtaattcactggggaccaagaaaataggtcttctggcctgaaccaggatgaaatgtagaggaatggatggtctgcatgtctttcaggccactattcaacagtattatttcttgaaatgagctttgggtaagagatggaaaacagttctaggttctttccttcatcaagaacttgaagtacagatactctcagtggccaattaagggtagaaaggacatcctttgaggtgagtcaagccagtacctatcttcaggcccagaatttatgcagaaaacagttctgaatcttggctccacctccaaaaacaaaataaatgacagagtcccctgagattctgagttctttctcagtggtaatagatataaaccagggacaactgtttcaacttcagatgttgttgggtttagctggctttttggttcagttgtgtttggttctcgatgtgccttcttaggagcctaacatgagcacatgtaaaaaaattattttcctaaactgtctatcaattgtcagtggtgggagatggctcagttttatgctgagaagggtgacatagtggttgccaagggtaatctgcagtgacaagctcaagagttggtagtgactgaaagctgttttttcatctatagctttacagctgcagaaatcgcaccgtttgttgagattctgctaacaaaccttttcaaagctctcacacttcctggctcttcagaaaatgaatatattatgaaaggtaggctgtttccctggtgtgcagactacaggtatccaatctcagattgtaagggtgagcactctgagttatacttcaggttatacagtctatgaaccagataatgtttaccaagtagtaagttagtttagatatttcaaaatgaaaaacattatcttgtttactactaacaataatttttttttttttttttttttttttttttttgagatggagccttgctctgttgcccaggctgaagtgcagtggcttgatctcagctcactgccacctctccctcctgggttcaagcgattctcctgcctcagcctcccgagtaactgggattacaggtgcactccaccatgcccggttaatttttgtatttttagtagagacagggttttgccatgttggccaggctggtctcaaactcctgacctcaaatatctgcccgcctcagcctcccaaagtgctgggattagaggccactgcacctggccaacagtaatcttaatttgatatggaacttctcattacagaaaatgtagcaaagcccttttttccttccctagattgagtttctttaaggcaaagaagagatcatgcaacgtttattaactgcatgctcacctaggtaggggtgaaatgtgggtgcctgtggtagactctgcacaaatcgtgtcttcttacgtactgccaaggacacaggcagctgtatccatccacaggctggtgtatccatccaccaggcactacattagttgagtgtcctggtgccagctctgaatttagagatagtctcagtgtttttcactgttgcatcccaaaagcctagcacattgggttgtaggaagcacttttcagagaaactccctgatcttttcagtctggatcagaaatcctagagtggatgtgtgtatctgggtgtatgtttccaacactatccttcccccaacaatgatgtataattgtgtaattattgttgtttaatgtcctttttttttttttttttttttttgagatggagtttcactcttgttgcccaggctggagtgcaatggcacaatctcagctcactgcagcctcactctcctgggttcaagcgattcgcctgcctcagcctcccgagtagctaggattacaggcgtgtgctaccatgcccagctaattttgtatttttagtagagacagggtttctgcatgttggtcaggctggtcttgaactcccgacctcaggtgatccacccgcctcagcctcccaaagtgctgggattacaggtgtgagccactgcgcccagccttaatgtccatttctatgagagcggctaactagtctgtaatcttcattactgtgtttttagggtatgtaagaatacacagtatgtaataccttctctgtacggttgtatgagtgaatgaaataattctgcgccagcctagtggaggagcaccaatttatcctctagcccttttaacccaggtcagggaaggattttctctaggaagtgatctctaagctgagatatgacctaaccgaacgttaggtgtgagggataggtagcaatctgttgaagggtggatgagtctttgactccagtagaggaggaaacatgatgtgcagagttcaggaggcaagagcagatagctttctgtcctttatgcttggcatgtatttggggctctgcttagtaaacatttattttagaaatgttatttgtggaaagagagcttttatacatttttagctgacaaatttatttttctcccatgcttcctatttttaacccatttatggtcttttgagcaatatttttgcaatttggactctgtggctttacatgtatttttagaatttttttaggctcctaatctctttttttgagggaggtggataggcagttttctcttcagtttcctgtagtttgtgatcatgtttcctttaggctagggctaaacattttctgatgctggtttctttttctttttcttttttttttttttttttgagagagagagggagtctcgctctgtctcccaggctggagtgcagtggcatgatcttggctcactgcaacctccacttcccaggttcaagcgattctcaagcctcagcctcccgagtagctgggactacagacgtgcaccacatacctggctaattttgctatttttaatggagatgggttttgccatgttagccaggttggtctcagactctagcctcaagtgatccgccagcctcggcctcccaaagtgctggggttacaggtgtgagccaccaagcatggcctctgctactgatttctaagagaaagagaccccaaacagttctctctcagactcacctgctccattcatgtcagctcactgtttcttcctcttagtcaacctctttaattattttttaaaccttgagccttctagaaatactcagtatttcccagctaaattttgttgccaacccgtcctaattttaaaaggaagggaaatttagattatttttaaatgtagagagctatctcggggttgtctaagcatcttaaaatttagttgatgaattagtgcgcttttttccccccagtcgctctcttattctgaagtttaactaaactctatttgtttttgctgtttttgtattttacagctatcatgagaagtttttctctcctacaagaagccataatcccctacatccctactctcatcactcagcttacacagaagctattagctgttagtaaggtaatagagccaattttgaaagtggggttccttttttatttgctccaaactgtttgggcctcagaactctttggcattacgtgaagctttagagaaggtctgtgaattcttcctgaccagccactaatggacttttctgaaagtgtgggcatgctgttagattggagacgtaatagcagtcacctttaagtgtgtgctagaagcttgaatacattttcattctcattacaaaagtaacatgtttattgtagaaaaagaaagtgcagatgatccaaaattaccttaaatggagttaagtaggctttgcactaaatggatataaaagaggctgtctggacttctatgaaatgatgattaaaatcctttgtgttgtcttttcttccttactcttatttctcaaaaggaaagttcactctgatcaaaattttacagatacttagattcatgtttattaacactaaattttagaaaataaatccgtttaaggctgacagaattcctttttagatgctattcttgatcttatgagaattagatcaattcataggaagtgttggagggattttggagaacagagtgattattattcaaccgagttagggctaagggtctttggactacttagggccttgagggatggagcggggagggaacccaagtctccgcctcccatatgtattaccatctcatgttctgattgagttagatttgtatgctagtagccttccaagaacttgtttaaagaaaaatggggttttgttgcttaaaaagaacataaaaaactactcatttgggggattatcagtaagtagacatagacattgaggcccacagaagttaaggctagtggcattactaggacttagtatttcttctctgcgagggcacgtgggcttaagacaagttacagctctgggatctgaggtttgtataagcaactctgtaactctgaagtatttttttcatggtggactttgggccatttaaaaaaaaattcaaatgaacaagcactagggtataattggtgtttttttcttaattttgatttttaaaaaataagatggcctctattttaaatgtgttttataaaggttaggtgtggattattagcataattaggttttttttttttaatttcagaacccaagcaaacctcactttaatcactacatgtttgaagcaatatgtttatccataagaataacttgcaaagctaaccctgctgctgttgtaaattttgaggaggctttgtttttggtgtttactgaaatcttacaaaatgatgtgcaaggtaagttaacggaaattattttctttgtaatggaataaaattaacatggctataaaatgcagcccacctaagcgatgtgggccttttgtgtcagtcattccttctgaagctcacagctctgtttttacttttatcaacagaatttattccatacgtctttcaagtgatgtctttgcttctggaaacacacaaaaatgacatcccgtcttcctatatggccttatttcctcatctccttcagccagtgctttgggaaagaacaggaaatattcctgctctagtgaggcttcttcaagcattcttagaacgcggttcaaacacaatagcaagtgctgcagctgacaaaattgtgcgtcaggttttgatataactgtaattttataaagtagcttggagaaactggggatggcagatgtttgaaatttttttatttaaaataaatttaaggctgggggcagtggctcaagcccaccactttgggagcctctagtgggaggatcccttgagccgaggagtttaagaccagcctaggcaacgtggtgagatctatctctacaaaggaaaaaaaagctttttaattagttggacacagtggagcatgcctgtggtcccatctacttgggaggctaaggtgagagggtcgcttgagcccaggagtttaaggctgcagtgagccatgatctcaccattgcactccatcctgggcaacagagctagaccctgtctcttaaaaaaaataataataataataacggaaataattagtagaaaatgttatggtatgttttatcagaattctgtatcctttagttatttatatccatgatggaaaattttaaaaacagagccaaacaggttgattttaagaacttaactttggtcgggcgtggtggctcacacctgtaatctcagcactttgggaggccgaggtgggcagatcacctgaggtcaggagttcaagaccagcctggccaacatggcgaaaccccgtctctactaaaaataaaaattaggtgggtgtggtggcacgtgcctgtaatcccagctactcagaaggctgaggcaggagaatcgcttgaacctgggaagcagaggttgcagtgagccaagatcgccccattgcactctagcctgggcaacaagagtgaaactccgtctcaaagaaaaaaaaaattactttaatggctacgcgggaggaattgttccccatatgtttcagaaataattaaagagaaaaggatagattattacagtatgaactctgttttaagacatatatcatgtttaacttttcgaataattattcctgttaaccattttctgttggatctcatttcttaacagcctgggttactaggtgtctttcagaagctgattgcatccaaagcaaatgaccaccaaggtttttatcttctaaacagtataatagagcacatgcctccgtgagtatgactagaactttgtgcatttatttagaaattttgttaggtgctcagaaaagtcctaaatttatattgttgattttttttaattctttagtgaatcagttgaccaatataggaaacaaatcttcattctgctattccagagacttcagaattccaaaacaaccaagtttatcaagagtaagtaaaatcatctggatgttctacagaagtaatgaaagaaggtagctaaaacccttagactttatggttgcagatacattttttatccgttttaaactttatgcaaaaaatacttggccacgtgtggaggttcatgcctgtaatcgcagcactttgggtggccaagggaggccgatcgcttgagctcaggagttcaagaccagcctgggcaacatggcgaaaccctgtccctacgaaaagtacaacaaaattagccaggcatggtggcatgtgcctgtagtcgcagctgcttgggaggctgaagtaggagcatcacctaagtcccagaggttgaggctgcagtgagccaagattacacccactgcactccatcctaggtgatagagtgagaccctgtctcaaaaaaaaaaaagaaaatattgtaagggcctggtgcagtggctctcatctgtaatcccagcactttgggaggtgaaagtgggagtattccttgagtccaggagttaacgaccagcctgggcaacatggtaagaccctgtctctacaaaacagccaagcatggtggtgtgtgcctgtagccccagctactcaggaggctgaggtgggaggatcacttgaccctgggaagttaaggctgcgtgagctgtgatcacgctcctgcacccagcctaggtgatagagtgaaaccttctcacaagaaaaaagaaaatattttaagatgtttgtgttctccaaacattaagttagtgttagtcatattgtgttccagaggttggtttatggttggataccaaaacattttttcagtagagagaatattataaggaaatataaatcaaagagagacagcatgtaaaggtctatgacagaaagacaagttttctatttactagaaggcaggtattgatgccacagcctttggatgttaatgattaagcataggtttattttgcagacttatcagttaccagtttagtgcgtgagttctctatgctgatattctgcatcttctttcaacaggttttttagtctttattaatttgtattgcataaaatatggggcactagcactacaagaaatatttgatggtatacaaccaaagtaagtttgtttttattattttttaaaggaagaaaatgttttgactttttttttagtacaaatcagtatctctgtcttatagatgatgatgtggttcttggtatggagatagtgtctatggttttcaaaatattcttaggtattgggagtaaagaaaaagtaatcctggcccagcatggtggctcacgcccgtaatcccacactctgagaggctgaggagggcggatttagctcaggagtttgagaccagcctgggcaatatagtgagactccatctcaaaaaaagaaaaaacaccctggaatcattgttctaatcctctagattagaggaccatctactctacacactggcattctccacagccagtgttctatattatgttaaatggtcagtgttgtctccaggagcctgccttattaaaactaacagcagaaaacaccacatgttctcactcataggtgggaattgaacaatgagaacacttggacacagggcggggaacatcacactctggggcctgtcgtgggatggggggcaggggaagggagggcagagggagggatagcattagcagaaatacctaatgtaaatgacgagttaatgggtgcagtaaaccaacttggcacatgtatacatatgtaacaaacctgcacgttgtgcacatgtaccctagaacttaaagtataattaaaaaaaaaaaccagaattttccttcccccttttttaaaaaatcgtgctaatccatatcgttccaattttagtatatgtgctgctaatgcaaacacagcagaatttttcaaatgagaaatacttaggaccaataaattaactttgtttttgacttatctggtatatatgcaaagaatgtatttaggtggcatttcccattagtagggaataaaacaattataacgataagataaagaacaactcttagggaaaatttcttcggggacagttagatccctgtacctcagttatgtctcaaaaattctacattgactaaaaaatgaattactctggaaaggagaccagaaaacatggcttccggcagtaggggattttgaggaaatctcatgcactgctagtgggagcctgaattagcctgatctttctagagagcaaaatgtatgcactttttatccagagcattagaattgccataccctttgagccatatttccacttcaaagaattggttctattaacgcataaactgaggattttgcatcatttagaattacggaaaacttcacttctagcatgtttgcaacaacatagaatgattggccgaattattttaaatagccattagcatttatgtacctgcaggtatgtaagcaaagacagttgggaagcttataacccaaaaatgttaaaactagttgtttctgggtggtgggatgattccttttttccctccttgctcctctctcttttttttttttttttctttttttttttgagactggccaggtgtaatttttaaagaaaaaagcagagagggccaggaatggtggctcacgcctgtaatcctagcactttgggaggctgaggcaggtggatcacctgaggtcaggagttcgagatcagcctggccaacacaatgaaaccccatctctactaaaaatacaaaaatttgccgggcgtggtggtgggcacctgtaatcccacctactcagggggctgaggcaggcaaattgcttgaacccaggaggtggaggttgtagtgagctgagatcacaccgttccactccagcctgggcaacaagagcgaaactccgtctcaaaaaaaaaaagaaaagaaaaagattatggcatttggctacagggtagaggtgtgatggggtttttttatgttttgactttcagtctcttcagatgatcaaaaacagtcttgttatttagtaatttatcatattcataagaagtaactaacatctaagcattttactatttcattatagtgataatctaatattaagttgatttattttgctttaatagaatgtttggaatggttttggaaaaaattattattcctgaaattcagaaggtatctggaaatgtagagaaaaagatctgtgcggttggcataaccaaattactaacagaatgtcccccaatgatggacactgagtataccaaactgtggtaagtacttcattttaatatttttgtaagttacagcttccttcccatatgactgcaaaattaacaaagcttattctcttgggggccaagagaatcttggtctgatctcagcttctccacaatcagatccaagacatgatttctggatccttctgggcttagaatgatcttgtttcctgcttctttttcagggggattcatggacccctttaagagtctgatctaggtgatctctaagacaattttatgacagaagcccaactaaactgacttatctttaaggggaagaactgaataagccaagaaaagaaccatcttaatttcaaaggtccccttttattcttgagactatgagtctgtaattttgtgtctctgagcaattgctggttttaagtcttccgagtattttcttgacctttttatctcttgctttcttccaatccaggactccattattacagtctttgattggtctttttgagttacccgaagatgataccattcctgatgaggaacattttattgacatagaagatacaccaggatatcagactgccttctcacagttggcatttgctgggaaaaaagagcatgatcctgtaggtcaaatggtgaataaccccaaaattcacctggcacagtcacttcacaagttgtctaccgcctgtccaggaagggtaagtgtgttgtcaaagaactctgtgataaatggagactttaatgggagggcaaaaggatagtagtagttctggtgtctgttttcattggtgggcgtaataaaactaaatctcattgagttacagcaagcttattttctttaattaaaaacactgagccctttttttcttgtattatgtactacaaatatattttaagtgaatggatttaggagtgagaacaaaggaggaaaaatcccttcaatagaaatgtaataaggctgtatagttgcattttgtcagcactttataataagagtttatttcccagatcgaagtaatccatctattattaaaatgtggtagcatttttttatttttatttttatttatttatttttttagacagggtctcactcttatccaggctggaatgcagtagtacgattatggctcactgcagcctcaacctcccaggttcaagtgatcctactgcctgtcagccttccaagtagctaggacccactatgcccagctaattttttatttttttgtggagacagggtctccctatgttgttcaggttggtctcaacctcctgggctcaagccatcctcctccctcagcctcccaaagtgctgggattacaagtgtgagcctggacacagttatttttttttaattgcagcatactcagaaattaatagatcatggcataaacctaataatgactgtatagttgcattttgtcagcacttattatagagttcttacatgttacctgataaaatatatatttttcaagccagacacagtggtttatgcctgtagttctagtgctttgggaggccagggctgcagtgagctattacagtgccactgcaatccagcctgggcaacagagcgaggtcccgtttcttaaaaaacatgtatgtgtgtggcgtgtgtatatatatgtatatatattttttcattgtattattacggagactttcaaacatatatagaaagagcataatgaagcctgcatgtgcccagcttcaataattaccaatatcttgccagttttgtttcgtttctccttttattctctgtattgagcaagtcttagacatcatacgtttcacgcgtaagtaccttattctacatcattaaccagtaaggactttttaattaaccacaataccactatcacacctaataatagtaattccttatggatcttttctttagacctatttttgaaggcataaaagcagttgagtttctggagaatttttggatggtgattaatgacttgactggctgctcttcccagagctgtggcagctctcccgtagaagatggggtttgtattggcgcaccaagatctccaacagccagtgtgtgtttcccatctcttgtaggttccatcaatggtgagcaccagcctgaatgcagaagcgctccagtatctccaagggtaccttcaggcagccagtgtgacactgctttaaactgcatttttctaatgggctaaacccagatggtttcctaggaaatcacaggcttctgagcacagctgcattaaaacaaaggaagttctccttttgaacttgtcacgaattccatcttgtaaaggatattaaatgttgctttaacctgaaccttgagcaaattagttggtttgtgtgatcatacagttatgtgggtggcttctagtttgcaacttcaagggacaagtattaatagttcagtgtatggcgttggtttgtgttgagcgtttgcacggtttggataatcttaaattttgacggacactgtggagactttctgttactaaatccttttgttttgaagctgttgctatttgtatttctcttgtcctttatattttttgtctgtttatttacgcttttattggaaatgtgaataagtaaagaattacttgtgttacttgccaagcagtgcacatttcatagtttcaaatctgtaatcagcaataaaaatcctaaaatatgtacctaagaacatcttaagggcaggttttcagtgctctctcatgcttttataaaaatgaagaatttctttaaatttcttccttttcctttcctggactctgtaaaatcctaatttctaaatcatgtaaactcagattatttagtctttttttttatatgggggaaggggacattaatatagatttggggcttatttactagaattttctgtagcagttcctaggtggcagtgtgagttttgggtaggtggctcctctgggagaaatgctctgcctcgcttaatgggatggcggtcgagagtacttgagactgtggatgttttgatctctttcatctctgctgttccctggagagtggaggttacttggaacttttcaaaccctgacaccttagaaccgtgaagtccagtccagtggtggatccggccggatgcctggtgagcttggttgcactggctccctcccttggcctggcccatggaattgtacagcattcgtttctgaggaatgaagaatcagaatatctaaattttgtgaggcacagtttatgctggaattgttcattgtccattcagtgtagttaaactggaacttttgtcttcccagctcaagtgatttgtcacaggagttatcgatatcccttttttttttcttttttacccccaagataagagtcttgttctgttgaccaggctggagtgcagtggcacaatctcagttcactgcaacctccacttcctgggtttgagcaattctcctgcctcagcctctcgagtagctgggattacaggcgtccgccaccacgcccagctaatttttgtatttttattagagatggggtttcaccatatttgtcaggctggtctcgaactcctgacctcatgatctgcctgcctcggcctcccaaagtgctgggattacacgcgtgagccactgtgcctggtgataacttttttaatcttaggcacttgactcgaatggtttttcttattttgaatttttttttttttttttttttttttttttgagacggagtctcactcttgcccaggctggagtgcagtggcacaatctcagctgactgcaacctccgcctcccaggttcaagcgattctcctgcctcagcctcctgagtagctgggatacaggcatgcatcaccatgcctggctattttttgtatttttagtagagacagggtttcaccatgttggccaggctggtttcaaactcctgaccttgtgatccgcctgcctcggcttaccaaagtgctgggattagaggcttgagccactgtgcccagccacttgtttctgtaatgttgcatgagaaatttcaagttctcttaagtctatttgtaccatctagtcatttaagggctttttgttgttgttgttgttgttgttgttgttgttgttgttggttttgacacagtaatgggaatactacattttacgttattactttggcttaagtggtcgttggtagaaagatactgaaatattactgaagccatttttaagccacaatttatttggaaagtctgggacaacagggaattgctagtgatggtttctgtatgtttttcactcacatgagctccttaa

SEQ ID NO: 16207 - DNA, 100551 bp, Human
tagaacctactatagttgaaacccaataaacagttgtagaccaattttcttactgttatatactcagattatgccttaagttcaccctacaagtaaactttccgtcaatttcatagtgttgtgaaaactctctagtagctcagaacgttcttggtggtctcaatatattaaaagtatgcagtcagatactgatggccctgagtcctgcagacagctaacaaagctgaagcccacaggctagtgagcaccagctgagagcactttctatagagtttgtgggcagtccaagagagacaggatctgagatgtgatgatatgtcctctggcagcagcaatatctgatattgagctctgctaggtggtgctgagcgtggacacctgcttccttcaccggctgcagagaacacagtatccattaaaggagctgaaagaggtgctagaggagtttacatggcaggagtccaggaagctctgcaacagtccaaaatgaggttgggacacatgatacacttgttcatccctattctctatcttcacacatatgcatatcagtccttccgtggctgctatattcttgtggtgagatccaaaccagctgcagtcttgctctcccagtgcatgctcattctgcaaatcagagcttcaatgtattgctatgaaaaattctgactggtcttgaaatccattgacaccatcacaagaaaattcaacatgacatcgtcatgaacagaaatggatgatggcttcatattcttaaatataatttccaactatggtgaaattttgaatggttgtaaaaactgtttttgcatttttatacctcacttattttgttaatggagactatctagagtttgatgtaattctcatcaaaaagtccatcagtaattatttcaaatataaaactgatatcaaaaaattgagttaatgaaaataaactcaaatttttcataaaaatatgaaattatattatacggaactttatgtacatggaaagtgaataatttctattatttttctatttgatatttatcatatttatgtaattaaaaacataattaaattttaaactaaattaaactgcgctccaggaagacatcattttctctgaaccatgactctgaaaatttggaaagcaccgtacaagagggattttcagtgattcacaagagtgcaagattctgcaaagtactttcaaaactaagcgtgagatctttgctactgcctttatggcatgcaaatcactcagcctcaactcagttccttcctccaatgtaaaaatactacaagaacaacatctcacgcttccatcaaatgggaccatgtgtgatattttacactggactacacaataggctggaaaagtgatccgcagagaggctcattgctctaagttcactccctgtaccaactgtcttgcacaaagctgccacccgggtgtcttcttccaacatttcccctagttggacttcaaagtttccttcttgcagcctgtgcggggaccaagaggccggtctagagtagccgcccagcatccagatccgacatccttttccctttcctcaggaagacttggatgcgcgccagcccagcccgggtctccaggttcagctgcggaagcttcccacatggtgcccgtcgcttgggatgcggctatccttgtgccttctctgcaggtgtcccggcaggtagaggaggagaccggtggctggtgttcctgcagggcggggctggggctcctcgatgtccttgcgcttgccctgcaagttctgcgccccaggccccggcagggacggaaacaggccgggaagcagtgacacctggggcagtcagtcatccaggagccgccgccacccgccccacccccagtctccgcgggaggtgtttgtcttcgcctatgctcccggctctttctctttcacttttcttttcgccaggggttgggactccgggtggcaggcgcccgggggaatcccagctgactcgctcactgccttcgaagtccggcgccccccgggagggaactgggtggccgcaccctcccggctgcggtggctgtcgccccccaccctgcagccaggactcgatggaggtacagagctcggcttctttgccttgggaggggagtggtggtggttgaaagggcgatggaattttccccgaaagcctacgcccagggcccctcccagctccagcgttaccctccggtctatcctactggccgagctgccccgccttctcatggggaaaacttagccgcaacttcaatttttggtttttcctttaatgacacttctgaggctctcctagccatcctcccgcttccggaggagcgcagatcgcaggtccctttgcccctggcgtgcgactccctactgcgctgcgctcttacggcgttccaggctgctggctagcgcaaggcgggccgggcaccccgcgctccgctgggagggtgagggacgcgcgtctggcggccccagccaagctgcgggtttctgagaagacgctgtcccgcagccctgagggctgagttctgcacccagtcaagctcaggaaggccaagaaaaggtaccgcagctccccacttcctaactgctcccgtcccaaactcattgtgggccggtgcagatgtctgtgcgtgcgcgtctatccctacctttgcaaaatcaaattatcgccctcttctttgcttgcacacgtcttctgggagagaaatttgcaggaatggtcagtgcttggcagtcaggcctgggtctgtattggttccaactctgcgccagccagttatctcttagagaagcgatagtgtatctagaatgtcgaaggaacttggaaaaaatacgagcgaatttcactgaaataaaatcattattcaaggtggcttttaaatgaaaatccagccaattttttcaagtgttattaagaccgcatgtagcaagggtatacagttcatttgactttatgtaattccatgcattaaaaactatgttgacttcaaagtatgtctaaaccaaactaattcttaaatgatgcttacaacagattcttaaataggatgagtcagcaatttcaaaactggaagtaaagtggtggtcaccagctagtttccattatatatttttaaactactatctaatattatgatactggtggtggccaactaagtggacgtcatccttatcttgtcagtgtggtgaaagaggccatattagctaggctgaatttttgctcaggtattacagaataaactggtgattatgcatcctgccatgtagaggttataaggtgaaccattctactgaaagcatcaagatacaatacacttttggaaggccgaggcgagaggatagcttgagaccaggagttccagtttatagtgagctatatgatctgccactgcactccagcctgtcaaaaaataaataaatgaataaaaaagatataatacaggttaaatttttaaactcctgttgttttcgtgtgaagtaatgtggccaacagagcaaggaaatacatgggaaggaacataaagacatataaagagaagaactgaaaatacagcaaaagccatttagatttaaaaagtgaagaaaaagctagttttgcttaaagttaacaagtatcatagagatcttaaggtttgttatgattgtcttagtttcgggtccttattcgtgtaaaattctcacagaattttagtcaatcagaaaagtctctcctgcagtatcatctgctttgcaacagtgacagagaagggtcagttgaccattggtctggaacttctgataggcagggtgttcccatacttttggtttcactgttccttgctgatttggagtggcaactccagaacctgattggaagctatagttctggttggaattttcctgcagactactggtgattaaaatgatgctcttttgttttaatccatgaaattaatgtagccaatgtcaacagctatattgcaaggcacaatgtttataaatttccttgggggatggagaaaacagtggtttaaggtttatcgaaatagattttggaagtggaaggttttaaagcctacgggatactccatctcagatttgctgcctctgatgaatttcaggacagctagaagagcagccctgaaatgctgggtacatgtggatttttctcaggaaaatatccgtaactttgatcagctttttaaatgggtctctgacccaaaagagttttaaatcttttgaaaatatagactactgtccttttcccctcatctctcctggagtttaatgttgagttctgctcattgtgttaactatttttctgaaggttagctgatcataatacagagttctgtcttcagacctataacttaagttatgagaaacagtatgaataataactaacattgttgagttcttattatgtatcagacattgttctaaggatgtattttttaaaaacatcgtaataaacttatgtggtaggcaatatattttacagctgaggaaattatcaaggtcacagagctagaaagtggtagagttggaattccaactgagacaagtttaagactggtggtatttatggaggatggtattatttgcatacaaatatttcgtacaatttgacagtgataatccctacttattttcaggcagcgttgtaatggtagaatgccggttttaaagtaatgtttgtatggtacttgtgcaattgacattattatatatttaaagattatctttataatcaaataatattcatttgagtgtcaaatatgtgtttggtatattggagaaatttcctttatggtccctgaatgaaaacatttgtctaatctgcatcactttctgctgaaagagcctgacaaatagtaggcaaatgtggattgatctagatatctgtctctgcctatctatgtatcccttcttccatacaactagaagtctgggattcatggagaggtcagagaagaagagtttcccataatatcccaactggagatgatatagttaactatttgggacatcctctcttcagaaggcattatggtagaaggtttggcaagaagccacttcttttgctcgatattagctctttgatttacttacccgttgattacagtaactgcatgagactactgacactgaacattgcttaaatacttgctgctgtcctataggaatgggttggatggaaaaattccatagaggagttgaaggaaaaattgttattttagtgagtactggaatgcactaacacctatttgatggtaaatttcactaattaaatactatcaactatatgtctatatgtgtgcatatatgactatatgtgtatatatactgtgtatgtgcatatatgtgtgtgtatgtatatattgtactgtactatttgttaacagctgtgggcagacaaggtttactttttactcagcttccagactgtattgaatatataaacataagaagctaagaaatcttgacagaaagcctgaaggacaaattattgttattaacagtgccattccagtaggaacctaatgtgaatttgaaagtttcaaagaggaagcctctgctatgtttcagccaccatactggcacttcatctgtatgtcctcattgaatttgaataaccattgcatttttatcctgaatttacaaagaaaaaaaaaaaaagacatgcagagttttgcttgcattaggacacaactaggtaagacagacactccactgagatttatcttgattctaatgttaatgctccttttcggatatcatatgcattctcttctaagaaaactcaggtgttcagtgtactgacaactaaaatgctgctatccttaccttgaaatagaccctggtcaccatttggggtgatttaatgctatttatgaatttgcctatgtcaaagaatattgcccttttttaaacaaacaaaaaaaaaagttgtttagtgctggagtcagaaagaggagaaaaagaggctctttaatctcagtttagttcaataatattatttgtccacatttcacatccagagccagggtatttgtatgcatttattttatagtgtttcatcccactgcaggggcagaagactctatgtagaccgtataaaaatggatttttaaaaagtctgcatgtaatacacagttgtttcttctctaaatgctaatagttcctccaagtgctgacagggtgcagacaaaatcaggaaagtgacaaattattttgtgaaatgagggaattgaaactgaaaatggttgtagaacaggaaaatatgatggttgtaaggttgatggcggtggtggtgggggtaagctctgcttatcattgtgacacacgaaaggagcccagagagggtctttggtcccttatatcactgaatgctacttctccttcctgggtattttgcttatgtgccttctaatagaaatctgacaaagtagtccttgcacactgttagcactgacctctaaaattatcaaatgattttttcttaattgaacattttactgttaaagattttctattttcctgactcatctgcaacaaaaataagtacataaaacttgattttttatttgaaggattttcgttgtgaaaattattctagcttatgttatttaaaacactatcattataaaattaatcaaaggaaccattaatttttgataagtgattattaagcataaaactaaaacatatatacccaaaggattataaatcatgctgctgtaaagacacatgtttattgcagcactattcacaatagcaaagacttggaaccaacccaaatgtccatcaatgttagactgaattaagaaaatgtggcacatatacaccatagaatactatgcagccataaaaaaggatgagttcatgtcctttgtagggacgtggatgaagctggaaaccatcattctcagcaaactattgcaaggacaaaaaaccaaacaccgcatgttctcactcataggtgggaattgaacaatgagaacacctggacacaggaaggggaacatcacacaccggggcctgtcatggggtggggggaggggggagggatagcattaggagatatacctaatgtaaatgacgagttaatgggtgcagcacaccaacatggcgcatgtatacatatgtaacaaacctgcacgttgtgcacatgtaccctagaacttaaagtataatttaaaaaaaaaaaagccgcaatgtggttttcgagcttctagaaacttagaaaggtgctaagtgctaaggaaatttcttgcatcagtgctttgaatgtaaattatttttgttgaaaagtgtgaatatcgctacgttttgtggagttttgaaaacaaaacctgtattggagaataataataataataataaataataacgtgctcttgaaaaaaaaactaaaacaatattggaaatatatatcatacaactagatatgtcaatgctttgattaaagatgtctcttatatcaacttttcaaattgcccctttatttggcaccctggtgaggcaaggcacatgttaagattctggatagggagagataggcatttttttcctaaagtgggagaagggtaattatgaaagaggaagtgaggaaggagaacttgccagaaatctgcctgctttgggcacacatcaggcatatctctggtaaaaggggctcctatggaagtaacggatcttgaaattggttcctttagaaccgtctatgtccacaaagccctgggaaagttgtagggtatgccagaggtgcgtgttgttcagttgggatatatagttcagccttctttcccacaccctccctttggcttctggattaccatgggttactgtgcttaaagcaaagtacagggagtaggatggggagcagtaaagagcctgggctagcttctgtagaggtttcccactggggactagtgcgaaataagctctagtagggcttggatagcctctgcagtgcagtctcctcttctagcctcagctgcagtcaccttgcctcagtgtccagacacacttgccattctttgtcagccttcatgggtcctgctcaaaatgttaaccctctataactttttctgtccccacctactgcccaggcagaattattttctcccttacatgaattcatttggtgctgtctacattcccttataacagctttaatgtctgtaaactcatttttatgtgtctgactctacacttacattttgagtaagggcaatgtgctccatgtgcttagcagagggttggtcagagtctatttgtattgacttcagcatgagtcaatcatctttcaagtgtttgacagctaagcaaacaactgtaaaagaggtaggaaacataagtaatatagcaaaacaatgttggaatactgtaataaaaatagtattttagggaaattagtttgaggtagaatttattgaagaaaagacaattagagataaggaaaccagctagaaattcatcacagttaattcaggagtgtagtttcattctcattatctgctcaaggacataactctagtaattcattctttctctccatcaccatttttttctctgtctcttatgggtctttcccaataccatgtagccatgctataacttctgccatttttaaaaaagactcatgtttttctcctcatgtttctgctcacttctatatctgcttttttctgcccacattttacaggaaaacttacaaccttaactatattctctgtttccagttttcctctctcctttctctcctgaaccagccaggctgtcatctccactgctccactagaaatacacttgtcaaaggtaccacgaacatcccttttattaaatccagtagttagttattgggtcccttcctatgtaccctttcagcaggacctgagagttcttcatgtggcttccaagccactccccttctccttattttccttttaccataccagcaacaatttcagtctccttttaccttaccagcaacaatttcagtctctgtctagttcctaatttccctaacatgtaaatatagctgtctgagggctcagtccttaggcctgttctctatctgtactctctgtcttggtgatctcatctagtgtcatggtttttaatcccttcttacattgatgattcacaaatgtacgggtgaatctagccatgacctctcccctgaactccagactcatttagcagtctatttagctgttattcaaccatctctgattggatgtctaatactcactggattcctgcctttactgccatatctgcttgccccaccttcttcctcatcttacctgatgtcaatttcattctcttagttccatagataatcaatcaatctatcttgggtttgtccttaacgtctctttatgtcatattccacgttgaatctgccaccaaattatttagctaggccttcaaaatataccctacatcctatctcttctcaccctttttttcagtgctgtcacctgggttcaagttgctatcatgtctcacagtattattgcaaaagtgcctgctgcttgtccccttatctccactccagcctgttctcaacatagcagccacagtgttttggttacctgtccctgcatctaaaggatcaacagccataaaacaagaacaaaacaaaacaacacccccagaacttagtgacttgaataacaataatttgttatttatcgtgatcttgtaatctgggctactttcggctgcttgactcctcctaggctgctggagatgagacattcaagaaagcatcttccttcacatgtctagaacatcagcttggatagctggaaagctcatggctggccaagcatccatctctccgtatgtgacccctatacatgactaacttggactttacataacgttggcctcaagtagttgtatcatttaactaattattgactttcaggatcccccatagcttatctcgttatggcatcaaactcagactttaagtctctaaactggatctccagatgaggatgatatttctctgatgtagtttcttgagtgcagcaacctgtagctaaaaagataggttatctgtgaccttccccttgtcccaacatacaatggtaaaacaaaaataggacaattgctttaaaaaaataccatttcaaaacaagacaatagaaggcatataacagttgctagtccatagcaagtctaaatagagccggcatatatcccaagttcttgctctggaagcaatacatgttccggattaaggtttaaatttgttccctaggagtgatcctctgtggctcttaacttcatcttttgcactttgggctccttttctcattctttctttcttttctatgagaaataatttttgctattctttgcagtggcgtagcctgctttctgatgttagagggttaataatttagagaccttttatatactcacttttgtttaactgctttttgtttttaagttcaatgatatttagaattcggggggcttcctatgaattttattgagattcattcactccgttagataaaagacataaccagaaaatccttgagacaagttccactttaattttttgggaagtcaaggtgccatagaaacccttaccatttttagaagccttttgactagttggcaaggtctgtgagacatcattttaaatctttcagagttcttaatgaagggcctccatgccacacacctgatttgatctccaacctgagagcacatgtaatagtagagcctggatttgatctttgccctgaaactacttatttcttggagaatcttttgctgcctggaaaggcaagaatgagaataggtgttattttccaatctagcaagtcttaggttgaactatttcgtcactgcatttctagccttcactaacagggtccttgcctctctccaggtgtcttcccaccactcagtctcatagtagtttcaatgtcaattactaatttccatataatagactaccccaacacttagtggtataaaataagaaccattttattttctcaagcctaagaattaggacaaaacacaaagagaatgacttgtctctacactgcaatgtatgtggcctcagatggtatgactcaatggtcaagggatgtctgagatggctcagacattaagtcacacatatagagcctcagttctggctgttgtctgggctccttggttctcctccacttagtctttccacatggctaaactggactttctcacagcacggtagtttcagggttgtcagactcttcacaacttggccaacttctataagagaggaagttggagctgtaatcacttaaggcttggatatggaatttccagactttaacatttgttttattcttttgggaaaagcaagtcagaaggccacccagattgaaggggagacgacatagattccaccttttgattagtagagtgtcatgcatgttcatggggggaaggcactgactgatggcagctgtctttggagattatccaccacaaagggtaatccggttaaaatattaatcaggttatgctactcctctattccaaaccccacatggttctcccatctcactctaataaaagccaaattctgttacagtggatattaagtctcttaagtgatttgtacccctgatgtctgccatctgctactcttcccttagctcactgagtcagttacactggcaccttttctattcaccaaccatactactatgttcttgtctaagagtcttttaccttgctgttccttcttcctagaatgcttttctctcagatatcacccgcttccccatacctgctttggggtttgtctcaaatatccctgttgcaatgaagtaatccttgactgatgtacttcaaattgcagcctcaccagcactccctgtcccaaccctgtttgggaattcagattatttttcagattttggaaagtaatatagtgtgtttactatatatcatgtaacgaccaagcttattcaggtacttcctcaaaagggaataaatacagcttacacatagtctaatgttagttcagcttgtgttttgttaatcagtgaattaaggagaaactttcagtttttggagcttttttgatttaatattttcatataagggactatggacttgtatgttttattgaattatttgattattaacatctcccttcattagaatatgaaccacaggagaacatgcagttttgttattttattcattgctatattcccatcacctattagtgctaggcatatggtagtctctcaacaaatatttgcttgagtatttaaagcaatatttaaaacaaaaatgaatgagggaatgaatggattaatgaatgctaagtagtagggtactgcaaatagaatggagaatagaaagacaagctaatttcaaggaagatttgatataccagtgttctatttattcattgaattgattttggcacttcagcagttaataattttgagtgcctaatatgggctggggactttcctaaatacttgactggtcttgattgagtgggaggagcagagcacagcgaagagtcagagaatgccgaagattttaaccatgagagtcaggaaagataaacatgttaggaacagatatatattacagctaacacatggggcaaggtaggggaatggatgaacttgattttggaaatatcacgattgagttaaaagtggaataaactacttaaaatgtcctgtaagtgattagaagtactggattgaagattggataagctatttgtacaagatttgggtttgtgaattaagtaaagaattattggttaaaacaaatggtcaggatatttccccaggaggcaaatgtatatatagatggcttagggtcacataagacaactagagggactgtcactgagctaagcaccctgaaagaggagatattcgggaaggccttcgaggaggaattgaccagctcccaggtcttcaaaagagaaggctaggctttttacacctcctagaccttgccttcctgtcatacttgctctgtctgctgctctctagagggattttaatccctcatatgcttattcttacatagggatcatctttaaagactcactttctctgtgacgttttcctggcgagacactatctttacctcctgtcttgcctgacacctttcctttgtgtgttctccacctgatagatacttctctcatagtatctgcagtgtttcactgtatttatctgtgttcatattgcctctccggcaggtaaatgataaaggtcatagatgagaagaattgtgatggtggagttggaagggctgaagtttgagaaacactgcattcttatgtgtctaacaccttgtctggcacatagtagagctataataatgttattcttgttgtcaatgatccaacatatattcctgaggggtcaagttagatcaggttctgagaaaaggagtttgaccatatttgactcatagtatattactggtgatcacatggcttttgggaaactattcacagcatatttcctattatcagggtcaggaagggaaatagaattttctggggatgtactttgggccaggttacaaatagaatctttaacttccttattaggagtatgagttttagagaactgaaaacaaatacgtttgtttaatattttgtgccagttttattatagaggggataattttataaatttgcaaagtaaatgcttcagtaaatgaaaggaaattaaaacaaggcacatcttattctctaaattccttcaaacagaaatcctttcattttctttattttatttgccgagtattttgagaagttatttcagtaggacaaaaaagatgagagaaattgtgtgaaaataatagtattgcggaagtttaatttatttagtgtctcttctcctgagggtttaagagaagaaatatggtttcttctcttgttatgctgttaaaaaaatttgcagttacctcaaatatcagattaaaatctgtatttggtatctttagattctactcctgaaaagcaagatccttgtaaagaacctctaaaactggaaagatgtgattatgctgatggcttatttgacttgatattgaggcattcatcttctaaaccttggcctttcttaagtcaaaccatattactctgagccgctgcaacttataaagcatggcttccaggctaaggtgtttaaaccaaagaggctaacagcacaccaaaagttctaaacaatagtggatatttattgatcactttctctgtacatggctccctgccaagtgctgtgaaggataaaaagacgcagcacatttgattctctttaggaacttattgtctcgtggaacaattattgtttgcatgtaaacagctgagtgtccaggatactgaactactctctgcccctaaacacaacacacttcctttcatagccaaatattttgacatgtttctctcattggaatgcactacttcatccagtatctcttccgtgcccccttctcctgactcgcctggtccagaaatctcagtctgataatgccttctctgggaatattgtcctaaatgtccaaagttgggttaggtgtctttcattcttaacttcattccataaatatttcaatagttaacatttattttcacccatagtcccaagtacattaacatatgtagcattctcaaactcatgagatactttccttcccacttttcagataagtaaactgaagcaccaggaagtgtggtgactggtgcagggactaccagtaggaagtggtggaactggagcttgaactcaggtttctctctcaagcatgcacacttcctatagagggtgctaccttgctggtgcaattaataagaattataaagattaaaagagaggaggtgaaattttcattatttatagatgaaagccatacaaattaacaagctactaaaacaaatgggagagctcagaaaagttgccagaccaaagatttttaaaaatcaataacatttttcaatagtaaataaagcattagctaacataacacaacagtaaaacaaaccagcaacacaaccttccccagtaggagcacgcttgctgcaattaaatatggtttatttgaggattgtctggatggctcaacatcagaaaatctatcaaaataatcttaaggatataggaaaagttagtgtcaagttctgagaagaataaaaatagattggattttccaaaactgactaaagtatatctatgaaaaatctatagtaaacaacaaatttaatacagggctcagaaaaacattttttgttttacattttgggagacgatgaggatgccagtgttggcacaactattcagtaaagtgatgaagacaaaaataataatcaccattcatttgtattgagtgtttacctatgtgccaagcagtataaaagcaaaagtggtggattagccattggtgcaaggagatggtgaaactcccatcttcctactcctccaaggtagaggtgataattgaactacagtgagccaggatgaaatggagttgtcacagaaaattgtaactaggatgcttaatttattgttctgacccagaatgtagctatttggacataatggaatggagcaaattacaatatagtagaatttgggtggtaccaatgatggtgtaggatagttagatctaagctgtgagatgaaaaaatccctcaatgtctactagtaactgcgctttagatatagtcaatacatatggaggtgcaagccccaaacatactgttatcatggattttatggatgaagcagagcccttttgaaattgaagttaatatggagaagcagcacaatgcatagcatatgctttgtgctatggtaactgaatgaacttctggtgaagaattaaaggagggatccaaaacacattgctaaatttcaatttaacctctttatgtaaaattgaacaatacatttaatttctctgcacttattattctcttcttgaaaattaagataattagaccagagaaaatccctttggtgttgaatctggtggttcaggaaaccaacataacatggatggattctatcatatgctgagattttcaacctgtcatctttatagatgttacttaggcactggaagggactttagacacctccagtctaatctccgtattttaaagacaaggtaactgacacttaaagacataaagtaccttgctagtgtcacatagctgtttaaaggcagaatcaagcctagggtccaagtctctagaccccagtccattccatggttctggtaagattaggaaagctccacatttcatcaagaagttctcaatctcaattttacatgaactatagttttggaaattgtaatatgttaatgatgaatagatgggaatgatggtagtctgtatggagtataataaaagaatagatgaacacttccaccattatttacacaacacatccaaagagattccacagtgtgcgtgtgtgtatatatacacaccatatatatatatacacacacaccatctatatatatacatatatataaacacatatatatacacatacacaatgaaatactattcagccataaaaatattaaaatcacgtcttttgcagcaacatgacggaattggaggccattatctcaagtgaaacaaatcaaaacagaaagtcaaatgtggtatattgtcacttagaagtgggggctaagtgatgtgtacacatggacatagaatgtggaataatagtcattggagaatccaaaaggtttggaggatggaaagaggttgagggatgagagattacttaattgtacaatgtacattattctggtgatggttacactaatagcccagactttacctctatgcagtatagccatgtaacaaaactgcctttgtatgccttacattttatttttttaaatgaatgttgtggtcccaccacatggaccacatttaatgttagtttcctagaagtatgttttataactgaatagagataattttctatattgtattccaacccggatgatatacatatatattcggtaagatttttcaattttctttgttctcactctgtatttatcaaaaattaattttatgaataatttggtcatgtaagttaataatgcaggcttagttactcagggattgctctggagcaagaaaaaagttactcacttctaccttctgtaccccttcatctttcactctgccactgccaataaaaccctccaaagaaatccgacatcttagactacaaaaaatgcagccatcttgggaaacctgtagcaagtacacccagcagaaagggtcaaaatcttaaagattgtgacaaatctgtaatcccacagaagggatgaggcatgccaagtgtttgatgtctacaaaaaccattttccttagacaaaagctgaaaggcataggagaagtaatataaagcagaaaaaatgaaaagcaaaaattataaagaagacaagaatggcaatctatttataataatagttttgataacaaccatttagataagaatagttaatgaggccagtgaaagaggagataaagtactaaaacggactattctcctattgtgaggacaggatctctgttagctctgtctcagataatttgtacagcccaagtggagaaggaagaaccagcagtgctataaaagataagttctgctgtccaatctagggagaaaaaagcaaccacattgaccacattagagctcaggagtccaaacactgctagttgccaaataaactttattaatagagacgacctcccccttagcagttttataagcactattgcttttttatatagacttgagaaggttagtttacttgtcagaaagtaggccagaaagcaatgttttagaaacaagacgtttgggactgctacagagatccaatgctcaggctaaatcacgtgatacatttcatgtgaagctaagtatttggaacaagagatgccagaggtctaatcagcaagaataataaacaattagaagaatggcagccaagcctagagaaactgtctggagaaagagtactggaggatttgtggtctaatgtgcatttgtgcttagtaaaagattagctgttcctagatttttaaatttaattttaagtgttattcctgaggattatggtaatcgcatctctttgcttctataagggattggtgagaagcagtagcaatatttgaatccagttatttgtgagtgggagatgtactatatcattaggtgtcattttcaccgaatacgttattatcagcaggtaataagaaatgtgcatcattacaaattctcatctggtattttgtgctcaaacagacaaggtatgtcttctgtggcagcactgagtgatcacatagagactggtgtcaaaaaatggctcttataaattacaggatacattttaatagttaaacaattatctaaagaggcaccactggaaaattgtttagtaacaattggctgatttttatgatgaaggataattcaattaaaaaaattatttacagcctcctttggttcagaaactgtgccatgctttgggcattctaaatgaattttgtcttccaggagttcatcttctaagcagctttatggagaatgtcatagttttttcccaaattttcttcatatatgattagacaaaatatttaaatctgtgctacataatattttgtggtattttgattttaattttatgagtggataatacattaccatggtttaaacttcaaaagtttcaaagcgctttccaattcccttctatagatgcaaccagtgctatcattttctagtgtatgtccttgcaaatgttttgtgcagacacacaaaaatgcacgtatatatttaaccatccccctttctgaaaacaaatacacactgtcgagttacctttttctttttactttaaaaatacaccttggatatatgttcatgctaatattaaaaaaaacttcccattcttttctatggatgtataatattacattgcatgcatgtattataatttacttaagcagtaccctactgatggacatttaggttttttccattcttttgctattacaggaaatattcacatgagtaatttcaacactgatattctaaagtgagctagagtgactgcattcctgtttcccagcccatattccatagaacacaagtctcatgagatgttcaatatccaaaagggttctatagttaaataactttgattaactctgggtatttgttgatgtttatagtgcatactgtcaaattaaaagaaatcttgcaataatctgcttcgatgtaatccaagtgtttcctgacctcacattttctcaaggaatggaatacactattgttttaggtcaggttcttgggaagcagactgagatggaaatatacatgcgagaggcttactggggcatgttctaaagaacaacacctgatggaagtaagggcagatcaaaacagggtgggcagagggagaagttggactgtgatgcagttggaacagtggcctcactggatccaacagggagccctctagaggcaggatggccctttggggatgttacagctctggaagggaagcaggccagattcctggaagggaagcaggccagattcctggaagggagagctttcttccattgaaagcatttatcaggaggggctcagctatgagctgtcagctggaacaatgaatttcattgttcactacaactctgtatagaatcttcaaatttttaaaggaaatgcttatcagttcctagagtgtcttgctggtcagagcaagtcacttggtctccagggactcagtttcttgctgtatgaaatatggatgctgagctgaaagttctttagagtttataacattctttgcatctatttccatttcagtatgtgctaattgaattccaaggtcagacataagttttccccaagacatacttggccatatagaggcctatgatgtggatagataagctctaactttttaatatttctgctgtgcagttatggaaaaaaagtgcattgttataatgctttcaagtatgtgttacttaacttggggcagactcttggggcgaaggtgcataagagctgaattagagctttttattaaaatataaaaatatatttttaaaatattttggttacctcttgttgggtgtttgctggagaagctggcttgctatcttcctaggaacattggcccatattgataaaattgaagaaatatactggcatagggtgtaaaagagagaggagcataactggctttaaagcacattcttaggagctcttatttattctccttttagaagctcaggaagcaaacaggtatagacaaacagctatagcaatttctcagggaccttccatttgggaatcagatgggtctaaatgcccatcctatgtcatttatggtacttgtgaatttcattctcatgctcctgcaggattcatcaattgtggttgttattgatggaagcttgtttcctggtaggagtggggaaagggctcagggaatgggcctctcttaagtgtgcctggtagagttaatgaaggttcataaagaggatggaaaacatatccaagaaaaagaaaatgttctttaagataaggaaatgggaagtgaaatcaaatttaaggcggtattatacaaacatgatgcagagaaaaaagcaaaaagaaaaaaaaaaacaattctaagattggtggctgtatgggtgtaagatcaacttttaaactgaatgtaagtttttctaaaaaaccttaatctttttcttcaacacaaagcttcatgcggattcttggatcatactgaaatttgattaagatgtttcttaatttattttataaaataaaagttatactactttacttttttaaatggcataataagttggattacccttataaaaaaacatagaagttacactgtttttaggttttctaattaaataatctgttgccatatttatacccccgaatcacatataccttaaaatattatactatattatgatgttgtgttttactacttcgtatttgagtggagactttgccacttcacttttagaataaacgtttacaacttattttcaacaccttcttcagacttggtcaataacttaatatcaaacacacaaatacacttgacatcatgtgtgctttgtgatattttgtgataaagagaaagacaatttactagagagctatatgaagcattataggttttaaaaaatgatatatgatttttttctccaaaatgatgtagctttagtcagcaaggacatgagttaaattatggggaactctgaggattgtagaaaagatttccccaagaagttcagtcttgacttatgcagttttctccatatgagtcttcctgtttttttatagcatgatcaggtatgtaggtaaccataaatctgaggaagggaggattactcaatacataattattaatcctcttatccgtacctttgactcttacagaatccattccaatatatggccatgtggctctttggagcaatgttccatcatgttccatgctgctgacgtcacatggagcacagaaatcaatgttagcagatagccagcccatacaagatcgtgtaagtaaagttttaaaagttttatcatgcaatacagatacttttatataatagcataactaataataaggaaaatgtggcaaaacaggtgaagttatatatactcacagcttttaaaatgagcatcttggtttaaaaaatataccctttgttattgcatgcttaaagcatatatttgaaggcacagaatattgcacataattttttttctgaaaagagccacttagtaaatattataggctttgagagtcaaatgctcactgtcacaatgagtcaactctgccctattacctgaaagaagcaataatcgtgtaggtgtatggctatgtcccaccagaagtatttacaaaaacaggcggctgatgagggttggcctctgggtcatagtttgatagtttgtcaattctaggcatataaaatgacagaattgtgcatatcactttctgtatattactgggttaattttgaaagaacttgcgtgcttaaaattaaataataagtgtaatcaaactatctaatttttgaatgagtttatgtaaggatattagaagataatgtagattagattttttaaatgactgagtcttttaaggagtattttagaaaaatgtaaggtcaagttcagtctcgataactaaacaaaatatagtaaggtataacttgatgatggagatatgttctaagaaatgcattgttacacaattctgttgtgggaacatcctaggctgcactgacacaaactgagatggtatagcctatacatgcctagtctatatggtatagccagttggttctaagctacaaacctgtacagcatgttactgtactgaatactgtaggcaattgtaacacaatgataagtatttgtgtatctaaacacagaaaagatacagtaaaaatataatataaaagataaaaaattatatcctgcataggccccttaagatggataaattttacaatactggaagctgctctggttgattcaatgagtgagtggtgggggaatgtgaaagcctaggacattacttcacactactgtaaactgtataaacactgtacacttaggtcctacaaaatttattaaaatatttttcttcttttaataataaattaactttagattattataattttttaaagttaagaaacaaacattttctttaactttttgacttttgtaataacacaacttaaagcacaaacatattatacagctgtacaaaaatgtttctctttacatccttattctgtaagctttttttctgtttttaaaaatttttaatttttactttttaaatttttttattaaaaactaagacataaactcacacattagcctaggtctacacagagtcaggatcatcaacatcactgtctttctcctccacgtcctatctcactggaaggtctccaggggcagtaacacacatggagctgttatctcctatgatgtcaatgccctcttctggaatatctctgaaaggtactacctgaggctgttttacagttaacttttaagaaaatataagtaaaaggagtacaccatacaataatgataaaaagtatagtataataaatacataaaccagcaacatagttataatcaagtattatgtactgcatataattttatgttatacttttatatgactggcagcacagtaagtgtgtttccaccagcatcaccataaattgaacaatgcactgtgttacgacattatgacgtcgatgtggtttggatttgtgtctccattgttggaggagggggcctggtgggaggtaatcagatcatggggcaaacttcccccttgctgttctcatgatagtgagttctcacgagatttggttgtttaaaagtgtgtagcacctccccctgctctcttttcctcctgctctggccatgtaacacatgcctgcttccacttcatcttctgccatgattttgtttcctgaggcctccccagtcatgcttcctgtataacctgcagaactgtgagtcaattaaacatttttttctttataaattacccagtctcaggtagttttttatagcagtgcgagaatggactaatacagacatctttgtcaccagctgctaggaattttcagctccactataatcttatgggaccacctcattgtatatgcagtatgtcattgactgaaacttcattatggggcgtgtgactttaaagccacagaaataaatccaagcatctggcttcttactggtaaagtgaatatatacatttcattttcactttcagttataatttctaattaacactctcagatagaattctgtagcatgtatactagatcaagataaacagtagaataagtaaaggactttaaggaaattgaaacattttataagaactccaagaggaaaaaggcagtttatttttccatcatttttagtatgagaaaataaaataaatataaattcaaagaaaaaacacggaaatcatgctctttgacagtcattatttataaactgaaacttaccccttaacttcataaacttcctagaaattattgtttcttggaatttttttttttttttgagacagagtcttgctgtgttgcccaggctggagtgcagtggtgcgatctcggctcactgcaagctccgcctcccgggttcaagccattctcctgcctcagcctcctgagtagctgggactacaggcgcctgccaccgcgcctggctaattttttttgtatttttagtagagacggggtttcaccatggtctcgatctcctgaccttgtgatccacctgcctcggcctcccaaagtgctgggattacaggcgtgagccactgtccccggcctgttttttggaatttttattaagaattccccaaactcaagaacaagtttcctggtgtctttttttttttttggagacggagtcttgcttgtttgcccaggctggaatgcaatggcgtgatcttggctcactgcaacctttgccccttgggttcaagcaattctgctgcctcagcctcctgagtagctgtgattacaggcacatgccaccatgcccagctaatttttgtatttttagtagagacggagtttcaccatgttggtcaggctggtctcgaactcctgaccttgtgatttgcccacctcggcctcccgaagtgctgagattacaggcatgagccactgcacctggccagtgtcttattgatacacacagattaggtattgctaccattgaggggttaaaaaagaagcagggggaaattttgagtattgagtgataatatttgagacatttttagtaatagcaatgtggttgtgaagtgtcttgtcactgagatattgatggaaatgaataaacattctttttaaaaaaatttattctgatcaattctgtggcaaataagctatggcaggggaattttgcttaaatgaaatcatgcttgaaatatgcaagagatttaaacagggatctcccctagtatatgagtagtaaataagtgttttgaagtcataagaagagtgtcgtgtgccttctgtttttctttttatgaattctgtttgattcctacattttttaggttcagcttcctttgttgggatacttaaaaacaggtacattttgattgcttatttcttggtggccagtgatagttattcatgtcaggatttaggtggaattaaagacctcaagtatctctttcaatttgcacagtaaaacaggcaagtaagtgtaatttgttccttggtgagctctgctcttactgtaacaagaacccagaaaggcactatttgtatcagttaatcccttgaaggtagcttttattttggatagtcaactggggaatgtaatgggctccatgctaaagaaactttcactgtgaaacatttctgccaaccgaatctcacttgtagtctttatcatgatttctttgctataatttttacattctgaaaataaatgcatttataaagcagaatttgggtataaactaagttactaggaacctcaccagtgcatgctttcactcaaggcccctcctcttttattttagctagggatgcagcttacaagcttgggtggccttgagtcaccacttttaactcaatttagttaaagcttttaattttgtttcttattatctctttgattatcagggtattatgcgctcattatagaagagtgaaaactacagaaaagtttaaagtggggaaaatatcaccaggtgccgtaattactagaaggcaactaaacacatgactgttaacacggttattttgtttacgtggttgttataaaaaagattgaaaagttgcgttctggttttgcttgtttaccaggaaattgtgacatttctctgtgacattacataagtaaacattattttaatgtgtatataatactctaaagtaggttccaacccatcattcctttctctaattgttgattattataaatagcacttcagtgattatatttttgaataaattttgtccaaatttatgataattcattaggtacatttcctaggaagggaactaagatgtctaaagtataaatattttaatggtgctcttatcccaaaaatgatgtacaaatttacacttttgtcatccctacaccttcatcatctctatgtgagtcttggtgatactgcatcctcaccagtgctgatgtttcacaatcctttctagttctatgaagaatagggcagcagtttatgccaaatgtaattctcttggaaaccacagagaaaattatgagaatggcattgaagggaatcccacaaactaggtcaagcaaaacccagagacagtgagtaaccataaaatccagaacgtgttactgtagataggcaaaagcaactgaaattagcagaatttgtgcaggaaatactgccaggaagaatgagagtgtggaggagccacagagtgatagcaggtgttgatgactgtcatcaggtaagtattctaagaaggaaagagccctgttttgagtgggagctaaactcaaatagggagtcattcctgggagaataggagaaagatgtttttgttcccataagaggcagatctcagaaagcacatcttttaaaaaggagagaaatgcattggaaggaaggggttgtatcccttggtggcagtatctagtgaggaagctggaggagctcagagatggtgcacgtgccattcctcgtaagatccaatggacttcacaaggtgcatcctgacaggcagagtcggattcctgcctgcactgtgcacttagtgcctgggatttttctccttgtatggagatgcggacaagttaacagcctgtgtggctcatctttgaccaatgggatacaaaagttggcaacacattcttccccttttctctgcctgggtgtgacctcttgaagtacagtttgtgtaccgctgtgcacttagaaatggcgagctctgttgcactcccttatattggctccctccgccctccatttctgttttttgttattgttgttgttgctattatttcttctccttattttcacttctttctgctttcctggaatcatacccctcaataaaatacttttttctgtgtctcatgatgatgtcttacccgtcatacctttattgtttttctgatttctattgggatttctttactgttccatggattatttaaaaatgtattgcttaattttcaagcaattgaagattccctagttgtctttttcgtttttagatttcacagccagatttctttcagagaataaaacattgagtacttttagtccttttagttttgtcatgacttgccttaggcccaacatatggttaattttggcaaatgttccaagaggacctaacaaaagtaagttttgccattgagtacaatgcaccttagagaacaggtaggtcaagtttattgttttttccacatctactctgtccttgttgactttttcttttactgtgtattctatcagcttttgaaagagatgtttttaaattacccgcaatgacggtgaatttgcctataagccttaaagctgtgattttagaagactatagattttggaatgtgagaccttcctggtagtttgaccttttcatagttaagaaatgcacaccatcatctttgtaataaggctacctgcgttaaagtctgctttgttattaatatagctacctcagcttatttcatttaatattgcatgatatatattttctcatccatttactttcagcctgtttttgtctctgtgttatgtatgtgcatctcttgtaaacagcatgtagctgtgttctttgttactgttttgaattcagcctgacaatcttagtcttttacggagtatttagttcatttttatttaatgtaattaccgatgtatttgtgtttgtattcatcaacctattttttttctgtttgactcagtttttatgtagctttttcttcctttgttgttattacttagctatttcaacatgcatcctttgcatattacattctatctaatgacttgttttaagaagagataattgcagtttgatttaaacccttaaagaagaataaaaacttcaaattgtttccatgaagtgagaatgccactgatatctaagtttgataaaaatttcacaaaaaaactatttcccaattttatttatgaatatcagtgcaaaactcttcatattattggcagaaaaaaaatccagcaactcattaaaaaagtaatcattaaaaaagtaactcattaaaaaaataatatcatgatcaagtagggttcattctaggaatgaaagattgtgaactctattaaaataatttatcatattaattggtctaaaaatcatatgttaatttctatagatgctgaatatttatttgacaaaattcaacagccattgtggatattttttaaaaagacaactcaataaaataagagttaaaacattttataaacaaggtgaactgacaaactatttatgctataggggcagaaattgggtgatccctttcttccccattataaaggtcacagcctacacacccttataacgaaagacagattaacaagagaaatgcatagcacatttatttgatcatagttttatgtgacacagaagccttcaaaaatgaagactcaaagactcagggtaaactatccattttcatactggtctttttggaatgtttatggagacttcattagctaggcatgattgaagcataaatggccaatgtagaactgtgcttggcaaaaacggcatgatctaatgttaatagacctggtagggaaatctcaacaaggcctgttcagattcttcttgccctatctatgcagcattccttcctcccaggtatgggatatggcccatctggaatgaagtcttaatttctttttggccaactgttacatggaaaggtcggggaagttgagagtaatatttttaggttttatgcctggctttggtgaaaaggggttctggctcctatgacctgccttgaggaagagggcttctagtttccgcagctctccttggggaagaatgaggctaggggaagaatgaggctgagaggagagagtaggaggtcagagagaaacttgcttctgagactgcttctgaggccttcattttgaaatataattttttgagccctgagaatgcacacaaacaaacagaaacacacagcacacaaacacacaatcttgtctcaaagccattttgtaatgaataacaaaacactagaggcatttctgcttattctgttaaaagtataaatcagataaggatgcacaattctcaaccctgctactgatgctgtaccagagattttagccaacaaagcagatacaagagacaaatgaagtcttaagctctaagacctaagcaggtggaagtaaaacctttatgtttctgtgacttaatatttcaaaaacccccaaataacctgtgagagtttctaaccattactcaattccagcatctaaaataggaaaaacagagataaatctgactcattaaaaaaattctttggtgggcaaaacacacacacacacacacacacacacacacacacacacacacacacacaaaaccaacaacaaaaaaaccctctggggaaattcaaaagaatgataaactgggaaaaatatttacttctccaatcaccaagcattttccccctaatatattaagaacttttagaaactggggcgtgtggggaagtacaagctatagagctgttggcaaagaacataaatgaacagtttatataaaaagaattgcaaatagcatttcagctcataaaaaagatattcagccccacataagacaccagttgttatttgattttatttaagaaatgagagaatataagtatatatttctaaatttgcttgcgttttataaagaaactttcaaggaagcacaagaatgaatagaaatggttgcctacagagaccagagtggagggacaacaaatagggtgaatgggacaggaattgaagcctaattcttacatacatactttctcatattgtttcattttttagccatgtgaatatattacttttatagaaaaatatataaaaatacaaatttgcaattcctttatttaaggtgaaaaatttcacctcttttgattactgtgtaagttgagttctttaaagtgttcatgtgctatttgtattttcatttcttaaaattatctgttcaagttctttatatttagagatatttttgttttgttgtttttttaaccaaactttataattccttaatatgttaaggaaccagtacattttatcatttttatttcaccttttaaaagtctggttatcctatcattttgtttattatacattaacttagagaaattaataattcttattttgtcagatctatcaatcttcctgtgttgactttttaagaaacattactatattttatttttgaaatgacacccaaatgctaaacgtttaataagaatcatatcaattttaaggaaattgattatcactggctgacctttcacttcaaactgccctctttttaataaaagcataaaacatttcaaagggatcatgacagtgtattttattttatgacctagtatttattttaatatatactaggtctagttcctctttattccttttctatttaaaaattattttcaccagtagatgtttttggatgaacttacggatcatagtgtcaagttcgcttcttatgtcaattcttatatgtcaatttcacttccaaatttcttatgaaataatttggaaaaatgatatttctgtaatatatagtttccatctaggaataaagtatgcttctcagattgtataattgttctttttgcctttcaatctagttttattgatttctttatatatttccatacattaccatattcattcctaactatggtataattttgttgctaacgtggattaggtaatttcccctacatattgatgagacatggaatgatgaatataagagttgttgatattatgatgtatatattttggtttctgtccatggtttctgtctcataactcccatagaccttgttatttcctaggtgactaaaacaataagtatatgtcttttgttaaagtatttagtcttttgttcttggtttctgaagcagcttccaaacagcttttaagtaataaaggtgaaagacagccttttgtcataatgttggggctctttagggctcagaagcaggactcagaaaacagaatctctctcagactcatcctttttatttattatttatttatttatttatttatttatttatttatttatttatttattttttgagacggagtctcgctctgtcgcccaggctggagtgcagtggcacgatctcggctcactgcaagctccgcctcccgggttgacgccattctcctgcctcagcctcccgagtagctgggactacaggcgcccaccactaggtccccgggcgtggtggctcacgcctgtaatcccagcactttggaaagccgaggcggtcggatcacgaggtcaggagatcgctccccaccttttaatttaaaattttcaattttataagacagggtctcactctctcagccagcctggagggcggtggcacaatcttggcccagtgcagccttgacctccgggactcaggtgatcctcccatctcaacctcctgagtagctggagctacaggtgcacaccaccctgcctggctaattttttgtgttcttttgtaaagatttagtttcaccatgttacctatgctggtctcaagctatctatctatctcagcctcccaaagtgctgggattacaggcgtgacccaccccacctggcccttctgcttccccccacttttttttttaactttctcctttttctccccaaggaaggccatagaaactaaaaatatactctcatcttcccccctttgtgtcttggagctggccgtgaagaaattgtctgattgtaagtcataagatccccatttctgaaggggtcctgcaccatacccaggaagaaggaatgctgcacagagaggccaagaaaaatctaaacagtccttgctgggttgccccactcagcctattcatattaggtcatactctctttgtccagtcatatttttacatgattgtccatgcttcaatcattcctatccaatgaattttccataagaggcccagaaagatagaatatgggagctcctgaacagctgaacttgtggaagcttgcagaaaggtgaagaagaactcatccacgtgcgggtgggtggcacatcccatttacacaggaatggaagtgcttgtgctcaggaccctttagacctcaccctatgcatctcttcatctgactgtttatttgtatttttaaaaatatcctttataataaagttgtaaatgtatttctctgaattatgtgagccagcctaacaaattaatcaaacccaaggaccgggctgtgggaactctgatttataactgatcggttagaagcccaggcaaaataacctggggcttgtgggaactgagcctccaacctgtgtgatctgatgctgtctccaggtagatagtgtcaggatgctatttccaggtagagagttgggtgtccactgcagaactgattgcttgcttgttggttaggagaaatccccacaaacttggtcacagaagttttctgtattgattgttgtggtgtgagagtagagaaaaaactgtttttccacccagcacctatggtttaattcatacctttttttttcactctgtatgccacttactttaaaaaaataaaaatgtgagtgtcttgtctggccagcaagattaagaaataagtttgtcttctgctttccggggctctgtttattcagttataggaaggaagggtagagttgaatcaaatattaattcttaaaacatcttttggttttttatttcttttataatgtgaggtaatgcggggtgtatttatttttttcttggtatcctaatgtatataatactttgaaagttgtcggaaccctctatggattagacatacatgcatagataaataagcatgaacatcactgtcgtcatctaccattagtgagcttatttatttaattctttctcttattttaattttctggtacaataggttaatattctgtgaaaaccaacctgacattcttaaccttttcatgggacattaaactttgactactgtcacagttagtaaagttccctttacagaaatttaatttgtgcattaaaatgtatgtatacaattatcttttattaacacattttacagttgtgattaaatcactgtataattttattaaaacatatgaaatgattgattttgagatagagataatacatagtgccacatatggcgggaaatacacgcacatccttgttcagaagtattttctttaggatggaaggccctttgagagagacactgcagctctcctgtgcctcagcctacctccctgggccaggtgtctctgatgtggtgggttcagcttcctttatgccacttggccactgcctcttcagtgcaagcctctgactctctcctcagctatcttccatgctccctgtgggttttggcagaaacttctggattccttccagagaagaagcttagatgagtgaactcagtctttctctctgcctacctagttttcacctttgttgtcacatttggtcgtttcttgagtgagactacccttcatgttggtatctgtcaggagtttggctgggttgttggggactaagcatgccaccaaatccactctcaatcccctactggtgtgtcagtactggatgagaatttagctcacataggtcttcctcttccttttttctctttgccttcccacccactagctgatatgccaacttgcatcacatcctttttctcctaagggcaacctcctgtttagcctccattgacaaatcatatttccattctctaccatggtagaaactcaatttagaccaactttcattttcatgattgaagccttaggaaagctagacaatagggatttacaaacaggagattacactggtttattctaagaggagcctaacttcgtgctaaaaacgtgaatgcaagacaggctgcctagtttcttgttctgggctgtcacttactagatgtgtcactttaggtaaataatgtaatttcttttttcctcagatttgtcatcttaatggcaatctgttacaacaactttataagaaagggattattttatcatcattttatgatgataatttaaatgtcatttaaaatgatgacaaaatagtccctttcttaaaaagttgctgtaacaaaaaattagttaagaacctaaaatagtaactgaaaagtaataaatatttggtatctgttagctaataccaaatattaggaggctaaatgaaaaatgtaaagttggaaatgcaggtgcctaattaagtgagactttgaaagtgcctggaatttagacacacaatgtagcaagcaacaagaagccttgaaataatttgagtggttgtgtggtgaaagtagtgttgacttaaattagttcattaggagtatattaagagtgagacagcgattgtatttacaggacttcagcctcaaggtgatgaaggcctagactaagttgttgcaaatagcagtggtgataaaagaaaacagaggagattatcagggatcagagagaggtgtgggcccagggtgtttctgagccaaggataatggctgcatcatgtagaatttagcagaaatagagagttaaaagaagagaatgttgtctgggtagaaaaattttgattttagatttattaagtttgaggcaataataggctattcaagtggaagtatcccaggggacagggattggcaaactttttctgtaaaatgccagatggaaaatatttcggtctttgtggaccagatgtggtctctgtcacatcttattctttgtatttttttttttaactattcttttaatatatatttaaaatgcaaaaatgtaggacaccaaaaaaagctgcaatctaacttggctcatgacagagccttgactgagatattgggtctagaaatctagattaatgttcaccgtgtggataatttgaaaactcttgagtaagcatagatgtacagtattctaattaagatagattattattgtaaattatataaatatttacattgaaagtgttttgcccagaaatagattttaccttattttttctgagccctgtaaagttactaaggacttccgtcaactagatataaaaatagattcaataaaattaataaaatttttcaaatgttgattaggatttaagaaaaatagtttcagaaaatttctaatttcataattctgtggaaattaatgcaaaataatgtttggcttactggatgtcacagaggctaaaagtaatctttagtttatgagagtatcatgatacatgatagaataagacaggctataagaattgtagccagctgtgctggcatcaaggaattagaatatttatgctttaactatgggattaaagggggttatagcctttcaaaattgacttaaataaaggcactatagatagaattaaataaaaacaatatgagttccttacttctgtccaaattaaccaaatgaatggcacaaactgaagaagtctcttaaactaaccataattaatgagtttatttattcccttaattcaagtagatcactagagtttaagtctattttcctaatggaatgttattgattttaagtttaaccaacatgttttgctttttacaacagatttatagaaatattcaatatttttactagtacaacctagaaattattttacttctttatttaagatgatatgtttcagataaacttttgaaatctatagagtattactttcatatatgtaaatgcagagtgcagattacagaaattagttttagattcaacattatgtcgaagttccagtacctttatacttgaagtgtttgagagaaacattggcaaattggagcttacatagaaagacacattcaggaatataacatatctaagtactaattcaagtgaaaaatagctaaaacaactagtatggagaagaaagacgttggagggtctgggctcatgtatgcattgcacaatggggtgagttgtgtatatatcacagttgtcttaaatatttaaaatggcagaagaaggagcagactcatttatctatccattcatccatccgtctaacaattcacccatcatttcatgtagaaatagccttctatatgctagtcttaatgtatatactagagacagaaagatgagtaatataacccctacgtaaagaagctcatagactaatgaggaatctcatattttgtgggaacacttattacttaggtaaaccattagctttcatttcctcctctctaagtccagataataataataatacataactcagagggttatctatgggggaaaatgaaattgtgaaaagtactacaaaaatgctatagaatgttagatgacatattattgactgagggatttctggataagagattactaactcatgttttctgaatctcgtgatttaaaattttgtagtaaattagttatgtgttgtgtgataaaccatataaaatttagtgtcttaaaatcacaacactttattgtttctcattgttttactggttgactgagtgattttctccctggtcttgtttgggctcattcgatatctcctcactcacctgtctggtgcctcggtgatggctgttgtgtgagccgctttcatcatgcagtttcttcattaggtagtccagctggattttcttacatgacagcagaaacagtcaaagatgtaacaacagaatggcaaggcctcttgggacctagagttggaagtcacacattatttttgccatatcctgttggtcataactagttataaagacataggacataaatcgtagctaggacataaatcatagctagcccagatttaaggggagggaagagagactccacctttcaatgggagaagtggcaaattcacactggagaagggtgcatgggatggaagagactgttgtggccatctttgcaaactatctaccacatatacacatggcaggtttttatttcccatttggtaaagtataagtagtctatttttctgtgtacagtggctaacagttgtacttattttgttgtgtgtgtttcaatcatcattactagcaaggaataatagtatgaaaaggcacagtttgagtccttctatatagttcatagtcattgttgtttgtaatcaaagaaatattgcagcaacttctaaccaataggttatgagtgaaggatttgtctgtctgtgaaaaaatctagtagtttgaaggttcttaattcttgttactttattattacactgtcttcatttttttagcaacaagaggtaaatttttactttactgcttaatatctgtcacttttattcctttataacaagaagataaatattttaagtcagttttcctcttatctaagtatataaccaatggttacagagcatggagttggggtgaagtgtgactttgttttctttttattttaatcaagtagtttcaatatcatttctaactagacagccttacttttcaaacaccgcaccgcaaagtattatgttgttgcattgatttatttctgttgttttgaagtctcagtgaatttataatttatatcccacactatcttgagggtatgtgtgctaaagcagaaaacacaaacttgtccattttggtaaaataagggtattctaaacttttgagagttgcaagaatcctactttgaaaaatattcagtctccagatgaactgtagactttaaatacgtaaaagcattataacaaagaaaaacataccagtttatagccaatgacgtatgttgatcgtagactctagctataggaatgcctttcattttcttgaaaatacaagacagtttcttatcttttgacttatagatatgttgccctctcaggttgaagcgcaccctactattcttttgatgagtgtctccctacctgtaagtcccagtttccatgtcacttcctccacaaagtcttctggccaggcacctctcttgcatgtttgcatagcaccctccgctaatgcctcccagtatcatgtagctgctgtgagcttttctttcttcctcactagactatgagctcaataaggagaggcgtgatgctgactttgaccatgtttataccttcacttcttagcacagcagttagaacattgtaatgggcaactgatatttgttaaatgaattaatttggggtagaatgtaataaaatttcccactttagcattttcattcagataaaagtacaatagaaaatctcatttttgaatcaggactcataattgtttggcattgaaatagaaaaaacatacaatgacctatcttttcattgtgtacaacagatcaaacattctgctttgtaagtatctaaatagtctctcattaaatggttctttatatgatcaaggatatgatttttcttgatttacttttattttgtagttccctagcaaattactatgggaattaaggtcacacaaatcaaatatctcaattatgcctttggtatcttactcatcactctcctacctactttgactatatctttctgcttcttaaaattttctacagcttccttttaccctctgaaacaataatgaacatattgccccactgttctcagagcgcttggctatcagatacaaggtattcgactgtatctgcctccggaacacacgtgaaataatgtatttattactatctgaaaatatatttcaactcaccttctgtagtttgccacctttccttaatttttgtccatttatatcatacatataaactactttattcattctgacagcagtagcatagatttcattctttttaatttcattatatggtttgtttcctccaaaaacaaacattctagttttttataccatttctaatattccagcataattaatgatctgctcttttcattcaacccatatttgtactttgatatctatgaattatttggaccagctaaacaatgtaagcaaattgaacattcacagcatttgatcttttttgtctgggtcttgatatttagaaagttcagctaaagttgatattaaagtgttaaatttgcagaagtttcaggtaactcttcagttgatctttactgaaataatgaaccacagcctagagcccttgtgcttttgtatgcttactaggattccataatttttaaggatatatagttggaaattttgggaagtggggatttggtttttggtttttttattctcaactgaagtgtagcatgtatacagatcacagtgtaggatgcaaatacagatcaccagacagaaccttctgtgtgctttgtggagtcatttgattatttgtgtagtatctcacatgagacttaattttaatttaaacaaacctgtaagtctgttcaaagtacagggaaactgaggtagaagtaataccctaacaattttgcagagaatttcagaaatataaaatgtgtcaatacaaaaattagccggatgtggtggcacctgcctgtaatcccagctactcaggaggctgaggcaggagaatcgcttgaaccagggaggcggagattgcagtgagccaagatcacgccactgcactccagcctgagtgacagagaagacttcacctcaaaaaaataaaaaaaaaagaaataaaaaatctctgaagtttcataaaataaaatgtttaaaggtacagtaacagcatattaatttattgctgtatgctaaatagtgtgctaggcatattgcacacaagattatgtatgcaatatgtatgcaatgtgcctcctaaaaattgttgattatttgtattattatctctgtttttcagcagctctggaagttaaataaattaccctatgtattagttttctattgctatgtaacaaatcaccacaaacttagagaattaaaataacaccattacttatatcatagttctgtagatcagaaggccaagcaggctggactgggtgttctacttggggtctctgaaggtagaaatcaaggtgtcagccaggctgggctcttagctggcagctggaaagaattcattatcaagctcattcaggttgttggcagaattaaattccacttgaacctcgaacaacatgggtttcagctgcaggtccacttatacccattttttaaaaataattatattgggattcttttggatatttgagacaatttgaaaaaaaaaaaccagatgaacagtgtagcctagaaatactgaaaaaatcaggaaaaagttaagtgtgacactattctggagatactagtctcttttatcattaactaccataaaatatacacaaatctatcattaaaagttaaaatgtatcagaatttacacatataaacacttagagttgacagaaatgtaaacaaatatatggaggcataaaattaattgtggtacatactaaactactgtaataatgttgtaaccccctcctgttggtaatgaggtgaactccagcactataagtctctgcataaaatgctctgtgatgctaatcaacctgtgtgagcagctcatctccagtaaattgcatactgaagtaaaaagtgatctcttgcagttctcgagtatttgttatagtgtttagtgtactaccataaaccttgaataacaccctacggcccacaggaagtgtcactagtgatgctggaagtgcttccaagaaacagaaaagtcatgacattacaagaaaaagttggattgcttgatatgtaccataaaatgaggactgccactttgattgcccatcatttcaagatacatgaatccagcctaggaaaaggaaatttctgaagctgtagctgcagctacaacagcaggtgcaaaaaccttgcacattttgtgaaatacatttgtatctcatatcgaaaatgtagcttttatgtgggtacaggattgctatgagaaagtcatacctatagaccaagagacagcatactagtttcctagacaccattaaaaatcattaaatagaaaggatatctgcctgaacaggtttttaatacagacaaaagtgtctactctggggaaaaaaagccacagaagacatttattagtaaaaaatagaagccagcaccaggaattaagctggtcttttttgtctgggtcttgatatttagaaagtttttaaggcatatttagaaagtttttaaggcatatttagaaagttttaaggaattaaggcaggaagggataggctaactctactgttttgtacaaatgcagtcaggtttatgatcaacaccgccctcatctataaagctgctaatctaagagccttgaagggaaaagataaacaccagctgccagtcttttgcttttacaagacaacctggacaatgagaagccctattctgcatttgttttatcagtgctttgtcaggaggtaccttgcaagtaaaattcttttgattttggacaatgcccttggccacccagaactccatgaattcaagatcgaaggtgtctaagttgtctacttgatcccaaacacaacttctctaattcagcctctagatcaaggggtcataaggactttaaactcattacacatggtactttatggaagggattgtcagtgacatgaaagagagccctgatagaaaggacatcatgaaagtctggaaggatcacacaattgaaaatgtcgttgttattgaacaagccatgaaggccattagcccaaagcaataaattcctactggagaaaactgtccagatgttgtgcgtgacttcacaggatttatgacagagccaatcaaggaagttatggatgagattgtaggtatggcagaaaaaaaaaaaaaagatggggtaaaggatttcaggatatggatcttggggaaattcaagagctaatagaaaccacaccagaggaattaacagaagacaacttaatggagatgaatgcttttgtgccagtgccacactatgaggaagaagacatattataaaagaagcagtgccagaaaacaaattgacattagacaatctggcagaagggttattgttattcaaggctactttcaacttctttcatgtcatggacccttctatgatacaggcactgaaactaaagtgaacagtggaagaaagatgctaccacatagaaatattttaaagaaataaagaagcaaaagagtcagaagttacaatgtatttcctcaaagttacaccaagtgtgcctgcctctcctttctccccttccacctcctccacttcttctgcctctgccacctgagacagcaagaccaacctctccttttcctcctcagcttactcaatttgaagacaatgaggatgaagacctttatgatgatccacttccacttaatgaataataattatgttttctcttaggattttcttaataacatttttttctccagcttgctttattgtaagaatacagtacctactacatatgaaatacattcaaaatatgtgttaattggctgtgttatcaataaggcttctggtcaacagtaggctattagttttgggggagtcaaaacttacaggtagatttttgtctttgccggggatcagtgccccagcccgagttgttcaaggagctgtacttgcagttgtaggagtgaggtaccagttttcttgctggctgtcaacaggggctgctcaccactcctggaagctacctgtgctccttctcatgtggctcactcacttcaaaccagcaatggcatgttgaaaccttcttatgatttgagtctttctggctttcccttctcctaccagccagataaagttctctgcttttaagggcttgtatgattagattagtcaccccttctatgtaaaatctctctatgttaaggttaactatgccatgtaacatgaaacaatcacaggagtgatacgttgtcacatgcacagttagtgtgagatattctgtgggagaaggggcataattctgcttaccatatcatattgctcaaaacagtaattggcagagttagaggtcaagcctgggtttggttgaactccagagctttgtctctataccacattcatcagagggcctaattttatctgtggtgatatggaaaccagtcttagtcctatatagctaggctatgttggtcccatatgctgctataaatatattgcctcagaggtctccagcacagttttacatgcacactggtcctgtaaaataggagatccagatggtcagaaatgcatacgttaggttttgttatgccccatatatttctgtgatttgcacttgtgtttattagtttattctgccctattttattacaagctttgatttctactttctaccctttctcccttctgcttaccttatgaacgtacttaaaaaacttggttaactaagagtcaggcttattgcagtttcttttggaaattcgtagtcatatttttttttctgcttaattaaatccttttcagaggtaattgagttgagtgaccataatgtgctaagggaactgcaaaagataacaaagtcaatcaagagaaatcccttacttgatcatacaaagctatcatttaactagggaccccatggatttttctgaagcagaatatttgatctggtgcacacaatgaaaaaaaaaaaagcaaatgtgtgatttcgttgattttttttttttttttgacagagtctcactctgtcactaggctagagtgcagtggcatgatctcagctcactgcaacctctgcctcctgggttcaagtgattctcctgcctcagcctcccgagtagctgggactacaggcacgtgccaccacacccggctaatttttgtatttttagtagagacagggtttctccgtgttggccaggatggccttgatctcttgaccttgtgatccgcctgcccaggcctcccaaagtgttgggattacaggtgtgagccaccacgcccggcctcattgattttaaataacataaacaaatatatgccgtatatttcttaggttgttaagtgtaacatattttgagataactattaatttctttgttaacagcttttgaatcttgtttgcttgcctccattaagaaaatgacacagtcttctttttcctcatgactcaccaggccagagacagcctcccagattacaactagctcagtggtattaggagcagtatggattgtgtatgaaacaaagtccaacttttatttactcaatgactaagtaatttgggacaagtcactagatacagctggacctccttattctcaattataaaaataagcaagccgttccacagttctattattttaaatgacatctgctatgatatactttgcttagtatccaagaggctggaaatatttaatttattttagtttgaccactaagaaatttgttctctggatctcataaagacatggaaacattttacaggtgaatatgtgtaaatattatagtaaaattaatttgaatactcatggggcttgtcatacttaatcaagttataagattattttccttctttacacaataaaattatttctttggtttcaattttttgtatactcttgtgatctcaaaggtgttccttttattctctttcttttatttaaccagaaatatcttttattttgaatgctattttgtcataattcatgcatgattgtgcttactttaaatgggacatgattatttctgctgtctaggatacatgaccaaaatattaaaaaacagataattgcagattatggccaacatggctacacaatgtcttagaaaagttagttttgcctttctttgtgaaatatattgcatgaaacactgatgttatcattttgatggattctccccaaaattgatggcctggtttttacaagtcaaagcatctacatattttaaagtgttaaagaaaattaaatgaacagttaaattagaaatggaggatgagctataacttctcttcctagaagggaggacattatgagcaacatgcacatagggagtgatttttctggcaataaagtttggaaaatagcaaccaaaacagaacaaaactattcatgttgtcattcagtacgtagagaacaaaaagtttccactatacaagaacctatactactatatatttgcaatgatgctttaatgcaggggaaaacagctgtttatctgtttttcttttggttttattttctttttaccttgccatcctgtcagtacgtggcttcataaagctgtaggattctgatagggaaactaccgattccatgtgctttggaagccaatgtgctgattatctagcttgatagcagtattttattatagctggagggaaagtgtggctatgtttgtgagaggcaggaaggcaaatgccaccaataacgtgtccagaagtgagctatcccctgtgttttatgcacttcattctactgaatgaatattgtatcactgttttcatttttttgtttgaatatcagagacttttccaatggttctgtttctgtcgaacacttgatggaaagccctgttgtaaagcttccttcatggagatggctttatgtcttggctataaagtaaagttccataaatttgatcagaaattgtctttatgggttgccaccctgtgtgctattaaaagctcagaacctgggtgttagttttcactcagagctgtgcttgccttttgtatttggcaagtgcagctctgagttaaaacaaacactttcctttattttaccactttcttcctacagaacatctctcccaccagcctcccttttggggctcaatagtcttgttcaacccatctttactgtacactagagccaagttctttgggtgttttcctaggatatttgcaacatcaaggtcaaaatgttctttatattcaacaattcacctctttcattaccctaggtagagctcctcagaagtacttcccaccaaggagtcctcaataaatattaattatacattttggagagatttgtattgcaatgaacatgcttcagtgccagttcttccttactaaaactttttgttctccacttacattttgtggccatgtcatcctggctttgtatccttacctgctgacgtctatatattcagcccagccaatatgcatttatattctctctgtagttctgagactcattaatggtcctcttttaccttaattgagtacagtctgagagagtgcctgtcttccattattgtacatttttcttctcacagaacaccttttgattcttgctctgatctcttatataagatgcgctgtgaaacataatttccttccttcctcttttttttctaataagttggcatgtttaattaacctgtgtaaaaaaaaaaaaagagagaagacttttttaaagggtaatagaagtcatagtaatattttgctttgcctgaaaacagctttctcagtgtccaaagggattctaaactatacatgtatttcttcacatgcattatttatttaaaaataaataaataaaagggtaagtggcagtccagacaggctgcttcactgtgtcttgatgcctcatgatagcacaggttctagaatgccatgagtgggaaaacaatttctttcatcttttctgataatgttgtttgcatgatgtaaatattcagttctagcatgacagtgggtacctgagggaatttaaagtgaaataacaggattgttaacaaattttcattcccatataatttatgtttcatatatttctactggaaaactaagaaaaaattttttcccaaaggcaattattttgcaaggcctttttaccctattataagactttcttttcagttaataacccaaagtgtctcttcagatgcttaagtcaagtcgttaattggcttgactaagtggttgttggtgcagaaagcttattctctccgttggttgtatataactcacagacattaaatgacccactttgttgttcctaaggcaaagaatcattattttctttcggcagtatactgtggacttttaattcacaaacttatagctcaggttgaagtaatttctgctgagaagtgatttttctaaacaattgtttaatggttttgatttggagtaaacattagatgcaacttttgagctagtatactctactgtagagatcattaatgtaaccttttgtttttgtagcgtgcctgtctcccttcaaaaattgtttattctaaactgtgatcttttttctaaagatttgtttaaagttaacaaggtaagtataaccattaagttcacatataaatgattaatacacaaatattcagctttgttctctgcataaatatctacctctccttaaattaaaatttgtaattgttgaaagaaaatttgaatagtaggaaaattttacttaatgatgtctaactgtgaatttgctttgctgagtgggaaatagtgatcattgaatctcataaataactttacctagagttacataaaccttttgaccaaaattatttaaagaataaagtactagctagaatatatctgtcagaaagtcactactacttacttctgcatgtccataacacacataagtaatatatacagtcacattaaaaaatgtgccaactctataagaacggagacttttttctctttagttctctcagtggcacatgaacacatgtacatacatgtgtacacatacacacacaatggaaagccaacactgaaaccttctctggggagttggggaacgatgagagacaatgtggtataataaaaacaatagggggaggccgaggcgggtggttcacgaggtcaggagttggagaccgtcctggctaacacagtgaaacccggtctctactaaaaatacaaaaaaaattagccgggtgtggtggcgggcgcctgtagtcccagctacttggaaggcccgggaatggcatgaacccgggaggcagagtctgcagtgagccgagatcacgccactgcactccaacctgggcgacaaagcgagattccatctcaaaagaaaaaacaaacaaacaaacaaaaaacaataggggctgggtgcggtggctcacgcctgtaatctcaacactttgggaggctgaggcaggcggatcacgaggtcaagtgatcaagaccatcctagccaacatggtgaaaccccgtttctactaaaaatacaaaaattagcccggcgtggtggcaggtgcctgtagtcccagctactcgggaggctgaggcaggagaatcacttgaaccgggtaggtggaagttacagtgagccaagatcatgccactgcactccagcctggcgacagagcgagactccatttcaaaaacaaacaaaaaacaataggctgggcgcggtggctcatgcctgtaatcctagcactttggaagggcaaggtgggtggattgcctgaactcaggagtttgagacccgcctgcgcaacacggtgaaaccctgtctctactaaaatacaaaaaattagcctggcatggcggtgtgcacctgtagtcccagatactcggaaggctgaggcaggaaaattgcttgaccctgggaggcgggggttgcagtgagccgagatcgcgccactgcactccagcctgggtgacagagtgagattccgtctctaaaaaaaaaaaaaagaaaaaagaaaaaaaaacaatagtggactgtttctcctcttgtttgttatagtaactgcactgtgcgaacctggaacaagtcatgtaataacttttggctcacttttatcttgtccatatattaggaaaacattctcaagtgtaatttcacattattattagaataacagttatttgaagatggagatgatgttaaagatacagaaaagagctttaggtcggggagagagcagtacagatgttctggggaaaaatggcattgctcacatctacttttatctacagcaaggattctaaagggatttataacccaaacatattgcgaatggatttgtagagagattaataactagctttagtagacaggctgaaatgtagacacaatatgaatacttgatacatagcagggttttcttcgccaaaaatacacttatggaagcaacagtaacagagagtgctacaatgcaggtgaaagaccctgttggggatatgtgttggagaagctgggagatttcatgctatgacctcaactaattacgacccagcctgtacccagacagctaaaaattaacacagaagtttagcatgtaatcaactataaattctcactcttcagtactcagtagtcttttttttctgttaaaagattgaccactgatgaccaggaattgtaaatgaatttattcaagtagaagggctatttatcagattaggatcttagtttatctaataggtaaacgactggtctgagtttttatactagctgatgttaaaaagtgatgtgtaaattttttttctcttcagttatgtatttaattactgactaatccctgtcaagtataattgttaggcagcatcactgtctaagaatctaaagtgatatcccattgccgagcaaatcatatcagattcctccgtttggctttgaaggacacatgcaatctggcttcaacctgcctatccacatgtatttcctttgacttccttcaatacttttcattcagtggcacctcttaggttttctcatacttgctattattatttatgctaggtctatattagcttggaatatcctccttctttctattcaaactttatccactcttcaaaactaacctcaattaccacccattccaaggccttctccatttgcagcagtgttgattcagtattatttattatttattttttcatttattcacaataactcaacaaatattgagtgtcttctatgttacagatgctgtcctcacctaaacatgaatttttattgcatgtagagtcataaccaagtagtatactgagtttgtagtttaatatttattgtatctcctctataaaactgagcttacagtggcagtgattatgtcttttttttttttctttaacaaagaggtcatgaaatagtgtaagtcaaaaccaagtagggaattacaaggctgatttgtatttcctcttggctactacttagtcattcgatgattcaaatcaatggacatttattaaacttctgtcatgtacgttgcgatgttatacactataggagatacatagacaatcacttaatagagtcagtattccaaaagagagagtctctatttgaggtcctaggacccccctagagaattcaatgttttaacttcagaggattttatctaaagtttggatatgtgcttatatgcatttttctgaggagagggtgcatagtttttagatgttaaagatgtaattgataattttttgaaaaggttgaaaagctcatgatctcagtatgtatgaaacaagtacacaactaaagaacaagagtcataaaagagcaacaaaccctaagctgtgtttagaaagaggtaaaatgatatctgactgtggtcatttaaggaaaaacttcctgaaagagatgacttttggaatatatgccatgcattttttggcctcagctccctcatggaaaaaaaggtagattataaaatctctgctattttttccgagatacaaatttatttcttgattcaatcaccaagtgctcttcagaatgccagtgacatcataggtactcagaaaacatctgttaattggtaaatctgaaattaaacttcagaaatttatagctacaaatatatctattgagttgaaattttagaatattattgcattagcttcctaatgttccatgaatgaaaagatttatcagatgtttatataccattaatcacaatcttccacttggcagatcagaatgtttaattcattatttctccttcatttcttcataacatttaaaaatatctttgtattttgttattcttactgttacagccattggggtcgcctcattagtctttatgatttgtaggggcaggaactctcttaaacctgtttgatattatttagaacctagcacatccccctaatcaaaaaggggcacagtaggctgggcgcagtggctcacgtctataatcccagcattttgagaggtcgagacgggcagattacaaggtcaggtgttcgagaccagcctggccaacatggcgaaaccccgtctctgctaaaaataaaaaaattagccaggcatggtggtggtcacctataatcccagctactcaggaggctgagggaggagaatcgcttgagccccataggcagtggttgcagtaagccgagatcatgccattgcactccagcctgggcaacaagagcaagagttcatctcaaaaataaataaataaataaataaataaataaataaataaataaaaaggtgggagggacacagtaaatattgaatcataaatgaaaggctgcatatcaaggtgcatcaaaataataaatttcctatttcattatcgtccagaatttaaagagcatgagcccagaagtgagaccacatgttcaaatcctgacactgcctactcctctgtgagtcacctttgacgagttccttaaattcgtcattctcagctttcttgtctgtggagtgtggtaatgacagtgcctacctcatacggttattgtgagcgtcaaatttagtgcttggcaaagtgcctaacacatcataggcaagagagaatccaggttcgtagggcctcaagcttttacagtgtctgagctctctttaagaaaatgaatttcaaactatgaattcaaaattagctaattagaacattttaaaggtatgtctgtagagtgggaaattataggcaacaaaggtctgaaaaataccccagttatcatcaaatattattgttactagtaatttcctggttcattataatactttattttctacacatttttagatgcatacactcagatttcctttttcaaataataattttaaatattttctataaagagaatagaaagaaaattcattctttagcaaaggggattgaaatttattaattttttattgttgctggtttaggaagtatttatttacttaattcataacatattactggaaatgccacattctgacttcctccctggctttttgcccaggaagttcattgtttggaaggaagccttagagaagttcaggttttgggtctcacttggcatggtctcagacaggccagtgccttggcagtggctccatcctggcagcctcctcttgattccccatcttcatccttgtaagcagggcaggtctttctgtgagagatgaggggaggaagtagaaagtagccaagagcctgggagatagtggtgacaaagctttgcttttacattattagggtcacaggtaaggtccaaaatctccctgaagtccactggggttaggttgtcattgaagtgtagatagatttaaggaaatgctggcagcctgcctgctgacagcatctgctgcaaactcaggatgatttttaggaggtagaaggtgaggacaggctaggaccactctccacacctccactaaaggcctgaggctattacttcctcaatataggcagtgcaggtgaggagctctgaagcctcaactccattaattccatggtaaagctgcttctgacttgtaagtgctcagtaaattagcacttacccgaattgttttactctttcattggcaaattatttttcattaaaaccctaggaattttgcagtgaatgcctttttaaattttattttatttttaaaaaatttttgcaataattgtgtttctcctctttattccaaacaggacagaattctaaataacccagccttttactaaagtgaatttgaaatgagttgtgatagagcaagtttgtttaatacctcatgatcatgttaagatctaatcatattgagaaaaaaatgccatattcatttcattcttaaatatcatttctagtggataccgttctgtgtccctagatcctttcagagatgaagaatttgttatcccagttgttgggagtgctgcttgctacttgtcaagacgacagttctctctgggacaagttctttttgtgcaagatcacagccactccctaagggcagcttacacccagcgtttctttaataggagtggagtagggttgtttacaaaggccctggtctagtgcaccccctgaaggatcatcctagcttcagagttccacaaagtctgcctagtgacagaatagtgaccttacttctccaccctctgaccaatttacgtatcctcccttccctgacatgtagtgaccctgaaaactttttccagtataccttgtgtacataaaccagtctcagagtctcattcttagagaccactacctgaagcattttcaaaattttcaagaggcaataatgtgttaaataacagcttctctggggatgagggaggagatcgctttaaaaacgtgatccaattccagaaatgttcaagttgaaaaaaatcttacattcaagaaagtgtgctatcagagtatacaagagtgctataattgctgtatgttagctgtgaccaataacctgaagcaattagaagcctttcactgaagccactatctatagaaaggttaaagattgttgttctttccttttctcagtggaattttctctttatatgctcttttggcttgatctctttggaactcatggttttagaccattgcattatatatctctagttctgccatctcttgagcttctaatttacatattcatctgtctgccagagtccttttgttgatatcccaccagcctcccaaacttaacatgtacaacactgagttaactttccctcagatcagtcctgtcttgtttacagtttcaactagtggccccactgtgtccggaattgatgggttcttggtctcactgacttcaagaatgaagccgcggaccctcgcggtgagtgttacagctcttaaggtggcgcatctggagtttgttccttctgatgttcggatgtgttcggagtttcttccttctggtgggttcgtggtctcgctggctcaggagtgaagctacagaccttcgcggtgagtgttacagctcttaaggtggcgcatctggagttgttcgttcctcccggtgggctcatgggctcactggcttcaggagtgaagctgcagaccttcgcggtgagtgttacagctcataaaagcagtgtggacccaaagagtgagcagtaacaagattaattgcaaagagcaaaagaacaaagcttccacagtgtggaaggggacctgagcaggttgccactgctggctccggcagcctgcttttattctcttatctggccccacccacatcctgctgattggtagagctgagtggtctgttttgacagggcgctgattggtgcgtttacaatccctgagctagagacaaaggttctccacgtccccaccagattagctagatgcagtgtccacacaaaggttctccaaggccccaccagaatagctagatacagtgttgattggtgcattcacaaaccctgagctaggcacagggtgctgattggtgtatttacaaaccttgagctagatacagagtgccgattggtgtatttacaatccctgagctagacataaaggttctccaaggccccaccagagtagctagatagtgtcgattggtgcattcacaaacactgagctagacacagggtgctgattggtgtgtttacaaaccttgagctagatacagagtgccgattggtgtatttacaatccctgagctagacataaagcttctccaaggccccaccagactcaggagctcagctggcttcacccagtggatcccacactggggctgcaggtggagctgcctgccagtcctgctccgtgcgcctacactcctcagcccttgggtggtcgatgggactgggcgccgtggagcagggggcggtgctcatcggggaggctcgggcctcacaggagcccatggagggggtgggaggctcaggcatggcaggctgcaggtcccgagccctgccctgcaggaaggcagctaaggcccggcgagaaatcgagcacagcgctggtgggctggcactgctgggggatccagtacaccctctgcagccgctggccccggtgctaagtccctcattgcccggggccagcacggccagccgtctgctccgactgcgtggcccaccaagcccatgcccacacggaactccagctggcccgcaagcgccgcacgcaggcccggttcccgctcgcacctctccctccacacctccctgcaagctgagggagctggctctggccttggccagcgcagaaaggggctcccacagtgcatcggtgggctgaagggctcctcaagtgccgccaaagtgggagcccaggcagaggagtcgccgagagcgagcgagggctgtgaggactgacagcaggctgtcacctctcaccactaccctgacatttcaaataataaaacctattagtcatcctagattctttcttctcccttgtcctgcatatccagacagccaacaagacctgataattttcctatgaagtattattccaatcagtttcctctttgcaactcctattgctactttctcgatttaggttcttatgcggactactacaataataattgacttgttttcctaccctaagccttgcttcctttaagccctctgcatagtggtccagatactctacatcaaatacaaattcgatcatgccattacatgcatgaacacaatgaacagcaacttctcctgtcaagaaagactctccatgacatactcctatttttttcattttccatattaccgccactccctttatccaactttatgtgctagtaaaattgaactgcttggagtttactggtgtgcttcatgtttcatgcctctgtgccattgcccattatttccactctgccaggaaagcgcttttcttctgtattagattaactttaatcattcctttaagatgatttatttttatcatctctaggatgtttcttgcatctaaaaatcctataatactgtattaatcaattttcatactgatataaagatactacctgagactgggtaatttataaacataagaggtttagttgacttgcagttctggggaagcaggcaccttcttcacaaagtggcaggagcgatagaacatgcaggagaaactgccaattttaaaccatcatatctcatgagaattccatcactatcatgagaacagcatgggggaaattgcccctatgatccaatcacctcacaccagattcctccctcaacatgtggggattacaattcaagatgagatttgagtggggacacaaagccaaacattatcattctgcccatagcactgcccaaatctcatgtccttttccattttgaaaccaatcacaccttcccaacactcccccaatgtgtgaactcattctggaattaacccaaaagtccaagtccaaagtctcatctgagacaagataagtcccttctgcctatgagcctgtaaaatcaaaaacaagttagttatttccaagataaaatgggggttcaggcattgggtaaatgttcccattccaaatgggagaatttggacaaaacgaaggggccacaggttccatgcaagtccaaaatccaacagggcaatcattaactcttaaagctccaaaatgatctcctttgactccatgtctcatatcctgggcaggctaatgcaaagggtgggctcccaaggccttgggcatccctactgggtctgcagcatacagtccctttagctgctttcatgggctggcattcagtacccatgggttttccaggatcatattgcaagctgtcagtggatctatctttctaggtctggaggtcagtggctgtcttctgacagctccattaggcagtgcctcagtgaagactctgtgtgggggctccaaccccacaattcccctccaccctgctccagcagaggttctccaggggctttgcccctgcagcagacttctgtgttgatgtctaggcatttccatacatcctctaaaatctaggcagatgctcccaaagctcaattcttgtcttctgtgcacctgcaggccaaacaccatgtggaaaccaccaaggcttgggacttgcaccctctaaagcacggcccaagctgtgccttggtcccttttagccacagctggagctggagtggctggaacacagggtgccatgtcccgaggctgcacaaaggagttgggccctgggcctggcccacaaaactgtttttattttcctaggcctccaggcctgtaatgggtgtggctgccttgaagatctctgaaatgcctggagacatttcctgcattgtcttggcaattaacttttggctgtttgttacttaggcaaatttctgcaggcttgaatttctccacagaaagtgggtttttcttttctaccaaatggtcaggctgcagattttccaaacttttatgctttgtttcccctttaaacataagttcaatttcaaactatctctgtgagagcacataaatacactttcaggaaaagccaggtcacctcttaatgctttgctgtttagaaatttcttctgccggataccctaaatcaactctctcaagttcaaagttgcacagatctttaggtccggggaaaaatgccaccagtgtctaaagtgacctttactccagttcccaacaagttcttcatctccatcgaagatcatctcagcttggacttcattgtccatatcactatcagcattttggtcaaaattatacaacaagtctctaggaagttccaaactttttcacatctgcctgtcttcttctgagcctccaaactgttccaacgtctgcctattacccagttcaaaagtcacttccacattttcaaattatctttgtagcagtacccccatctgccaattatctgtattagtccattttcacacttctacaaaggtactacctgagcgccactgcacttcagcctcagccaggggaacagagcaagactccgtctcaaaaaaaaaaaaaaaaaaaaaaaaaggatcctacctgtggctgggtagtttataaatcaaagaggtttaactgactcacatttctacgtggctggggaggcctcaggaaacttacaatcatggcagaaggcaaaggggaagcaggcaccctcttcgcaaggtggcaatagagacaatgcaggagaaactgccacttttaaactatcagatcttgtgagagctccctcactatcccgagaacagcatgagggatactgccttcatggtccaatcaccccccactgggtccctccctcgacacatgggcattacagttcgagatgaaatttgggtgggaacacagagccaaatcatatcaaatactatgtgttgcttatctataaattcctaaaggacaggaaccatgctcattcacttttgtaaccatagtgcctgacacatacgggatattcagtaaatatctgctgaacagaactgaataattaacactaataggtccctaaatctctttgcacttactgacttatttcttatttggtatattatcaatttttccatgattgtttctttaaaaattaatgaatttatgatttatttatacagtaaatatttattgagtggtaattgtatgaaagatacttctagatagtgggaaaacaagaataacaaatcagtattaaatgatttagatacacatttgttggataaataagacaatttcattagtcatttgaaacaaaaaaaattagtgagcccatactctgttccaggcactactctggaaggaagaaaattctgggaggagaggaaggaggtagcacatatagactatttttaagagttttttgattgtactgaagacagaaagcttaggcagtagttggaagaattggtgaggtcaagagtttttctatatgagagaaataattgtatataggtattactgatatgaatgatccagcagtgtcagaaaaactggtgatgtgggagacagtgggttcaattaatggaacaatggtgttgagaaagtttaaaaaggcaagtatttactgcaccaatggatggttttaccttaggtagtggcacagtttatctatggttgtaaagggaaaacagagcagatggacacagatacaaggagatggaagatgtggaagtcctctggtgagtcctgttttctaggtgaaataagcaagtgatcatccacacgtgaacgtggagagtattggtttaaggaaaaaagagaagcagagcgatagtcacctgagaaaattactggactattaaatgtaataaaatagctgggcattattaagggttggttctcttgaggttagagatcatgaattgaaagtgagcttcaccattcaatatatggtatttctccaggtacagtctgatgcaggggtaaggtcacagcaggcagagaggtgagcttaaccaggtcagatactttatcaagtaatttcaatgaaggaaaaaagaggcagtgctgttgaatctggttgcaagggaggtggtacatgcttatatttaagatcatggaaggcctgcaatagaaataactggagaagcccagggctcaattcttagaccgtctttttcctccttcctttgctaggtgatctcatccagccttgaggccctgcaaatcatcaataggcaggtgtatttcaaatttataactccagcctggacctctatcctgaaatacagcccccttctcaacatcttgataaaattggatatctaagaggcatgagactttcaaaaaactctggacttttcccacagacctggtacttccatggtttcacccatcttaatagatggcagccctgctcttttggtatctcaagccaaaaccttcagagccatcctttaggcttccatttcaaatgtaatatctaattaatcagcaaatcctacaccatcagaatatacccctctctccatgtccattactatttactttggattactgtagcaccttccaatttgtctccctgtgcccatgcttgtccacacaaatagttcctcaatatggtagccctggtgtgctttttaaaatttaacccaatttattttctccccactctcaacatgctttaaatgggtttcccaattaagtcccaggttcttacctgatggcagccacccctatctaattttaactttatactctttggccaacttctcccaatccttctaagcctcttctccctagtctctcttctgctctgcttctatgaaaccctttttttttttttttttttttttttttaagattccacatatgagtgagattatgtagtacttgtctttctgtgtctggcttatttcacttaacatgatgtcctacaagttcacatgttctcataaatgacaacacttcattctttttatgactaaatagcattccattgtgaatatatatcacattgtatttatccattcatttagttggagacttaaggttgtttccacattttgggtcttggaaatagtgctgcgataaacatgggatttcagatatctctttgatatatttatttcattttctttggatgtatacccattagttggattgctggatcctatggtagttctgtttttaattgtttgaggaacctctatactgttttctctaatggctgtgctagttaacaatctaaccaacagtgcataagttgtggcctctcttcacacccttactaacacttgttttgtctttttgataattagagacttttgcccatttttcaagttgtattgtttcttcaaatttgagttgtttaaattcactatatattcaggatatatacactatatattcagatgggtagtttgtaaatattaatattttctccttttctgtatgttatctcttcactctgttaatagtttcctttgctgttcaaaagctttttcatttgatataatctcattttcctatttttgcttttgctgcctatgattttgaagttatttaaaaattatctttgccaagccaaatgtcatgaaacatttcccctatattttcttctggtagtttcacagttttaggctttacatttaagtatttaattcattttgatttgacttttgcatatagtctagtcttatttttctgcatgtgatgatgcaattttccagcaccatttattgaaagactgtcttttacccaatatatattcttggcacccttgttgaatatccgctgtaggcatgtgaacttatttctgggttttctacgctgttaaattggtctatgagtctgttttttatgccagtatcatgctgttttggttactagagctttgtagcatatttcaggtagtatgaagaacctcctacaatattctttttgctctgaattcctttggctatttggggtgtttagtagttccacatgaattttagaatttcttttatatttatgtgaaaaatatcattggtattttgatacgtattccattaaatctgtaggttgctttggatagtatggtcattttaacaatatgaattcttctacttcatgaacactggatagctttccattttttcagtgtcttcacattcgttcagaaaaggtttataggtcttagtgtatggaattttattactttctatttttatttcaatagatttttggtaactggtttttggttacaatgataagttcattagtaaggtgtaaggtggtatctcattgtggttttaatttgcatttccctgatgattagtgatgttgagcattttttcatatgtttgctggccatttgtatatcttcttttgggaattatttatttttgtcctttgcccactttttgatgtgattatttgtttttttcttgctgatttatttgaggtccttgtacgttatgaatattagtcttttgtcagtacatagtttgcaaatattttctcccaatttgtgggttgtccatttactctgctgattatttctcttgctgtgcagaagctttttagtttaatgaggttccatttatttatttttgtttttgtcgcatttgcttttggggtcttagtcataaattctttgcctaagccaatgtctagaagttttcccaatgttgtcttccagaatttgtatgctttcagctcttagatttaagtctttgatccatcttgagttgatttttgtataaggcgagagatgaggatccagtttcatccctctatatgtggtttgtcagttttcccagcactatttattgagtaggatgttctttccccaatttatgtttttgtaaactttgacaaagatcagattgctgtaactatttggctttatttctgggttctctagtctgttccattggtctacatgcctattttcattccagtactatgctgttttggtaactatatcctcgaagtgtgatttgaagtcagataatgtgatgcctccagatttgttctttttgcttagtcttgcttttgctatgtgggttcctttttggttccatatgaattttaggattgttttttctagttccgtgaagaataatgatggtattttgatgggaattgcattgaatgaccagattgcttttggcaatatggtcattttcacaatattgattctacccatccatgagcatgggacctgtttccgtttgtttgtgtcatctatatttctttcagcagtgttttgtagttttccttgtagaggtctttcacctccttagttaggtatattcctttatttttttttcagctattataaaaggggtcgaatgacaattcaatcgatgtcttctttaccaatttggatgccctttatttctttctcttgtctgattgctctggtcaggacttccagtactatgttaaatagaaatggtgaaagtgagcatccttgtcttgttccagttctcagggggaatgctctcaatgcttttccattcagtattatgttgcctgtgggtttgtcatatatagcttttattactttgaagtaagtcctttttatgcctattttgttcagggttttaattataaagggatgctggattatatcaaatgctttttctgtgtctattgagatgatcatatggtttttgttttcaactatgtttatgtgatgtatcatatttattgacttgcatgtgttaaaccatccctgcaactctggtatgaaattcacttgatcatgatgtattatctttttgatatgctgttcaatttggttagctagtattttatgaaggatttttgtatctatgtttaacagggatattgttctgtggttttctttttttgttttgttctttctgggttttggtattagggtgatactggcgttatagaatgatttagggaggattctctctttatcttttggaatagttttagtaggattggtaccaattcttctttgaatgtctgatagaattcagctgtgaatccatctggtcctggacttttttttttgttggcagctttttttattactgattcaacctggctgttagttattggtctgctcagggtttctatttctccctgatttaatctaggagggttgtatattttcaggaatttatcaatttcctgtaggttttcttgtttgtatgcataaagttgtccatagtagccctgaatgatcttttgtatttctgtggtattggttgtaatatctcttgtttcatttctaattgagcttaattgaatcgtctctcttcttggttaatcgtactaatggtctatccattttgtttattttttcaaagaaccagctttttgtttcatttatcttttgtatttttttctttcattttcatttagttctgctcggatctttgttattttttttcttctgctatgtttgggtttagtttgttcctgtctcttaagttccttgaggtgtgatattaggttgtttatttgtgctttttcactttttcatgtaggcatttaatgctattaactttcttcttagcactgcttttgctgtatcccagaggttttgataagttgtgccactattatcattcctttcaaaggattttaaaatttccatcttgattttattgttaagccaaaaatcattcaagagcagattattaaatttccatgtatttataaagtcctgagggttccttttggaattgatttccagttttattctactgtggtctgagaagatacttgatatgattttgattttcttaaatttaatgagaatgattttgtggtttatcatatggtctatcttgtagaatgctccatgtgctgatgagaagaatgtatattctgtggttgttgggaagaactttctgtaaatatctgctaagtccatttgttctatggtatagcttaagtccattatttctttgttgactttctaacttcatgatcgacctagcgctgtcagaggagtattgaagtcccccactattattatattgctgtatatctcatttcttaggtttagtaggtattgttttataaatttgggagctccattgttaggtgcatataaatttaggattgtagcatctttctgttggactaatcttttatcagtatataatgtccttctttgtcttgttttactgttgttgctttaaagtctgttttgtctgatgtaaaaatagctactcttgttttttgtttccacttgcatggaatatctttttccacctgtttcccttaagtttatttgagtccttatgtgttaggtgcatctcttgaagacaacagatatttggttagtggctgttttatccattctgctattctgtatgttttaagtggagccatttacattcatcattaatattgagatgtgaagtactgttctattcatcatgttagttgtttcctagatactttcttttttattgtgttattgttttatataccctatgagatttatttatttattttgagatggagttaccctcttgtcgcacaggctgaggtgcaatggtgtggtctcggctcactgcaatccccatctcccgggttcaggcgattctcctgcctcagtctcctgagtagctgggattacaagcacccaccaccatgcctggctaatttttgtatttttagtacagatagggtgtcaccatgttggccaggccagtctcgagctcctgacctcaggtgatccatctgcctcagcccctcaaagtgctgggattataggagtgagccactgtgcctggctgagatttattctttaaggaggttctattttggtgtatattgaacttttgttttaagatttagaacttcttttaggatttcttgtagtgctgggttggtaggggcaaattccctcagtgtttgtttgtctgaaaaatactttccctctccttcatttatgaagcttagttttgctggataaaaaaagtcttagctgacaacttttttgtttaagaaggtttaaatatagggccccaatcccttctggcttgcaaggtttctgatgagagatctgctgttaatctgataggtttgactttataggttgcctgatgcttttttctcacagttcttaagattctttcctttgtcttgactttagatagcttgatgatgatgtgccttagtgatggtctttgtgcaattaatttcccaggagtttttaaagcttcttgtatttgcaggtctagatctctaacaaggccaagaaagttttcctcaattattccctcacataagtttttcaaacttttatacttctgttctccatccagagcacgatttattcttaggtttgaccattttacataatcccatatttcttggagactttgttcattaaagaaaaattgtttttgtctttgtctgattgggttaatttgaaagccttgtctttgagctctgaaattcattcttctatttgttctagtctattgttgaaactttccactgcattttgtatttccatggcatgtctttcatttcgagaagttctgatttttttaatgatatctatttctctagaaaaattttcatccatattctggattatttttgaaatttctttaagttgcttttcaccttctctggtatctccttgactagctgaatagtcaaccttctgaattctttatctggcatttcagagatttcttggtttggatccattgctgggagctaatgtgatcttttgggggtgttatagaaccttgttttgtcatattaccagaattactttcctagttccttctcatttgggtagactatttctttaaattgttcttgaatttatttttgatgggactgaggttttttttttttattttttccctcttaaggatctgactttaatgtttatattttattttagcctaatttaattcttggtgcttttagggtgaagactttgtatgagttccttagttatagagagacgttgtgtgttggtttttccaaatgttgtttgtagtagttatgtacttgttgtgtgggcaagttcactgtctcctatggagttggaatggcagggatctcttgaagtttgtctcattctcttgtgatgtatactttatttatttaactttactccagtattttatttactgagttgatgattcaggcttcagtccaataggagaggtagcccttggtagtcactggttgtagctaaggcaggtgggtacatgtaatcctcagtggtgggcagggatcccagccttgatgaaggtggctaagggagttctcaattagatgtcctgaggttgtaccaggatgaagggtgtgagctacctcagttcccctgccaggccaacagaaaagttatccacctcatagcctcactcctgtaccagtgttctggctattcagatcatacgggcacctcttttcatgtgtaggaatgttgatgctccaagtagcggggaattgtgaccttgcctcttatgcaggcctgaatatggagagtactccccctgttgggctgcaatcaccatgaatggttccaggaaggctgtctatagacgcatatacactgcattcttgtgatagaaactccagttgtgtccgcagtgatgtaccagggttgaacaaggatctcttctccaagacccttcatgatcacagaggctgcctgcctgttggggtagaggtgctgactttctctattgtgcccagctctgcacttgggtcactgctgaaagaaacattccaccagtggaaagatctgggactcaagcctgctgttcacactcttttgttccatggggtgttctcttgatatggtgttctctcccttcccctaaaaatgggacttcttgagagctgtactgcagtgattactattgatcttctgggtctagccacccagtagggctaccagactctgggctggtgatggagaatgtctgcaaaggatccagtgatgtgaccttttttcaagtctcccagcaatggataccagcacctgctttgaatggaggtggcaggggagtgacgtagactgagattccttggttgtcaataggcttagtgtgctggctttcttgaatgctggttatactaatagtgaacttgtcatgtggacagactcaggacccctggatagccagggtattgcaggcagtggtgtaagctgagatcccacagctgttttctccttcctgagagcagtgatattctgctgagaggtattgtgatggcctgagttggctggcctccagccaggaggtggcgcttgcaagacagcatcagctgcagtagcagcagtgggatttgagcttgctttaagttgcccaggggaattattctggtttcttaggtgatggacagggctgtagagctcccaaaagtttatgttatttgtgttcatctactaggatgagtggagaaatatcaccaggtgagggcagggttaggtgggtctgagctcagactccccttgggtggggcctgccgcagccactgtaagaggcatggggtggtttgcaggccactagggtaatgatccagaggtgagtataactgcctctgctatgcagaagatttcacaaagggagtggggagtagccggcagcagtaagcctcatccagctccttgcagttggcaaggccaatctcgctcctgaagtgtcctgctatcagcaccaggtttaggtccacataacgtatgcacagaactcagacctgcctgaggccataagcttccctgcagaaatagcaagcatgacttttgggtcacatccctcctcctctcgtctgccctcaaggctggtcagcagtgctcttcccactcgccaccaagttctgttgatgggtgtacatccctactcaaaattatatcacaaattcagctgggagcttcttttaccctgtgacccctccctgagctcattggctaactttcttgagggctcctgtgagatatagtcaggaatggctttccttggttcatactagagactcagaatacctgcaaggcacttcctgcgactgcttctacttttattttcacgaggctccctaaatttgttccagctcttggtagcattaaggccttctcctgtggcctggattttcagattccttagtggggatatgtgctcaaaggtagaatctccccgtctcatactctgggaacttttattttttttcctatctcatggagtaggctgcagcctatcacttctttcaaaaggtctgtggatttttccagttttcccagtgggagaggcatgctaacactgcctcctatctgctatcttgaaaaaaaaaaaaaaaaaaggtgtatagatcattcacttccttggttaagtttatttctaggtattcgatttttttaattttttgtagccattgtaaataggatccctttttgatttccattttagctaattcattattggtgtatagaaatgctggtgatttttaaatgttgtttttctgtcctgcaactttactgaatttgttaattttaaaagttttttgatgaattctttagggtttttaatatataaagttttatcatctgcaaactgggacaatttgacttcctcctttccaatttggatgccttttatttatctggcctaattgtcctgggtaagatttccagtactatgttgaatagaagtcatggataggcatccttgtcttgtctttaatcttagaagaaaagctttcagcaattcccccttcagtatgatgttagctgttgttttgtcatatatgacctactgagatacattccttctatgtctaattttttgagagttcttcacatgaaggaatgttgaagtttttcaaatgcttttctgcatattatcatctggattttgtttttcttcctgttaatgtgttgtaccatatttattgattagcttgttataccatgcttaccatgcttgcatctctgggatgaatcccacttaatcatactaaatgatttttttaatatgctgttggattcagtttgctactgtcttgttaagaatcttgtgtctatattcctcatcaatattgacctatagttttatgtttttgttgtatccttgtctggttttggaatcggattaatgcaggcattataaaataagtttaaaagtattctcccatcttcaattttcttcagtagtttgaggagaattggtgttagtactttatatatttggtggaattcagcagtgaagctttcaggtcctggtcttttctttgatgatggaagacttattagtgataataataaataataatttatattaattgttattaatttctttactcattatcagtctgttcagattttctatttcttggtggattttctattttaattttgataggtcatatgtgtccagaaatttattcatttcttccatgtcatcaattattttggtgtatacttattcataatagtctctcatgatcctttgtatttttgtagtatcagttgttatgtctcatttttcatctcttattttatttatttgaatctctcacttgttttttaccataggtaaaggtttgttgatttttatctttttaaaaagccaaatctttgttttggtttttatatgaattcatttttttgtctgtattttatttgtttatgttttgaattgtattatttctgtccttccttctaccaattttgggtttagtttgttcttattatttttagttccttgaggtgaatcattggattgtctactagaaatctttcttcttttttggtgtaggcatttactattttaaacttccctctcagagtttctttcactatgtcgcataggttttgatatgatgtgtttccattcttgtttgtctgagggaaattttttttcacttttacttccctcattgacccattggttatttaagaaaaagttgtttaatttctatgtatttttaaattttctgaagtttttattttagtattgatttctagttttattgcattatggttaggaaagatacttgatatgatctctatcttcttaaaaattttaagacttgttttgtggcctaacatgtgatctatcctaaaaaatgttccatatgcaggtgagaagaatgtgtactctgtcggatgcagtgttctataaatgtctgttagggccatttggtctatggtataatttaagtccaatgtttctttgttgattttttgtctagatgatctgttcattgttgaaagtggtatattgaagccctctactattattgtattgccctctgtttctcctgttaggtctaataatatttgctttagatatctgggtgctctggtgttgggtgcataaatatttataattgttacatcctcttattgaattgatttctttatttttatataatgaccttctttacctctttttacagtttttgacttgatgcctattttatctgatataagtatggctatttctgcttgctttttgtttctgtttgcatggaatatcttcttctatccctccactttcagtctgtgttatgcttgttggcagcatatagttggttccttttaaaaattcattcagccactctctatcttttaactggagaatttagtccacttatattcaaggttattattgatagataataacttactcctaacattaaaaaaattactttctggttatggttatttcgtaaatgttttgttcctttcttcctcttttattgtttatctctgtggtttggtggttttatgtgttactaagcttggtttcttttctccttcttgtttgtatatgtgttatatctttctttgtggttattataaggataaagggtactgatggtttatttaaatctgatagcaacttaattttgttcacataaaaatactccagatgttttctcttttctttactatttatatatttgtttccttaatttacttctttacccattatgtagctgttgtaatttttgaccgttttgatttaaaccttcatactagaggattaaaagatttgcataacattacagcgctaggatattctgagtttgatttatgaatttacctatactggtgagctttatattttcacacgtttttattatagtaataatgagcctttcatttccaattgtaccactcctttaagcatttcttgtaagatcagttaagtggtgatgaatcccgtcagtgtttgtttgtctgggaatgtcttcatttctccttcatttttgaaggatagctttgctgaatatagtgttcttggctgatttttttttttttaattttcagcactttgaatatgtcatgccattctctcctagtctgctgaaaaatctgatagtctaatagagatccttttgtatgtgagttaatacatttgtcttgcagcttttagaattctttgtctttgactgctgacagtttgataatcatgtgcctcagaaaggatcttttggggttcaatttaattagggacttttcagcttcctgaatctagatgtttgtatctctgaatacttgggaagcctaaagctattatttcttaaatacatttcctatgcctttaaaaaaatttcttcttcctctggcattcctataatgtgaatatttgtttgcctaattgtatcccatgtattctgtaggctttcttcattctcttttgttcttatttctgtgtttttcctctgactgggttatttcaaacgcctgttttctagttcagaaattccttcatgaaagatctagtctattgttaaaaatttcacttgtattttttaaattttcatttatcaaatttttcagctcccagatttctgtttggttcttttaaaattatatttatatattatgcatttctcattccaattattgattgtttgtctgtgttctattgtatctcactgagctttttaaagatcataatttttaattattttttaggcatttcataagtatcattttacttggggtcttctactaggatttattgtgttcctttgggggtatcatgttttcttgcttttattatatttcctttgtctctgcattgatacttgttcatatagtagaatagtttttgtttccaattttatggagtagctttttcagggagagacatttcctgtagataagtcctagggtataagttcagcatggtgaatggctttgattctgggtggactcagtagcacggtatctgtgcagtttctttggctgtaatactcatcagtggtgtctgtgattgactcagtggtctacgctgtgagagcttttgaggtagtggcatagttttcttggggtgggagcactgggttggttttcaggttgggcatgtgggggcacagagagctgacaagctgtctggctacctctccagagagtcagtggctactgctgtgctggctgttgggccaggcttgagcttacagagatgctgccagcaaggtggctgtgtggctttcttttcagtgaggcagggcagccaccaaactagatgagcacagcaatgccaagcatccctgtggcagtctgttggagaggcagagctgctgcaggactggatgtcgggctgcatgtgaatgtttgtgggtgcagcaaggccatgcagctctgcagtggcctttcatgggagtaggttgccacatgaccacttgccaggctgggtgcaggcacatacatgctcagagtgcttgctggctgtgaagcacaggtatgtgttggtaacatggctagtggctgtttggaagcttccctgctgtgcatatctgcctgttccctgagatagtggtgtgccatgtgagtttggacactggggtcttggtcattatgacatgcctatgctctaggtagctgagtttgtggtggtgcaagcattcatgtgaacatagtggaatgagagcagggcctcagggatggagacagtcagttgctattggctcctactagtgggtctggttttaagaagccattgagctctatcatcttaggccttaagggtgggaggtgttcaaggtgggctcctactgtgaggcagtgcagctgtacaaacttctggctaatctccaaactggattcaaaacctataaggaccaggagactctcctgcagcaaggatttctggcatgtgtggtaataattgggactgctggggatttagagcttacctttaccccataagaagaagtctccctgactctgagctaattctggtgaagatgacattgtggcagaagtggattacttgctctcctctctatggtgctattctcgccttctgtgcttcacagggatgttgccactgccagggtgctctccagcatacttcctcagtcactccagtcaaattatagatgtttattcactgttttgatcccttttagttgggggaacaagcaccaggtaactatagtcagtcatctttctaacttcacttggacaggtattttaattatgtgcaatttccagattgacttcctcttttattcaggattactttaaatgataattttatgtttataagtggatgggattttttatttgctattcttttattattaatttgtaattcaatattattcaatattgaaaattttcaatattgaaaaatttcaatattattgaaattttcagaattcaatattcaatttaatagttcaatactattaattttttggttttgtgatcatataatgtaacaagtatgaattcagatttgtgtaatgtttgagactttattttagatctaggacataaacactttaggtctaggtcatagatgaccttttacaaatattctgtatgtttatttttaatgcgctatcactgtggtgtaggatgtcatgtatctaatctgtttaatcaaatgtacatatatactacataaaaaggttgttcattgtgtttttaaaatttgccctaggcattggtttgctggagccagctctaattggctcattagggccaatggttaaatagttaggaattttatgagccagcttttaagccattggtattttgaagtcagtatagtgaggtttttatacaacaaaaattgggaaatgctacaaaacaacgattttttttttgagagctagtttactggcatatcaatgctagccttactgatttctgtatatgtttaaatttctaaaaactatgttaaaatatttgataacttatttttcatattcatttttctctatataatttgaagctatactgttaggtacataaacattcataactattatatcttctgagagggttttatttatttattttctcaacttttattttaggttcagggtgtatatgtgcaggttggttacatgggtgaattgtgtgttgctgaggtttggtgtatgaatgatgccatcacccaggtagtgagcacagtaatcaatgagtagtttttcaacccttgttctcctcccaccctccccccacactaactcagtgtccagtttctatttaccccaacttataagtgagaagatgcagtatttgattttcaacagaaaatcactaaaaatcattattttgcctatgataatggcttccagctgcatccaagctgctgcaaaggatatgatttccttctttttatgactgcatagtattccaaggtgtatatataccacattttaaaaaattcagtctactgttaatgtggaattactgcagggcctcagcaatggagacagttattggcccctggggcaggataccctctattagtgggtctggtatcaagaaaccattgagctgtataatcttaggtcttaggggtgggaggtgttcaagagccagtgttaatggacattctcagagagttttaacttttatccatgtgcattatccattatattgtttagtacttctcatttgagttctactttttctctattcttgttactacagtcatatttacttggcatatcttttttttgtaatttttaagcatttcgtatcattttatttttgtttcatttcttataaactcattttaaaatttatctctgtgtctactttttaactaatgttagtatccatctcttagtaaggaaatatagtttatttacatctttgcttgcatgagtgaatgattactggtatgtttagacttactactgccacattgttttttctgtatatttttactgcactttcttttttttcttctctctttctgcctgtccccactacctctactactattacaaccttctgttagattctttgagttttgtttgttcattttattttattttggtttggaaattatacatgtctggcttgggtttttttttcatagttaaattttctcttgactttttgcaattaattagcataagtgtatttcaaattatcacaaataaaataatcatcagagtatgagtttacttcctcctcttccttttcctacaccatttcccccagggagagtatccatgattttccttgcacattgctacttgtaaaagtacatggctaaatcactagtttcctagcattgcgactgatgatacagtgactgaaaaggaggatgagataattttttataattacaaatattttctatatcatggttgtggtagtaatttcatgagtgtatagtgtcatcagaactgtatactgtatgcttaaaacaagtgtatattttattatcttaaaattgtatctcaataaagtttatttaaaagtatggtacagaatgtcagacagagcaagaaataattagcaggatgtagagaaagcccattgcaagttacatcttatgaaattatactggcatggtttttccagaaatacttagcagtttggaacttgaaattggcgagatgaatgtagcagaaagatgaaatgtggggtaaaattagtgtgctatttaggatagtatttattacagtgactggctgggccaccttctggttagggaagctagtgcagctaagatgctgatagttgtgagaataaggacaatctgtttataatataaacaaattaaaaatcaaatccagtaattatgtcatatgtgctttttatatgcttagcatgcttataggtgttgtaggtacagtaactagtaagatacacaaggtttctgaccacaagaatttcacatttttgcaaaatgaatgatgtcaaaaatgtactttaatgaattgccattagttatttagactcaaatataaatgttactaattctgcatacttatatcccacatcttttttgaataactttttaatttatctggaatgcattttttacttaattatttcatagacattctgtgggtcttatattttctaagatgtgctatgaaagaatgtttttgccctccttttcaaatactaatagctttctaggttcaaactcattctcacttagaaccttgaagatgaattctcttgtcttgtaagtaccatgatcagattcattctgatttttgtccttaaatagctttctattagcatgtgtttcattatcctggaattaggaaattcaatttaaaattgctgtgtttttcaattatcccttttatgccctgtcaatgtgaaagcttgtgttctacttcagctctgtaaacttttcttttatgactgttttgattgtttcattctgtctgttgtctctttgctgtctgtttatggaactccttttggatactatgttggaatttctacacctatctatctgataatttccaactttttcttcttctgtactatggtttgggataatttcttcaccttagtgagtgtttgaatgaagtgcttttgaaaactgactagaggaacagatatcattgattgtttccggacagtaggttaaatatatttttgctgccctgaggaagctgtccattgttcctgccctggagaattatactagctgggatttttcaaaaacatttataccaaacattttcaaaaacatttgcaccaagtgacaatagcccatgaacatagtgctacagaaaactatgatcagagagtggtaagagatctaccatatatcccctccagctacataaatgaatatcccttgtttaccttaaacaataagctacctgaggtgtttctatatttattttatatatttctataaataaatatattgtttaaatatatattaaatattgtttaaatatatatttctatatataaatatattgtttaaatatagtgtttctatatttacccactatctgtttaattaatgctttttgatagtgattgaaactaagatgtccaaatcttactgctacctctgtccctggcagctcaaaaaatatttatatagattattgtttgctttggaaacatttcaatataattaaccaatttgtcttattttaagcattccaaagaacttaaaggtgtttcattaaaaaagatacatatatttatatacctttgtatgaagtagttacctaatcatttttttttgttttgataagctgaaatttataggccttataaacatattgtgtagccttataagagaattaataccaacctcaggtcttatatttgtatgaatgaatttttaaaaatcattatagtaacccaagttattatagtttgtattggggcttatttagccttgatattgaatacagattaagtttgaggacatttcttatttgaaaatctcatattggtgtcaatttaaaacagtttgaaagcaattgctgaaaatgtcttagtgcgattaatgataggaagattggagatgtttaaagatatcactttctcagctgtacttaaattaggactgaagagatctgtagcggtcaaaagctggcaaaccaactgtttatttatcaaaaccgactagttatttatcaaagcaggtggttggtgattcaaatccatcaaccacctgtttttataaataaagttgtattggaacacagccatacccatttgtttatgtgttgtctatagctgctcttacactacagtggatgagttaatcactggcaacaaagtctacaagacttgcaaagcataaaacattatctggccctctacacaaagtgttaaccagttgctgctttaaacaacggtgacagttttgtggagtcttactgaccactactttcatactgttaggaaaatggctcacagtcatctgaaaacacactatacttggttgcatatggccttgcttgggttctgccttctgcctcaatgctgtttttctcctttcactcatgcctagaatatatccaaccttcaaggtatgattcacgtaacactacctttatgaagtcctatcataaagaaatgaagtaaaatttcctggacaaatctcccaatcgctcccttacatatagtttgaaatcccttgcccctctcttccttgtacttgcttggtatacacataacatgtttaaatccagttctgtacctattccaggctttctttccctttcagcttactgtggctggagaaaacacataccaccctaatgactaatctcactccacaaccattcacaacattgatccttcaaaaggtcaggctctcatactattctcccagttacctaaatggctattttgtgtgtcctcttccctctcctcctcctcctgtccccatcctcctcctgtccccatcctcctccaatcttcactttctgctcatgtctttttattttaattcactgagaaaatggaagtaatagtagaaaacttacacctacctaccagccccatcccccttataactcagcattccttcccgtgacagtagatgactcagccctcgccccctcttggaggtgagctaacatcctcatcttcacttgcttattagagaacattactctggcacttcccaccccctccaaaatccttaattccccctctctaataagtcagtcccatcagcatgcaaacatgttgttatttccaccacttaccacctgcaacaaccccctttccttcctcccttttggagcaggattcttaaaaacattgcctgcactagcatcttaaaaaccttttcttgctactttcttgtcagccatcccaggcaggcttctgcctccatctaacccctaaaagtgctattgtcagagtcatctgacatgacctccgggttgccaagcccactggtcagtgctgaaactgtgtcttgcttggcctgtcagtgcatttgatgtgtccatcattcccttttgctggatatacttcccttgactgacttctagaatatgatactcttcattttccccttattcagtagtcattccttttgatttttctttcctggtccttcttttataatccttgacctaattaatactgaagtatcccatgctcaggttttggtccttttctctacctacatcactccctcatgagcactctgatgagttgcatatctatttccagttcagacacattcctgaactcgagatttatgtatccaatggcatatttgatatttccttgtgcatatctaatgagcctttcaaactcagcatgtccagaactgaaactcctgacctgtcccctctcctcaaggcatcagctgtgtccaaggcttgcttttttcagttgatgtcagctccatcttctcaggtgttcagaggaaaagactcagagtcattctcattctctttttcctcctgtaccctgcaatctgtctggaaattatattagtcctatcataaaaaatgattccagactctaaccacatgtatctatctccactgctaccccaagcagattcaggtcctcctctcctccacctttctgacctcatctcagactactcttgcccttgctcattccactggcttcttttctgtcccttagactcatagccacacagttgcctctgccctagctattccctctgcttcaaatagtcttcactgagataccaccggggctcacaccctttctatctttaccctgactacccaaaatttcaacctcacccttcttaccttgtttcctttttcctagataatttttcactctctaataaaatacataattataataacttatttgtgcattttctatatggttcatctttctttctgaaatcaagattgtgttctgccatcattgatgtattccaaggtcataaaaaatgcctagcccataataaatattcagtgaatatttactaaatgaatcaaggaaagtgatgttgtcttatagtctctatattctattcagtctcggcttgtcttttctagtggtttgaatgaatggatgatgcatttaacccagaaaaccaatacttgtaaatcttttattcttgtatgtttaattaattttaaatgtgtgattagacaagttaataagcagaacaaaacatcaagtatgttagatcatctttcctcactgggaagaactataatattggtatagaatgtaagatgtttacagttattttcacaagcaatgatttgcttgggaaatagcaatggtgtgagccccgacagtatctgggtgaagaatatttgaagcagaaggaaaatctagagcagaggcaactgtgtgactacgagtctaagggacagttttcactccagaatgaaaactatagagatgcctgcctgcgttaacttgctcacctcactatgtattttccctgggcagtaccatcctgctaggatttcagtgctgccatgagtcagcagtcaccttgcagtgagatccaatcacaagattccaaacaattcctaccctgtgagctccttgaggacagggctgggatttagtctcttttatttcacaggcccagagttctaggatggcagaatggtttcgggtgccaggccccacctggttgctctccatgggcatactgcccagggctgccttgggacttggctccctacattttggtgcagcagtcttcagccaccccaactatggcttaagtggccccagctgcagcttgacccactgcttcacaagatacaggtggtaagccttggtgaaattcatgtagtgttaagcctgcagtctcacagaatacaagagctgagggggcatggcttcctccactttgatttcaaaagatgatgctgacttatttggggcacaggcagagactttgcacaggggtagaaccaccacagagagcccccaacagggcggtgcctcatggagccaaggaaatggggttgccaccaaaatcctagaattatggttaacagtgtagagctgcagtctggaaaagcttcaggcatgagactccaacccatgacagctgaagaataggctgagcctaggaaagctatgggagctgagctgcctgaggccttaggggtccaacccccacccagtgtgcccaggatgcagaatatggagtgaaaggaaattattctccaactttaagatttaatattgttctccctgttgggttttggacttgtttcagatgagttatccctcttttcttgcctatttccccattttagaatgggaatgtctcttctataccttcgcacattgtattttggaagcagatagcttattttgatttcacaggctcgtggttgcagaacatttgccttcaggatgaagtcacacccatatttgatttagataagtattacctagataactcgattaactagatttagataagtattaactaacagtattaagagttaatactggagtgacttttgagcctactaggatggaatgaatatattttgcattgtatgaaggatgtgaatttggcagagaggggagggtaggtgcagaatgctatggtttgaatgcctccaccaaaactcatgttgacatttaattgtgaatgtgacagttttaagaagtgggatctttaacaggtaattaggtatctctttaggcactttcattagacagggccctcatgaatggattaatgcagttatggagggagtgagtttgttattgcatgagtgggctccttattaaagggtgattttggctcagtttcctctctgtctcatgtgcttgctttcacttctacccttctgccacaggatgacccttagcagatgtcagtgccatgcacttgtacttcccagcctccagaactgtgagccaaatgagcttgtgtcccttgtaaattaagtttgtggtgttctcttatagcagcagaaaatggattcaggcagcaagcagagctataaaatacttctttttttttttttttgagatggagtttcacttttgttgcccaggctgtagtgcaaaggcatgatctcggctcaccacaacctctttctcccgggttcaagcaattgtctggcctcagcctcccgagtagctgggattacaggcatgcactatcacacccggctgattttgtatttttttgtaaagacggggtttcaccatgttggtcaggctgatctcaaactcccgacatcaggtgatcctcctgcctcggcctcccaaactgctgggattacaggcacgagccaccacgcccggccaatacttcttttcatctacactggcttccattatcatgattttgttagatacttttgaggacattttctattgcattcctccatgtttggcaaccacactctatggtggagtcttctggctaagcacttagtcttcttttacttataccagcaggatgtagttgagcagggtagtgaaaatccattgtgacattgtaaagcctcactgctataagaggccaggaatgaaattttcattgtttacaaaagtagcttcgtaaggcctaattaagaattatatcacccatggcattgctcaatcccaagtcaatattttttttttttgaaaaatgtggattcaaggataccacaactaaaagggatgtagggaatttaagaggctttggatgaaatgatgaagattacggtaaagttttataaaaaatttgaagcactgagataatatagacaaagggaataattataaaatgagagtgataaggaaggtttgctttaaataaaccaatcaatgagtgatttagatcatatgtaacaggaatattagatttgatatgttcttgtggacaaaaaggtatttctattggatacacctttgtatcttgcttaatacctaaataagtgttagctttttctttctatgagttatagacaatacattttaaagcagccattttttatatttcagaaacatttgaaaagtataataatttaattctttgtgtttatggaacttaattcagtgaatatttatgtcatgggttgtggcagattttggttttttgtggaagaggtcaccatgtatatactattttgaagggcagaaaatagttgtttctatttttgtatattttggttataaactgcttttaatggcatggagttgaatttagggatgtttaatcttcatattcttcacttgatttgagtgagaaaaaataaaattttcttggttataaaattctcaaatgattaacaatggtttctttaaaagactgaagatacatattcagtggctgtagaaatggctactgctattgtaaactggattaacaatcagtacttctacaaatctaagtatttgtttgtttttactttttactagtatgactctggaatttttcaattcagggaaataatagaatagaaaagctttgctaaggcattgtaatcagacagaactggcctcaaatcctggctgtcatgtacttgctatgggcctagagtagcttacctaaatgctactaaccttcctccataccattattgtaaagattaaaggtgatgcatctgttaagtaactaatagagtgcttattaaaaggtaggtgttcaataagtattaattccctttctttctttttcttactagtgcacttgtgtttttaatggatcatactttaccctagattgtattgtaggaggcatcgtggatggatggctgctggaaaccccttgccatagccagctcttcttcaatacttaaggatttaccgtggctttgagtaatgagaatttcggtaagaaaaaaaatagatgaaaatatcctatggaatttcccttaaaggtcgtctgaatctcagagtctttgcaataagttacatggttattctccaaagatcttgagatatcacagatgtctgttcacatttggattgttcttattttgaaaataaataggtttttaaaaactctattgaccatcttgataggctcttcttgtcattataaatgtgttatttcacttatcccactcttttgtgttctctaaatgtctttgtactcactaaattgtgtagtcttagagggcagggtgtgggtatcattcatctttttgaaaggaagcatgaacaattagtggttaaggtggcagttaacactgctttctgaaactttaaaagcttcgacaacacaaaagaggcaggtgaaagtaccaaaactctggtaagttgtaggataaatgattttcctaaatcaccaagaaagattattagtcactctcaagatggaatacagtatctgtaattggttccattttatccaatttttcaccaaataatattaatataattcattttcataatttacatgaagttaatataactattgcatctctgttagtaatgcatgttattaacctgtgctgtataaaatattttgacctattaaaaaagaaagaaggatgaggaggaggtcaaagataatataaaaactttaagtggtgacattggtatgtatgtaaattaacaaatatgtcaactttgttaaattatctttgacatgcatctgcagaaatatctgttaaggaactttgtgcataagagacagagttggaggtgggagagaaagtgaaaaaagataaattatagttttattatttttgataaggggcattaattatgaaattatgacaaacttacatctttagacctaaaaatatgttgacatgttattttaaacctcactttttaactaaaaaatttaaccatttgtctatgattatatttttcagaaaccacatttgagaagtatttccatccagtgctacttgtgtttacttctaaacagtcattttctaactgaagctggcattcatgtcttcattttggggtaattttatctttaggcataaataacattatgttcatggtcatgatgattgtccttggatatattttccattaaattagtttacgttcagtttgcttatatctctaggtactcagtatctgggggatagaaggcagactacagagatttagagaggtttggtaaacacctaactgagcatttttctacattgtggtaatagtccaaacaagcattatagccctcaaataaattgggccttttgatatttaactgaacttggaagtataccacttattgatagactacatatttttcatggcaattaaaagtagatatttagaatttgcttatgttacttttttatctgtccctgacactgactcctcctatcccttgatctttatcctagttcagtttaaaacatttctttctttatttaagccttttgttgtttccttctaataaaattcatatgtttccatgactattaacttttttcttctctcttagatgcagctaatatacccagttggcccaaagcacctaacctatagttatataatctgactctcagttcagttttactctactaatgccttcatggtattgggaaccatagatttgtgcaggtaattcttcatcataagacagattagtgttgactatcatgcttctgtgtaagatccatcaggaagtgagtgattatttttcctcaagctctaagcatcattccaatgttacttggtcagtataagtgtattttgtctggatattaaattttaatttttatgaaatttgtgaaagtgagtaagtatatgatcattcagcctacactggaatgaagtctgtactgtttatggagaaagctgctgcaagcatagtaagagtgtgagcaacatgaaaggggcatgtttaatgtagtgtaaaaaaaatttactatcaaaatcattacatgaaaatgattattactcattttaagaattttacctatttattagacttcaaagtctctgtaaatctctacttaaaggaaactagtaattcattcaaaatcatttattgagcattgccacacatctggcactgcttctatttcattgtgataaattgagccagtttatttataaagtatgcctacagttaggcttttctctaatccgggttggtgaagcctcaagttatcataaaatgccaaaattgtactatatgctcaatgtttatgttcagttacaaggctgttgaatgcacagaagcaaggataacactgattttttcactggtcagaataaaaattattgattgctcttttgcttatagtattcatcaagatgaataggctccttcaaaatgctttgctctatggtttttctttcagctgtttcagtgcagggcttcctaaaacagaagccaactgggtgaatgtaataagtgatttgaaaaaaattgaagatcttattcaagtgagtactcatttttccataaaatgcctggtataactgctatggagtttgtctctctctgtgtttttctgtctgtcttaaggaaaccacacttgaaacaataatatttttgtagaaatttatgatcttataaagctcaaaaagaagtcttttccttactgttttagaatctaattatctttaaaacgtaatttataagcggcccagacggatgagttctagtctgcacaggtgaggtattctcttcctctatctggagaagccagatatcttggtggcacctgcagggagaatggcttgacccagggaacagctgttgttgcttgtggactaaaggccctcttctcccacctcaagaaaacaggtggcctgacctaaggaagtgatttttgccatagcaggtaataccagcttcagtggaagtctcgatggcaccaagcataccaaaatagcaccacaaagttctgaaaactaaattgtcattggaatcacagcattaaaaaataggttagaacttgcatgctaaatccaaacaacctgactgcatgttaaaatagaagatttaaataggaccagagtgtcctaacataatagacatgaagccaagatacaattggaaatcacccattgtaacaagaaataggaaagttacaacttaaatgagaaaatatagtcaacagattacaaaattgaagtggatcagatgttggaattctctgacatagatttgaaagcagacattataaaaagtgcttgaaaaagcaattacaaatgcccttgaagcaaatgaaaaactaaatgccttaacaaagaaatagaagatatgaaaggaaccatatagaaattatataactgaaaatataactgaaatataaagcaaactgtaaaggctcattagcagaatgaatgacagaggaatgatagttaatttgacaacagaatactagagagacagttgacttaagaaaaaaaaagcatcactgatcttgacgacagtaacaaaagattcagcattcctatggttagtatcacaggagagtatgagaatacaccaagtaaaagagagagattggttgaattcataacaaaacaccacccatctatactatctataagcagttcacttctagtacaatgacatacataggttgaaatttaaaaagacagaaaaagatatagcatactataatgggttgaatagtgtccccccaaatttcacatcctcttggaaccttaaaatgtgatcttattttgaaataatatctttgcaaatataattaatgaaattaagatgagatcatactagagtagggggggccctaaatccaatgacaagtgtctttattagaaaaggaaaggacacagagtaactcactgggaagaaagccatgtgaagacagaggaagagatcagagtgatgcggctataagccaaggaaggccagagattgccaggatccaccagaaccttggggaagtcaagaaagcattcttctctagacccctcagaaggaacatggccctaccaacaccttgactttggacttccagtctccagaactgtaaatgaatagatttctgttgttttaaaccacccaccttgtggtagtttattacagcagctctagactgatacacatgcatacattaattataaaaagcagaagtggctatattaacatcaaagttaatgttattaacataaagtagacttcacagaaaataaagttgctataatccagagggatattacaaaatgataaaaaataaatctgtgaggaaaacataatgttcttaaatgtatacacatcaaacaacgaagactcaaaatttgtgaaacaaaaaataatagggataaaagagaaatagacaaatccacaattattcttgaggacttcactgcctcctcctcagtaactaatggaagtactagacagaaaatcagaaagggcataaaaatacaatataaccaaccaacaggatctaatttaatacatagagcactacacccaacaacagcagaatatactttcttttatcaagactaaatatatactgagccataaaagaaactttaaaaattttttcagaacttaaatcatgcagaatttgttctcaaaccacaatggaatcaaaccagaaatcaagaaattaaatacaacgggcaaatctccaaatgcttggaaattaaatactatacctctatataatccatgggtcaaagagtaaatctcaaaggatattcataatacatagaatgaaaaaaaatgaaatacagcatatcaagatatatgtgatgtggctaaagcaatactgacaggacattttttaaaatcaaatgaatacattagaaaaaaaggagaattatcaaatcaaaaatctaagttactgcttcaagaaactagaagaagtagagcaaaacaaattcaatacaagcagaacaaagaaaatatttaaatataagagccaaaattaatgaagttgaaatcaagaaaacaatagaaaaaattaatgaaacataaaactggttatttggaaaatcaatacaattgatctttaattgacagaaataagagagaagacacaaatctcaggaatgaaatttggggctgtcactacagaatctgcagtcattagaaggataataagaaaaactatgaacaattttatgctcacaaatctgataacttagaggaaatggaccaattcttcagaaaccacaaactaccaaaacataatgaagatgaaatagacaatccaaacactcatataatcactaaatacattgaattcatcatacacaagctcccaaaaagggaccttcaagcctgctggttacactgaatcattctatcaaatatttacagaagcattaacaacaattgtacagtctcttctagaaaatagaagaggaaggaacattttccagttgattttaggaggccagtattactgtgatgctaaaaccaaataaagatattactaaaaaagacaactacaaaaatatctcccattaacttagatattaaaatgctctataaaatattaacaaatcaaattcagcaatgtataaaaagaattatacaccatgaccgagtgagatttatttcaggtacacaagtcttgctcaattatttgaaagtcaagcaatgtaatctaccctatcaacaggctaaagaagaaaatcatatgtagaaaaggtatctgataaaatgcaacacctctcatggcctgtgtccctccctatgcctcctggatttatatgttgaagtactaattgccagtatatcaaaatgtgactgtattttgagatagggtcagttaaaatgaggtcatgagggcaggtcctactgcaatatgactggtatctttagaaaaacagataagggtatagatacacagagatagaaaaccatgtgaagacactgggagaaaatggccacctataagccaaggagggaggactccaaagaaaccaacactgctggtaccctgatttcagacctctagcctcctgaattgtgagaaaataaagttctattatttaagtcaccaagtctgtggtactttttatagcagccctagcagactgatataaacacctattgaagataaaatttcttagaaagtaggtgtggagaactgcctcaacttggtacaaaacatgttcaaaaagtctagagctaccatacttaatggtgagtacaagactgaatgtttttctgctaggactggaaactaagcagggatatcttctctcaccacttttactcaacataattgtctgagttttctgttgcttataacagagtacttgaaatgcataatttataaagaaaggaatttatgtcttatggttatgagactgaaaagttcaaggttgaggagccacatctggtgagggccttcctgctggtgggggctctctggagtccagaggtgacaaaaagcatcacatggcgaggggctgaatgtactcatgtgctagctcaggtctctcttcctcttcttataaaactaccggttccctttccgtaataacacattgatactctaatccattcatgagggcagagccattgtgatccaattacctcttaaagccccacctctcaatactgccacattggggattaagtttcaatctgaattttggaggggacattcaaaccacagcaataatattggaagtttagccaaattatgaagcaggagagaaaaaatgtatgagaaaaaaataaataaaaggcacacagattggaaaggaaaattatacatcaccccaagttttttggagagaaagtagtaaaaatgggtatattttgtttagaaagtaatgcaaattaaaaccacaatgacatattattacatgcagctataagcgtatacagaataaaaaatagtgatgatgctaagtaaatataaatgaacaagggtgataatgctggcaaggatgtggagaaactggatcattcatacattgctggtgatgatgtaaaatgatacaggcactgtataaaatagtttggcagcatcctatgaaacaaaacatgcatttgccttacaatccaacaattgtgctcttagacattcatccttgataaatgaaaactacgtgcacacaaaaatatgtacatgaatgttcacagagattttttcatgactgccaaaaactggaaacagatgtgcttcagttggtaaaatctgtgatatatcatgtcagggaatactacagagcaataaaaaggaacaaactagtgatacccacaagttaggtggatctccagggtattatgatgagtgaaaaaagccagtcttcataaagaaactgtggtacatttataaaatagaatattatccagtgataaaaagaaataagctatcaagccatgaaaagaaatggagaaaccttcaaagtcatattgttgagtgaaagatggggacgccaatctgaaaaggcttcacactgtatgatcccaactatgacattttgaaaaaggcaaagctatggagacaataaaaagatcagtggttgctaggggtttggagggaaggagaaatggctaggcagagcacaggctacttttaaagcagtgaaaatattaatatatgatgatgggtggcattatacatttgtcaaaacctgtaaaacatacaacacaaataatgagccctaatattctgtacacttaagatcataatagtgattcaccaactataacaaacacaccacactaatgcaagatattaacaatagggaaactggggtggagaacaaaggggtgtataagtctctgtactttctgctagtttttctgtaaacctaaatggctcataaaaatgtctatcaattcttttaaaagctaatttcagaaggttacatatgatatgagtccgtttacataatattcttgaaatgacaaaattataggcatggagagcagagaagtggttgccagaatttagagagattgggtgatgatgaggtatgtatggggagaaaggtgactttggttatgaaagaatagcagcagaatccttgtggtgatgaaactattttgtgtcttaactgtggtggtggtgatgtgaatctatgcaaatgataaaattgcataaaacttcacacatatgcaagcacacacactgtggcacataaaacttgtgaaatctgaacaaggtgagtgcattgtattaatgtcaattttctgattgtaatactgtactgtggttatggaagacattaccactgggagaagcttgttgaagggtacacaggatctctctgtatttactcttacagtttcatatgaattttaaattatctcaaaataaaaaaagaattaaaaacaatttaatgttttcagtaggttgttctcataatatttaaagcagggcatagtttttaatattgtctaattttgtttcctttcagtctatgcatattgatgctactttatatacggaaagtgatgttcacgtgagtatactttttttcaaaattgctatttgtcttgttattaaagtttttaaaagtatatttttgtaacaactaaaatatggtagttttaaaatctaacttttggtgtgtttctataatatatggtcaatgagttttattagtgattattgagatgggacttggggacagatagctacatcaatgctatttttgtaatggtgccaaatcaaaatattaaaagagtcttttccatcaatgtcaaacaagatacattatacgtttttgtgatgcagttgcatcatggtgcaattagatgcaaaaatcagattaactgattcaatttaagagtagccaatatatcagttatttccaatgctgtaatgtatcaccatctgcaatcatattttccataaattgcttaaaatcattcatgttctgcattttacatgattctctacatttgtcagaaaaagattctaattattctctatgtgagaaaggaaacataacccatgaaacttattagaactgaaaaatggtcttgaacttgtttcattaataccctgacatttcctaaggaatgtaggatttgtcatgttggtggtggttcttcccttcagtattgttactaaaaccaagaaatgaatccccaacttcacgtcagggaaaacaaactctatgtcctctctccattattcctcaattagaacttctcttacatagatgactttctaagcattggaaagaaaccatagtcagaaactagaaaaaagagatattcactaaccaattgggtcatgctgctgcacaaagaaattgtctccctcctctggcttcagcatggattctgtttttctttgcattttttgtaaaatggaaagtagtcaattagccaccaaattcagcatcctgaaattgcttttttgcaagaagataactttgcaacccatgggttagagaaacaaccttagattttagattttagattttagaagtttagattttaaaactgactccaccactttttacttgtgttaccttggagattgctaaacatttctgaagctcatttttattattgctgatatggtgacagtatttgtctttcaatcctaagcagtgactgttgggtttaaggaatattaccagtgctgggcacatgggtgtattccttcattttttttatccattcagtaagcatttgtgaagtgtctgcaggctcccaggtactgtgcaaggtatcgaggacacaaagtcaaataatggtcaaatccctagatattccttgtttcctttctttaagttattgttaaagtaaatgttgtggaaaacatatttttgtggcacctaagagagccttttctgatttgatctgcctgtaagtggacactagtcctgctttgatttttctaataaatttcttggaattacttctctccctctggaactttggaacttgaaagaacagtataattagcagctaccactatttaaaatgttaacaacacaatttgattctaaaaattcttacaaataaactgtctatattgatgttttcagactctaaggccagtattattaccctttccacaggggaaatgtgctcggtgagaaaaactggccactatttctgcattttctagtttcatgttcttctgtacaatattgccatccttcttgattgtgttttgttggtttgttttggtttttattttaaagccaaaagaaaaaaaattaagctgcctcctatgtaaaatttcttaaggatattgtgtatctttataaaatatttggattgactttttgaaaatcaaaattacatcagtatgaaaattaataatcagaaaaaagtaattgttctttataacttttatttttagcccagttgcaaagtaacagcaatgaagtgctttctcttggagttacaagttatttcacttgagtccggagatgcaagtattcatgatacagtagaaaatctgatcatcctagcaaacaacagtttgtcttctaatggggtgagttttccaacagttgcttagagttgcatcttatgttttgggcctgatttggagaagtcattcatggacaagcagatcctcctaaggggcaatcaggagaaggagtcctgttccagtggagtggtgtgcaaaagtggcaccatctccagcatgcacacaatgctaaactgttcaatgattgattcagtagacaaacatttacagaataatgccaggtagtgtgcttcagtgctagaattatagttgcaaaccagacagacaggtcactgacctcaaggtgtttattgtcaggtgcagtggatagacattaatctaattacatactcaaatgtctaacatcaataatagtaactcacatttattgagttattactgtatgccagacactattctttgagctttaaattgataattcatttaatcctcatgataaatctgtgagatagttatctttatttctgtttgaatgttgaagaaattgtagcactgagagcctggatcactcgcttcagttcatacagctagtaaaatggggagccacaactcttacccgagcagtctgtctgcagagtctgttatctcatgagaagataaatgctttaaaaagataacaatgaaaatattaatgattcgagtataatctgggacatcccaggcaacttgagcagtagagggttccaggagagcaaattctaggtactcgtatgataggctggggaatcagctgtgcaatggccctgaagtgcaaagaattagggctttcatggcaaaacaccagtggccaaagcaaggtagagagaaagcagttttgcaacaaagaggcataatcaaattagttcatttcataaatactttttagccctcaggagacagtatgaaaaaatacccataatccctgctgttaaagagggaggaaacagaaataaaccaagcactcagcaaatgagtaataagttagttatttatgaagtccagtggtgaaaaaggacacagggtaggggcactggggctccagttagggtaggctgagctaataagctgccatttgacaaagatgtgagagaatgagccttaagggtatctagggacatatgtttaggcagagacaactgaaagtgcaaaggccctaagcttgtgtgggtggacaccttgacttttctctaaaaatacaagactgctttaggtctttgcttcagtgtcaccttctcagtgatttacctatttacagttgcaatcccttccctatctgagcactccctgtccccttctctgcgtgtcccatatctggaatatgatatattttatgtaatgggtattgtctgtttttccctactagaatgtcagcttaaaatggacaagtgtttttgttttttattagtactatatccaaattcccagaacagtgtctcatatatattaaatactttacatatgtatgaaatgaatttattaaggtttataatactcttatgatgttatctccatcttattggtggaaagagtgagccacgcaacaggtaactcatggcaaaataaatgatgagctctttaatgtgaatgttgatagtcatcctcatcatgacagagtgtgacatacgtgctggaatgcgtgggcaggactgcacagtcagaagacctggatgggaagaatttcagttgattatgtcagttgagatgagtcaatatctctgtcttcctatctgacatgattattttcaggatcaaataggacagcattatatgaaatatgacagtgcttggcatagaggatgtgcttgataaatgtcgctgattctgaattccaaatagttaatggatataaaatctaatttttatttttgctggcacagccttcatggttcagatgatctctaaaaagtttattcttaattgctacatttggaacattctagttatccatgagactgtgtttgaagtacaacaatttgtggtattcacctaaatggctcagttcaaccaatgggtgattacagtgtgtcaggccctgtgctaaatgctagggaaacaaacatactggctctgaccttctggcagagagcttagagaatagtattacagtataaaaagagtaaaacttcataatatgaatagaatacatgacatattgtgagagaggtctaaataaggggttctgagatgtaaagatgggacattgagtccagccctaggagcccaggggttcagagaagcctccctaaaagagtacctgaataatcttaagtgcgagtagcagcagctaaaataggaatgaatgtaacagagagaaaagcaaaggcagagaggcatctaatagtatgctgtgcatggcaaggaaagccagatgctcactcagtgtttctagggcataacattgaggcaagggggatatgtgaaataaataggtaaggaacagctcatgaagagcctgtgtgctatgcagggaggcatggtctttatgctagaagcagatgataggaaaccattgaagggctcaaagcaggaactccgtggtctgatagacacagcttatttttctcaatgtccttaacccattattggaaaaataaacatatatcaaatctccctgttctctttcctcgtagttcttcctaatatgctatttatttgctaaagctttcatatctcaagacctcaccatatggttcaaacgatatgatattcccattcccatgaatgtatatttaatttaattataaattgccaatttaatctctctctatattttgcagaatgtaacagaatctggatgcaaagaatgtgaggaactggaggaaaaaaatattaaagaatttttgcagagttttgtacatattgtccaaatgttcatcaacacttcttgattgcaattgattctttttaaagtgtttctgttattaacaaacatcactctgctgcttagacataacaaaacactcggcatttcaaatgtgctgtcaaaacaagtttttctgtcaagaagatgatcagaccttggatcagatgaactcttagaaatgaaggcagaaaaatgtcattgagtaatatagtgactatgaacttctctcagacttactttactcatttttttaatttattattgaaattgtacatatttgtggaataatgtaaaatgttgaataaaaatatgtacaagtgttgttttttaagttgcactgatattttacctcttattgcaaaatagcatttgtttaagggtgatagtcaaattatgtattggtggggctgggtaccaatgctgcaggtcaacagctatgctggtaggctcctgccagtgtggaaccactgactactggctctcattgacttccttactaagcatagcaaacagaggaagaatttgttatcagtaagaaaaagaagaactatatgtgaatcctcttctttacactgtaatttagttattgatgtataaagcaactgttatgaaataaagaaattgcaataactggcatataatgtccatcagtaaatcttggtggtggtggcaataataaacttctactgataggtagaatggtgtgcaagcttgtccaatcacggattgcaggccacatgcggcccaggacaactttgaatgtggcccaacacaaattcataaactttcatacatctcgtttttagctcatcagctatcattagcggtagtgtatttaaagtgtggcccaagacaattcttcttattccaatgtggcccagggaaatcaaaagattggatgcccctggtatagaaaactaatagtgacagtgttcatatttcatgctttcccaaatacaggtattttattttcacattctttttgccatgtttatataataataaagaaaaaccctgttgatttgttggagccattgttatctgacagaaaataattgtttatattttttgcactacactgtctaaaattagcaagctctcttctaatggaactgtaagaaagatgaaatatttttgttttattataaatttatttcaccttaattctggtaatactcactgagtgactgtggggtgggaaatgatctcttaagaatttgatttctttctattccatagtacaaactcgttctctgttgaaacattcttctatcaccccagtgccctatccatgtacatgtgttcttattgctctagtcaaacggtgcttataaatatctttcagaaagtttaggagaaatctgtatcctatttgacttccaataatcatgtattggctgtcagcttcttacctactctcagtccagagaaatagtatttggcagccactctttaaagtttatgggttgtggattgtggcggttgatttattttttttatttcaattgggatagaattttttaatatacctgtatttttgttttgttttatgtagcttttctattagggagagtaggaaaagtgcaccattttcttctctaaatttccagtccagtctttaggggaatgttagtcttcctgagatgggggaaggaaaatcataatgccagtcactttgcaaataatattttatagtgataaatggttcattttggttacataggcatacaagtgggcttaaaacttggaatttaccagggctcaaaattaaaattcttacattagttactcgatatggatcgcttcagttgatcttagaaaactcaaggcatagatctgcaaccactttaaaatactattagttaactgaagaaacaaaataatagtgtaaaacaatctaaattttatttttcatgcttatactctttacaaaatcagtctttcagattttggattcaaaatctgcctgtttgaactatcttccttaattaacccactcagtgtcatttgcctagaggatactgtgtttatgtctcatttactgccttaattgctgaaaatatcgtccatgtagaacatataataaagaaagcacagaaacgtatacttagaaactcaaatagtaaaggtaagcgtaacaatatgatatacagttcaaagttatattgatgaattttgtttttatcttttcttaatttcaggaaagtaaaagacatatgaaagaatattatctctacattctccctggcgatgaacaaaaagggctagaaggcagaggacatggaaatgtaaacagaaccaatatataattgttgagcccaggccgggcacggtggctcacgcctgtgatcccagcactttgggaggccgaggcgggcggatcacgaggtcaggagatcgagaccatcctggctaacacggtg

SEQ ID NO: 16208 - DNA, 45197 bp, Human
  misc_feature (1)...(45197): n = A,T,C or G
aagtggattataccaaatctacaaaaataagatttttaaacatttttgatgccgattactttattaaagtgtatattcccagtatccctacctaagaatgcctccttcttagctcttttatccacactggatgttttatacttttaaaatgtttacatcttagtttgttaatttgatttttttatttgtttactagtgagattgaacttttttcatgtatttactggtaatttgtatttcttttttggggtgaaattccccattcatgtcctttgctaattttttttttttggtcaacttgccttttcatattgtttgtgtgtttactttaataaaatttaaatatttatgtaaaaagcatttacgtagccaagtctaccaatcttttcctttatggttgtttcctttgctgttttgcttcttagaaagctcctcccattttgagatcaatttattaaaaaaaaaaaagagcgccctcttctgctagctcttttatggttttattactttgggattttgttttcacaattagtgtgagatagagttctgcttctctctgcccatagtgcagctaatcagttaagaacacaatttattgaataatccatccactgattcagatgctacccttatcataattgtccctttcatcttccttggatttcatctactgagggttataggaataggggcatgtgggagagtgaataagcactacagaaatagatagtgctaccaaaggtgtgaaaatttggaccaggcagtgggaaagcagagaaagaattgtgcctatgacaaagattatttgcttggccaaactctagtacggcttctgaatcttctgctaggtccatctgtgcacttctttgtaaaaatccagttttagcaaagaaccccctttcctccatatctaatcagttttctcaccctgcaccatcccccaggtgatgttatgtcttcagaagtcctgttaggtcagtttcaccaaatgccccttacctctgatgcttcctcttagtaattttccatccactgaactccatactgctggttggctataaattccctcttgcccacgctgtattcggagttgagcccagtccctcttccccactgcaagacccagttgcagtggtccctatgccaattgagacagtcctcaatagtcttcgttcggtgctttaacaagtatcattgaataattttgtctttaacacttcttcacattatggtcacagctatatattgttagcttagtagtggactaactgaacatgtaatttccaagctataagttgctcatcaaaatatataagtgaaaaaaattaaaaccagggaaggaaagcaagacaatcctccccaaataacgttaagtctatgcgtctaattccacatcatcgatgagccatctgtcacatggactactgtccctcaaacagcactcaggtatgagacttgagacgaagttcagaccaaggccgtgtcttcgaggatatttcgcttagagaaaacgaaactacttttaaatgtagtgcttatgactagtgcggtaaccactacacaaacagcattctcctggcatttttatgctaacataagcctcagcagcgaagacaattgctaccgggggaaataaccttcaattgtgtttttagcaactgattcctcttttttgctgttgtaaagggccgttaaacacggaaacaggagcctggcgacgttagtccgcaacagaaagttattttgtactttcacagtgggtttgcctacttggtgagataaaagtggggcaagaccgggcctcaagccaggacttcctgggggctcccgggagcaccgcaggctgcgcgttccccgcgcgccggcaggaggcgcgcgctgcctggaaacgccccagcgccgcccgcgcccagagacccgccgctgtgacgcagcgagagcccgggaggaggcgcgggaacgcgcgttgggggtcaggtgccggaagaggaaacctctcgctggggctaggagttcggcggggcgcgcgccggcggctgcggagctggcaggtgcgaagcgtctgcacctggcgggcgatggcgcccgatgcgggcgccccgggatagcgtgggcgaggctgcggggccccggcgcgcacgcccgcacctctccccagccctggcgtgggcccagcccggcccaggcagcaatggggttcctgcagctgctggtcgtagcggtgctggcatccgaacaccgggtggctggtgcagccgaggtcttcgggaattccagcgagggtaaggtcggggcgcctggcttctgcaacccaaagttgcttttgcatttcttgcgaggtcaaaatccgccaggggtctgtcagcctagcagggagatggtgctgggggcgttggtacacgctgggtggtgagtccagaaccggcacgaatggtgtttcctgcagcggaaacactcatggctaaggaggtcttactattaacctcctcatttagcggaggaaatgggaagagataaataattctctttttttaacacagtattatctcccttagggagcagccatgtttgtggctttaattcaacttactaaagcgcctctttgctgcccagtggactgtctgagcttctggacagcaagacttggggtggaactagcggcttaatgactgatggctctcaagctgcatggaatttttacacccccaaatctagaggcttttcaaactggttatgttctacagagtttgagagggaaaatgaacccataatgaggctttatttttaaagagcctttaccatctaatttattaataccatctggagacaggaaaacattccatactcacaatgagaaataaaggactttctgaattacagatacatagacatacagatagaatgtgtataccctcaattctacaagttcagccacaaatgaaaaataaacacagaaacacaaaagcttgccagtccaggtatcagagttgttctccttacttgagggcaagaaatttctaatcgatttgaccttaaaaaagacaaatggacaaaaactgtgttctctgttgtctcatatccaacaggaaatagatctctatgagatattaattcgtttacagagatcacaaaattcccaatcattgcagctaccaacaggaaataacttgtcatccataaatgaactgtaaaaaataacaatttaatagagagtaaaactaaaatgagaaaaacaagaatcaacgaagttctattgccacttcaaattcacctgtgggagccaagaagcaacatgcccgggcttggctccctatgagtacaccatttttgatgatttcaggtgactttttttttttttttttttgacggagtctcgctctgtcgcctaggctggagtgcagtggcatgatcttggctgactgcaacctccgacacccgggttcaagcaattctcctgcctcagcctccagagtagctgggattacaggcgcccgccaccacacccagctagtttttgtatttttagtacaggcggggtttcaccatgttgttcaggctggtctcgaactcctgacctcgtgatctgcccgccttggcctcccagagtgctgggattacaggcatgagccaccgcgcccggccgatttcaggtaattcttgttcatctcagtgagaactcagaatgggatgttagattgtaagtcttgtgcttggtgaatgggtttgggcaacagctcatggtttgttaatataaaatgtaaaaggcactagttgtgccaggcagatcatcatgtgcttttccatgaaactaagcacattctgttttgttttgaggttaatagactagttgcagttctgaaacataatattttctgaataatgtgattgtgttgctatgcacttatctttgaaaagcccttgtgcaaactgaattctaggatctttgtatataggactgaggccaaagctgaaaagggcaacttttttttttgcagaaaaaccttgcttataatagggcactaacattcactctgtatagtgtgtgccaggtgctttccacgtgcagtgttatttaatccccaccaccctacaatgtaatgatcttcctcccttgtcagaggaacaaatgaacagctgctagggttacagataggacttgaacccaggtgagtctccctgcaaatttcatagtccttccacttccgtaaagctgtcttccaataagaatatcttacatggcatggtgctttgtacttaatccttctgtgaatcctcattcttcaaaatagccttatgatggaggtagaagagatgctatctctattttaacaggtgaagaatttgagatattagagtttttagttgatcgaggccagcccctgagtcaggagagcaggcgtccagaactttttctttctacttggtgttagtatttaatacctagaaatttttatacaaaagttaaaaaatatgaataaattgagaaattaatttttttcagacactgctttttgcctctttgctatgattatagcactgatattcctcaatgttattctttttgccttgcattggtattgtcattctgtgcagaagagggacaatgtggggacttaactgctgagtgataataaaagctgatattctccacatctatcagctaaaaatcagtatagaaaggtagaaggacatagttcaggacttgcataatcctcctagaaaatggctggattgatgtttgatgatgataattctgataaccatacaaactgaagaaattgagcatctgctgtaatttaggaggatttacccatctttggcaggatgagctaacttgcatgacttctgtagtggcctgaatgctaaataaatcttggaacgtggcagatggagttcctagaatgtctgaggagggtgctttctgtgaccagtaggcacatgagatggatcatacttttaagcagttttcccttctcttggagtcccagttcactgctgcctttaacatctttcatttgtttagattcatatccagtaactcccgtggaatttcatagtaattggacttgagcacagcatcatttgggcctttcagtcttcttgctattgatgatgctttaccaaggtagcaggctgttcatggttagttgcaagtgctgtctttctctaaaaagtgtgtgaagctaatatgttcatttttgtgttccctttcaacctttagggctattgaacatttgtaagaagataacaatgagaaattgggaggggcggttgactgctgaccaactcaagtagctgaaccatttttgtttttaatgtgaagagaattatgaagactaggctatgatggatttctcttagaatttggttgttgtgttgaaacacaaacagtagaagtaaattttagtaaaatagtaaaaaggaagagttggaaatttttatggttgccagattaggatctgattcggaaagaaaaaggaaagtattaggattgggcagctctttttaaagtggaattattggaaagaaaaagtgattctgggtaagaatggaagatgggtgtgaaaaattgtttcaagtccctactataggtcagatggcaaaaaaagccatttctttttagaggaaagctaatgtaagtgccccaacttgatgttagccatttgctttgtaatatcttttgatgtgctgtcttttttcctcctactctgcaagtcataagatataattatgcctcataaaatgcttctaataaatccttttccatatgccttagaggtgaagttaaattcctgttagcttcttcaggatattttttgagtatgtgtcttcttttgctaaatctgtttttatgagcagaaattaaatgagtttctaccagactgagctgtttaagttgtcttgactttcagtatcttttgttgtcactcttcggaagtctctttctcaacgtaatgcttatgatgtgcctggaatttctgtgaatgccctgtacatgttagttcctttcttcccactaattttttcgtagggctgctctgagtgcctgattgtctttctttctttcttttctttcaataaggagatgaatgtgtgaagcacaggaaagctaatggaaattaataaatgatgctttattgtgtagccttgggcagtttaaaagttgtttcccatttgtttgatactttcagcagccaactgatggcagcacagttacctcaattttactttgagggaactgaagcccagaggaagtacattacttgcctgaggtcacatagttcaggcatcatttaacaaacatttactgtatgccagttaggtgactatactgtgttagacgttggaacatcaaaaatgacaaaatcctgcacagccaggaatcaaaccacaactggtttggttaaagcaatcttctgaaaaaaattgtacaatggatgttagattgccagggttacactgccaaagtattttcacacagatgttaggttagagataactaagactgggaaaaaaatacatatttatcctttgcttgtttatcaaacactatgttaggagttctcaaacccagctaaacattagaattacatggagaactttttataaaagatatattggtgaagagacagctagaaatagacatttaaaagaaaaagcagggtcgggtgctgtggttccgtctgtaatcccagcactttggaagactgagtgggggaggatctcttggggccaagagttcaagaccagtctgatcaatatagcaagacctcatctctacaaaacgttaagaaataaaattaaagaaaagaaaaagtacatttaaaatagcctcaagaaacattacgtattctgggatgataatcatgggatatgtaaagacctctacagagaaaataacataatacatctcaacattctttagataaattgagaaactaaagaaatagaggaatatcggaaattcatagattacaaaattctaaagataaagatattttaaaggtatcatttcttcctaaattaatgtatatattcagggccatcccaatcaaaatcccagcaggtttttttgtgtgtgtgtggatattgacaggctgatttctaaaacttatatggaaatgtaaaggatcagaaatagtcaagataaatttgaggaggaagaacaaatttggagcaggagttaagagagttgtaatatttgtgttaggattggtgtctatagctagacaaataagccagtagaatgcaattgagactctagaagcaaacacatatgttcacttgacttatgtgaaaggtggaactgcaaagcagtagggtggggagatggtggtatttttaaattattttatttgtataaacttatggagcacaagtgtaggtacaggatatattgtgcagtgaagtcagggcttttagtgtatccatcactggaattatgtacattgtactcattaagtaatttctcatcttcaggccccctcccaccttcctcagtcttcaatgtctatcagtccacagtgtaggcccatgtgtacacattacatagctcccatttataagtgagagaacatggggtactacagggtggtatttttagtgaaggttgctgtcaagtagatgaacatatgaaacaatgaactgtgacctctatcttacaccatgtgtaaaaatcagcatcagcttgatttttagctctaaatgtgaaagataaaacaaacttctggaagttaacatgggaatgtatcttcatgatcttggtatatgttgacaaagatttctttaaaatgacacaaaagggactaatcataaaggaaaaacctgaaattgactgctaaaatgaaaactgttaatctaaaggtaacagagtgaaaagacaagcaacaagagtgggagaatatattcgcaacgtatctgtcagaatactcatatctatgatgtattaaaaactcctaaaattgaagaaggacagttccatttttaatatgtgtaaaagactcgaacagactgtttcacaaagaggatatccaaatagcaaataagcaaagcaaaggtttcttaacacccatgagtaattagggaagtgcgaattaaaatcacaatgagataccactatatactcagcagataaatgaatgataccaggtgttggtgagacttctgggcaattggaacactttcctacagtaagttgatgcggtatacattggcaaaacattgttggaagactggcagtatctactgaagatgagaataccctattacctgataattctactcacaggttccacccaacaaaaatgtgtatatgcgtgtaccaaaagacatgcacagaaaatgtttagagttatttataactctaaaccagaaatacagatgtttattaacagtagaacagataattgtggcatgttatttcatgaagtatacaattatggtaatgagttatagctacctatagcagctggaatgaattgcacaaacataatgctgattttaaagaagccaaacacacaaaaattgtgctgtaaattctattcaattgaattcgtccaaataaattcctagtgtttgaacttaggaccctatttccctctggggaggaaagaagatgtgattgggaggggccacagggggaccactaagatgctagaatgctgtttaggtgctggttaattcatgggtgtgtaaactttctgtatttctctgcatagtatttaatggatatttgttttttaattgatacctggaccttagccccagggattttgatttaactcatctggagagggtcccaggcagcagtgttctgttttttttttaatcccctccagatgattgtaatggatagccagggtgtataatcactgtattataatttcttatgaaaaggacaccttatggtcactatagaaatttaagaaataaagaaatgtgtaatgaaaagaaaaaaaatcacttaaaatacacccccagagatacttcctcttaatacccctacctattttgtcaagtgaccaggttttacataatgtatacagtgtccctcccttttatttcctggcttctgcctggttcgcactgtaggcatttgaggaaaggaagatgatgaggcatcattttcctgtagcttttgggaaatccaggaaataacagatgaaagttgtaattattcctgaaattcaggtatatttcttgaagaagaattcagaagcaaagactgcagattaatttttggtcctaatcattgtgtattctcacatggtctatttgtttttatttctggatatcttagactagaacaagactttttaggtacagtttaaccatttaaggtcaaaggtcatctgttacactgtcacagcaaaaactctctcaaatagatttattgcctgacacatacgctttctggaatagtcttccacaaaatcagaactattttatttcttattaatttattattcatgctataatggtaacagcctagatgttcattaataggagattgggtgaataattatggtacatacccagaatggaatactctgtagcttttaaaatggtaaagctagcattatctgtgttgctatggaaagatatataagacctgttaaatgggcaatatcaaacatatttatatctttttccatctatgcggaaatatgcatgcttatatctgcctaagccctaaaagatatatcccaactgttagcagtggtgatttctgtacattgtacttgctggaggagttgactttctgtttatttagcaccttttataaggattatatattttctagaaaaatattaccattttaagggaaagcaaaacagtgacagaatgttgagagaatgtcccattttgtccctttttttttctagtgtgtgttcctattttataaacatttaaaatgtagagttggcctggcgtggtggctcatgcttgtaatcccaacactttgggaggcccaggtgggcggatcacgaggtcaagagattgagaccagcctggccaacatagtgaaacccagtccctactaaaaatacaaaaaattagccgagcgtggtggcacatgcctgtaatcccaggtactcaggaggttgaggcaggagaattgcttgaacctggaggtggagatttcagtgagctaagattgcgccactgcactccagcctggcgacagagcaagactctgtctcaaaaaaaaaaaaaaaaagaaaaagaaaaagaaggacaagtgtaaaaaaaagaaaaatcagccgggcagggtagctcatgcttgtaatcccagcactttgggaggctgagatgggcggatcgcttgaggtcaggagttcgagactagcctggccaacatagtgaaaccccgtctctactaaaaatacaaaaattagccaggcgtggtggcacatgcctgtaatcccaggtactcaggaggttgaggcaggagaattgcttgaacctggaggtggaaatttcagtgagctaagattgcgccactgcactccacctaggtgtcagagtgagactccatctcaaaaaaaaaaaaaaatcagttaaaatatactccaagagatacctgcttttaatacccccctacttattttgtcaagtcatcagttgtttaacaatgtattttagtttccatggttctgtgtttccgtactgtctttccaaagttttgtttctccaagtatttttgagttgtgattcatcctcatcctgggtgataggttaagggaaggttaagaaaagtttaccatgaaggcttctctagttgatggcttcagtctcttccagggcttttaaaggttctgtatactgttctgatggaaggctcatgtcatgggagatagacatgaggattattagaacattttctaaaataatatcaaagggcaaatttaagtgataattacagaagccttggataacctttatgaatttgtttgtgtcagttttgatcatggtgcccaacaactagagtgcctagtccatgagtaccttataaatattgccaaatagggaaaatgagaacaaaaaggaaaaactgaagatgtagactagaaaaggcaggatagtaagtgagttgaatgctgtgaacagtgaaaggatagaaatctgattaatttctaggaaagcagactgatactgccaatacgggtgggaatttttaagacttggaggatgcatgatggatgggaccaaacttgaagggcaataaatgaaacatttttagtgtaatttactgaaatccatatagttttatgtataatttgcttttctaataaaataatcatgataatgggaaggcctggaaaatataaacatgtttttcttgtttctttttaaaaagaaaaaacacgtgcacacaaactttttccagacttccctacccagattctattggccattccttaatattttaacctctgttccagctggagtttggtccatttaaaatgtaaaatgtctttctggtaccataaataggaaatatgctatcttcatttgtcattgttaaaactattacaattttctctagagttttagaaatgaaattgtaacgttttattctatcatttttttaaaaaaacattaagttatgaatgtaatgtagcatcacagagcttagggaaaatatatagaggttaagattattctagtcttaacactatttgtgtcttttttttggctgttcttccacaggctactcattcttgatttttttggttctgtttggttttaaatcatccagtggagctttcgtattaaaaaaaaaagtgttgaaaattgacctttttgggacatggtatataagaatgtgttattaagttatttagtatctgaaatgttttaccgcccactgactctaattaccttctaaaataaaacatgacagttccactatgggactcgggtgaattataatcttttttcatcaattccttttcatctatatttaatctaaatcttttgtctgtttgtttagaattgaacccccaagactgcttatgtgaaacttgggatcttttctgctgttcatgcagacagatactgactgtaggatggggggtggggtaggaatccaggaccgcacaggagtaaaagcaacctaattaaaggattatttgagagttagattgaaaaaagatgagctggtgtgcagctggcagaaacacatcacagagaagtggggacagagtcagtgagatgcagaccatggaggcaagtagacagatgggacaggcctggaggaggtgttgaaaaactgttcttgttataacctatcttttttatggactcagtttgatccttaagcaaacaaaagctctcttttccagaatgcctgtggttcacaattttatgtgcagtgcctggtgtgggtgctcattggacatttttgtcagtattgatttcaccttcctttgcagtctccattagacagatgaggaaattgaggcttaaggggatttaaggaacgtgcctaaaatcacacagctggtaaacaccggtattaaattgcagccacctgtgtctcttcgggctacgctgacttcagaattcactagacggttatggttctttaacaccagcacattcatgattgttagtagccccacaggattgtcatctttaaattcagggactctgttccagagatcattgttattgctgctaccagaggggaagtttctctgggttccaggagcctgtcttcagcataccttttgaaatacctcttgcattttagttctgagctctaccattcactggctggatgaccctggatgggctgcatcactttttaagccacattgtctttagcagtgaaataggagcaataaccatatttacctcaaggagtttttctgaggattaaattccacattcatttatgaatatgatttctgcaaattgatatgagagtacaagtgttgtaatgaaaagtttatctcgttgtaggtcttattgaattttctgtggggaaatttagatacttcgagctcaataggccctttccagaggaagctattttgcatgatatttcaagcaatgtgacttttcttattttccaaatacactcacagtatcagaatacaactgtttccttttctccggtaagtgcaaagaattattttagtaaaaatcatttctatattttgggggtctggtatttagtatgagcattagaatttgatatctctatctcttttatgtttatgatcttatgtcttaaattttaaaaaatcaagataggatgttttcaagttagtgactgagagtatctcaggcctttcttgagtgtggcagtctctgacctaaaaaggggtaatggagagctgagctggggagaagggcaccctgtgacaaatgtcaccactatgcaggcaagttttcttcgtgaattcccaccttttcattttcttactttagtggggccttaataacttttacctgagaatatatgtttaatgggttttcattgttgtttagctatagtattgaactttaccaagaaccctataatatcaactttattctttggactctgtcacgcaaacaacaaaaaaattatagtgctcagttcatccagccctgtgctatgcctccagcagtattaaggactctattatagatgtcatcactaaaccccttaacctcaacctcagccttagaaagtttttaaaattctctgggttagtttaagctatgaagagtctgccatttatataatcttttacaatctatctgcatttagtctctatgatgccctagaccaatacatgcatttcaccttgtatgaagttatacttctttttatttgtcctaagcctatattataatattctggaatttggtaaacaattctgtcttaatctaattcatatgtaaatttttaaaatttttatttttttttttagagataagatctcactccatcacccacgccggaatgtggtcgtgtgatcatggctcaaattcctggtcttaagtgatcctggaactacaggcacatgtcaccacacttggctaatttttaacattttttttttgtagagatggggttttgctctgttgcccaggctggtcttgaactcctggcctcaagtgatccgcctgtctgggcatcccaaagtgctgggattgcaggcatgagccactgcgccccagcccatatataatattagaggcattggtcacactatctttcttactattttgtgtatttttattcctgccttctttcccctaccatagaggtttggaaattgtgtgcatgtggttgtgcacgtgtgtgcgtgtgtgttgtggggtatgtgtgtaggggggtagttaatagactagaaatggaagaattcagcttaggaaaaaaggaaaggaataaatagtattaattacaagagataccgatgtcacacatacgtcgaatttgcccaagttctttgcagctaaagcagaaggtaaagcatgttaaatttcataacttccttagaaaggaaggagcatgccagttcctcaggggaggccaagttttttatggcactgaattcaaaagacagcttcctattcagactcttacataggagacttagtaaaatggcacatagatgagttctttcttcttctcttttttaactagatctattaaaacaatttttaattgacaaacagtatgtttcttcctaatgacattacagcaagacaacatttgaaggaaaagagagaggatgggtgaaataaggatttatatttgttgaacgcctgctatgtcctaggccagtggttcttaagctcctggagccatagactgctcaagtctatggactcaaatataaatataaaatttcatggggcccttcaaaaactcagactctcaggcccccagttaggaacccctgtgtttggtttccatatggttaattctcattaaagctcaacaaattagtagtgatgcctatttctacatctgaggaagcagaacttggataaagagatgtcagcatcaccagtgataaaacagacctagctggcagcatcttgggccttgatttctatgcagaaagggtcttagttgtccttaattatcattttatttcttggactgcctttagttcccactgttatattacttagaagatgatggccagaactgcacatggctcaggaagtgagtggtctgtgtaaagagaagtgcttctgtttcctgtgcccttcctaataaagtgtggcacttttgttttttttgagtcgtgatggcaattggctctttgaaactgttgacttgatcatttatcaattaatatttgagtcattctttcttatgcttatcaaattgaaactactctgctaccttttccttcccatttccttagctttgatagaacctcttgagtctgttaccttttagcttagcattttattattcaaaaaactttccaagcagatgggagtgggggatggtagagaggaagtgtgtgaggaaggattaggaaggggcacaaggaaacttggggtgatgcatacatttgctattttgattgtggtaatggtttcacaggtgtctgtatatcaacacttaaaagtatactttatgggccgggcacggtggctcacgcctgtaatcccagcactttgggaggctgatgctggcggatcacgaggtcaggagatcaagaccatcctggctaacatggtgaaacctcgtctctactaaaagtacaaaaaattagccaggtgtggtggcaggcgcctgtagtcccagctacttgggaggctgagacaggagaatggcgtgaacccgggaggcggagcttgtagtaagctgagatcgcgccactgcactctagcctgggtgacagagcgagactccatctcaaaaaaaaagaaaaattatactttatgtacagtttatagtttgtcagttataacacaatttaaaaggtacctcgaaaactgaactccttggggccaggtctcatgtttttgtcctagtggtcttagaaactaagataaaacattatttgacatagtaaatcttaattcaaattaattgaaacacttgggaatttcactgtgcatctgctattcctgatcaaagattatttttacagacagaatgtttgtgtcttcacaaaattcacagttgaaatactcatcctcagtgtgttatattaggaagtggagtctttgggaagtgattaggtcatgggcccccatttagagccctcatgaatgggattagtggccttataaaagggaccccagatatgtttcttgccctttctctgtcatgtgaggatacaacaagaagttgggagtcttcagcctataagacagctttcatcagaacccgactgtgttggcaccgctatcatgaaccaccagactctagaattgcgaaaataaatttctgttgtttataaccaccttacctgtggtactttgttatagcagccttaactaagacaatcgtatatttttcaagaatgctttttccatgtatatgtgtgggcatgtgaacatagagatgaaaagaattccctggttatttaaggaaggttttttttttctatttgttttgggaagatttggaataggacatgcacactggatcagctcagtaatttatgttttggtcgacttcctattcatgacaatgtttcttctggactgcagactctcctttccaattcctcggaaacaggcactgccagtggactggttttcatccttagaccagagcagagtacatgcacttggtacttggggacttcaggcatacagcctgtccagaatatggctatcctactctcctactcagaaagaggtaacccttctgtcttctcctccctcttactctttggaatatggaatgtgttcatgaaactttaaggaaaattatcctattgagattgtttgttgcaagtataatttatataatcggattttttttttttgagatggagtctcgcactgtcacccaggctggagtgtagtggcgcgatctcggctcactgcaacctctgcctcccgggttcaagcgattctcctgcctcagcctcccaagtagctgggattacaggcgcccgccaccaggcccagctaattttttgtatttttagtagagatggcgtttcaccatgttggccaggctggtctcgaactcctgaccttgtgattcgcccgcctcagcctcccaaagtgctgggattgcaggcatgagccactgcgcccagcctataatcagaaatattttatagtaagagaattagcacgatgactgaaagctcaggtagtgactaggagaacatgtttattcattcgaaaaacatttagggagcccttggagaagcagtaatagttaaggcaagacatagtccttaacagtttagttgttctaagcagaagcagtaagctcgacgtcatgaagaaaaatgatttggagaatggcacgttgtgagtgtggctgcagctggagtgtggagggccttgcatacaatttgaggtttgtactttatttcgaggtaggttctaaggaggcatagagtttttaagcagaggaatggtgtagtccatttcatctcttagaaagctaactctagaagtagtgtggggatggattggagagggcgcagcagagtcaggactcagcacaaaatgagaaatgaggatctgaacagaggccatgagaggcgggatggagaagaggagcaggatttgagatatccagaaggtggaattgatacaacacaatgactggtggttatggagtataagagggaagcataggtttcctatttgggcagcagggaaatagtgatacaaaataggtgtaggaacagggttatggtggtgctggatgttttgggaggtgggacggagtaggtgatgacttcagtttgggacacagtctgagatgcttgtaggacatttggatggaaatgcagagtacataatttaaataagggcctggagtggaggggtgagattagattcccaactaaatagctgttaataaaagctgtggcagtgagtgagattatccaggcatgtacttggatatttagggcaaaaaaatcatagcaaatactttactagtgcctactatgtgtcaggcactgtttctggtggataataactcctgaggaataagcacaacactgtggagtagtcaagaaggtaggaagaaagcctggagtttctgcctttaaaagggagcaggccgggcacggtggctcacacctgtaatcccagcactttgggaggccgaagcaggttgcaggtataatttatataatcgggagtttgagactagcctggccaacatggcgaaactctatctctactaaaaatacaaaaattagtcaggtgtggtggcaggtgcctacaatcccaggtactcaggaggctgcggcaggagaattgcttgaacccggtgggcagaggttgcagtgagctgagattgcgccacttcactccagcttgggtgatagagcaagactccgtctcaaaaaaaaaaaaaaaaaaaaggaagtggtaagttacagtctacggagaggtcaagagaactgactgaaagtgtccgtatgctagagcaagtaggagtcagcggtggccctttatgagagtcactttagtggcacaacagggatggaggagtgaaggtgaggtgaataaatttagactactcttaaagcttgggggtaaagggaaggagagggagcgctagttaggaaaggagggagaatccagaagattactggagtagaagataggaaatgttagctataacaaaaggctaattacctgataagaaaccatagacttaattaaggcttgcgtcaaggacagtgtacaaagaaaaattatgaacagaggagcttcagctggcatacataccatttgtggtgtggtaaagatccataagtgcagaaaaaggagagtatgaaagaagagcatagaatttggaggaagattccaacatgatattgaaacatatatacacactgtgtatctgcattccaaacctggccagaagtagtcaaccaatagccgatctttttaactctagaggaaaggttggcaaactacagaccatgagccagatccagcttgctgcctgtttttgtacataaagttttactgaaacacagctatgcctcttcctgtacgtattgcctgtggctgctttcctgccacaaggactggggtgggtagttactgcagagaccatcagactgacaaagcctaaaatactattaggccttttacagaaaattttggctctgccctgctctagggccctgaacctcagttaactctaccctctttaacctcagttcatgaaatagtatacgactagaagctctacgtttatatttaacttctatttgggaagtttttgtaagagtagatagagttctgtttttctgagtatgatttggatatgtaggaattgtttgtttagtaacttccctatttcttatccagatcctgtccctggaggctgtaatttggagttcgatttagatattgatcccaacatttacttggagtataatttctttgaaacgactatcaagtttgccccagcaaacctaggctatgcgaggtacgtctgtctcccatgtctgagaaatgcttttagaatatacatgacgacagttgtgtagatttgaccagctctctcaagtccctaattctctgtagtaaaattgagttaatttttggggggaattgatgtaatttaaacttcactattaatatttggactgtcatttacagttaatattttcccacttcattcttgtgaactctttttatttgaagagccagatgtgagtctattatgagcttgaaaatacatcctggtttttataaagcactttaaatatagatagcactcagtagccctgaaacatccttttatttttataaagattcattgttttaattaaagctgtgcctcagtttctgctttaatagtaatgatagctaacatttgagaacacttgaatgcttcctgtgcattgtccgtggtgctgagtgttgttatgttctttgccatttaatcctaacaattttatgaagaagggcaattgctgttattttacagaaagtttccctaggggttatggaggttaccctacttgctaacaaatgacaaatctgctatattcttcttcttttttttttttttaaatcaaagatgaggtctttctatgttgccctggctggtcttgaacttcttagctcaagcaatcctcctgcttcagcctcccaaagtgctgggattacaggcataagccactgcacccagcttttttttaaaaaaaatttttttgcctccccagagctgtagtattttactctaggcctgactgatatcagaatccagttatgtaatcacctttgcctgttggtgtttgtcttagtttgtggtgctgtaacaaagtagcacagactgggtggcttataaacttctttctcatggttctagagggtagaagtccacgatcaggatgccagcacagttgagttctggtgaaggttctcgtccaggttacagactgctgggttgtcattgtgtccacacatgacagaaagaaggctagagggctctctgggatctcctttatgagggcagtaattcgattcattagggcttcaccttcatgacctaattaccttccaaaggtcccacctcctaatatcatcacactgggagtgagggtctcagcatattaattttggggagacacaaacattcagtccataacagtgcattacttttcttcagaataccaattgttgccactgcaaaaggtgaactgttaaattgtaattattgttgcaagtgtttgaaattagggctcttggttcctttttatagatgggacttgcaccacaagagactgatgtttcattttgttggttgactttagaggcgtagatcccccaccatgtgacgctgggacagaccaggactccaggtggaggttgcagtatgatgtctatcagtattttctgcctgagaatgacctcactgaggagatgttgctgaagcatctgcagaggatggtcagtgtgccccaggtgaaggccagtgctctcaaggtaaatctgagtcccatgatttgtgtggctggattgtgacacctttgtcagagttgagaaggggagaagctaccaggatcttatttctttactcttttctcctttttgggggacactcactttattctcttttgttatcatcttgggagtctttgctggtgatatctcaaaatgatgttggcctttgaggagatgcatgtaaattatgttacgttttagttgcagccacatctgtgacttggtaatctgaaatgtgaatggaaggaggtggtaattttctgtgtactcccacgactactgggtaaacatttttggcaagtatgaagattacattgttttgagaaaaaaataatgagaaactgcttaaggatatacacattggcattcatatttgaacccaaactcaaagtctaacttggagtaaaattcttctctgagcttttgaatccatgtaaacccttgctccccaggtgtggaccatggaccagtggcattggcatcactggggagtttgtgagaattgtaattcttaaactccaccctggaactactgaatcagaatttgcattttatatccctcaggtgattctgactgggtgcagtggctcacgcctgtaatcccagcactttgggaggccgaggcgggtggatcacctgaggtcaggagtttgagaccagcctgtccaacatggtgaaaccgtgtctctactaaaaatacaaaaattagccaggcatgttggtagatgcctgtaataccagctacttgggaggctgaggcaggagaattgtttgaacccaggaggtggaggttgcaatgagcccagatggtgctgttgcactccagccctcaggtgatttttatgcatattaaattttgagactcactgcaatagatcatttttgtggagggcaggattttatctttatgtcttgaaaagtgcctaacagcaatataatatatgaggtcatccttcagtctaatggttgatgggtggagtttttctagacagcgtcattgtgcttattcacaaaataagaagctctgttagtaaagtttattagttgctttattagatatgacattttaatactattattatttttatgaagaatataagaacttgtataataggctttttgtaggttacttttaaacttttagttaaaagaatattttgtaccagaatgtggggaaaccctcaaagactaatgagggtatgtcaaagagattcaggagcctgtttgaaggggcttgcactgccaaatttggggcagttcaagaatcaagaaaaagactgtggttgtcagccttgaataaatacaaatgaaaccttcctcagttgccaccactggaggagactcttacagcaaattactctaaaaattgataaagaaatttagcttgcctttttaaaggaggaactaattcttccccagttggtgagagaaagctctttgcagaagagtgctggctaatatatgtagaagaaataatagaattagatgatcaccattttgtgaccctcaatgaaataattccagcaaggatcagcaggtgaaaggtttttggggaacaggatatttctagggtgtctaagtagcatccttagattaattctcattgtaaaaggagaaccactttaacatggagtgaccttatagtctccacctattccaggtgggcaaagctagtttcactgaaaatggatcagcctgtattacgtgcttatgtagtgcagtctgacattatcaccatcacctgtggtatattctagcaaaaaatgtctaacctgaatttagtccattggattccctatttacaggaaatatgggggataaaagaataagttagacacaaaattgtggaatactttatgagaatactgacttcacatcttctacagtcattgggtagctgggagagaaaggtgggacagactgctctggattactgagattggccgtaaacaccatgcatggaacttggtttgatcttgggtaagaaggagaaaagctagaaaagatgttaggagccaggaacagtggcacacacctgtaatcccagcactttgggaggctaaggagggcagatcacttgagctcaggagtttgagaccagcctgggcaacgtggcaaaacctcacagccactaaaaaaaccaaaaagttccaggcgtggtggtgcgtgcctgtagtcccagatattgaggaggctgaggtgggaggatcgcttgagcctgggagaagttgcagtaagctgagatcacgccactgcactgtagcctgggcgacagagtgagaccctgtctcaaaaaaaaaaaaaaaaaaaaaagacattagggaaaatctggatcatttattagctaataagaaattattcattttcgtaggtgagctaaggtattgttatataggagaatattcttatacagatggtccctgacttatgatggtttgacttatgatcttttgattttagttttgataatttcctgagctagcaatatacagtatgatactcttgcaacgctgagcagtggcagtgagccatcgctcctgcttaaccacacgggtaatagctaacattttacagtgtactgtattcaataaattacataagcaattaaacactttattataaaatagcatttgtgggccggacatggtggctcacgcctgtaatcccagcactttgggaggccaaggcgggaggatcacaaggtcaggagatcgagcccatcctggctaacagggtgaaaccctgtctctactaaaaatacaaaaaattagctgggcgtagtggtggtggcgggcgcctgtagtcccagctactcaggaggctgaggcaggagaatggcgtgaacctgggaggcagagcttgcagtgagccgagatgatcgtgccactgcactccagcctgggcaacagagcgacattccgtctcaataataataataataataataaaaaaataaaatagcctttgtgttagatgattttgttcaactgaatctaatgtaagtgttctgagcacatttaaggtaggctagggtaaagccataatgtttggtgggtgaggtacattaaatgcattttgactttacgatgggtttatcctgatgtaacccccttgtaagtctgtacttagacttacatctgtactgagtaacttgttactcagagtgtggtaggtgtttgcatagcattggcatcatctgagagctttctagaaaggcacaattgctagtaccacgctgacctaagaatcagatctaccttttaacaagactgccccctgcgattcacaagcacgttaaatttgagaaacactgtggtaggacatgcacagtgaagtgtttagaagtgaaatgtcatgatatctgtaacttactttcagcaggaaaaaagtagagttggggagaaactagtgatagagaagcaaatgtaaaatattaacaattgttgatattaggcagtatatagtctatttattgtgttattcattcaacttttctgtctggtttaaacttttcattgtaacttgggagtaatattaacagtttgttgaactttaccagacctttgcccaggaagcaagttattgaaggctaagcagtatttttaaacaatggtagtctgatgtaggagggctcataataattttctcctaaaaccctaatatttatttttctcaaattagtaggaacataggtattatggttctataaagcatttgtttcttctattttatagtttacaatggaatttctgaagttaagaactactggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactggggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaagaactactactacataacaaaacctcatgtaatattttcttgtttcagagactgttagacaaaaataagtgggtactgtctgcgagatgttaacagactgtctgcgttagtctgtggctaacattggacacatcctctgtgttaggcattgggctgtacactgaggaaagagcagtgcacaagagaaatacagttcccatccttgtttatagtctagcagaggtgaaaaaacttttttcatggtcgtaactagcatttatacattgtttatatcgcattttccttaaactattaaaaaaaacctttggaagcattttgtgtgagagcttgtttacattagcacatacaaaccatgtaagatggccttttgaccatattaaatgggttggtgtatattttaagcaagaattataatttatgaatataccatttaatattacacgtaggtgggattatcacagaatagcttaaaaaaatcccctaaacactaatcatgtgttatttttggcttcaggtggttaccctaacagctaatgataagacaagtgtttccttctcctccctcccgggacaaggtgtcatatacaatgtcattgtttgggacccgtttctaaatacatctgctgcctacattcctgctcacacatacgcttgcagctttgaggcaggagagggtagttgtgcttccctaggtgagtatgtggctttaaacttttacaaattctcctttggccttgcagataatgcttttgtctagttctcattcattcaacacataccttttgagcccctacgttattccactctctgttctaggcactgggacatagcagtaaacaaaacagcaaaaatacttgttctggagcttatattatagtgagggagatgagacagacaagataaatttataaaatatgtaatacgtgagaaaatggtgagtgctaagaagataaataaagtaggaaagggagataacacatgccagtaagaggaaaatttgagatagatagcatggccagggcagtccttgatgcaccacgcacgtacctgggtgtggcatgtaccaggcagagggagcagccaggatgagggcctgcacctgggagcctgtctgagggtgtgaagaactgcagtgatgacaggggttgcaggagaacgaggagggcaaaggaagtagaggtgaggtgagaggtgcaggggcaggcagcctgtgtgtggccttgtagactgtagtatgggattttgcttctattctgaatgaaagggaaaggcattggaaggttttgagcaaatggtgccatgatctaagatattttaatgagatcactggctgctttttgagaaaagacggaggcaagagcagaaatgcagattggttaggaggccactgaagtaatccaggggagagataactaggttaggtagaatgggggcagtgaaggtgttgtgaggggtgtgtgtgtgtgtgtgtgtatttagcagtttatcttgaaatggtttctcagaaaatatgcaaaaatagtataaagaatttctgtataatcttcatccagattcctcaaagcttaatgtattaggctatttgcttttcattctctcttcttctctctctatatgcaattgacctttgaacagtgtaggggttgtgggggagccgactcctgtgcagttgaaaacctgtgtataactcttttctttttttctgagacatagtttcactcctgttgcccaatctggagtgcagtggcatgatcttggcccactgcaacctctgcctcccaggttcaagtgattctcctgcctcagcctcctgagtagctgggattaacaagcacacaccaccatccctggctaatttttgtatttttagtagagtcggggtttcaccatgttggccaggctggtctcaaactcctggcctcaagtgatccacccgccttggcctcccaaagtgctgggattacaggcataagccaccataccccacccgtgtataactttgacttccccaaaattaactactattagcctagtgttgaccagagaagccttattgattacataaatacttgattaacacatattttgtatgttatatttatcatagactatagtcttacaataaaatgagctagagaaaagtaaatgtcattaaggaaatcataaggaagagaaagtatatttactattcattaagtgagagtggatcatcataaaggccttcatcttcatcgtcttcacattgaataggaacaggaggaggaagaggaggggttgttgttgctgtctcaggggtggcagaggtggaaggggaggtaggagaggcaggcacactcagtgtgacttttactgaaaaaaagtctgtatgtaagtggacccatgcagttcaaacccgtgttgttcaggggccgactgtgtatgtatagatacgtacacacacacacacacacacacacacacacacacacaattttcttctctgaaccatatgagagtaagttgcagacataaagacctttttgccattaaatacttctgtatttatttccttacataaccatagtaaaattatcaaaattacgaagctaacactgatacagtagttatttaattcacacgttagcacatttactagttgttccaatagtgtcctttataagtaaaaaaaaattatttttggctgggtgcagtgtctcacgcctgtaatcccagcacattgggaggtcaagatgggcggattgcttgagctccagagttcaagaccagcctgggcaacatggcgaaactccgtctctacaaaaaatacaaaaattagctgggtgcggtggcacatgcctgtcgttccagctacttggtagtctaaggtgggaagatcacctgagcccaggaaggttgaggctgcagtgagccgtgattgtgcttctgcactccagcctgggcaacagagtgagaccccgtctccccgtcaacaaatttttttttcccctgtccagggttcagtttaggatcccacattgcatttaaccgatgtgtctctttatagttgtataatctggaacaagtctttttttttttttttaattttaatcttttaagaccttgacttttttgagaagtacagaatatttattttttttagaatgtcttcaatttgggttactttgatatttcctcataattaaattttgattatgcttttttggcaggaatacaaaggaagtgatgtgtccttctcaggagacacttgtctctttatttatttgtctctttactggtggtgacatccttgatgacttggttattggtgtcttgccaagtttctccactgaagtaactgttcctttttttaagtgtctttaggggaggtacttcgagtgtcagtaaatatcccattctcaaactctcacttgctagttttggcatccagtgatctttgcctgaaacatttattactaggtggttgccaaatggtgtttctctaatgtatcactccttctatgtttatttgttgccatcctgctctgaggaagggttttccctcccctgccatttatttatccatgtatttattttaaacctggacctgtagattcctattttattctctggatgaaatcctttactatcatttattttcatgttcaaattgttccagatttggctcatgagtggctggatatgtttggagtacagtgtactgatggattggatgaggggtttgagagaaagaggtgtaaaggactttgtagtttttggcctgagcaactggagagagagagcgaccattcgctgaggtgggaagcactgttggaggagaaggttgggaggatacattaagagttcagttttggacaagttcagtttgagaaccctattgagcatttatgtgcagatgtttaactgatggttgattatatatataagcctggaattcagaggaaagtcttagctggagagcatcttggaaatcttcagactgaatatatggcatttaaggcctcatgctaaatggtgttatctataaaggggaggcagaggtggaaggggaggtgggagaggcaggcacactcagtgtgacttagagaaaagggaggggtctgaggactgagccctgggtgctccaatgtttagagcttaggaaattgaagatcctaccaatgggctgagaagctgcagccagattggtaaaaggaaagtgatgtatgttgaagccaaggggagacagtattgcatggaagagagagtaatcaactttggcagatgctgctgataggtcagctaagaaagagactgaaaatgacccttggatttagcaacatggaggccattggtaccagtgagagctgttgcagtggagaggtggggtaggcgcctgactggagcatattcaagaacaaataggagctgggagcacagaaactggagaaagttcaagtagctctttcaaggagctttgctctaaagaagaaagtctattagttgtgttcaagcgagagattatggttctctacctctgctagagccgtatcccgctgttaaagaaaaaaaaaatcagtgacactagttaaagcacagtgaggaagattttattcaaggtggggggtagtattacaataggcatagggaccactgtgatggaattttgcagtggggaagagagattgggcccaactcttgagtacaacatgggctactgggaatttgtagccaagcagtagggtgggagtcagtggatggaaaatttctaagaggaaacatgaggggcaagggggcattctgtctgcactgacctaaggggattcttactgaagacagaccagggtggtcagacatcacctgggggatggatggtggaggatgaagaactcgattagatatcgagggtgatttgatatcaagcataggggattcttgctaagctgacttatcagagttcttgctgaagctggattttacaaagatgtgcgcagatgggcctaggagggggttcaggagactgaaatttggccaagcaggccgggtgcggtggctcacgcctgtaatcccagcactttgggaggccaaggcgggcggatcacgaggtcaggagatcgagaccatcctggctaacacagtgaaaccccgtctctactaaaaaaaaaaacaatacaaaacattagccgggcatggtggtgggcgcctgtagtcccagctactagggaggctgaggcagaggcaggagaatggtgtgaacccgggaggcggagctggcagtgagccaagatcgcgccactgcactctagcctgggcggcagagcgagactctgtctcaaaaaaaaaaaaaaaaaaaaaaaaacgaaaaagaaatttggccaagcaaaggctctttgtcaccactcagtcttccactcaagacaatcttccactcaagatccttgagggatacaatgcaagagaccttggcagatatgtttgtgtgtgtgtatatatatatatatatatatatatattttttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgatctcagctcactgcaaccactgcctctcaggttcaagtaattcacgtacctcagcctccagagtatctgggattataggcgtgtaccaccacaccctgctaatttttgtatttttagtagagacctgaccaaccatgttggccaggttggtcttgaactcctgacctcaggtgatatgcccgcctcggcctcccaaagtcctacaggtgtgcgccaccttgcctgactaatttttgtatttttagttgagatggggtttcaccatattggccaggctggtcttgaactcctggcctcaagtgatccacccgcctcagcctcccaaagtgctgggattacaggcgtgagccactgcgcctggccatatatttttaaccgatggactgaagtatgtctgggttcctccatttctttcccttgaacccttcatgcaaaagccccttctaaatagaaaggcccccaggcctgtctctctctgttaggcttaggagacagagagctctgatccagttgttcttcccgcccaaagttgaaccttcctagtgatgttagttctattgttactctcattttcaagattgatgagtattagagtgcttttcctgagcttggagtagggagactatatccatattgcctcctaactaaaaccttgccctgtggttcataacccttagcaatactgtcatagttaaagacactttaaccttcaacttgctcctgtcctagtctattcactcctttcattcccccagagtgaatgcctgttttatgtcttgttttatcgtagattctgcttttgatggaaccttccataccctctcattttacttgtataattgtttctctccctccttcctggtattgtgataggggatttagttcccctctaatgttatggaagagtatctaactgtgtcttagtttttattgggttggaagaccttgctgtcttggtgattatacttgctgaaaagttcacgggattttcatttgagaaaatcatcccagcaaatttaatggttttggtgtaaaaattaaattctagaatgatagtcaaccacaggtctgaaataaacaatgtggtgtttttatctttcgtttaatctttctgggttttttttttttgtttttcgttttttgtttttgagatggagtctggctgcgacatccaggctggagtgcaatggcctgatccttggctcactgcaacctctgcttcctgggttcaagcaattctcctgcctcagcctctggagtagctgggactacaggcatgtgccaccaggcctggctaatttttgtatttttagtagacggggttctcaccatgttggccaggctcatctcaaactcctgacctcaagtgatccgcccacctcggcctcccaaagtgctgggattataggcgtgagccactgcacccggctgttgtttaatctttcttatgggctccttattctcagaaaagctgatatttaggtattatatcccctgtgaattctgctcttctgtctgtgtttcttattttactgtatgtcttcatggtttctccattctgagcactcttaggcattttatgtattttgatttgtggcagccttgttttattttagcatgagattgtatagatgtcttgttttgggttttagttcagggattattttcttgggtttatctcatgatggtgggtgatgaatttagtgagcatatttttctcttcagtaaactaaatgataccgtgcttcatcattggttgtaatgcaacatttttctccaaggcaatatgtataattgataagactggtagtaatttgtgtatgtgtaataaatattataataaataacttataagtgtaatacatgtttttaaattgtgagtttcggtttaaattttttattgtgaaaaacttcagcgagcctccatacaccaattatccagccttaacaattttgatttatggccattatcttgtttcagctgtgctgtacctgcttctctgcctctccacctcatcaccctcctttatcactggattattttaaagcaaatccctggtcatcatgttactcacaaatatttcagtatgtataccttaaagataagcacttaaaaaatagaaccaccgtgtcattaacataattttcattttaaaatattgaaaatatttctttaatagcatcaaattaacagccagagtttgcttctggagtcatctcaattgttttccacagtttgtttgaatcaggttgcagatgagatctatacacagtatttagttgatgtgtcttttaaatctcttttaacctgtattctccctccacccacccccaccacctcccccccactccctgccaccttttgtccatgcagtttatttgttgaagaaacaggattatttgttttaggaacactctctctctgtttctctccactttacccaggaatatgtcataggaagtgttccataccgctatcagcaagcatatattgtctggattctctttttgttatagcagcagttgttgatattgattgtctacataggttcattcattaggggtggcaagagtattttaaagataaatttgtaatatacatgtatgggataaattatgtcagttcacttagcttttttgatgaaggttcgttctataaatattaatacaaagtatcaaattggatgtattatccactaaattttcattattttttaggaagagtgtcttccaaagtgttcttcactctttttgccctgcttggtttcttcatttgtttctttggacacagattctggaaaacaggtattatgtccaatgtagttgctatttccattttgcagtcttttcagtgttgctggggaatgacctgtgaggagagtaagcacttacttatctctactatcttcatagatttgtagctggggtcttgtagtcgtgagtctactgagttgcaatgcatttttatttttttctattctccctacagcggagtataaccttctcttattaacaggggaatacaattatgcagtgaattttatcagctgctagatctgttagttgactaaagataaccgagattagacattggttgtcagggccgggctcagtggctcatgcctgtaatcccagcactttgggaagctgaggtgagaggactgtgtgaggccaggagtttgaaacaagtctaggcaacatagtgagatcccttctctaccaaaaaattaaagacaaattggggctgtgtgtggtggctcacacctgtaatcccagcactttgggaggctgaggcaggcagactgcttgagctcaggagtttgagaccaacctgggtaactcggtgagaccctgtttctccaaaaaatacaaaaaattagccaggcttgatggtgtgtgcctgtagtcccagctacatggggaggctgaggtgggaggattgcttgagcccgggaggcagaggttgcagtgagccaagattgtgccactgcactccagcctggatgacagagtaagatcctgtctcaagaaaaaaaaaaaagaagttggttgtctttgtaaaaatatgtgtggatattggtgatggcgattgacttggtttcacatgaatcaggctatggggctgcagtgtacagtgagtttgaaatgtctgctcagtcctgagagattcagatgccaaagggaatgccagcatcaacatcagtgaaacacactgaagaactgggatgtaaatcatgctcactgaattggtttgaattatttgggctgctttttatataagtgatgttttcgattattaaaaaatccttatttaatcaacaagttgtataactgagcatcaaggtagctcaaatgtaatcctgatctaataaagctctttaaacttatgttaaattgtttgaaatagcaactcctttcctgctattatgacactttttttattaattgggaagagagtattgtaaagaatatataatatctcaacatgtagaatgattctgtaacaaagaacttagttgctaagctgtggtctcaaagttatcactagctttttttttttctttttaaagagatggagtctcactgtgtctcctaggctggagtgcagtgtagtggctgttcacaggtacaattatagtgcactacagcctcacattcctagcctcaagtgatcctcccacctcagcctcccaagtagctgagactacaggcacaagccaccatgcctcactctgggtttttttggtgtgttgatatgtatcattttatatttattgaaattgagatacagtacaagtattaccaagaacagctgtgaagaatttaagaaaataggtagagctatggcctccatgatcaggattaggcttatttgtgggaacaaagttatctgtatacttgcattaccaggtgttttaatggatgaaggtaatgattgatcattctaaacaggataggatgaattaaaagaagatataaaagttatattttgctttgggacagtttgggtttcttttaccttttacattttatttctgcttacaaaactattaaaatttaatgtgtaatttcgtatcacatacacgtgacaaagtgctattcttattttaagcagaaaacataaatatattaaaatgagctatgaaatgaacaaataacaatttaacaatggaaactgacctatatacaagaaagtgtatcctgtagttggtactttaatattgtatctgtttaataataattactcccatggctgctgaatttcttctgccttttagattttttttttcttctgaatgctgtaacatgtaaattccaggagcttaagcatgtatttgtagattaaatatttaaattgcactgtaaaaagggtgcttaaccatagcttttgttgttttgcttttttcctttcctggtggtttgccacttagaattattcttcataggctttatcatcatgggattcttcttttatatactgattacaagactgacacctatcaagtatgatggtaagtgaaaattatatagtttaactgggtattcaagaaggcaggtgctgtgttttacttcacctttccttctacagtttggcctatattgtgtgtgacagcctattacttatgtaaaataatggtccatctagtctctgaacaccttttctgaactactcattcagaccttctgggtttttaatctgtatggtgaattccttggtacttagggaaaggaggggccatattgattatagacctgtgttctggctatgtgatatgttgaagatatgagatgtacaacaagcaaaatgttgaggttttctttacctgaaaacagatacctccctaccccattatgtttaacagaatgcttgtcaacttttccttctcaatcccaatttattgacaagccaagcctgtcactggccctgtgaggtttagctccctagctaatttccttgtctcagcccagacccctccctagagagggttgctctatgctggcttcatggcaccactgaagagccctcagtgcctgacctacagaaagctgaagctggcactggtaacggtattgtatgtctaaggcacgcggttggaagtactgccggttatccagcagttcatcctctctctttgtacagtgaatctgattctgacagctgtcactggaagcgtcggtggaatgttcttggtagctgtgtggtggcgatttggaatcctctcgatctgcatgctctgtgttggactagtgctggggttcctcatctcgtcagtgactttctttactccactgggtaggcgatatgtaacagatgttttgtgtgttcgagtgactgtttgaatactgcctaattggatttgcatcctggagtggtgttgcatgtcagtgcttctcctgtggagttctggaaatctgcattgatggtgtgacactttcagacagcaccaggactagtaaaagtccctccttcctcaaaggcacagtagatgaaatatagaatgtctttagaggtagctttgtatctatttgttgtgataagtggtatgtgtttattagaaataatggaggtaaaggaaataaggaggtaaaggctctgatggcagctgagtcggggaacctggtactttgtttctggtcttctgttgtaccctcaacctccactcccatccgctgccaaaccccaggtgtccctcaggtacttaatcaccctggggcagtagcacagggctggttctggggtttttttggtgtttttaaaaagtaattcaattgctatcagtttttaaaatctggttaacttataagttaactttctttgccattgtttaataacttacatttcctgattattgtcaaaaacaaacaaaaacagcatctgtactcaaaagtattctatttggttgtttcctttctgtgacaatgttcttaaaatactagaataaagttgatgggactgttagacataaaaatagccatttcatgaggctgtcaactctatagagaatgcaggatataatagagtacaagtcatgtgtcccttgtctctctgaagactttttttttctaagactactggatagtctgatgaaaagcagtgttgtgtaggcttggcgaaatgacagattcacatggggatgtttttgaaatacagattcaaggctctaccctacatgtgctaaataaaatacttcctaatggctgagcatggtggctcatgcctataatcccagcactttgggagaccaagtgggaggattgcttgagctcaagtttgagaccagcctgggcaacatagtgattccccatctctactgaaaaaaaaaaaaaaaaaattagccaggtgttgtagtgcacacctgtggtctcagctactctgggaggctgaggctagaggattgcttgaacccgggaggttgaggctgcagtgagctatgatggtgccattgcactccagcctgggcgactgaacaagaccctgtctcaaaaacaaaacaaaaagaccacaaaaaccaactactacttaatgggcttcccctcttttgttaatgcttagaggatggagggatgataggttataatttctagtaatttaatgtacttttcatgaggagaatgagcataaattataaagtcaggaaaaaaccttctatatgcattctggctctgtcactagttccctttctagcttataaccttggacgatgtattgaaactttgttccatcatctgtgaaactatctcataggatagatgtgaggaatgagaaaacagaaataaagaggtctcttaattttcaactttataaagtagtctagagcagttgtctctaaactttttgacataactattcctattggtaaaaataattttagcatataccctttatatatgtttgtttatgaactatctcatagctcaaggaccgttagagtgatcatctcctcaatgctagtgggtgcaaacccatatttttattttttagagacaggatctctttctgtcacccatgctggactgcagtgacactatcatagctcactgcaacctcaaactctaaggctcaagccatcctcttacatcagcctcccaagtagctgggactacaggtgtgtgctgccatgcctggtaagcttttatttttagtagagacagagtctcactgttgcctagggtggtcttaaactgggctcaggcagtcctcccacctcggcctcccaaagtgttgggattacaggcttgagccactgcacctggcctacctatatatgtatacacacacacacatacacacacacacacacacacacacattatttttttcctgagacggagtctcactctgtctcccaggctagagtgcagtcgcgcagtctcagttcactgcaacctccacctcccgagttcaagtgattttcctgcctcagcctcctgagtagctgggattataggcacacactaccatgctcagctcatttttatatttttagtagagatggggtttctccatattggccaggctggtctcaaactcctgacctcaagtgatctgttcacctcggcctcccaaagtgttgggattacaggcgtgagccaccatgcccggccaagaggcctacccatatttttaagcattagcatttaaaaaatatttggctgaccactacaatctgattagattgctagttttcaccttatgtgggaagcaatgagcttattctctgaaagggtccgttcttcacatgcatgcatcgtaactattttcaatacttagatttcttgaaagccttttacaagaaagccacatatgtattttgtgaaggttaatatagttaaactagagaatagaatctataagttcacctcaatggcatattgctgttggcttcagagaatatggagtctcaaggtccagtcctgtagcctagggactcccagtcttccactctgacctggatatgtaggtcttgaggtatggggccatttacagatggactgaatggtggtgccagtgtcagtattaaacagcagtcagcctattcttgctttttaaacttaatttataaagaggagttctcatatatttgttctgggtcggcctaagttgtgcagcattttagagtccagcagcaggagaagggtttgggaagagcagatagttggttggttcctctttcctgatacatgaggaaatcacatgtcacagtgtgcagtggcatgacaggacatgctttgacggtaaaaatctgttaagtggactcactgtttacattgggttcatggcttaactttgaatgccttttacttgtattttttattttgcagtatgaaatcatgaagtcagcaatgtagagctaacaggtgatttagagcttggagatataattcaatgtcattttgagggttaggaaactgaggctcaagttcacagagctagtgaatggaagagcttggactattccagtgtcttctaaatgattttgttaataagtgcagagcgttgacctgcttggttcctcccacccaccttctagaacacatccttcaaagaagattgtattgacagttaaatgaagaaaattagaattcatttctagttgccaacatattccctggttgttactttaaggctttgatgtatatctgtgttcagatgttccaagaaaccaactctaacttggtaaagctgttgtttactcttagtttctttttgctttttcaggaaacctaaagatttttcatgatgatggtgtattctgggtcactttctcttgcatagctatcctcattccagtagttttcatgggctgcctaagaatagtaagtgtttcatcaaaagttagatttattgattatgttatcctgtgtgttcagctgatcacttatttcatcattttgcatgttttattcactggggagggctgtgttacctgtatcagatgactgattctaaatagccttgttactgtgaaaacgaagttctatttatgattaccacatggtgtttgtttttttcttttttttccaccaaatggagcatcacagtcaatatgcttttaacagtgggagcagagaaggtagtgcttactctagtacaccaacctgatgggtcattagtttcaactggcttcagaagagtgattcttcctctaattagattttattgttgaagttccttcatatggaagatattttccatagtatttggataagctgaactgtgttttaagaactcatatggatgttgaaggttgttttcagtttatctttccagggaacttctgttcagctctgagtgggtctggtcctttttcatgcctgagggagcagatgtgattgcctgtgattgaagccagtggagagttataaactatttttgttctaacatggatgatgcctaaactcttccactcttccacagctgaacatactgacttgtggagtcattggctcctattcggtggttttagccattgacagttactggtccacaagcctttcctacatcactttgaacgtactcaagagagcgctcaacaaggatttccacagagctttcacaaatgtgccttttcaaactaatggtaagactcttaaatccaaaaaccagtgtgacagcacagtaggagtcttgacccacctatgctaaccagagcacttggaaactaaatttaaagaaagtcaactgggacaaaaggagggaacacagcatacaatgctgtgagaaccctctgttatgataactcaggatcatgggagtaaagcatttaaaattttaagatgaagataaaaatctactaaatgaatttcattaagaaatttccaagattatttaggtttacctggtcattctcagaggggagaaaaatactgacagtaaagatgtttgagacttatgggtggggatggaataagggatgagaatgacaacctgatttaatgttaagttattcccttgtttccctcctttaatgaagcatgcagtttgctagttgaaagagtttttaattagtaagcatatagtttccctcacttgtaagattctatccattacagattttctataaattttttgaagaaaaaaatgactaccacatgaattgttcagattgtaagatatgttgacttcagaaatgttgacatgtggagagtgaaaaagcatgtcctagaattgaagatatattgcataagcacaattgtgattgttgtgattttattttagggcaaatctttccctttactatccagagctttccctttggataagaggttgatggtagagaccttgaaatccttgaaaaccttaaaactcttgcaagttttaagtaccagacagtgttttgccaagctagaagctttactagaagctgagtacgattggttgaatcttttcatgcattcctatacctacactgtgagtgcagtagggccccatgtagagtggaatgggaaagaaatgagcgtggtggaatctgatgttccatgatgtacatatgtgaagtgtaactagatcactgccttcctccccgaaccccctctgaaaaaacacacaaacaactgtgggtacttgttacataatgttggaaggccaaggatccaaacaactgatttttttacaacctgtctggactttcaaatgcctgtaatagaaaattcctagtttcaaaaataagactgtggcttccctactgattccttggtttgtaactgaggaactacatatgtgtttggactaactcaccagaaagtctattagaaaggaatatacagatttagtccatgaagggttgtattattatgttagattttaaaatactagagttcaaactgtactttttctactgttttttagacttcattatcctggcagtatggggcatgctggctgtaagtggaattacgttacagattcgaagagagagaggacgaccgttcttccctccccacccatacaagttatggaagcaagagagagagcgccgagtgacaaacattctggaccctagctaccacattcctccattgagagagaggctctatggccgattaacccagattaaagggctcttccagaaggagcagccagctggagagagaacgcctttgcttctgtagatgcccaggggcttggtcagtgtgcctcagctttggagttcatgcctggagtggttcaacagtctctggtgcaagtctaataagagatcaggcatatatatctgttctttgcataatattatggtgcccttattgatatatggtaagggtgtactaggggattaggatgattgtaagagaatgagaaagatgaccaaaaggttggtggtagggaggctttttcttatttccaaatacttgagaaattaccttttggtttacaaatctatgatcaacttattccattaaatagatacattaaaaaaattaaaaactgattcttctgcagagcactggtgtttctttttataaccccttgaaacaagtctctcacctgagcctgtctaaactttcggagggagtttattattgagtctttatctgtgacagtatttggagatttagggatttgatacttaggcctttgaattttagaatacaaaaagagaagcaagccagacatggtggctcacacctgtaatcccaatactgggaagccaaggtgggagtatcgcttgagcccaggagtttgagaccgacatgggcaacatgacaagaccccatctctacaaaaaaattaaaaaattagccaggcatggtggcacatgcctactcccagctcccaaggagactgagatgggaggatccctggagccctgaagattgaggctacagtgagccttgattgtgtcactgcactccagcttgggtgacagagaccctgtctcgagaaattaaaaaaaaaaaaaaacttattttcttactaaaagcagtctgattacttagttgcatgcccttcttagtatcatacattatccaaaagttaccctttgtttttttttcagtattttttaaaatttttaagttgtgataaaatacacatgaaatttaccttcttattcatgtttaagtgtacaattcagtaggttccctttgtttttgccttttattgcttaaaatggtaattgaaatagctaaattattatttgaaaataggccaatttatatagataatagaattttataagggtgatttatattccaaataatggcccccttttttttttcaaggccttttcaaatagtgtcaacaggtgatctttaatttaactgcattagatgacatatggattacttttgtttttaggaaataacccccaccttaatctatattgccgaccaggtgcggtggctcaaacctgtaatcccagcattttgggaggtcgaggcgggtggatcacctggggtcaggagttcgagaccagcctggccaacatagtggtctctactatagtatagtagaatatatactactacaccctgtctctactaaaaatacaaaaattagctgggtattgtggcaggtgcctgtaatcccagctactcgggaggctgaggcaggagaatcgcttgaacccaggaggcagaggttgcagtgagccaagatcacgccactgcactccaccctgggcaacagagcgagactccgtctcaaaaaaaaaaaaagtctgtattgccattaataagaaaaccttagaaaaatttgtacttcatagttctttctgctcaattagctgttagcattagtgtaaaatatagtttttaataatttctgtacaaagcctttgtacagaaaggcttcatccttaaagtgatgagaatggagtcaaaaaggattcaggtgtttagaggagctgcttttcattaggaccttggagagtcccctcagttttgacacccttgtttcaccacaagaaagcacccgacaccctgggttgcatacttactactcaggggctttccccccagctttcagagcactgaattattgtgagctggtgactctgcaggcctgagtggtattagggttgtggaatgttgttgcatacacgtttatgagttaaccactatttaaatgatgctgctttttaaagttttttcaaagtacaatagatttttgaagtttcaggtaactggaaaaatatttaacttttgctttaagtgtttggggcaggataaaacaacatagaaaatataaaacaatttttgctttgaaaaatacagtgcaggtgaccatttactgcttattctgtaatccttactgtctataattaacttcagtaacactgaaacttgatgaaaagttttaaaaaattatttactgtagggacaaagttatatggaatgtttgttattttctatactatctgaatgcactgccagtgaagactgtaaagacagaacacactattttggagggaggatactaattgtttaaaatttttcatcatttgtgagtgataaaaagtttgtatagtttttataataaatccctattttgaaaaaaatgctaaaaagcctcattaaatattttcataaaatttttcagattatatttgtaccacagcaacaagacatgacgagtttcatagctataaaagttatttaatatgggcaaacaatatagttcttcatttttaaaaaatcacaaagataataacaggaaatgaaatctggggcaatgtgttaaaagactaatttggtgttattagcacttcaggtgtgtcagactaaagaaaagtagtagttaacaggaaactctgttgaactgttctttaaaatgttttcagaaagttctgattaatctgttataggttagctaccaggttgccaaaccatactaggtatattgtaccacaggccagttgagttttctgtagcaggtgaaataga

SEQ ID NO: 16209 - DNA, 12240 bp, Human
cctttcgttcgcatggaatcgcttctgcccacggggcgctgacgctaccgagctcatgctaatatgctattcttcgccctcccctcctcatccccctactcacacaccctcacccgccaccacaacccgccccccccacccacttcctggttttattttttttctcgcgcccgctagggcatcgccgagcagcggcggcggcggcggcagcagcagcggcagccgcaacatctgggggaaacttaaggtggtcacgtaggtttccccgaggctgcggcgcaaaagagcccgcggcttcctggggcagccgcagggcatctgatggcaacgcctccccagccgccggcgagctgggggcagcagggagtaggcaaaggcggggctgcagattagggttgagcagcccgggatcccgaatagttccacggagccatcggccggtactgagaacacgagtaggggggcaagttgcaaaagggtcccggctgcctggaaacgagccacaccgagaaaggaggggcggctgggacgctctgcgcgagtagaaaagcgggggcggctccgaactctccctcccaaggcccagccgctggaagccccgcgggagaagccctaggaagccctcccagctccggccgggagacggggagggggcttgccctccggagctgcggcgtttcctttgctagaaagctccctgcgctctcggcgtggctaggggaaatgacttgcaaagcagaagcggcggcgacttggacggccgcgggggtgggacacgctcccacagccagctcgggcccctctcctggctgggctgtaggctcacaccttacgctttgcggagacgctgcccccaatccccacccgcttcgcttttcttgtccagtctttctgggctctaagattgaggctgtgatagaccttgtgtttcaaacgaagatcgatttattcccttaaaactcgtggaaggggtacgagttggtgggcacagaggagtatcgaaagtattagagtttgcagaaggtgggaatcagagtacctttctgcagaaggcgcacctgttgcctgctgctcggctgcattgtctgcgaaaggaaaaggggcgacgcttcactctgacttttggggtttctaaagagctgggtcacggtcactgtctaccctctccccttcctctcccccccccccgcaagcaccacgtcctccatcgaacgtgggcactgcatggaaataaggaaacatagaaaaataagccctacccccactcccattccctttcagatgggagtgtggggggtgggggtggggtagagagagtgagagagagagataattagaatgaatatatgccagaagaggaggaggcctgggacaggaaaagggagtaaaaggggatgaaccgggtagggaaatcccacccgaactgcgtgagccctctgagcgtctcgtgtcatgggacatctgtacgctcttccgctaagggggtgacgaaggtgggtgggagaggttagggcgctgcaaggcacatcccattccgtgcggctccaggtgcgtactacctggcccacgccggccttgccttccgccggtgcttttgttgcaccctccccacatgtgagcggccgagccgctgcgcgggcgcaggggcttcggggaaagtgaagtgtcgcgacgctgcgggctgcgcagacctgggagaggtcacacctctttcggaaaaaaaaaaagaaaagaaaaaaaacaccaaaaaccacccaagctggctaccaaggtgaacgcagagcggttcccaccttaaaatcggccctgctcgtgacgtcaggtcggaaatataccaaagcgagcgcgggccaggagtccagggagcgcggcagcgcggcgattgggcggcgggccgctgacgcgcgctgacgcgcggagactttaggtgcatgttggcagcggcagcgcaagccacataaacaaaggcacattggcggccagggccagtccgcccggcggctcgcgcacggctccgcggtcccttttgcctgtccagccggccgcctgtccctgctccctccctccgtgaggtgtccgggttcccttcgcccagctctcccacccctacccgaccccggcgcccgggctcccagagggaactgcacttcggcagagttgaatgaatgaagagagacgcggagaactcctaagtgagtagatgcagcccatgcagttcgccttcttttatgctttttccttcttttgcacgtctcttctttccacttgtgtgggacaggttctctggaagtgggagccagaggcttctagtgagagtgggaccgaaggatggggagtgcgtgcgcgcagttaccggggggcatttgttcgaactccggctttggcactagtggggagttggctctcgacagaggtttccaggctcctcattggtggacgtggaagggagactccacagtttgggagctgaggactagcccgcggaaatgtgcgcaaagtttgctgttagtgaggaattgattgtggcctgtgaacacggagactccaagtcctatgtatacgagggaagctgcccacaaactgacagggagaggaagttcttcagtttatgcgttgcttgggaactgtgtctccgcggctggccagcgcgcgatgtttcccgggtattgttgagtaagggtggtgttggtagcgtgtcctgttactaagttgcctgaaatttctggttttgacatatgctgtccttgggtttgcgaatgtatcagagcgagaatatgaatatgtaaagagtacagttatgaaactgtggagctaccagggggttaatatccaacacaggaatatctctaagggctgtggggttcgagtctcctttctgctttttctgggtaatcttccccccacccccaccaccactatgaagcaagattgtgggggaggggaaagaataaaaagagaggatactggctttcttttttcattagtaataagattgtctgtgctctagaatgtcttccaagtgggaacatctgaaaattactaggacacaagaatgccttgttccagaaaggcagattgtggaaggcattatggggaaggtgttcatcttgctgtgctgggaaacacttctaatattggtgccaataccatataagcagtatgtcccccctctgcaattgacctaagaagctcctggaaaagtagatcccctcttcccaccttgtgaccattaagccttgtgaccattaaagatgctgaaagacaagttttctggaaaagtgaacatcaatttatctgtagctccaatcccagtgctctgtcaaaagcactttagaagtgcggatgcttccactcaacttgccttctcagtcaaggcctttctaacattttgtaagggggaagattgttttctcattttatattcttgacttctactttcttcccctctaccaaaagaaaaggcaatttcaccacaagaaaaaaaaatgcaagagaaggttccaatgctgtattttcatactctagtcttcatactcaggtcctgaattaacctaagatggaaatgacctctccacctacactgtagcaaaggggccagttcattacatcataaatgttaaatgagttcatggactagctttcctcttgcaggatcttctctctgcaaggatttacacagtgcaatgggtggtattttctgttgtttcaagtcatttcttttatacattcattttaagtgctatgtttggtaaaggcttcccactcatttccaatgagacaaacagggaaggcatggaagggcctgcctggtgagtctacatatgcccagctgaatctctgtcgggaagaaaccctgaagcttcctgtgtctgtatttcagggaggagattggacaggctggactccccattgcttttctaaaaatcttggaaactttgtccttcattgaattacgacactgtccacctttaatttcctcgaaaacgcctgtaactcggctgaaggttagtgcaacttcatttctttcctttactctccagagctccccaaacatcaagaaacaggacaaggcaaaccctgtaacttaaggtttgcccgacccatcgccttcgggaacaactttctcattgtgaaattcaacttcatttctagatggtcatttctagaaagagactgctgaatctgagcttcagagaagaggctcatctgagtgggatgagtgggggggtatgagggagatgtttggaaatacccaggagtgtagaccctcagtagctttttagctctgggtctttatttggttagtctttccacgccctaaactgttgttctgcagcattctctctctcctgcctttcctctcgcgcccctacatgctctctgactgccgcgggctgccggtgtagctccaggtgtacccgagcccgggagaaagtgttcagttgaccaggctgagtgtgttatcaccctgtttcatttccagccatgccttgtgttcaggcgcagtatgggtcctcgcctcaaggagccagccccgcttctcagagctacagttaccactcttcgggagaatacagctccgatttcttaactccagagtttgtcaagtttagcatggacctcaccaacactgaaatcactgccaccacttctctccccagcttcagtacctttatggacaactacagcacaggctacgacgtcaagccaccttgcttgtaccaaatgcccctgtccggacagcagtcctccattaaggtagaagacattcagatgcacaactaccagcaacacagccacctgcccccccagtctgaggagatgatgccgcactccgggtcggtttactacaagccctcctcgcccccgacgcccaccaccccgggcttccaggtgcagcacagccccatgtgggacgacccgggatctctccacaacttccaccagaactacgtggccactacgcacatgatcgagcagaggaaaacgccagtctcccgcctctccctcttctcctttaagcaatcgccccctggcaccccggtgtctagttgccagatgcgcttcgacgggcccctgcacgtccccatgaacccggagcccgccggcagccaccacgtggtggacgggcagaccttcgctgtgcccaaccccattcgcaagcccgcgtccatgggcttcccgggcctgcagatcggccacgcgtctcagctgctcgacacgcaggtgccctcaccgccgtcgcggggctccccctccaacgaggggctgtgcgctgtgtgtggggacaacgcggcctgccaacactacggcgtgcgcacctgtgagggctgcaaaggcttctttaaggtgagcaatggcgggagcggagtaggcaggtagggagcccctagtgcccgggacctcggagtgtgccctctgccttggtgccagtagcccagccccagctctcccgggactgcccagctctccggggtccgccgaagctgccctgcaggagaccatgggctgcggcggggacttccgggtgtctgagaaagggaagcagaaagactgggaggccagggtcgcatccccctcgcattcagccgacccggctggcccccgcccgaagttgctggagccggagttggaagagggtcatttgcatgtgctaggagctgtcttccctgttcagaatgaaattggttaggacagagaaccgtgtctgagctaaccaagtggaacagaattccctatggtcaaattaagtgatctctttatttcgccatcctgattgaataatcttatcattttaaatagagaaggtctccaaggaatgtaaataatatgaatgcccacggatttgtatttactgagcgtctccttctccttctcttggcatataaaacacagcaaggagcggcaaggttagctcaaatgttaacgctatcaattttcttctgttaaatgccctgggggaggaaaaaagaaaagaaagaaagaaaaggaagagaaaaaaataaaatggaattgtgtgtatgtgtttgtttgtggggaggaatcgtagaccccagtcacataacagaaattttctccgagttgcctgattttcaaaagaagaaaaaaaatgttggtctatattgtctccttttgcagcgcacagtgcaaaaaaatgcaaaatacgtgtgtttagcaaataaaaactgcccagtggacaagcgtcgccggaatcgctgtcagtactgccgatttcagaagtgcctggctgttgggatggtcaaagaaggtaggctgaggggagctgccgaccctccagtttgcgcctttaggaaaccactgctcatactccagcatcacgttccacttcccggtgctggggatctccgactccccctcagtatggcctccaggaccctgcagctgcctgcttgcccggccttccctagagaaagccgccaggcccttctctcctttaactatacgacccatttggaggaagacataaaataaccccgcattttttaatgcttctagtcagtgaaggctttacaagcactggggccctcagccgctcagcctggtgccccgcggctgcggccttccccggggagggaccgaggcagcagctgggcctgggctcggaaaagcggcgctaacagggctcttcctttgcagtggttcgcacagacagtttaaaaggccggagaggtcgtttgccctcgaaaccgaagagcccacaggagccctctcccccttcgcccccggtgagtctgatcagtgccctcgtcagggcccatgtcgactccaacccggctatgaccagcctggactattccagggtaagaagctggcgggggggatatcatgtggacaaaccgacagatgggcaggacccctccccacatccgtcattaactctcagattcaacgggggtaaagaaggcaagcaaggctgtatatgcctcgcagctctggccagggcctcaagattcagatcttcagacaatccatgtagctgggggcatagacatgaggacaggatggaggaaggaggagagggacacgccacagggtttgaagctgtgtgaattcccactaccccactaccccatcgcccctcctcttccatatacaccagtgcctctaccatgaaatccaggggctgtgcaaactctcccccttcccaatctactttattcccagtcctccatagagatagatgctttaatcctcatccttcctggcactgtgctggggaaggatgtgggggcctgtctgggggtcagggaagggaaggagagggtgtaaagaatgccagtggggtgggggatcaagtggtcagatcctttttactccagctgtgaaaaatatgcgggctttaattggaggaagtatgttgagcaaacctggtagggactgcaattttattaagatttgcaaaagggcgtctcagctcgaggcccactctgggactagcatgaatactaacatgtcaattgttttgtggagataagagtgaacgtttcccagggctggatggcactgtatttagtctgtatggaaatgacaatttacatatttaaagcagcgacctcgtagcaccatccctaattgaattaattgccccggaacatctaatttccttactggtcagagagaggtttaattgttataaaaacctggctcccctattagaaacggggttagcaatttcacgggttatatattttagagaacctcattaagtgctttttaaaatgaaattccagttccaggcgaaccctgactatcaaatgagtggagatgacacccagcatatccagcaattctatgatctcctgactggctccatggagatcatccggggctgggcagagaagatccctggcttcgcagacctgcccaaagccgaccaagacctgctttttgaatcagctttcttagaactgtttgtccttcgattagcatacaggtaataagggagggaggagacaatccagggaggctgtgagagaaatcaagaaaggaaaagaaagggaggaagggaaaccagagggtggggtagagaaaaagacagaataggaaatggaagtcggagaaaggaagaaaaagaaagaaaacaaaaaaagacgagaagaagcgagcccagaagccttggatgaatggaatggaggtgggatagggggcgttcttgattgttatgaaattaaaccctttcaaggtccactggtctacattttattaactcttcagtaattaggtgactcttaaatccctcatttattgctcttcaagtaattagttgtttagcttttctctctctctttttctcccctctctctctttggtattaattgcaggtccaacccagtggagggtaaactcatcttttgcaatggggtggtcttgcacaggttgcaatgcgttcgtggctttggggaatggattgattccattgttgaattctcctccaacttgcagaatatgaacatcgacatttctgccttctcctgcattgctgccctggctatggtcacaggtcagtactgcaggcgcagggcgcttcccctccagaactgcctagcaggatttgtcctgagtttcccttgtcacagattctccttggttttgccaactagctaactgtcttgtacattcttcttttgtttctgattatgttttctgcagagagacacgggctcaaggaacccaagagagtggaagaactgcaaaacaagattgtaaattgtctcaaagaccacgtgactttcaacaatggggggttgaaccgccccaattatttgtccaaactgttggggaagctcccagaacttcgtaccctttgcacacaggggctacagcgcattttctacctgaaattggaagacttggtgccaccgccagcaataattgacaaacttttcctggacactttacctttctaagacctcctcccaagcacttcaaaggaactggaatgataatggaaactgtcaagagggggcaagtcacatgggcagagatagccgtgtgagcagtctcagctcaagctgccccccatttctgtaaccctcctagcccccttgatccctaaagaaaacaaacaaacaaacaaaaactgttgctatttcctaacctgcaggcagaacctgaaagggcattttggctccggggcatcctggatttagaacatggactacacacaatacagtggtataaactttttattctcagtttaaaaatcagtttgttgttcagaagaaagattgctataatgtataatgggaaatgtttggccatgcttggttgttgcagttcagacaaatgtaacacacacacacatacacacacacacacacacacagagacacatcttaaggggacccacaagtattgccctttaacaagacttcaaagttttctgctgtaaagaaagctgtaatatatagtaaaactaaatgttgcgtgggtggcatgagttgaagaaggcaaaggcttgtaaatttacccaatgcagtttggctttttaaattattttgtgcctatttatgaataaatattacaaattctaaaagataagtgtgtttgcaaaaaaaaagaaaataaatacataaaaaagggacaagcatgttgattctaggttgaaaatgttataggcacttgctacttcagtaatgtctatattatataaatagtatttcagacactatgtagtctgttagattttataaagattggtagttatctgagcttaaacattttctcaattgtaaaataggtgggcacaagtattacacatcagaaaatcctgacaaaagggacacatagtgtttgtaacaccgtccaacattccttgtttgtaagtgttgtatgtaccgttgatgttgataaaaagaaagtttatatcttgattattttgttgtctaaagctaaacaaaacttgcatgcagcagcttttgactgtttccagagtgcttataatatacataactccctggaaataactgagcactttgaattttttttatgtctaaaattgtcagttaatttattattttgtttgagtaagaattttaatattgccatattctgtagtatttttctttgtatatttctagtatggcacatgatatgagtcactgcctttttttctatggtgtatgacagttagagatgctgattttttttctgataaattctttctttgagaaagacaattttaatgtttacaacaataaaccatgtaaatgaacagaattttgtcttctttttgggtcagaaaaaataatgactaaacagcaacataacatacacagttggagattaatttgggataggtcacttattcaatatctgaattttaaacagcctaaatctattctggcaaaagaaatcaggtgaaccagaataattatccagataattcagtaaaatattttttcttaaccagaattttccagtctggtgaccaatatttattaggatcaatttagaatatctcaattcttctgttaactttgcaagtaagtgtagctttcaggagagaagttctggagacccaaaagcttttgaacttgagcaaggtcagagtctagtcaagtacttgtcttgcacagtgattaggaagtatctttttaagactcaagaagtcaacatggatttgaggagtgttgtatgtaatctccgattttccaatttctcaatttacaactgttgggtcatggagaaagggcaaagcagttcaggccctttgggccttgggtcactttggcacagagcagaactcagtagaggtagttcttacaactctttattttcctcattcagtggatggtgatgaggtgcaatttgtagttttagaatagaatttctcccgtgtaagtttctcaggtacatgataaaatatctatgtgttgggtcttgggcctagtataagcaagttgtagccgggcctctaggattccacccagcaccaactttcaaaaaagaaaggaaactgatgctgtagaagctgcttccactcagaacccttgtccttgggcaaatgaagtccaacgagtttcaccttagggcagctgtgaattcatagagagcataagatggggacggtctccttcgctgaccctagtgaattacagatggcctttgggtcactgaaatttatgaagagtgttattgtttttaaaatgcagagttagaactgtaaattgccacgagagcgctcaggttttcttttgtttgtttcccctctttttaaaagacacgttttgcgggtcagcaaaaagagagaatgcaggtgtcggtggtaatataaggttatttttacgagatgcgtttttctccgggtaactgagggacaaatagggtggccacataagagattaaataataacgaaatgttcaatttcttgactttcttgaaaggatgagactagccatatcattttgttttcacatcttatgcccaagtaaagccacaaagcagtaagtaaagcgaaagagaaaagctctttagaaatgctgggaatctgcagagccttcagcactcatctccctcccaggtgtctgcagccctgagacaatgacattccgtcacacaatccccgagagttgaacccagaaacgaactctgtgactggttctcccttaaggaagcggctgcgcaacacccaaggccaagggggtgtcgggtagttcgcctcccgggaatttggggtcaaaggaggcagagatgaccctccaccatgtccgcgtgccgactgcaccggctcgcggaacattcagttgtgattcctaagttgcaaattggctagtgccttttctgtttcacagagtcgctgtcaaactcccggccggccgcgcaccgagttgctcgggtgaagagcgtcgcatgcattgcccctgcatctttccagatgcagctgaggacttttcttgtcctaatgtttctaggagtaaagtgaggaaaaacagcagacacgctgcattgccaaaagccagacgttgcattaccttcttcagaaagagattaaactttgtaatgagggcttcataccgccctcgtattcccgcgtcctcttaagcatttcagttattgtgtatcgttccagcaatggaaaatatatgatcattgttccgaagacatgaccatacagttctcagctctgagggaaggtctaattttaagtctttgctatctagccccattttgagtttatggaaagatggccttaattcaaagctcgagtgagcagtgag

SEQ ID NO: 16210 - DNA, 27120 bp, Human
gcttacctttaaatctgtggaaaccccgtggtcagcatttgaagtttgctttactgccaaggttctctgccacaagagacttttattctttgataataattaagaggtggaaaaagggaagtcactaccaattctccactccacaaagtatatgaattcataatatgccaacagtggccaaaatgtcctacttctaaggctatgttacacccttagaaagatttatacataagtcagggagagacagggttaggcttcttttgtacttcgatcatcgtagaatgcccaccttcacaccctgcaataattccaacagtacgtgtgcttggggacccagagaattttacagtctccatatagcacccccctccacttcttccctcaacctgctcccaccaatgcactgttaggaggatgaagggtaaggaggacacacaactttctcttataaagggtggaagcttaccctaagaatggaaataaacttgcagaccagttctcagagagatcaaacttttgaaaaagttcaaaatctggtagatgaagcccttagaacagacgtcagccactctgagaccagcgtcagagtggtctcagagtggctgaggcccaccgcctatttttgttcagcccactgctaagaatggtttttgcatttttattttttatttttttgagacggagttttgctctgttgcccaggctggagtgcagtggggagatctcagttcactgcaacctccgcccctcgggttcaaacgattctcctgcctcagcctccagagcagttgggattacaggcgcaggcaaccatgcctggataatttttgtattttgtagagacggggtttcagcatgttggccaggctggtctcaaactcctgagctcaagtgatccgccgcctcagcctcccaaagtgctgggattacaggcatgactcactgcatccggcctgcatttttattataaaatgtcatttatttatttatttatttatttatttatttatttatttatttatttttgagacagggtctcactcggtcacccaggctggagtgcagtgagcgatcatggctcactgcaactttcacctctctggctcaagcagtcctcccacctcagcctccagagtagctgggccacaggggtgcaccacaatgcctggttaatttctttaaaaactttttgtagagatgggggtctcattatggttgcccaggctggtctccaattcctgggctcaagggatcctcctattcctcggcctcccaaagtgctgggattacaggcgtgagccatagagcccagccgatttttgcatgtttaaatggttgggaataaagtcaaaagaataataatatttcgtgacacatgaaaattatattaaattcaaatgtcggtgtctataaataatgttttattaggacctagctgccctcattcctttagtatttatggctgcttttgagctacgacgctcgagtttgaatagttgccacagggatcgtatggcccgcaaaacctaaaatatttagccctttacagaatagtttgctgtcccctgtcttaacacggttcacatcccatttgggaagttctgtgtcttcagaggggagcacacccggtatgaaggctggtctaaactcaacaccctagggaagtccttcccgtccctgggccttagtttccccaactataaaatggggttagccgcagtgatctctggggacctgcctggcagtgggtcaaataaataaagggagttggagctcccggagggtaggactaggggttgagtaggagccggcgggctcgggcagggcgggtcccttggggtttccaactccgcgggcgggcgcagtgccccgcaggcctcgcttccactggggaattccgggcggggtgcgggcggcggggcgggggcgggccggggcggggccggtaggccgcctataagatgggtggcgcgcccgcccggggccactcgccgcagcctgcgcgccttctccagtccgcggtgccatggcccccgcccgtctgttcgcgctgctgctgttcttcgtaggcggagtcgccgagtcggtgggtgcttggaggttcccgggctgggggcgaagcgggggcgcaggccggtgcctcctttgttcgtcggagcgtgggatggggggggcagatcgggggtacgctacccccaaccggacaccgaggcccgggaaactttgttggaaactttgctccggggtcacgggccagctccgggatggcttcacgcgccgtgcgcccctcgcctgttgctcttcccgcctccccgggcctcagccccgccgcgggctacgggctcgttagtgactaagccggtgtcaactcttcaactcccacaccctcgtcccttccctggtgaccctggggcaggcttggagcgctgaatcccctcctcgctctcggggcgcccagagcagacagctttaggatccgagatggccctgggggtcggggggctgcgtgtactcggaagggggagggttttagggttgtgcgaggccctctttcacacaccaaggagaactgagccctaacctcagttctggccccagctctgtcattgacttgtgacttagggcaaagtcctgcccttctgaatctcttcccaatactgcaccaagggtctgagggaatggggcaagaggggacactgcgttagggtttctagaaagttggggactctgctcttttcgaggacagaggagaggaatggtttagactcaacacttagccaggagctgagcctctgctttctgcaagaagtgtgttcattttttctcaattgcagataagaaaattgaagcatccaccttgagtgaggtgaagggggtaggggggagagaaggcctcaatcagcccagggaaacctttccttctcactgtccactggcctccgtcatagctgtccctgggccagcagaagctctatccatgcccgcagccggcttaggaggaggggggcaatctcatctgggaagttggggggcatgggaattactggtgaaggcaatctgtcccccacagcctgagctttgtgccccctttgtgccctttagccccagttttcagagcgagtgagtccttgcagtttaaccattaatgttaatttctttgaaagccttggggctcctgttcctctgaatttacttagcggaaggttgattctgcctgcaggctcttcttgaggaatgaatgagaccctaggcaatacttccagcacaattccaggcatgccatgatgattgcaaacgtggagcgcctttgtcggggggccagacattgctctaataactttctaatgggtatatccaggagcttaattccaacaacaatcttactgtgtactgttcttaaactggtcctgaggctagagaggttaagtaacttgcccagggtcacacagttaatacacaataaatgggtgagtcagattgaaatttaggcagccaggctttcaagtttctgctttagcttaacttctactctttgtgctactccaggtgtcccatcgttggtaactaaagacgggtttagaataggttgagattttaggctggaaggcaaaggaattctgaggtggaaggaaacaaggccagagtgaggtgatgacttaacctaaaccaaaggctaccttgcctaaaatgttagtggctgaggacccaagccttctgcctctagcacagtgctctaaactaggccctgaaggatgtgtcgggtcaagcaactggggaagcatccgaagggataccacctaggcagtacagggaaaaagaggaaaggacccaggaggttgctgaggtcaccgtgtgcccagtcacatgccagtttcctcccaggggctgctgagccttcaggtgcttcagggtgctgagctgtcagctgtgtcctgggggcattctgaaggatgtagtttgggggaaggggactgtgtcagtcctgcctgggtgacccatcagctgcaggagacatcagccctgggcagctgcttcctgagataggtgtcaagtctcatcctgacctcagctctccccttcctggctaatgtcacagacctcctgcctgtaactggggcacagggcttcccctttggcctgtcccctccctcttttctagattgtggttggaaaaatcagacatagtcacggttggctcggactgaagagatgatccagcgtgtccttttctttttgcaggtagagaaaagtgaggcccagggagaaggactttgctaatagcagttaggagtgatagagtactttttatatgacagatctggtgcattttgtcctcacaaaaagacctgtcacatggggattctattatgcccactttccaaatgtgagaggtaaaatggtactactttgggttagtagagggcatccaggaccccaggatctctgactagtagccctcccattgtgggtggtgttcgcccgactgttccatcattccccttaccacccccatattttggaagggaacccaggctcagtacccagctgtcctctcctctgtttggctgggcttgctatactaaaccagttcttcctgtccagctgggagcattccctgatctgccttcctgccactccctctcaggccaattaaaggcagccttgttttgggagtcccctccacccaaaggtgttcctacccaggggcacagcctactgacttggccccaggcccaggcggttgtggggaagtgtcccccacctatcacctatcaagtgtactttagcttaaggacatttctggtcttctacagcgtcctcttcttgattacatgggagtaggggtgggggcggaagcctaggggcttctaggacccttgagtgaacagtgagagctcttgggacttcttgagcccagggagttatcaaacacccacgaaaatatttgggccatgatttggagggttccgtgaggttggggggaggcctctttccccgctgggctgacatcccccaccttaaaatgaaaggtttgaacagggtagcctccagagtcctttccatctctcaatttgattaataacttaagtacctactattcaaaagaggtctctctcttgaaggaattaacttgagggaattaacatactccaccaaatgctgaatccctccctctctccccccgcacaccgagggcaggaactctgctctatttgtttttgtgaaatacctgtcccctagtttgtactcaggaaatgcttgtatgaatgaataaattcgtgcatgtaactttattctaaatggttcattaatgttatttattgctagtatgagtatctcccagtactgcgaggtaccattttctctatttttacaggaaattgatgctcggaacaatgcagtggcttcctaaggtcagaaccaggtccttctgatagggcaaggtgtctggtttgagtgtcctcagaatattccagatgaggaaatttgctgggtttgaaggtagataccttaggtcctacttctgcgttgctgggtgaccttgagcaaacatgccctgtctctgggtctcagtgtccccaactctaaaataaggaggctggaccattgccttccaagggtccttcctgcccagagagcccattgatgaggggaggggccctttgctggcctccttggtgaagagtctaaacaaatcccagtctcagaagagaagttggggtggcggggggacattcagctcctgccatccccagctcctagaaacagagggcttttccaaggacttggagtgctgagcctgcctgaatgaggagctggggaagccaggctgggctcccagccccatctccctgttgggagaagttggctcctagctgtccttcaacctcccggactggacaggcgagtgtgatttccaaatgaatgcttaaaattggggtaaggggctggaccgagcgctgtgagtcactgcatgctagcgtagcctgcctgagtcacccatttcctttcaaactcttggctaataggacagctctgtggtgggggtgttggaatgagctcagagttttaccttgtcctttgggagtcactgtttcagtgtccggggcctcgaggggacatacaggacatgtttgtactaggtcccgcactttcacagccccttgcctgcatgtagactttgacattgtacattgtgcagccagtcctcaaaattgggctttagacctctgcagagcaggtagtacttttttcctctttaaggcaaaactgaggctgcaactggcctgcattttttcagagagcaaaagctggtactgttcaggtttggtgtgaccccaggattttctgatgtttgtgaggactcctctttgcttcctggggctggccagagggcattgaaacattggcttggtgttacacagacttaactccagacgtgcgaagtccacctcttactggctacatgaattcagtcatgctactccacctctgagccccagcctcctggtctgttaagaagatcatgataccggtgtggcgaagcttaaaggagacgacagggctgtaaataaaggcacctagtaccatgcctggtagggaggaggtgttacttagtgacagttcccttccttgcccaggccaccttcatgccagggggtcctatctctgaagattctgagcccaggtctcctggaaagctttctccatcccccttatcccccttatctacccccacagctgggaggtgggaagggagaaatctagggtggggcttttggagtccaaatctcctatttgtttatcttagaagtgggctgtttgctaattatcgaatgggtttatgtttaaacaagaaccagttctgggcagccccacctctcctgctgggatttgctggagcctcatgctgaacagtttgcagcctggagggagagggggcagggggtttgccaagggtatcagaccactctggacactgtccaggacctggggtcaccctcctgtgctggaggggcagagtttctacccttaaggaggctgagtgattgcaaatagcactttgaggggtggggtgttggtggacagaaaaggtacagtgttctgaaaagccagtttctcgtatgttttcactgcatggtgccctagagagggaggagagagaacacatatgtcaacagttggggtctcatttaaccttagaagaataagcctgacttcttgggcttgtttgtcattaactaacacagtggtgaccttgggcacattcttgcatctcactggggcctctctggtcccatctgctgaaggctgggtgactgaaaaagagggtacagaaaactccagcccccgtcctagctctgctgctcacccagggacacacacagttaatacgtcactttgttgatgtgaactccagtgtcctctataaaacacctgtggcactcaaaggtcatcatcgctgtttggcaaacttgtaaagttctggctttattagcacctagacaagggttcttaacccggccagagtttggctttggggaggtggtgtctgtgcatatgttgaaaatgtaaactaagagttacagttattggggtttagacctttttatccttttcagggggctgcagtactccccaaaaggtcactctgatctcagcagttctttctggctttgacctttctacagctatccttcctccctcccccacttcccagccttgttcttgcctcctgcttcccccaacccccaccttcagcccagaccttcctattcagcggcccccaccccttcaggctgcatctcacccctccccctgtcctccaggcccgggagctcggctgctccagttttctctggcacagtagaagaggctgctggtcaggtgacacctggggtaatggaaaggggaggcagggagaggctggtatgtgtggaaacagtgacttggtgaagcccagcagtcagtggccaggcctgcggggactggcggtgtcactctagcctctgggcgtgggggcagatgtggcacatggctggcccggctacccagagtggggatactccttgccttggagaagccctgccggagccgtctgtgggacagactgacctggtctggaggatggcttccttgggggtcggtgagggaggctgggaagaggcaggaagccagcacccagggctgatctaatcagctgagataaggctgcagcgtgggctctctactctgctctgagaacacaggaggtttgtttacatcccgagagcctccctagccctcggatccagcagggatttcggatctgctgcctagattacaagctccaacttcaatgcacctctgtctctgaggccctgagggagccagccccctcctggctgtctccaccggtaatcggagcaatgcccagcttggttactgggctgggacagagggaggcttgtctctttgagacctgtcttttacagattggaaaactgaggctcagagaagggaattgtccacgatcatccagggagttagtaacaagggtgctgggtcagctcctggcagggagacatccagaggctcctgaacccttcccccatttctagctggcaccctaggatcctggagttcttgctgtgggaatgggctgccctgaggcttggtgaaaagctggttgcaggcagtgccaggcctggctctctcctgagtgattgtgttcagagtaacccgaccttgaaggcgacatttgaaccctcactccacccccacccccagacctggtttaaccattcaggcaccagagcaccagaccatggattggtgtgtagtttctttttaccttctagatttttatttatttattttgtccctggggacccaggtccccaagtagaatttcaggtgtttctggtcactgtcatttgcaccttcggggaaaataaaaatggtctttacctctgtctgcttaggacaggtggtcaaagctgtgtgaccttgggcaggtctctgactatctctgtatctttttttcacagtctgaagggacctgattggttgttgaaaagtctctgggctcagaagcaaaatgataacctattatagattatattcctttacagtttgcaaagcaccatctccctgtccccaggctagcttccttccagcaacagaactgcctctgcaagttttcccaggcctctgatcctttgagcactgatcccactggccaggaggaaggcaggtaggggttaatcacagccactattcattgatcacgtgctgggtcccttgcacacacaaatgcattcctcttaatcctcatcaccctgcaaggtgctaccagccctagtcacaaaagaggaaactgaggatttcagagatgaaataaactcccaagctcatatagttaggaagtggcagaactcacacttgtgaatctgccttgatgcacaaccactctgggtggtagagtcacagttgtgggccccaggttttagccattctggggaatgtctggcccttaagaagtgggtggggtggggaagaacagttacgagtagtgtacgctgctgggggtctcctgctagaaatcattctggtgggtccaggtgttggagccccaggtactcaccatcccctctccccactaaatttggcttgcccagttattacccttctggtcttgcctcctgaaagaagggtcaagtgtgtccccgaccctacctcccctggggaggagccaggtcgggagaggctctcattagttcacagttatccaagccctgaccctgaactcctctctggtgccccagccaagtttctgttcctttgtttaagtgatatcactttcacctttgtttactcctaggcagggacagggttgccctggagccctggcccagccagtgtgttgtggactggcgggttaggctggagagaagtgaagagtgggtggcagtgagaagcctagttgtggttgggacgtgttcttgaggaagatctggatttgaatcccagctctagctttctagttgcatgacgttggataagtgactcagctgaacctcagtcttctcatctgcaaaatgggtagagcaccttgcaaggctgttttgccatttaaatgaacttgtataaacaaagtacccagcatggtgcttggcatgtagtggatactccttttagtcactcatgcttttcctggggtgatagaagccataggatttggggatagggttgggataggaccttttcgtagcttcatgcctatagccaaaagactagatggggagtataactgtaatgacagctgctgcctgtggatttgctgagacccttaggggcagccaacaccctggaaggggagagaagataattccagtctgggagccaggatacctaggttctaagtccatctccgctgccagctgcttggatgaccttggcaaaatcccttgtcttgtctgtttgctaggttataaaatcagataccttctgttggcaggtgttagtttctgtagaacaaaagagcacttcccctcccttctttctccccaacagtctggggaagaatgtagtatctctaaacccccaggcactaatcccagatccccaccagccacagggccagcagagtctgtgggacctaggcccattgccctattttttattttttggagacagggtcttcctctgtcacccaggctggagtgcagtggcacgatcgtagctcactgcagcctcgacctcctgggctcaagtgatcctcccacttcagcctcccgagtagctgggaccacaggcgtgcacaaccacatttggctaatttttgtagagatggggtttcaccatgttgcccaggctgatctcaaactcttgggctcaagtgagcctcccaccttggcctcccaaaatgttgggattaagccactgtgcctagccaccactgtcttacttagttggtaatttctgttgtgtgttcatgaaagggacaaagatacaaggagacttgagagcccagagagggtgcctgtgcatgtatacacacgaacacacatgcctgggcaaaggtggggtgagctgaggagaacagaccacattcttagccaggagcagggcggggtccatctctggtcagggctgggcctggctgctgggtggcctggttcttcaaagtcaccccagactcaatgggctttatctgaaaagagggcggaggagaggaggaccgttggtgccttcccaacctttacacaaaaaagagtgattgcccacaatcccacggggcttggtcccgtcttgctggcctagtcctaaatggctcttatccactttggagttgccttccctcttgtcagaggtcatgggtggagaagggaccaaaacagggcagagagggggcttccagagctcaaggagagatttaattccctgtgtcctcctatcaccactgggagctggaagaagtttcttcccagccccttgacttgctgtaggagggaaatcctgggctcatctaaatgcagcctttgaagactccatcttttcagagctttgaaataggatcgaatccaggccgtgccgcggagccccggggtgacttcagactagactagtttcttttttggaaactgagtataaaaatgaagggttaaggatgaacaggtgcccacaaagagggctgaactgggaataaatcttggtttcagccttggttttgctgctgacttggctgcaagatcttcacgccccactttcgctcatagccttcatttctctaatgtaaaacggaggtaattcctaacagccagtgggcatgctaatcccatgggttgttttgaaatacctcttagcactttcacatactgaaagagaggctggatgcataaacaaccttccatggctcctgggggcagtgaggggtgggaaaaggtctctcagcctgagacaagtctcctgatggaactacagcccctgttgaggactttgacctggtcaacagctggccaaagtgtaccattctttctttctcccggctagattgacccccctacttaacagggctcccttggagcctggggcaggctggtgaccccgtgtacatatgtgttcatgcgtgtgtttatgtgtttgtggttaaatgtccaggtcagtgaagcctgggttctggcccagtgtggctacttcctgcttgtgtggccttggacaagtgactttacttttctgagcccttgtttccatctctgcaaaaagggactattaaaaggacctagacaggctgtgtgcttggttaaggcctgtcacttgggttcttgggggatttgccacaggagatggaggtaggagcacagggaccctgcccttaggtataggcacttgggcagccatgaggagccttcctcctgctctgccaaaccaaagccacaggcacgggctatgtgcgggggcttgaattccagcaccagcagcccggcagctcctgattcccgagtcatgaagtcatctctgagcagcacttaacctctctggctttccacccccacgggtgccaagcgttcagcattctccccactccccgggagagagtgattcctggccactgccttccttgtggcctgaccccgctcccttccgggaatccagcattctccctctgtgggggtggaagagggtgcatgagggtcaggttccacctgcctctccccagaagcccagtggggagagtacaggagtggctctgaagcagctttcctgggcctctcctgcaatgataataaccttatcttagggacagatgttccttctcagacaccctcctttgtcaatggcagtctcagctgagtgaaggactgcctggggtgtccgaaacagagacctgacctctttctatcctgagttatgtagcgaacgctctgtgtgaccttgggcaagtccctgccctgttccgggctcagattcaagttgtgtgaaacgggaggacaggagctccttgggtcctggcattctgtgattctaagcagacccccagctcctgcagttatggcgtctggagaagatgggaatgtctttcagcgggaggggcatggtgtattgaacttaatgaaaaaccccaactctcctggcaaatactaggcactttagtgtttgaattaattagtagaataatgaactttgctcagagctgctgttctctgggcaaacagaagcctgagcccagaagctggaggaagggtgatgggcatccaaatgtttcctgtgctcttgagggtacattgttcccactcggtggagctacaggatgggagcagggtaactgatgtactgtagggctgcccgggacctttgacactttcttttggcaagcggtttggtgggagtggacctgagactctgtcctgatcagctgtgtctccacagggtagtggctgagtgatgattatgggtactggagtggatggtctgtgagggtagggattgtgcctctcggtgtctgcatggtgctggcagcagagtagatctgtgggagatgtttggaaggcaagactgaatccaggagtgcactcctgagtcatcaggtctgggcagcgccctgacctgaggctgtcttagggtgtgcgtgaggcagccctgtctgtcccggcccagactgactcagctgggaaaagtatcctggactgggcaagaccagaaccagcagcccactccctgtcctgtgtgaatcagctgccactgcatcacagagccctggagtgtagcatcccagggccctgtgcatggagattcctggctctgaagtcaggcagccctgcgtatgcaatcctcgctcttccatctgccagctgtgtcaccaaaagaaaatgactccctcggctgtaaaaataagtgaataacatgcctccagagttattaaaacagggcccagcacatagcaagtgctcggtaaaggatatctagccatattaataatttgattattacctcatttagtgtttttattttttttgagacgggggtcccactctgtagctcaggctagagtgcaacggcgtgatcctggcttattgcaacctccgcctcccgggttcaagcaattctcctgtctcagcctcccgagtagctgggactacaggcgtaagccaccacgcccagctgatttttgtatttttagtagagacggggtttcaccatgttggccaggctggtcttgaactcctgacctcaagtgatctgcctgcctccgcctcccaaagtgttgggattacaggtgtgagccactgtgcccagcctcatgtactatttttatttgcccagaatggaaagagacttgcctaaggacacgcggtgagttagaggtagagtgggatccaggacgcaggtctccaggccctggcctggtctctttctagtttctgaatgcccacttcactagcttttgggcatcagctgtcatggagcactggggatgttggctgatgtgtctcctttctttatcttagatccgagagactgaggtcatcgacccccaggacctcctagaaggccgatacttctccggagccctaccagacgatgaggatgtagtggggcccgggcaggaatctgatgactttgagctgtctggctctggagatctgggtacggaaggtgtggtgggcaggcgtaggcacaaagctggagggagtggtggcttcaccagccaggagggtgaccatgccttgagacttggatttttgtgggacttttcctagagtgcccttcttccttctcaaaaaaaggggaaacaaaagtaatggattaacctattccatccctgagagcccctggggacaagctgtttgctgctttgaagtcattggtagctctgggttttctgagctccagcctgaacgtgtcctcataagctcttctcttttctgcagggcatggtgggggtggggtgagggtaggatgggtggcaggacagggtgggagtggggaaggaggacccatagagtgttttcctttttttgaaaggaaaagttccagcctgggccacatggtgagaacttgtctctacaaaaacacaaaaattagctggatgtggtggcatgcacctgtaggagtcccagctacttgggaggctgaggtgggacgatcccttgagcctaggaggttggggctgcagtgagccaagatcatgctactgcactccagcctgggtgacagagtgagaccctgtctcaaaacaaaaaaggaaaagtagcagcttagaagtggggatggggtgggagggggcatgagtgggcagagatgtagttgggaaaccaagaacaagtccctgcgtcagtgggggtgggggcgggtgaagggcccaaggcctctaggccagacagctaataagtgtccctcctatgtgcagagaggtgttaatgattgcaagttttagctttgcaagttttagctttggagtcacatggtcctgagttcaagcctccatcctgtgtgaactgagcttcagttttctaatctgtaaaatgggaataataaagatagtacatcagtgttgtggggactgaactgacttaaaggttttggcacctaccaagcactcagtacgtgtgtgtttggtttaaaaaaaaaataaattttatggccgggcacggtggctcatgcctgtaatcccagcactttgggaggccaaggcaggcagatcacgaggtcaggagtttgagaccagcctggccaacatggtgaaaccccgtctctactaaaaatacaaaaattagccaggtgtggtgtcgagtgcctgtaatcccagctacttgggaggctgaggcaggagaattgcttgaacccgggaggcagaggttgcagtgagctgagatcacgccattgcactccagcctggtgacagagcaagactctgtcttgaaaaaaaataaaaataaaaaaataaatttcattatgtgcatacaacatgatattatgggatacatatagatagtaaaaatgttactacagtggagttaattaatatatccatcatctcacatagtcgcccaggaaatgttttaatattgcagttagagttttctttctcaaaagttaattccctggggatcttgttaaaatgtagattttggccgggcgcggtggcttacacctgtaattgaagcactgtgggaggccaaggcaggcggatcacaaggtcaagagatcgagaccatcctggccaaccaacatggtgaaaccccgtctctactaaaaatacaaaaatcagctgggtgtcatggtgcacccctgtagtcccagctactcggggggctgaggcaggagaatcgcttgaacccaggaggcagaggttgcagtgagccgagatggcaccacggtactccagcccaggcgacagagagagactctgtctcaaaaaaaaaaaagtagattttgattcagtcagccctgaaattctacatttcttcttcttttttttttaaccaatgaattatttttactctttttaaataagtgaaatattagctttaatgttttctgatcatgacaatatttttagataagaacattttaaacattcaacagtaagagactattgaaaataaatgaaattcattgaatagaagtaattaaaataataatgtaactctttaagcattgtaatggaaagatgttaatgatatattgttacgagcccattattgggaaaaatgtatttaggaatacgtatggagggaatttatttatttatttttttgagacggagtcttgttctgtcgcccaggctggagtgcggtggtaccatcttggcccactgcaacctctgccaaccgggttcaagtgattctcctgcctcagcctcccaagtagctgggattacaggcgcgtgccatcacccgtggataatttttgtattttcagcagagacggggtttcactatgttggccaggctggtctcgatctcctgacctcaagtgatctgcccgccttggcctcccaaaatgctgggattacaggcgtgagccaccgcgcctggccttgaaattctacatttctaaccagctctcaggtgttgctattggtttttggatccacactttgcagagcaagggtttagagctgatgaagcctctgcccagctgccagctcacacattcctgtgaaagagccagggggtgggtctgaggagccccattttacagatgagatgactgaagtaggggtggggaagctcgcttgctggacattgagcatttggaagctggttgtaaggtggagctcccaccagtcctggctgaaggggtcattttcctggggtaatggacctcactcacacagctattctgaccttacagatgacttggaagactccatgatcggccctgaagttgtccatcccttggtaagtagctacatgcttctgcctcttccactttgctcctctatagcagacctattgggagaggcagaaaatacagcccccataggcagaataagtgaggggtcttaccccactatgcgggaaggctttttaaaaatctggccctggggtgggcatggtggctcaggcctgtaatcccagcactttgggaggcttgaggtcaggagttcaagaccagcctgggcaacacgatgaaacctgtctctacataaaatacaaaaattagccaggtgtggtggcatgtgcctgtagtcccagctacttgagaggctgaggtgggagaatggcttaagtccaggaggcagaggttgcagtgagccaagattgtgccagtgcactccagcctgggtgacagagccagactgtgttaaaacaaacaaacaaacaaacaaatctggccccaggctcattttgtaggttgctggtaggccatcctccctgcagggatagtcaccgtcaacaccaactccttttctctacatttatagctatttcctagcattgatagaaaagtatatatataggccgggcacagtggctaatgcctgtaatcccagcactttgggaggctaagacgggcagatcacctgaggtcaggagttcgagaccagcctggccaacatggtgaaaccctatctctactaaaaatacaaaaaattagcctggcacagtggcgtgcgcctgtagtcccagctacttgattgggaggctgaggtaggaggatcgcttgaacctgagaggcagagattgcagtgggcagagattgcaccattgcaccccagcctgggcgacagagactccctctcaaaaaaaaaaaaaaagtatatatatataattctatgaactgcgtttttcacttagactggtcatgagtatttccctgcataatttaatgctcttgtcatttttataggctgcgtaatagtttacctgattccctttattgacggaaaaatggcttataatttgttaacattttaaaattataacactgcagcaaacatcttttttatttttgcaaagcaataacaagtttattaagaaagtaaaggaataaaagaatggctactccataggtagagcagtggcattggctgctggttgcccatttttatggttatttcttgattatatgttaagcagggggtagattattcatgagttttccaacaaaggggtgggcaattcccagaactaggggctactcccctttttagaccatatagagtaacttcctgactttgccagggcatttgtaaattgccatggcactgatgggagtgtctcttagcatgctaatgtagtataattagcatataatgagcagtgagaccaacagtttcattgccatcctgtttttggtggtttttggcaagcttctttattgcaacctgttttatcagcaaggtctttatgacctgtatcttgtgcagacctcctatctcattctgttacgtaggatgcttaacttactgggaatgcggcccagcaggtctcagccttattttacccagcccctattcaagatgtaggcactctggttcaaacacctgacattttccccctcccttttgtaagaaaacccttaatcctaagggttgcagagggacaaagatccatcttctataacttcttcatgctgaatagggtgatgatattcctgcttaactattagggcctcttgtatccatggtagagaggggttcagtcagaaagggccagtatggtgagggccattcataactcttagttctgacaaaaggtgatatccaaagtcctccaatcagtgctgcagtccatttcctttgattcgggagtctcctccgtctcatcccttctgtggttctccagaaagatgttaccagaaaggggtcccgatccagaccccaagggagagggttcttggatcttgcacaaggtagaattcagggtgagtccatagagtaaagtgaaagcaagtttattaagacagtaaaggaataaaagaatggctacttcataggcagaggagctgcagcaagcatcttttacacgtagtctctgaagagctccttacaatagagtttccagggcaaaactgccaccttaaagggcaagcgatgtctaaggttttgccaaattgcttccagagtggttgctctagaataaccagtggccagcagtgcaggagagcacctgcttccctgttcccttgggtgcattcatttttcatttgggacagatatactaaaaaagttggggataaggattttggcagcataattgtggagacagtgttgccaattcctgctccaggaccatatggttcagctgaatatggcagaaccagattctctgcctggctgaatgtccctgtcccctgccctgagtctcttccaaaatacgctgagtgtctcttctcctttccgcccatccaggtgcctctagataaccatatccctgagagggcagggtctgggagccaagtccccaccgaacccaagaaactagaggagaatgaggttatccccaagagaatctcacccgttgaagagagtgaggatgtgtccaacaaggtgtcaatgtccagcactgtgcagggcagcaacatctttgagagaacggaggtcctggcaggtaagtccccatgctgcttataagatgccttgaaggtggaatggggctcagcgggggagagcacctgcaggcagggatgcctccagccatgaggctccttggtgccccttccttttgcctattcaggttgccctagaacattgaaagactacaccttccttatggggtggctctgactgtgcagcctggtggagggagaggaaaaagcacctatcaaagtcttctggaaaataggcattgagtcattcttctgccttaagtctttctcatttattttgcaaaggactttcactgtataagtttggcatctgggagttaatcattaaaagttaatttcccttgtaagtctggaggctccttcgaattgggttagcttcccctccccctactctatcacttggcagccttgtgaccttggctgagaagctttcgaacttgatgagcctcagtttccttatctgtaaaatgggtacagtgataccttctggggttgatataatgagtccatgaaaaataaaatatgaaataactttgcacactataaagggctattccgatttggcctcagttgagagttctttactggaatgtgcggtgaggaatgctttgtcccaggtgttgacaaaagggatggagggaactccccaaggtcatggccgagggccagcctggatgaaccggcctggcaagtgggcaccctgggcccatgctgggtaactcctgtctcctgggaatcaacagagccagcagctccaaggaggcttgagctatagggacagagcctggcttcatccaggacagatggaaggtctcacctgcctcttgtaaagagggttcctgggagcacagcccctgatgactgggcccacctcagccctgaccctggcttcctggtatctgagccaaagttctttttacttttctttcagaagtaaaaagatttgcataagactttggatttgcataaggttttgctctaattaactaaaggtgctattgcttctaaagaaaaatttgaaaaccactgattaatctaagcacctgcttcttatacatggggagactgaggcccaggctttaggccacatagtaagaaaagaactgaagccaggttatctctttaatcttccatttgagaattatacaagcctaagagcctcatgtgaaaagttatattgttagctggtgtggtggaatcccccattccagaagctttaatcagcacccaggagccttattaaatgcttgctgtatgctgtatgattcctgtgcccctgattgagtccgtacaacacaaaactcagtctaaagaacttatccgaagtcacaaagctggaagtggcagacctggcatttggactgaggaccacagtcagcttctgagcctgtgcttgaaacttgaccctgtggggcatcccagcgcagacccagggcctcgtggaggaactggggtcatcagagggaaaggtgatagagacaagaatggggttgatgcctgatattccatgtgcttgctctggcacctcctgggggtacttttttgttgctttttcataggattttacccaagaaagaaccttgcttgactcctctgtgccactctgtccccattgtgtacatagatttgtagtgtgtgcagggatggaaaattaatcttcttagcccgagtaagaccgaattagggaactcaatctgccacagaagggattctatgaagcatccctgcccctagcaaacaggaatgagtcattcaggccacctggcagagtggacaggccagacccactcactgttagaagcccatctctgcccaacactaggcaggttctcctctcggagcctgaaagtatcatttattaagcacctcctgttgtgcacacctgattcagggggttcgggacacagatataaaccttaaacccttacagttaatgaatcttgagaatatgctatgcactaggcattgttctaagcactttgagtggattaatttatttaatccttaggacaaatgtatgagaaaggtatggctcttcccattttgcggtagggagatgaaggaaacttgccccaaatcacacagccaggaagtaggagaggtaggagtggaaaccaggccttagctactgagttctgtatgtaattgtaacataagagtttggaattagtatgttctgcatgtgtgcactttgaatgtacatacctgtctatgaagtgtaggctatataggtaaatatgcacacagggagagctagagagtgccctgtgctaaggactgcaggataaatatgtctacagggatttccatagcctacggttttctcctgttcctggttcagttagtgctagactgttgcaggggagtccgcgtggtgtttggaaagagcctaggctttagattcaggcagatgtgggttaaaatagtggccttggccgagtgcggtggctcacgcctgtaatcccagcactttgggaggccgagatgggcaaggtcaggagttcaagaccagcctggccaacatagtgaaaccctatctctactaaaaatacaaaaattagccgggcatggtggcacgtgcctataatcccagctactcaggaggctgaggcaggagaattgcttgaacctgggaggtggaggttgcagtaagccgagatcacgccactgcactcagctcgggcaacagagtgagacttcgtctcaaaaagaaaaaggagtggccttaccactagccctgtggtcttcagtgacttaaaatgccaacgacccacttcttataactggggtcatgaggtcaacttaaataaggcatcagcttgcctggcacaggcagtggtgatggtgaggatgtctggttgtaagagaactgacagtgggggaaagaggggttcatccttaggtcctgatgaggagctctcacccccgcctcttctctctcctcctctccagctctgattgtgggtggcatcgtgggcatcctctttgccgtcttcctgatcctactgctcatgtaccgtatgaagaagaaggatgaaggcagctatgacctgggcaagaaacccatctacaagaaagcccccaccaatgagttctacgcgtgaagcttgcttgtgggcactggcttggactttagcggggagggaagccaggggattttgaagggtggacattagggtagggtgaggtcaacctaatactgacttgtcagtatctccagctctgattacctttgaagtgttcagaagagacattgtcttctactgttctgccaggttcttcttgagctttgggcctcagttgccctggcagaaaaatggattcaacttggcctttctgaaggcaagactgggattggatcacttcttaaacttccagttaagaatctaggtccgccctcaagcccatactgaccatgcctcatccagagctcctctgaagccagggggctaacggatgttgtgtggagtcctggctggaggtcctcccccagtggccttcctcccttcctttcacagccggtctctctgccaggaaatgggggaaggaactagaaccacctgcaccttgagatgtttctgtaaatgggtacttgtgatcacactacgggaatctctgtggtatatacctggggccattctaggctctttcaagtgacttttggaaatcaaccttttttatttgggggggaggatggggaaaagagctgagagtttatgctgaaatggatttatagaatatttgtaaatctatttttagtgtttgttcgtttttttaactgttcattcctttgtgcagagtgtatatctctgcctgggcaagagtgtggaggtgccgaggtgtcttcattctctcgcacatttccacagcacctgctaagtttgtatttaatggtttttgtttttgtttttgtttgtttcttgaaaatgagagaagagccggagagatgatttttattaatttttttttttttttttttttttactatttatagctttagatagggcctcccttcccctcttctttctttgttctctttcattaaaccccttccccagttttttttttatactttaaaccccgctcctcatggccttggccctttctgaagctgcttcctcttataaaatagcttttgccgaaacatagtttttttttagcagatcccaaaatataatgaaggggatggtgggatatttgtgtctgtgttcttataatatattattattcttccttggttctagaaaaatagataaatatatttttttcaggaaatagtgtggtgtttccagtttgatgttgctgggtggttgagtgagtgaattttcatgtggctgggtgggtttttgcctttttctcttgccctgttcctggtgccttctgatggggctggaatagttgaggtggatggttctaccctttctgccttctgtttgggacccagctggtgttctttggtttgctttcttcaggctctagggctgtgctatccaatacagtaaccacatgcggctgtttaaagttaagccaattaaaatcacataagattaaaaattccttcctcagttgcactaaccacgtttctagaggcgtcactgtatgtagttcatggctactgtactgacagcgagagcatgtccatctgttggacagcactattctagagaactaaactggcttaacgagtcacagcctcagctgtgctgggacgacccttgtctccctgggtaggggggggggaatgggggagggctgatgaggccccagctggggcctgttgtctgggaccctccctctcctgagaggggaggcctggtggcttagcctgggcaggtcgtgtctcctcctgaccccagtggctgcggtgaggggaaccaccctcccttgctgcaccagtggccattagctcccgtcaccactgcaacccagggtcccagctggctgggtcctcttctgcccccagtgcccttccccttgggctgtgttggagtgagcacctcctctgtaggcacctctcacactgttgtctgttactgattttttttgataaaaagataataaaacctggtactttctaaactgcttgcctctgtcattttcgttcataacaagtcatcctttttgggctctgtatccccttgatctcagtggagcatgaagaaactccccggaccaaatcccctacggggtgccagacatgccgggggtgggcagagggtgggggcagagaggtaagaaggcaggaaggggcctagagaagagggaagacttcagaacatgcaccctgatggcctatgcagcatatcacccctacttcaaggttttgtttaggtggcactgtgtttaaatagcaaacacaaaaatctttgcgtcagttgccatccatagaaatcaggaggtttctcataaaaatccagatttctcacttttcttgggaaaaagaaataaaaaaaattggcaactgtcagcctgcatggcaacaagagagctgctgagcggcaggcacccatctagatgtgggctctccgcaccactgtctccgcctgcttcactcaggccactgctgcagccaggctggctggcagtctccggaaatagcatgggccatctttcttgaccactataacaaccctgtgaggtgggtaagatccttgttaccaagagggcaacctgcccctagtgtgtctggagagtcgaaccttaatttcaggtccttggacattggtgatcttcctttggcaccatgttgcccagtactttgctggggttggggaaaggacgcaaacaggaattggtggtagttggagcaaaccctcccatacacaccatgtggccaggaacccattcttagggctttataccagatcccatttaattgtcagatctccacagagtaggtgctattagtaaccccatttgacagatagggaaactgcatctaagaggttaaataccttgctcaaagctacacagcttaccagttgtagaggtgagatttgaaccccggcagtcgggctctagagtgctaacaactgcactgcctatcaaggggtttatatcacccaaggctccctcactgggggctgttcatgcccctgcaaaccccctctgaaccagtgattctggtcttaaatctcgtggcagcttaaatctctcctgagactttgccacactgtttttctgagtcccatgaggttgagtgggtctctgttctcctaacttgtgtcttgtagaaggccctcacatctgttagatctgtgctgaccactatggtagccactgggaactgtggctatattataaatttaaattaattataattgtaaaaataaaaattctgcttcttagttgcactagccttgttttaagtgctcaacagccacatgtggctagtggctactgtatcaggtggtgcagacacagaacatttccagttgtagaaattcctgttagggctgctttggatggtgtgagactgagtcaggacctctgggtttgggtttcagcttttaccagctgttaccttgtgatccaacagcctatagggaggcaagtcagagcttagcacacaataagtgctcaatatatggtgttctcatcatcagtgccatctttttgggtaaagtattagtttaagaagacccccccaggagattgagacgatcctggctaacacggtgaaactccatctctactaaaagtacaaaaaaaattagccgggcgtggcggcgggtgtctgtagtcccagctactcgggaggctgaggcaggagaatggcgtgaagcggggaggcggagcttgcagtgagccgagatcgtgccactgcactccaacctgggcgacagagcgagactccatctcaaaaagaaaaaaaaaaaaagaagacccccatattatctattgatatttaaaattacccccaaacttaggggcttataacaacataaatattatctcacattgtttctgtgagtcagaagtcaggagcattagctgggcgattctggctccatcttgtgaggttgcagtcgacgttggccaggtcttgctgtcatctgaaagcttgactgggctggagga

SEQ ID NO: 16211 - DNA, 16056 bp, Human
gaggcatctccgggtaggaaagtatgggaggtggcagaggccccttgtgccttagccctcatgctgcccagggatgttggctttgcctgtggcccaagcttgacaagggttccccgccctcccacttccaccagcgctgccacatcttgcttggtcaccctcccacgacgggccctgccagaggatttatgttcttctaccaggcctgggaggggaaaagggagaagaatccgggatgagaaggtcgcctggagtgagaagcaggcactggcctcgctcagaataggcgcattcacggaattggggggcgggggcggagctgctgttgggttaggggcagctggccctctctgccaagaaacagcaacagaaaaatggctaacacagcttcagcatggggcgcggcggtggggtaggagctggaaggaaatgaggtttagtgaattctaggcgccagggggcctcaagagagagaaggggaaccaggagccctaggttctaatcctgcttttgcagttcggcgggctgcctccttggggcttagttttcctatttgtatagtggggagggggtgggggggtggtccttcgtagttctcacggggcgtctccggggcctcgggagggtaagcgctcacctgctgcccctgcggggtccatggtggctccacggggccccagccgctcacccgccgccctctggacgagtccagtgctgctgtcgctggaaccctgcacacccctgctcctcggctcttgcgcgggttatatcctgtccaggccttatctccaaggccccgggccccggccccctgtttgctcggggtgggcgcacctgctgggcagatgtgggcttcccacgccccctgccatctcgggcgccccctggcggtcgctcctgagagcaggcgggaaacaggcgccaagccgcgcgttctcgtgcgcagtgggttttggtccactcgctgccacgccaccacgctcagccccgcaacagggcgcagcccctccctgccgcctgcggttgggcagtgcatgtctgtgtttgtgtgtgtggaggggtctgggggggttggcgagttgcaaagacagccacacagaagcctgtgtgcgtaggggagtgggccgaggtggggaagggcttctgtctgcagaggttcgcctggcaggaggagaggcaccaaacgcccaggctggctcacagaaactagcaggcgtgggattgtatcctgccgcagccactttttggccgaatgactttgggtaccagcgcttaacttttctgagcctcaatttcattgtctgtatgatgggggacaatcacagccttagtcttacaattgcagagaggattaaatgccacaatgcgtgaagagcatttaacactgtgcctgacatttaaggaagacctgtttttttctgtttaaattttgcatatttgtatctatgtatctattcttatttaccattctcttgtgggccgagcgcggtggctcacgcctgtaatcccagcattctgggaggccgaggtgggaggatcacctgaggtcaggagtttgagaccagcctgaccaacatggcaaaacccgctctctactaaaaatacaaaaaattagccaggtgtggtggcaggagcctgtaatcccagctactcgggaggctgaggccggagaatcgcttgaacctgggaggcagaggttgcagtgagccgagatcatgccactgcactccagccgggacgacagagcaagactctatctaaaaaaaaaaaaaaaaaaaaaaaaaaagaatctcttgtgtttcccagcaatcccactgtgatgagaattttttaattctgaaacatttcaaacatacacaaaaatagagagattagtaaaataaacctgtaactgtcttccccctccaagtgcctatcacccagaataagagctctgtaaatactgttgcttttctattttccttcctccctccaggctctgacacctccattctctgtccccaagcgccatgagaggccttctttgctggcccgtgttgctgctccttcttcagccctgggaaacccagctccagttgacaggtgaactggggcccagccctcaccagtgggaggaggggagcggaagcaggtcctccctctgcagccagctcctcctgctggggagagggaagcaagggctttggaacatatgggactgggtttaagttccccacttcacctttctgggcctcagtttcttcatctgtaggatgtggcttagttttgggcgcatgcagaactgcccatggggtgtttaatttggaaaaattatttgaaaacatggaaaaaaaccaggaaattttacataaaaatccctgtttagtatttctcttgaaaaaccagggatctgctgacatccaattcgcaggggcatggcctcatttggatgcagctacctgcccaatttaggagtgataggggctctttgggtctccagcgtcctaacccaaccagttcatccatgttccctgcctggtccctgcaggctttgagtttgcgacgcttccttgccccctcgtcaatgggtaataccgcctcagaatagccctcagatctgtaagatgagggaatttgtgaaatctcctagcccaggtgctaggcacatgccgggcgagtgcatctgtctaatctgcgtttgctgtgctgggcgctgttatgtcggcatagcggcatttcccctgggtttcctagggggtctcctcggaggtgaggctttgctgacctaggagagtcctccctgatctccccgcaggtcccaggtgtcacactgggcccctggatctggtgttcgtgattgacagctcccgcagcgtgcgccctttcgagttcgagaccatgcggcagttcctcatgggcctcctccgaggcctgaacgtgggtcccaacgccacgcgcgttggcgtgatccagtattcgagtcaagtgcagagcgtcttccctctccgcgcgttctctcgccgcgaggacatggagcgcgccatccgcgacctggtgcctctggcgcaaggcaccatgacgggactggcaatccagtacgccatgaacgtggccttcagtgtggccgagggcgcgcgaccgccagaggagcgcgtgccgcgtgtcgctgtcatcgtgacagacgggcggccccaggaccgcgtggccgaggtggcggcacaggcgcgcgcccgcggcattgaaatttacgcggtgggggtgcagcgcgcggacgtgggctccctgcgcgccatggcatcgcccccgctagacgagcacgtcttcctcgtagagtccttcgacctcatccaggagttcggcctgcagttccagagccggctgtgtggtgagttaggagggcgctggagtgaagctcgaactctcaatccaaatgcttggattcctttcccaccacagtaaatcccatcccgtgggggtggccccgcgatttccaggtagagttgccctgacctaccgcaggctgtgtcagatttcagctctgaccacttctgctcagcctccatcaacaaggagcaacctataatttcttgccctacccgccacagcttaccacaggcttaatgtcaaattccagcaccaaccccctgcacacacggaaccagtgattctcaaagctaagagggatcggctgctccaaagagtcgtggccctcccacatggggatgacttctcccattatcatcttagctcctcccacaaatgctgcaagatctgttctgatctgttttgagtttattccgcccacctcgacttagcacctctccaccttcctacccactcctgcccctgtgtagtcctgtcccagcccactgacgtgtctaattgagtgtctcctcttctgagcctactcacaggggctccttaagccttattctttccctaagccctctcacttggtacggcccttctcaaattagtcatttccttctgaaagccatttgagggtgatgcctgcctctgaccccatccccatccagctctctcttgttggaggcttctgcccatctgttccctactgattctagtcctgtgtgtcctcagggaaggaccagtgtgctgaggggggacatggttgccagcaccaatgtgtcaatgcctgggccatgttccactgcacctgcaacccaggctacaagctagcagcagataacaagagctgtttggatgacagctatccctgtcctgcaatctcactgctcctgaaccttctttggctctccattgccccaacatcagaccaatgagtctggaagggcctttggcagtaaaagcacacctccatcactttacaggcctaagaaagaaaggtattgcctggggtcacataagtccctggtgggagcccacagttcagtgtgctttctgccctctttctccctgttttcaggccagtctctaatcaacctcccaaacttgtttctgttttcttcttttcttttctctctcttttttttttttttttttttgagacagagtctggctctattgcccaagctggagtgcaatggtgcgatcttagctcactgcaacctccgcctcccgggttcaagtgattcttgtgtgtcagcctcccaagtagctgggattacaggtgctggccaccacacccagctattttttgtatttttagtggagatggggtttcaccatgttggctaggctggtctcgaactcctgacctcaagtgatctgcccgccttggcctcccaaagtgctgggattacaggcgtgagccactgcgcccggccatttctgtcttcttacaggcacatccttacggtttctcttcttagatactgttggggggtcttcaattaggtgggtgtcccccctcatgccacccattcttgactctgcacctcagctctttgtgtgctgctcacctgagctgcccttgccactcccctctgcctttgcaaatctttcaagactctctctttttaagagatagggccttgctatgttgcccaggctggtctcacactcctgggctcaagagatcctcccgccttggcctctcaaagtgctgggattacaggtgtgagctgcttcttcatttttgtcttctgaaaagctatggcatagaataccttgcttattcaattcagttttttactgagtaccaagttagtattagacattgtgctaggagcattacacatgttattatctctcagcctcacaacaacctggaaaaagaaatcatgtaatcccaataacccagatgtcagctggggtcttcttgtttctagaaactaaaagttggcttgaactctgatttgatgactgtttaacattcaaatctctctccaagacctctggaaatcccccaagtgcttatcttctggttgtcacctcttgctgtgagcctctgctaaattcatttgatttatggatcctctctcatttctcaaccctgcacatgctgttcttgttccatgcatgttaatcaacctcttcgttggtttacacacttgtgtatgcaggggcatacacaagcgtgtatgtgctaagtaactcatagcgcgtgcacacacacacgaaaaactcattataattgaatattagacagctttgtttctgaaagtcctcagtcagcctagtacaagggatttttcacaggcagcctcaacccacagagttactcatcttcatactggctctcttgttcttttttttttttttctttcctctctccactctcatctcctttccaggaaccccaaatactcacttttttatacagggtaattatcttctctccagtccagctctcggccatctttgcctatccagatcatcaagatgctcaacagggcaatagttccccatcttccatggaaggaagctgtgaatagcaatcactgtcttccattatattcccattttgcaaatagaaaaatggaggctcaaataggtaaagtggccaaacctgtcctctgtaagtcagagagcatcttgaggacaggggccctgactaattaggtcaggatttttggggttggggcccaggcgtaggtattctttaaaatttccttaggtggttgtgctaccagagctgagaagggcagtcctgggcatagactgaccccatttcttcctcagccattgatctgtgtgctgaagggacccatggatgtgagcaccactgcgtcaattccccaggctcctatttctgtcactgccaagttggctttgtactccagcaggaccagaggagctgcaggggtgagcaacacccccaccctcccaccacaccctggactgtggcctccgagggctccaatcagaggcaacatcttgctgtttcttccctcctgccagccattgactactgcagctttgggaaccatagctgtcagcatgagtgtgttagcacccctggtgggccacggtgccactgcagagagggccatgacttgcagcctgatgggaggagctgtcagggtgaggagggctctcctacatttgtgggaggggtaagagatcttagctggtggggtccatcctgactcatcctgacctgtctctcctttcagtccgggacctttgcaatggcgtggaccatggctgtgagttccagtgtgtgagcgagggcctctcctaccgctgcctgtgccccgaggggcggcaacttcaggcagatggcaagagctgcaaccgtgagtgatgggcgggagggtgttctgttggcttctgccccattgcccacattcggagtgtccttgactttgccattgctgtggcccctaggctgtggtgtgaatgtctgtgtgtgttgtgggggtgacattggagggtgtgccattccctccttccatctctttcctacaatcctctactctgctgtcaatgttaatttaaaaatacatatttgatcacattcctcctttgtgcacaagccttctgtggctcaccaatgactacaggagaaagatcaaatgacttacccctaagtatttcaaatggtgagcagaaccacattaatgaataatgaaatcaaattactgggttacaaccaacattaaaaaaaaaagagtggaagacaatatagagtttactgcctgtagaaagagttatattatttctgaaattttagttctgtgtgaaatgtctcatgatgtattgtcattattattatttttactgtgggctgtgataaaaattttgaaaccactgccttaggtcatcacgatctagcttcagccaactccatctgcccatctcctgccacacttgaacatttcagtcttactggcctgcccctccccggatgtgtcaggatctccccagatcccaagcctctgcacgtgctgcatctcaccttctagactgtcccttactgccttggcaaactcctactgatctttcaagactgtcttagatcattcaggctgctatatcaaagtactgtagactagacatttagttttcacaattctggaggctgaggagtccaagaccaaggtgccagcagatatggtgtctaatgaaggcctgttttctgattcttagatggcacacctttcaaagcctccccacgccaacacacacacacacacacacacacacacaccaattttcttgctgtgtcctcacatggtgaagacaggaagcaagccctcttcgactcttttttttttttttttttttttgagactaagtctccctctgtttctcgggctggagtgcagtggcgcgatgtcggctcactgcaacctctgcctctggggctcaactgattctcctgttacagcctctggagtagctgagactacaggtgtgccccaccatgcttggctaatttttgtatttttagtggagatggggttttgccatctcagccaggctggtctcgaactcctaacctcaagtgatctgcccgcctcagcctcccaaagtgctgggagccaccatgcctgacctcttcagactcttacaaggacagtaattttactcataagcgctgtaccctcatgtcctcatctaatcctaattaacctccaaagatctcacctccggagactatcacataaaggcgtagggtttcaataaatgaattttgggaaacacactcattcagttcataacaaagatcagatagaaggccatcatctccatgcagccttccttaacaactccaggaagaatacactattcctaccttgggatccctgcatgatcttctcttctagcactttccttgaccagagcacatagcatgtctgacttgctctgctctgtcctcatggaacaggattatgttttaattatttcaaaacctttgaaaacctccccacgccaacacacaccacattttgggcctagcaactttcctggctcagaataggggaggtgacattgtagagtcattcaggagcatgggttttggagtcagatggacctggcttcatgtcttggctcagtcagtactagctatgaaatctggggcaatcactttatccatcagaacctcaggtcatagaaaatggggacaatattcaagcttattgggaggattgagaatatatataagcacttcacccagtacctaccacatggtaagctgtcggtaaataatgtttttgttattattattgttaatactggtagagtgcttagaagtgtgcctgatacatagtagatgatcaataaatggtagttattgtggtcattactatgattgttgttaaaaaaagatgcttttagcagagtggtttgttctaagcactgaataaatgtcaagggcgatgatgagggtgatgatgatggtgatggtgatgatgatggtgataattattattacttagcacactgcctggcacaggaaggactcaggaaatgttgtctgttatataataaatgtttgcgaatgaacgactagatggatagacagctgctgccagtccagaatctggtccctcaattcaagcttttctggctgtgcagggtgccgggaaggccacgtggaccttgttctgctggttgatggctccaagagcgtgcgtccacaaaacttcgagctagtgaagcgcttcgtgaaccagattgtggacttcctagatgtgtcccccgagggcacgcgggtggggctggtgcagttctcgagccgcgtgcgcaccgagttccctctgggtcgctacggcaccgcagccgaggtgaagcaggcggtcctggccgtggagtacatggaacgcggcaccatgacagggctggcgttgcggcacatggtggagcacagcttctccgaggcgcagggtgcacggccccgtgcccttaacgtgcctcgtgttggcctggtcttcacggatggccgctcccaggatgacatctcggtgtgggcagcgcgcgccaaggaggaaggtgggcttggcatgggacacagtgggctggggttgggtcagacgctgggaggcagctttcccgaggcctggggcaccctctgagaccccggccttgcaggcatcgtcatgtacgccgtgggcgtgggcaaggcggtggaggcggagctgcgcgagatcgcctcggagccagcggaactgcacgtgtcctatgccccggacttcggcaccatgacgcacctgctggagaacctcagaggcagcatctgtccaggtgagcgcatctctctcggggctcctcctctctctcattgcccgtcctctgatatctccccttcctattcactccctgcccactttgtagttatagccagaggttgggctcactagacagagctttgctactccaaatgtggtctgcaggccagcggcagggcggtcacccggtagcttcttagaactgaaacatttctggtgctctccagaccgaatgaatcagaatttccacttcgacaagattctcaggtgatttgtaagcatattaaagtctaagaaatcctagactaggctacctgtcccccaaatcagtggaggttcagaataatttgggaaatttttttgaaggcacaccagacagcatttgtaagtggagccacagcatatatccctgaacttgttagaattcaaccttatgaacttggcaaagtggcaggactgaatatattttaagtatgcaaagactttttttttttttattggggacaacatacctcataagtgcaatccctctacttcatcatctggtgctcagctgaggaaaaagagactgactctacctgtgaagaaggggactcttgaatcgcatgcagtgtactgtgctctaggtgatacagggaatgtctccagggtaacttttaccctagagactttagacactagcccaggcttaagatgtgactcttcttcccatttatcagactgcagctccagaaacagactaagtagggctggtttgggtctggagaatttgcctttttttttttttagatatatgtaggggggctgggcgcagtggctcacatctgtaatcccagcactctgggaggccgaggcggctggatcacttgagatcaggagttcgagaccatccttggcaacatggtgaaaccctgtctttaccaaaaaatacaaaaattagccgggcaaggtggtgggcactgaggcaggagaattgcttgaacctgggaggtggaggttgcagtgagccgagattgcaccactgcactccagcctggtgacagagtgagaccctgtctcaaaaaaagtatatataatatactatatatactatattatataatatgtgtttgtgtatgcatgcacatgcacgtgcatgtatatacatatacaaatatacacatacagtccttcccccaactctccttccctccccgctctcagccaattctaattattgtggctctttcagattaggggctctttcagagctcttcctatgtgactcttatgggccctgcagtgtgactttggacgagtcacttaccccacacctaccttaacttttctcttcggtaacaggagaggcactggctgcccaaggttacctctagttctagagttctaagagaagtctgggttttgtggttgaagctctttatcaattggtggtatgactgttccctgtctccaaccctttgtttagagaaacaaatctgtgaagttaggggtctttgctggattccagcagtttgttcatagtacatataagactaagatgaagagacaacttttaaatcattatggcagtgttttcaaaggttaaatggcaggtattgtgcttattatttcaccacctgtaatcctttttcttttttttcctaaggtacttttattgtagcattttttttttctatgtcattccctgtaatctttttttttttttttttttttttttttgagatggagtctcgctctgtcatccaggctggagtgcagtggtgcgatctcggcttactgcaacctctgcctgccaggttcaagcgattctcctgcctcagcctctcgagtagctgggacaacaggcgcatgccaccacgcccggctaattttttctagttttagtagagatggggtttcaccgtgttagccaggatggtcttgatctcctgacctcgtgatccacccgcctcagcctcccaaagtgctgggattacaggtgtgagccacagcacctggcctccctgtaatcttaacaatggcacatgcttatagaatttcagtgaatctaagataccattcattttaagattcatcactaccttatgtactgctaagaaaaaacatgtgccagttttaattgtaaggcctcctgcccaacccccaagatgttgatgtgtggggagatagagttggatcaggatcagtggttcctaaaaattaggtcacaccagaatcacctggtggacctttaaaaacacaaattgcagctgggcatgatggctcatggctgtaatcccagcactttgggaggccgaggtgggcagatcacaaggtcaggggatcgagaccatcctggctaacacagtgaaaccccgtctctactaaaaatacaaaaaattagcagggcatggtggcacatgcctgtaatcccagctactcgggaggctgaggcaggagaatcacttgaacccaggaggcagaggttgcagtgagccaagattgcaccactgcactccagcctgggagacagagctcaaaaaacaaaacaaaaacaaacacaaattgctgggcttcaactctagattttctaattcagcaagtctggggtgttgtctgataattagcatttttgataaattcctacacgatgccgatgctgctggtccaaggaccacactttgagaatcactggtctagttgaaatacactataaagcagtggtttccaacctttttggcaccaggcagtggttttacggaagacaatatttccatgatggtggtggggagaatggttttgggatggttcaagcacattacatttattgtgcactttatttctattattacattgtaatatacaatgaaataattatacaactcaccataatgtataatcagtgggagccctcagcttgttttcctgcagctagatggtgccatccgtgggtgatgggagacagtgacagatcatcaggcattagattttcataagaagcctgcaacctagatccctcacatgcacagtttacaatagggtttgtgctcccatgagaatctaacaatgccactgatctgacaggaaaggagctcaggttgtaataggagcaatgaggagcggctataaatacagatgaagctcccttgcatgctggctgctcacctcctgctgtgtggcccagttcctaacaggccatgggctggtactggtccatgtaatgtgctggtactggtccatggcctggggattggggacccctgctgtaaagtatttacttgaaccaggcagtgttctagatctgtgctttttcaaaaaggtaggcagtacctatttaattacaattgattaaaataaaatacattttagtcctttagtagcaccagtcatatttgaagtgttaaacagccacatgtggcttgtagctactgctttggacagggcagatgtagaacactttcatcattgcataaaattttatttggagagtgctacacaaagtgtggtccacagaccaggagcatcagcatcatttgggagcttattagaaatgtaccttctgagcttcttctccattctgaagcagaatctatattttaacaagctctcctgatgattccaatgagcattaaggtttgagaaacagtcttgtaagttgtgcgtgagcacacacacacacacacacacgtacacaggtgaatgaatcctcgaagccactaatgcgtacactctttcattatatccattttatagatgagaaaactgagcttagaaaggttagtgagtttttcagtatctcacagctacttagcttgggactcagcccaggtctctctaaatccaaagcccatatactcaaccataggcccagtgcagggaaatcagagggccaaagctagggcaatttctcatccccctgaccctctgtgtccggcttgcagaggagggcatcagcgcagggacagagcttcggagcccatgcgaatgcgaaagcctcgtggagttccagggccgcacgctgggggcgctcgagagcctgacgctgaaccatatcctttggggctggtggcgcgggctggagggaaagtgaagggacctcggcgaaccccaacggcctccttaaccgctcactggcccagctgacggcgcgcctggaggatctggagaaccagctggccaaccagaagtgagggccacggacggcccagacccgggctggggcgcggcaccacggacggtgccccttgcgcgccatcggtgcgccggggccaggcagaacctgggcccgtccggcttgggctgtcggggcggaggcgctggcgggcttccggcattgagctgagttggcctcgcccggaccattaggcggactgcggcgtcagggggatagcgggtggtgagggaaggggcacgtgctagaccggcacgccctcgccgcgtgctgcgctcagttctttgttggatttcttgtttgtgttcttaaaaaaataaaaaaaactgatttccacggggtccgtttttgggtcttgctgcgccgcctgggggaggggaagccagacggagcgtgctgtggcggcgcccgggcggcgtctccttggagaaaggcgcattgtgcgggggtcgggctcgggggcaggagacccggcgctgcttccccctgcttgtttattcagccgagaacagatggctccttatgcaggctgcgggaagggagggggctcaacaggaatccttggggtctgagtaagtctgcgccactccattccccagcggactgaacgcttcgctcccggccacgcctatcccatgatgcccccaaatctggctcaaaagctgctagtactgagcgctggtaaggggtgcgggggtggcgttggtgggaaagtgagaggcagtaattgaacccctaaatggatggggtgggagtggatagatgagctttgaccgattttaactctctcctgcactaggtaggaagagaaggaggtatcagctaggacccctgtctgtccagcctgtggccttccttctgtcatcttatcaacccctcccaaaacacctctatcagcaaagaacacaaaccagtaccatttcccgagtgcatgtaagaaacaacgaagtttaaaatgcttccagtcctagagtgatttggggaaaattattttgtgtttgtttcctcatctgcaaagtggagactggaattgttacccccaagcgtgatggggagaatcaaggacattcttctaaggcatgtgccttgtacctatccctcaattaatggtagctattaactgttcttatagtaacagctaacatatttagtgttgggcattattgtaactgatttgcaggtattttcattttatacttggaaccagtgaaataagaattattgcctttatcatccccattttacagatgaggacactgagacacagaaaggttaagtttccaacagtaacataaccagtacgaagctgaaccaggatgtttcctatggctgctctaataagttaccacaaattgagtggctagcaacacacatttattaccttacagtttttaggtcagaagtctaagatgtgttggcaaggctttattccttctagaggcttttgtttcctggccttttccagcttctagaggctacctgaattccttgggtcatggccctacatcacttcagactcagtttccatcagcacatctctttctctgactctgaccttcccgtctctgtcttataaggacccttctgtttatattggcatgaccttgataatcaaagataatcccatctcaagctatctttttttttttttttgagatggagtttttgctcttgttgcccaggctggagtgcaatggcgcgatctcggctcactgcaacctccgcctcctgggttcaagcgattctcctgcctcagcctcctgagtagctgggattacaggtgtatgccaccactcccagctaattttttgtatttttagtagaaacagagtttctccatgttggtcaggctggacttgaacttccgacctcaggtgatccgcctgcctcagcctcccaaagtgttgggattacaggcgtgagccaccgcgcccagcctcaagctctctatcttaaccacatctgcaaagtcccttttgtcgtgtgaggtgaaatcacaggtgccggggattaaaatgtgtacatctttgtggggaaggccattctgcctaccacatggggcttgaagccaggctgactgacttcagagcagctgctcttaagtactctgtgccgggcaccttgctaggcttggtgaagagggagaaactgatgattgagaaaaactcttgagctgaggaagctccgggctagaagggctgaggtccacctgactgttgcagaaagagggaacttcagatgagaggagggagaaatcctggagaggtg

SEQ ID NO: 16212 - DNA, 16056 bp, Human; identical to SEQ ID NO: 16211

SEQ ID NO: 16213 - DNA, 8289 bp, Human
gtcaccagtccctactctcccatccatgaagcatctactgtagtaaaagattgtctcaaggaaccattcccatccctccccacttactcttccgtactaaattgtaaaccgcatcccccgcttccacctagtagcaggccttacattaaacagatgtttaatgaagtgttactgagttggagtgaaatgaatcaggcaatgaccactctcccttgctcctgcctcaggcctacctcctcatcgaggaggacatccgggaccttgcggccagtgatgattacaggtaaaaccagtgggtctcctgccccttctcctctccctgcctccaaatagcccctagaatgaggcagggcctacatcctcacttcccccaacttctctcttcaatgtctgttccagaggatgcctggatctgaagctagaggaattgaaatcctttgtcctaccctcctggatggtggagaagatgagaaagtatatggagacactacggacagagaatgagcatcgtgctgttgaagcacctccacagacctgaggccgggtcccctggccacacttggcagccctcctccaaagccctcttcctcacgtggctgaggccaccgctgggactgctcctagatggatctcagcggcattaagctgtgcctgagcgagtttgtagtgactcactgcacagcacccccagactagcatgtggttctatatttgtaaagttattgggataagaaacaattaaacagtttgtagtaaacacagatggtgaacctgctgtgccctctaccttgtgggaattgacagaacatcaagggctctagaagtgggtgtaggaaaaaaggacgagataaccctcacccataacagtatagagccaggcttgataagaccaacctgggagcaccatgtaccctgcccgtcttccctttgcccatttgtagtttccttacccagctaatgtaaggacatggcagaatgcgatggagtttgatgacagatcatatgaaaaatagagttggcttttattgctcccattttacaggttaagatactgaaggacccgccccaaggttacacactacccactggggaggtaggatatacaggatatgaacctgtgttgttggggtttttgtttgtttgaagacagtcttgctctgttgcccaggctagagtgcagcctctggctcaagcgattctcccgcctcagcctcgccagtagctgggactacaggctcgtgccacctcaccagccttttttttttttcttttctttttttttttttttcttttaagtagagacaggtctccctatcctgttgctcaggctggtctcgaactcctgggttcaagtgatcctcctgcctgggccttccaaagtgttcgggattacagacgtgagccactgcgaccagcctgaaccaatgttgcctttttttatttctgtcatctctgcggagatgtatggacctatgttttctaatagggagcctgctgctctggccatcagcctttagtttttcccctcgctgggattttcagatacttaggacgcagcaaaggtgcccaggcgattataatggtgggagggtaccagtgctgcaggattggaggcactccctgcccgagggaaattggatcaaggctgggcgtgccgagtgttcccacgcggagtaagacgtgtagccagaaggaggggttcatcccacgtggacgttttcttggccctttaatggttagcgttttccaacggccaccaattcgctacggattcgttagttaatggcagcatcatctaccaatcggttgtcagaagcgggattctgccgcccaatagcggtgcgccagtgggtaggtctagcagtggcgcagcaatagagcgctccggagcgtctcattggctggatcaaacccaagcgagccattgattggtcgacgcccccagagggttacaattcaaacgcgggcgggcgggcccgcagtcctgcagttgcagtcgtgttctccgagttcctgtctctctgccaacgccgcccggatggcttcccaaaaccgcgacccagccgccactagcgtcgccgccgcccgtaaaggagctgagccgagcgggggcgccgcccggggtccggtgggcaaaaggtgagtgatgcggcctaccactcgccgggcctgccatgccctaggcattggtacccagagcaaagatttctaggaccaccccccgccgccacctcctggagcgggagatctgcgggtgcaggagaacacaccaggagctcggggcctggcattcccctgggcatgggtgtcgagggcggagacttccgggactcccacctccttgcgcgggtgagattcgagagatgggggacaggccaggagctcagaccgctctttgagactctcccgaaggagaatgggagggtaggggcgctgccagactccttccctggtgggcctagatgaagacgctcaaggaccctcgtgacttggccgagacaggggaagggagaagttgagtcgggcaaggaagagatgctaaagcctggggaattaagaacatgccagaatcatcccgagggagtctggaattagggagggtgaggactcgctaggatcgtcctgtggatctggtgagtataccctgagctgagcctgaccttggtgatgtggggagcctccatgacggctccccctgagattcaggtgggagaagatgcaccgtctggaggcctggcccatccagactcccaggtaaccccgaatactcttttttcaggctacagcaggagctgatgaccctcatggtgagtgattaagtgcccagaaccccagccttccatccaattttcagtagcctccttttttccgtcagcttttttgctagacataggggtaatgtaatttgctccctcctgggaaagaagttcatacaccccacctacaccatttcttccagcagtccctcctcccaattccatccccccacacgaagttatctcgaacacttccctgaagtcatacaagaccctccctatccagtgtgtccctacttcctagccccaaccaagctttacccacacccaactccccgcccttcttggtatttctagcctatgaatttggttgctttattttggatcagagtgatgagattaaggggaggctgggcgcggtagctcacaccttataatcccaacactttggggggctaaggtgggcggatcacttgaggtcaggagttcgagaccagcctggccaacattgcaaaaccctgtctctactaaaaatacaaaaattatccaggcatggtggtgcatgcctgtaatttcagctactcgggaggctgaggcacaagaatcatttgaaccgtggagacagaggttgcggtgagccgagcgcaccactgcactctagcctgggcgacagagtgtgtgtgtgtgtctgtctctgtctatctctctctctcaatctctctctctctctctctctctatatatatatatgtaaatatatattttttagtagagatggcataaccccatctatatctcatatatatacacatatatgtgtgtgtgtatacatatatatgtgtgtgtgtgtatgtgggcatatatatatatatataaaattaaggggaaagctcacccactgacctttgctatgcccaaaagtgtactccacattccaacaaatgtgttttctccccagatgtctggcgataaagggatttctgccttccctgaatcagacaaccttttcaaatgggtagggaccatccatggagcagctggaacagtaagtgtagggctgggatgggtgagtgagtctggggaaaggtgggaagtgagatccaagtgcgagctctgcttcaagcctttggcggagcaagacactcctcctgtgactgtttacattctctgagccatgtggccttgttctttccctctgtgcaataaagggtgggtttaaagcagggctgcctatcttagatgtttacatggggggacagacagcaaggaaatggatgaagtgaggactttggccaatagggccagatctcaagaaggcagcttcccattgctgcagatcaggtttaagatgagtcagaagtccaaatctgtgccaaatctaatttttacgtattagcaactaatattcttttttttttttttttgagacggagtctcgctctgtcgcccaggccagactgcggactgcagtggcgcaatctcggctcactgcaagctccgcttcccgggttcacgccattctcctgcctcagcctcccgagtagctgggactacaggcgcccgccaccacgcccggctaattttttgtatttttagtagagacggggtttcaccttgttagccaggatggtctcgatctcctgacctcaagatccacccgcctcggcctcccaaagtgctgggattacaggcgtgagccaccgcgcccggccagcaactaatattctaattgaactaaagcacaggatgccaatttacaatccttagaccaaagagtcactgatgtctccaccagataagaggaaagcatcaggctaggcatagtggctcacacctgtaatctcagcactttgggaggctgaggcaggcagatcacatgagcccaggagtttgagactggcctgggcaacatggtgaaaccctgtctctaaaataaaaactaaactaaaaaaactttttaaaaaggcagtggggagcatcagaaccagctcaacagtttgtctactgtccggtcccagagaaactcaagattctagcaagccccttgtgtggggcttgggttgggacatgaggctgctgctggagcttactctgcaactgtttctccaaatgccaggtatatgaagacctgaggtataagctctcgctagagttccccagtggctacccttacaatgcgcccacagtgaagttcctcacgccctgctatcaccccaacgtggacacccagggtaacatatgcctggacatcctgaaggaaaagtggtctgccctgtatgatgtcaggaccattctgctctccatccagagccttctaggaggtgactttagagaccacccctcccctccatgcaacttgggaacctgtcaggactccctggggtcagcctcttctaccgccttgaccttctctttctctccacccacagaacccaacattgatagtcccttgaacacacatgctgccgagctctggaaaaaccccacaggtgagtcctcagtccttgagcccagggtgatccctcccccaaccttcaaaggctccctcaaacaaaaggagcccagtgacttgggaccgggttggttggggcagggtggagtgtcggcagcaacccacttctgtttctgccccagtgctcctatttgctataaaatagcaattgttttatagcagaataaaaatgtttggcgataaataattttgggaaattattggtgagaccaaggcaggaggatagcttgaggccaggaattcagtagagtgccttgcctgtgccctccagtctcactggaagcaagcccttccaggagagctgcctagatgggcagtgcagggagaatgccgggctgggaaaccagcccctcctccacctcctccgacctttgcatccctggtccagctgcctcttgcccaccttaattcatcctgggccaggcacagtggctcatgcctgtaatcctagcacttggggaggccgaggtgggtggatcacatgaggtcaggagtttgagaccagcctggccaacatggtgaaaccccgtctctactaaatacaaaaaaaattaaccgggtatggtggtaggcacctgtagtcccagctactcaggaggctgaggcaagagaatcacttgaatctaggaagcagaggttgcagtgagcagacatcatgctattgcactccagcttggtcaacagagtgagactccatctcaaaaataataaatagtaaagattaactcatcctgtctccatcactcactgagacctgcctgttctcttccagcttttaagaagtacctgcaagaaacctactcaaagcaggtcaccagccaggagccctgacccaggctgcccagcctgtccttgtgtcgtctttttaatttttccttagatggtctgtcctttttgtgatttctgtataggactctttatcttgagctgtggtatttttgttttgtttttgtcttttaaattaagcctcggttgagcccttgtatattaaataaatgcatttttgtccttttttagacaagttgttgcgttgtaatttcactagggttggaggtactcagggtaggcagaggtggaacttaaggatgtggggccaagcaatggggtgacaaagatttattcccttgtaccttattttatgactctgcatctgtttcttcatctataaaatgagtgtcacaataatgcctcctgtctatggagtcggtgatgtgtaccagcaatgttagtgaatgttggagctccctcagctgtgttgcagatgaggctgagccagaccttaggctgaaacctactcctatagctgtagaaggaacaagcgtgtgtgttggggggggggatcccaacacacagccacccatgttctgtcctgaagaagaatgcttaggtcaccctaagcaggtccagggcctggggagacagccaggaaaaaagccccttccctggcaggactcaggtctgagctctggtctccaggctctagcccaggtccccggtggagctccacctccaagggggcacagtcgcctcctgctgcatatcccccggggagcccccagccccttgggctgcctctttcccctggcctgatgaaggctccagtctttgagcccctaggaggaaacacccctgctgaccagctgggtccccacaagggtcggcaggtggaagagtaggttgaagtgatagggcccccacaaagcccttcaggaagatctccaaggtagataagcagcatccagatgtgctccaaccttgcacccaactccttcaggtctgttagcagctggttggttgtgcaagcctgaagcgggaggggtttgggattggaagttgggtcccttcatgtctataattgtgctcttaggtctctcctcttgggttttttcttaatctaacattcatacaaatacacttgggatcttgttaaattcttttctgtaggtgtgaagtggagcctaagatccagtctgtttatttattttggtttctaaatagtttccaagtgatgtcattgctgcggtctgcttaagaacaaaatttagagcaatgttcttagaatgtggtccttccagcagcagcagcatcacccggaacttgttaggcaaattcttgaccccaaactgccctccaggttctgaaggtctcccacggttgaaaatcactaggttagcggatactggagaaaaccagagctcagaacctggcactaaattagtcaatatatgctggccagggccgggtgtggtggctcactccctgtaatcctagcactctgggaggcggaggcaggaggattgattgcttgaacttaagaattcaagaccagtctgggcaacacagtgagacccccatctcaaataataaattttaaaagaaaaataaataaatcttggccgggcctggtggttcacatcagcaatctcaacatcttgggaggccaaggtgggaggatcacttggggccagaaattcaaggttatagtaagcttatcactccagcctaggcagcagagtaagaccttatctctaaaagaaatgtttcgaatactaactgtggtggatgtgttttcatctgccatgtggtccttggtcacggtgtttggtaccttagatggccacatggcctgccttgggccagtcacaggtctaaactgtagttcagattcaactggtgttgtctggaattaatcactgggagagagtaaagttattttactaatggggttgctaaaagagaagggagtcagtctcagctgctgggggagcccgctgcagacggaagaaagccaagtagagacaaacagctgggagtcggagagatgacattaactgagactctggcctccagttcatgctttgccatcccagttcgataaactaacaaatccctttttggtttaagtccgtttgatttagatttctggcacttgcaacagaaagaagcctggtcaggaagtatttgaatttctggttattatgattcccattttattgaattcctacaagacaaaggccctct

SEQ ID NO: 16214 - DNA, 8096 bp, Human
catgcctgtaattccggctactcgggaggctgaggcaggagaattgcttgaacccaagaggcggaggttgtggtgagccgagattgcaccattgtactccagcctgggcaacaagagcaaaactctgtctcaaaaaaaaaaaaaaaaaaaaaccaaaaacaaaaattagctgggcgtagtggtatgtgcctgtaatcctagctactcagaaggctgaggcatgagaatcacttgaacctaggaggcggagggtgcagtgagccgagattgtgccactgcattccagcctgggtgacagagtgagagtctgtctcaaaaacaaaaccccaaaaaaccaaaaaacaataaaaactaaattggaatcccatgggtctccctcaccctttggcaccctgcctgcctgggggaggccttatttagcttggcccagccctgctgagctttccttgggaatgtctatatataggggaagggggcagcccagttgccactgtccatctgcattccttggtgtccagcccccctttcctggccccagagcctgctatcggttgtcttggtgctctttctgtccacgtagccactgtctacaagccttgcctactccccagtgcccagcctgcaccttgtggattctcaggttgggctccctctggacttggtctgcccacccctttactccccagatgaccagatttcttcactgagctctaggaaggggccagctgtccttttaccacttaaagaaccttcccctgcctactccttacttcaaaaaaagtgaatccaaacaccctttccctggagaaggtaactttcagagaaggatctttgctttcaatgattatttctcctccaaatgcacatcctcctctcctccatccctccatacatttttccatctggacaggtgccccaaggactgtctgtcccaacttccctccagtcaggattaataataagaatcatcaacatgggtgggcatggtgcctcatgactgtaattctagcactttgggaaaccaaggtggaaggatcccctgagcctaggagttcgagaccagcctgggcaacatggtgaaaccccatctctataaaaatacaaaaaaaaaaaaagccaggggtggtggtgcacctctagtcccagctactcgggaggctgaagtgggaggatcacttgagcccaggagatagaggctgcagtgagctataatagcaccactgcacatcagccttggtgacagagtgagtatagacctttataatttacaaagctctgcagtcaagtggggataatagttgctacctcataggaggagcactagatgagatcatgttaaaatgcttagcacagtgtgtggcacgtcatggggttcagtaaacagtggcctacctgtcactttctcctcctatcccctgccccttaccatggttcaaagacgggacattcctcttgccaagcaccaacgctgtgtacccagcacaagctaggtgacttatacccgggttcccatttaccatggtctctctgtgagggagaccccacagacaggtccaatcccacagatgaagaaatggctcagagaggcactgctaccggcccaaggtcacacaactcgcagaggctggccttggatcttgggttttggacttcaaggcttgtactctccccattttaccatgctgcctcaccctttactactctgatcatccttaccatcttggagccagtgtgcttcctcggtcggggggactccaaggcagtggaacagggcaggccttcctcacaagaatctaggacgtcaaggcctgccacctgcttggaggcttaaatttctctgcaagggcccttggctaaattaggtaatgggttcagactgtgggaggggtgggactcgctgaccccaggatctgattgggcagggtctccagtgctggggagcagggaggtgggaggggagggtgcccctacaaatcccgggggctagagcaggccaggtcatctttgggtggtggagtgcaaaggaggcgacctgcaacagaggagtcccggtcaccagcaaccatggtaaggacaagaggggactttgtgcctttactcacgggagcactctggacccctttcaggccaggcctgggtgctctgtggggcagtaacttggatgtttgaggttggagcatggaggttcctggaacccaggtgtcttggaggaaggcctttgacttttcttgaaaggggagggctgggatattccagagattgatccttaaggcttgctgactgcctactcacttctggaaacttccagcagtgtcattcatagacctgtgaagagctcttagcttgtttccttcacacagtggggactctgaggggtcagagtgagtcacccagcaggccagtggcaggggtgagccagaagcctggccaaaccctcctatcatcatggagagaagaaagcctcctccagaagacgggaggccggcagggcgtggggcctgctcagatgcagggctctgggagccctgaggatgatgggaaggggcagaagatgacagaccagagttagagagactccgctctcctagagagggcttctgatttggagctgttgttttggtctgagatccccctccccacttcacttcaaggagtaactagatcccagaggccagctgctgttgcccatgcctgactaaaaatagcctgccctcctggcatagggaaagaggaggagaggaaggagggggagaaggaggagcactggtggccagccggctgaagagctccttggaagcctcaccctgtcctcactgccagcctcaatccaaagcctctgacccagatggcctggcttggatatgacgtggaaacccctgcagaaatctcactttcatgtcaaggcctccatcacattcggccccccatgaggggccttttctccaatgactgaatcctaagaaggaagctgacggcctccgactctgccagttctctgaggggcgggatgatgtgtcttttatctcttctttgtggttccagtgcctgatctgtggcctgacatgcagcaagtactcaataactttgtgttgcattattatttatttgagaacaaacattttattgagcaactattaaagtaccgggcaccattaggagctgcagaaaactggaaaatagtgctggaatggtgctagccctttacaaagccctttcacacccctgatatctcatccctgaaaagctacagagaaaagatgaaggcacgctaattgacgtgcctaaggtcactggggggtggggggggttcccgacttggccttcaattgacaagtgagaaggccttgggcttaacttgttgtctcctctcttttgctcaaaactggggtcacaggctgcgcgcggtggctcacgcctgtaatcccatcactttgggaagctgaggcaggcagatcgcctaaggtagggggttcgagaccagcctgaccaacatggagaaacctcatctctactaaaaatacaaaattagccgggcgttgtggtgcatgcctgtaatcccagctactcgggaggctgagggagaagaatcgcttgaaccccggaggtgggggttgcggttgtggcgagctgagatcgtgccattacactgcagcctaggcaacaagagcaaaactccgtctcaaaacaaaacaaaacaaacaaacaaaaaaaactggggtcaggccgggcatggtggctcacgcctgtaatcccagcactttgggaagccgaggtgggcggatcacctgatgtgaggagttcaagaccagcctggccaacatggtaaaacctcgtctctactaaaaatacaaaaattagctgggcgtgttggcgcatgcctgtaatcccagctactcgagaggctgagggaggagaatcgcttgaacccaggaggtggaggttgcagtgagccgagatcacgccattgcactccagcctgggcgacagggcgagactgtcacaaaaacaaaaagcaaaaacaaaaactggggtcagaagctgggcacagtggctcaagcctgtaatcctagcactttgggaggccgaggtggcaggatcacttgaacccaggagttcaaaaccagcctgggtaatatagtgggaccccatctctacaaaaaattttaaaaattaggcgtggtgtatgctatagtcccagctactcaggaggctgaagtgggacgattgcttgagcccaggaggttgaggctgcagtgagctatgatcacactactgcactccagcatgtgtgacagagcgagacaaaacaaaactgtgattgggtgctgtgcgggcacacaattatgtgacaagtttgaagttgttcttctggagaaccaagggcgctgacagagtgggggttgggaagaatggctttgaggtgaggaactgctctggggctgcctcttcagctcagactttctctgtgtctcctgcagacggaccagcaggctgaggccaggtcctacctcagcgaagagatgatcgctggtgagtgaggcgcggcaggctgggggctgggtggatgtatgctggggacatgttggcctctaggcagggtgggggttgggggggggtaggtgtgaggctgacagtccagcaggcctcacctctgccctctgccctccctcgcagagttcaaggctgcctttgacatgtttgatgctgatggtggtggggacatcagcgtcaaggagttgggcacggtgatgaggatgctgggccagacacccaccaaggaggagctggacgccatcatcgaggaggtggatgaggacggtgagcgggtgtccctcggaggcaggggatggtggggagaggcggcagcggctgggctcaggctcagtctgccacctgctgcccgcaggcagcggcaccatcgacttcgaggagttcttggtcatgatggtgcgccagatgaaagaggacgcgaaagggaagagcgaggaggagctggccgagtgcttccgcatcttcgacaggtgcgctgggggcccgggagccgagggaggggcttagcagtcagaacccggccggcagcgctggaagcttccccgtgttgggagtgcggaagcggggcgtcgagtgtggtggccagggcagctcgccccggccctgagccctgccctgtccctcggacctgaaggaatgcagacggctacatcgacccggaggagctggctgagattttcagggcctccggggagcacgtgacggacgaggagatcgaatctctgatgaaagacggcgacaagaacaacgacggccgcattgacttcgacggtgagggccaacgggagcttgggaagagcgggtgggagccccagaggacggcgggcactggtgcctggctccggtgcagtgtccttggccttgtgggctgggctgggcgtaacttcaccaagttccccatagtctcctgggggcaggtatagaagcgctccacgactctgtgcagtttatcaattaatgaccaggcaggggggcgtggtggctcaggactgtaaaatcctagaactttgggaggatgaggtgggaggattgcttgaggccaagagttcgagaccagcctgggcaacatagtgagaccctgtctttacaaaaaataaaataaaataaaaaggcaggtgtggtggcacacctgtggtcccagttgctcccggggctgaggtaagaggatcgcttgagcctaggagatcaaggctgcaatgagttatgattgtgccactgcactctagcctgggtgacagaccttggcgaccttggcaacagagtgagactctgtctcaacaaaaacaaaaacaaaaagtcatcccctctgtgtggctggagccctggcctggcctctgcgtccccagtgggacccctgaccctctccctctcctttccctcagagttcctgaagatgatggagggcgtgcagtaaggagtggacagtcgcctctaccaagatcgcgtgtccctagggtgtgggagactccgccctgccgggtccccaccagggaggcgcggccccttgtgggtctttgtctggaaggaataaaagcaaatgttccaaaactcgtggcctgaatgaggggagagccgaggacagcaggtcgcaagggctgtggtccagggcgccatcccggctggcaccacccggagcacccttggggatccccgggagaggctgtctgagcggcgggatgtggaagggagctgggccctggagcccgaggcggcggctgcgagtgctcgatggcgctgactcgctctgcaggtttgcagccggctcctgacagctggcgctgggcgtgcacagcttggcggacaggcagtggtggctccaggaggctgcaggggcttggagttgagtcagggtgagccggcggactgcggaggggtcctgagacggcaggtagggtgagggggtgggagaggctagaaccctggggagccgggaagctccctcacttccccaccatccttttctggaacgtttgcgtcttagatgttgtcgtagctgccaccttctgcaggctccctagctggggagaggggaagtaggtgcccatccatgccaggcagcattgtttctgctcgaccttttacttcttctgttcttccaagtgcttactcctcaaattgtactggtggttgtaggggagggtggaggcacccactaaggagattctgatctcatcatttgaccccagatccctgcctccacctggtctctgccagtgcgctctacagagggccatcagcagcagcgagctaaaatatctgacttggccactgccctgttgaaagtagttcaaggctcctcactgcttctacaatgagatccaaattccttccctccctccctccctccctctctttcttcccatagtcctcacagggctgcagccacactgggcaatgtattcctgatatggacctggggtgcattttcaagcccttggtactttgcacatgctgtttgccctccctggaatgcccttgtccttcttataagctggcagattcttcaacctacaagacccagctcaactaccatctcctcccttgaaccttgccctcactggctatttgctgccatagcaattcgtatacaacaggtatcagatggcagctaattaagtgtaggggtagtttagctttagagacagaatgcctgtgtgtgagtgctcactgcctgtgacaagctaaaccactctgtgccacagtttcctcatctgtaaaatggggatagtgatagtaaacacggggttgtgagaagaagttagtgtgtgcaaagtgcttacagcagtgcctggcacatagcaagcatttttttttttaacagagtttcgctcttgtcatccaggctggagtgcagtggcgcgatctcagctcactgcaacctccgcctcctgggttcgagcaattcttctgcctcagcctcctgagtagctgggattaccggtgtccaccaccatgcctggctaatttttgtatttttagtagagaccaggtttcgccatgttggccaggctggtcttgaactcctgatctcaggtgatccgcctgcctcggcctcccaaagtgctgggattacaggcatgagccaccacatctggccttctgttttgttttttaaatgagacagggtctcgctctgttgcccaggctggagtgcagtaggtgatcacagctcactgtagccttgacctcccgggctcaagcgatcctcctgtctcagcctcccgagtagctgggactataaatgggtgacccctccccactagtttttgttatttttagcagagatggggtctcactatgttgcccaggctggtctcaaactcttgagctcaaagaatcctctcaccttggcctcccaaagtgttgggattataggcatgagccatcgtgcccagcctctattgtcaccttactcattgctttagttcttcctctccatctgtctttttctcttcctcttttgtcctattcatgtttttctgtttttatttccagccaggatcagtgctggggtttggtaatcattactatttactgagtgccta

SEQ ID NO: 16215 - DNA, 8989 bp, Human
aagtagcatttcatgtttttatagctcaggatattagtgtatttttatactgtgtggcacagattgatatatcaatatttaaaccaacagtacataaaattaactcttcttgtttagtaaataacttttcaattattttatccaaaaattacttattaaaattaccgcactctgtaaatggtgattattgcagtggggaactgactgtggtgagttgataagagatattcactgattggcatatggatttgataaattgataaactgaagtcactaggatttttgtctatttcagaaaaactttaaatgaactcagttatggttcagatgaattcagttatggtttcaagttatgttgctgtacatcttgttatacacccctttctcttgcaacctataccatatacaaaattagtgcctgatatttttatataatgctttatactttttaaggtgccttcacatgtatcaggtcttttgttcctcataacaggcccactaaaagagttggtagtgttctttctttttttttttagagacaggggtctcagttggttgcccaggctggaatgtaatggcacagtcacggctcactgcatcctggaactctgggctcaagtgatcctcccacctcagcctcctgagtagctgggactacaggtgcacaccaccacacccagccaattttttcttcttttgtagagatgaagtcttactatgttagagactgatttgccaggataatcttgaactcttgggatcctaggcgtgagtcaccacatccagccctgggtagtgttcttattgcccagtagagaccgaagctctcaggttaagtgatttaaccaaggtcatgccacttgtaagtaagtagcagagctagtgctagatagagcccaagtctgactgcccttagtttatgttcttcctgtgcagtgtgtcctagtaacaaagttagcagattacagaagatgtgatataatctttcccatccttcagttatctactgcttgatgggtgcagccaaatagatcatttaaaatcatatcttttgcttcaggattggttgaaacaaacatcatacttactctttcctgtactatggaaaaaacaggtttagtcaaaaccagagttgcttacaggacagtgaagagaggacttcctgtattacaggatacagttggattaaggtcattaaaacaaaccagacaattactgagagaagtcaaggacatatatatagtaagcataaactttttttttgagatggagtctcactctgttgcccacgctggagtccagtggcgtgatctcggcccactgcaacctctgccttttggtttcaagcgatcctcctgcctcagcctccccagtagctgggattacaaatgcctgccaccacgcctggctaatttttgtatttttagtagagatggggtttcactgtgttggtcaggctggtctcgaactcctgacctcgtgaattgccctcctcggcctcccagagtgctgggattacaggtgtgagccactgcacccggctagtaagcataaacttctaaagaaatagttattaagcagtctgtatgtgccaggcaggtgaattaggctaatggaagaaaacaaaagctctagagccagatagatgtgagctggagttctggctctccaccatctatttgcatgttgctctgggcatatcacttgccttccctgaccctccatttcttcacccataagaaggggaaagttgttgttatgaacatacctactctgggactgttgggaagattactggaccaaaataatataaaggccttagcaaagtacttaaccctagaggtgtttgatatatcatcaatattgttgatggcatttggaatgagatgtttcacatttagtatgctgctttccagatgggttggaagaagattcacacacgtttcctaggccccgaaacctgacatttgctctttctttttctcttgctcttgttctagggaatgacaatggataaaagtgagctggtacagaaagccaaactcgctgagcaggctgagcgatatgatgatatggctgcagccatgaaggcagtcacagaacaggggcatgaactctccaacgaagagagaaatctgctctctgttgcctacaagaatgtggtaggcgcccgccgctcttcctggcgtgtcatctccagcattgagcagaaaacagagaggaatgagaagaagcagcagatgggcaaagagtaccgtgagaagatagaggcagaactgcaggacatctgcaatgatgttctggtaagaggccagtgcttctgttttgaacagtggtttctaaatagtattaatttaatgtataaatgcagactctcaaaacagcttatgagagagaggtgtctgaatatactggaaagctgccaggtatttacaactaatttttaagcatatgatataatttgtgtcacctattgcctgatcagaggttgtacatcacttctgagatactttcctctcctatcaaaaagacctgtgaaaaacagtgacattttttcagcctccctccatcttttaaaattgaggccagatagacaggattttaatagatacagctacagataggctattgtgtatattagtcagagtagtgatgtcatcgccagtaggggagggagatgaaaaagctgagctgcctttcagcctctccccagtcatgccttcacactgtaaagtcctgctttggtctgaaagttaggcacatccatcaagttcggcatgcattccagagccaaattcaaagtgttttgggcattctcctctcctgtattttacataaacccttagtcagatgattgattccctctggccgccacttgggattgaatgggaggggtacgtactccaaaacaaatcataatcatattgtctttcccgcacatcctgagccattgggaactttctttttcttccaggtgaaatcaggtaaaaatgaactcagcgagggctgctttgaagggaaaaggaattcacacttggggacctaccaccttccctgctggctgcctttctaaattactgcccatgactcctttcttttgaaaaccagtataaagcttgtcagccatcaggcagcaccccttatccctaacctattaggagttacacactgtctgtctacaaagaatattaaaacgactgccgccccctgcatcttctcactttggttgattaaatccccttataactaagctttgcattgagcttctctttttattagactcatggcgtaagagtgtcatgactaaatttgttgcctgttggtaatttgggggtttgttaatggtgcactaattcctgaatgttaggtacatctggtattcagatgaagtatgtcatgcattccaagggcaagaaagttccataattcatgaaatgtagaccaacttttaagagcatctgaaagaatgtgaagaagagcttggtacttactgcctcttaaccagtttttcaggatgccacattctaaaacaactcttcgaaaatattgctctgtatacgaagcttggactccttcagaactacttttgttgtaagcataaatgtttaaaggaatttattattaatagtattagctactctttgagtgcttactacgtgccaggcaacgtgttaagcgctttatgtatgtcaacttatttatcattataactaccctagaagatggctataccctagaagatgacccttcgtatagctgaggaaagtgaggctcaaagtgattaggtaatttgtccagagtcatacagataataagtggcagaagagggatttctacccaggtcagattgactttaaacttagttcttggcagttttgctctattatcacctttttcctcctaaggaaagatattttttcccctttaattatagaagtaataccagtttgtgggtttaaaaatggtggggggaacaagtcagaagaatataaataagaaagtaaaaatcacttctaatcttaccacccagagaaccattattaacatactccttccaggcttttcccttatatatttgtgagcatgtacacaaatgtatcttaatgttaaaataggattcttgtggtatttataatctgctttttttccactcagatttcttttgagagcctttccattatctgtttagctctgcatcattttaaaggcctacaaaacatttcattatatggctatactttaattatcccctatggatggtcaaagtgatttttaacagaagaatacaggcatctgctgttatgacctgggctaaacaacatttagtagcttggatgaaaaattggtgtttttttaatcttccaaaaaattatttagaagcagtagtgtatatcttgaatctcaaacatagttttaacatctcgtgaataattctaaattcttaacaatgttcattttttaggagctgttggacaaatatcttattcccaatgctacacaaccagaaagtaaggtgttctacttgaaaatgaaaggagattattttaggtatctttctgaagtggcatctggagacaacaaacaaagtaagtaatatctttaaaaagaaattcgaccagtaatggagccagtcttctttcacagggactttttaacgatttttgctttgttcgccatagacaccaatgtcacagtactaagaatttaaaagaccacagcattgtgacgaacggggtcatgggcgggcaaataaaaatttatctgacagggaagtatggagggcattacaaacctggtgcgcagtgtatttaaaaagatcttatcttgagtattatttgttagctctctttttagcagtgaactttttatacttggtggtacgaaactaccctagtgatgcattgcatttatcacatgtattaccgtgatggtggtaatcttaaccacactttattaagtgcttctgtgccaagtacttccgagtctcacttactcttcacacagccttacgagttaggtggcaggctgcccatttttcatataaactgaggtttatggaggtttctacttgccccaagccacagacctagggagtaagagttgggaattaaagtttggatctatcgactctaaagcctgtgatgtttgcactagaatgtatggtttttcacattctatattgttaaaggttatagctgtatttaactgctttagtagactttgtcataattgttttcccccaaagcatttaatatacaacttggtttagaataaatatctaacaaatgtataattgaatggcagagacactgacacttcatttgataggtcattgctcctgcccagtttgggactgagaaaataatttgatagttggtccaatgtgtgatacctatgaaagaaccgagcctttaatattttcatctttatgttacagccactgtgtcgaactcccagcaggcttaccaggaagcatttgaaattagtaagaaagaaatgcagcctacacacccaattcgtcttggtctggcactaaatttctcagtcttttactatgagattctaaactctcctgaaaaggcctgtagcctggcaaaaacggtgagaaagaccctttgtgatatctaaccatagcaaaacagtgcttgtgttattaacttcattttattcctgaacatactcattgtcttggactttttttgaaagattttctgggggtgggagtgtatcttttatgagataaatacagatctgttacttttttaattcattctcaataccttctgctgactttgtttgattactgttttttgcgggtggttgtagaaagttccaggtgaatgtagttagttgtttcttaccaagctttgggccttggttatacattgtcattctcatgccaagatttgaggttatagttgtataaaagaaatacacagcacattcttgttgtgtgttggattaccttccatattcttcctttggccttctctacatattttttatagtccctcaacatgcacacaactttttaaaaacatttttattcgggaaaggtgccttaaagttccgtcacttaaatcagatttagtgatgtgagtttccagacattttgagttttagtttaaataaataaataattttaaatagaagattgctagaaaagtctttggtaattaaaaaatcacacgcgtttgcccagaatgactgtgctagggttagcagtaatactgcttagttattaggtacagcaaagttcttaccttggagtttctgtcattgttggttggtgctttgtaaatatgccttatacttctgctggaaacagctaacagacagggtaataatagcctaggttcccccaaagtactgtacaagaagataagttatattcacctagcgggaaaaaaagtgggctaaactagctccagagaacttgtgaattctttgctaaaggctctttgttttaggcatttgatgaagcaattgctgaattggatacgctgaatgaagagtcttataaagacagcactctgatcatgcagttacttagggacaatctcactgtaagtactacttccacagggtttatagtctctttcctattcacctacttaataattcactgttatcttcaagaggggatttgtaccattaaatgtagttacagttttaagttgttaaatttgttataaatgactgctgaagttttgacctttgcaatcatccctgtctgcagtgacacaggaataattttaaactgtcgagtgagataagattatacatactgggccacttacctagggaacttttagtagccctgctttgattatacttcctttctcttgcagctgtggacatcggaaaaccagggagacgaaggagacgctggggagggagagaactaatgtttctcgtgctttgtgatctgttcagtgtcactctgtaccctcaacatatatcccttgtgcgataaaaaaaaaaaaaaaaaaaaaaagagaatcgtacgtcgactttcgatttttcacagcctcagcctaggaaaaatggttcatgggataaacagctggtatttgtatctaaaactcagattggtcacataaatgccacggcattccgaagttttgattttgattaacattgacaggattactgtgtgtttaattttttaaaaactgaacactgtgattatggggttttgtaatttagcagaactcttactggtagaaaaaatagacctgaattatgtgtaactttttggaaggtttaatctgatatcaaaataatcattgaaatacaattccattgtaaagttgtacagaaagttatagagattatattgtgatgctggaacttggagtgagacacacatcatttggcatttgagttgaatggtaattcacagtaatgctgccgttgttcgggacttaaagacacttgacctgtttgggctgttgccacttaaaagttcatgaccacaaatgtccacagtgtcttcctctgaggaaactcgaatcctgaaatggaaattctttgtggcagataactggcttatgacaccttgaaaagttcaagtgctcatataacacaccacactgaaccccctttcctacagcaatatgttcactatgttaccaatttgcaacttgtgcttcaatagtggaatctactttcattgttaacactgagctaaagaaaaaaagccgtgtgttttatgaatgaccttatctgtttcctggataatacctttaagaataatgtcctgagtcaggcgtggtggtgcgtgcatctagtcccaactatttgggaggctgaggcaggaggatcgcttgagcccaggagtttaaagctgcagtgccctgtggttgcacctgtgaataactgcactccagcctgggcaacatagcgagacctcatctccaaaaaagaaaacaaaaaacaaaaaaaggaatgatgttctgtagagatggcctttcacttgaggagtactcagttttcaggttcttcctagctcggggcttttaaattttgaaatctaaacattctttcccaccatcctttttgactgttgaccttggttttctcttctaagtttctgtccctctgcttccttactttttttcctttttgaattctatctttatctgtcttttgttcactttttaatgctatatatgggcaggggtgagagacattactgagcaccttggtgagcaagcctggctttaaagattggagaagagcttctggcaccagaaccctgtcttcctccagttctcaacacggtgttgctcttcagtcataccggaatctgaatcaaaaaagtatttttaaatatccatgatttctccctgtattgaggctagccctgatcatgctttttgtgcctgtcaccaggtctcccaagtgcactcatccaggtcagtgctcagatgtgtttaaggagaccctatattcagggaagttgcgtgaacactgcagtggggagaattgagaatagtcaggcctatcagtctcacagaatcacccctctacctttgatattccacttagctgtagagtccatctgtttgtccatctgctgaaatgagaaaagaaaaatttatgcactgatttaaaacaaaccaaaaaaaaagaaaaaaacaaaaaaaaaaatccctcctttctagctgaacaaaaatgtgcagttaatacttggcgcttgaaaatgcagtagtgaatgtggaaccaagcctgtctgtatatctggtagctcttttcttgctttgttttttcttaccagtattctgcctaacgtttgcttctgtgatggttatattgcctagcaagcacacccgtggttgtgaaaatagtatagcaaaaaagaaaaatccccggttattgatgtactagatttgtgtatgtcttttaaacagttctagtttcaccttacacagaataatcaggaaaagtgtaaaaattcaaaagtgaaataaaaattttatcagtt

SEQ ID NO: 16216 - DNA, 13580 bp, Human
tgtgagtctagaaagactttactggggatcctggtacctaaaacagcttcacatggcttaaaataggggaccaatgtcttttccaatctaagtcccatttataataaagtccatgttccatttttaaaggacaatcctttcggtttaaaaccaggcacgattacccaaacaactcacaacggtaaagcactgtgaatcttctctgttctgcaatcccaacttggtttctgctcagaaaccctccctctttccaatcggtaattaaataacaaaaggaaaaaacttaagatgcttcaaccccgtttcgtgacactttgaaaaaagaatcacctcttgcaaacacccgctcccgacccccgccgctgaagcccggcgtccagaggcctaagcgcgggtgcccgcccccacccgggagcgcgggcctcgtggtcagcgcatccgcggggagaaacaaaggccgcggcacgggggctcaagggcactgcgccacaccgcacgcgcctacccccgcggcggccacgttaactgggcggtcgccgcagcctcgggacagccggccgcgcgccgccaggcctcgcggacgcgggaccacgcgccgccctccgggaggcccaagtctcgacccagccccgcgtggcggctgggggagggggcgcctccgccggaacgcgggtgggggaggggagggggaaatgcgctttgtctcgaaatggggcaaccgtcgccacagctccctaccccctcgagggcagagcagtccccccactaactaccggcgctggccgcgcgccaggccagccgcgaggccaccgcccgaccctccactccttcccgcagctcccggcgcggggtccggcgagaaggggaggggaggggagcggagaaccgggcccccgggacgcgtgtggcatctgaagcaccaccagcgagcgagagctagagagaaggaaagccaccgacttcaccgcctccgagctgctccgggtcgcgggtctgcagcgtctccggccctccgcgcctacagctcaagccacatccgaagggggagggagccgggagctgcgcgcggggccgccggggggaggggtggcaccgcccacgccgggcggccacgaagggcggggcagcgggcgcgcgcgcggcggggggaggggccgcgcgccgcgcccgctgggaattggggccctagggggagggcggaggcgccgacgaccgcggcacttaccgttcgcggcgtggcgcccggtggtccccaaggggagggaagggggaggcggggcgaggacagtgaccggagtctcctcagcggtggcttttctgcttggcagcctcagcggctggcgccaaaaccggactccgcccacttcctcgcccctgccggtgcgagggtgtggaatcctccagacgctgggggagggggagttgggagcttaaaaactagtacccctttgggaccactttcagcagcgaactctcctgtacaccaggggtcagttccacagacgcgggccaggggtgggtcattgcggcgtgaacaataatttgactagaagttgattcgggtgtttccggaaggggccgagtcaatccgccgagttggggcacggaaaacaaaaagggaaggctactaagatttttctggcgggggttatcattggcgtaactgcagggaccacctcccgggttgagggggctggatctccaggctgcggattaagcccctcccgtcggcgttaatttcaaactgcgcgacgtttctcacctgccttgcgccaaggcagggggcgggaccctattccaagaggtagtaactagcaggactctagccttccgcaattcattgagcgcatttacggaagtaacgtcgggtactgtctctggccgcaagggtgggaggagtacgcatttggcgtaaggtggggcgtagagccttcccgccattggcggcggatagggcgtttacgcgacggcctgacgtagcggaagacgcgttagtgggggggaaggttctagaaaagcggcggcagcggctctagcggcagtagcagcagcgccgggtcccgtgcggaggtgctcctcgcagagttgtttctcgagcagcggcagttctcactacagcgccaggacgagtccggttcgtgttcgtccgcggagatctctctcatctcgctcggctgcgggaaatcgggctgaagcgactgagtccgcgatggaggtaacgggtttgaaatcaatgagttattgaaaagggcatggcgaggccgttggcgcctcagtggaagtcggccagccgcctccgtgggagagaggcaggaaatcggaccaattcagtagcagtggggcttaaggtttatgaacggggtcttgagcggaggcctgagcgtacaaacagcttccccaccctcagcctcccggcgccatttcccttcactgggggtgggggatggggagctttcacatggcggacgctgccccgctggggtgaaagtggggcgcggaggcgggaattcttattccctttctaaagcacgctgcttcgggggccacggcgtctcctcggcgagcgtttcggcgggcagcaggtcctcgtgagcgaggctgcggagcttcccctccccctctctcccgggaaccggatttggcggccgccattttcatggctcgccttcctctcagcgttttccttataactcttttattttcttagtgtgctttctctatcaagaagtagaagtggttaactatttttttttcttctcgggctgttttcatatcgtttcgaggtggatttggagtgttttgtgagcttggatctttagagtcctgcgcacctcattaaaggcgctcagccttcccctcgatgaaatggcgccattgcgttcggaagccacaccgaagagcggggagggggggtgctccgggtttgcgggcccggtttcagagaagatatcaccacccagggcgtcgggccgggttcaatgcgagccgtaggacaaagaaaccattttatgtttttcctgtcttttttttcctttgagtaacggttttatctgggtctgcagtcagtaaaacgacagatgaaccgcggcaaaataaacataaattggaagccatcggccacgaggggcagggacgaaggtggttttctgggcgggggagggatattcgcgtcagaatcctttactgttcttaaggattccgtttaagttgtagagctgactcattttaagtaatgttgttactgagaagtttaacccttacgggacagatccatggacctttatagatgattacgaggaaagtgaaataacgattttgtccttagttatacttcgattaaaacatggcttcagaggctccttcctgtaatgcgtatggattgatgtgcaaaactgttttgggcctgggccgctctgtatttgaactttgttacttttctcattttgtttgcaatcttggttgaacattacattgataagcataaggtctcaagcgaagggggtctacctggttattttctttgaccctaagcacgtttataaaataacattgtttaaaatcgatagtggacatcgggtaagtttggataaattgtgaggtaagtaatgagtttttgctttttgttagtgatttgtaaaacttgttataaatgtacattatccgtaatttcagtttagagataacctatgtgctgacgacaattaagaataaaaactagctgaaaaaatgaaaataactatcgtgacaagtaaccatttcaaaagactgctttgtgtctcataggagctagtttgatcatttcagttaattttttctttaatttttacgagtcatgaaaactacaggaaaaaaatctgaactgggttttaccactactttttaggagttgggagcatgcgaatggagggagagctccgtagaactgggatgagagcagcaattaatgctgcttgctaggaacaaaaaataattgattgaaaattacgtgtgactttttagtttgcattatgcgtttgtagcagttggtcctggatatcactttctctcgtttgaggttttttaacctagttaacttttaagacaggtttccttaacattcataagtgcccagaatacagctgtgtagtacagcatataaagatttcagctctgaggtttttcctattgacttggaaaattgttttgtgcctgtcgcttgccacatggccaatcaagtaagcttcagctttcagtaattgttatcttagagattatgccacgtgaatgtattttattgtacatatggttaagctgagtaattcatattctgtattgtcatatatcaaatatagacatgtccaccaaaaattaaactttttaagcttcgagtgctgctggtcataaaaattaatttgtcctggttataagagtaatttttaaggttatttctaatgcatatctttaaatattttcgtaactgagagtcatatggagaaacttagtgtttgttgtaaaaagttgtgtttttttggctgagatacttagaatcaccaccagagggggcagttaagggaaaataaatgatacttttcagatattgaatagtgaaataaaaactttgggtcataagtaatgaaccaagagttattttctgatgtttaaaaatagaaatttgcgtttttaggttgtagggttgaaatttttggtaaagattctttaataatcctttgataatcacggtctacatttgtttatttttccttagaaagttttttttttaattaataatttaagataatttaatgttgagtaaatttatatcaagcattaatgactttgaaacttgtgtagatcagctgaggcaattttttggtgtaacacaactaatatgcagtttaacatatggtttaaatttgatgtaagttttttttttccccccagaaaactttagaaactgttcctttggagaggaaaaaggtactctgccagcaggtcacctcatatttaagaatttaatttcctgcatacaaagaggaaaatgtaaataaaaattgaaatggtattttcctttgcagagagaaaaggaacagttccgtaagctctttattggtggcttaagctttgaaaccacagaagaaagtttgaggaactactacgaacaatggggaaagcttacagactgtgtggtatgtaaattactgaattgttactggatattagtcttttagctgtatgttaagtgaatcatggaggaaataactatcagcatagtaaaaaattctattatgacttcacttataagctataatgagattaaatgctaaagtttaccctttggtttgaaaggtaatgagggatcctgcaagcaaaagatcaagaggatttggttttgtaactttttcatccatggctgaggttgatgctgccatggctgcaagacctcattcaattgatgggagagtagttgagccaaaacgtgctgtagcaagagaggtaagcaaacaatgactgtcttgtgcattaacatgaagaacgctgccctgctgaaaatcagaaactatttctgaatttagttttaactcaagattttttctcttattaaaggtgtgttgggtttctggaccattttcttaagctagcttatttttcaaaagctaggtccctaaaagctattttatatctggtagttttaaggtggatacaagcgaagtatggtactacggttgggtgctttgaattatgcttgtgtttttttctgtttggatgacttttaccccaccactattttaggaatctggaaaaccaggggctcatgtaactgtgaagaagctgtttgttggcggaattaaagaagatactgaggaacatcaccttagagattactttgaggaatatggaaaaattgataccattgagataattactgataggcagtctggaaagaaaagaggctttggctttgttacttttgatgaccatgatcctgtggataaaatcgtatgtaagtgtctaaccacaaatgtactgtttttttccagtgtattcaattttgtgtatgttaacatctgtaactttattgaaaggtaaacttttgaagctgcttaatattgttgatttaatttaaaaggagtctgaatttttcattccagtgcagaaataccataccatcaatggtcataatgcagaagtaagaaaggctttgtctagacaagaaatgcaggaagttcagagttctaggagtggaagaggaggtaattttaattctgtttcttctttatttttgttcatatataagggcttgcttctaactggggcatttattgtaggcaactttggctttggggattcacgtggtggcggtggaaatttcggaccaggaccaggaagtaactttagaggaggatctggtgagtttcaagttctacgtgtttaaaggatgagtgtgcttttattttaaatatgattaggttttcattagtagaatcaagaaatccaacctaagtcaattttcctaagacttcaaatagattgtatcctggcaagctcttgtgatttggccagacaagaagttaatagagttgtattaataacagttgtatttatctggattaataatgtaacatgaagtgtcatccgaaaagctttgacccccatcaagtgtcattcttacgtataaataggatggaatctctaagattgagacttgttaagagtccaaaatttaggcggtagatttaattatatgctttcatgttttgtgggtaaactggtagcactggtgtgtccttttctgcggttcttaattattgtgctgaggtagtaagagaactgaaaatgaatattagcaataatgctgaacagtttatagtaaacgtaatctttttttggcccctaacagatggatatggcagtggacgtggatttggggatggctataatgggtatggaggaggacctggaggtcagttttcctctacgttttggtttgtttatgtgactaatacttaactatatcgtatatttacttcatttatattttgagtttttaaacattttatattagtgtctataaatggcttgggtgatagtggtccagttatttctaagtagttttgccatcttagctgttatagcctaaggaatagagtgccattttaaatgaaaatgtaaagataaccatcagagtatctcatcttttctcaagcaaaatgattggatctagatatatctttgtacgtgcttctctggaaaagtacagaatactggatttaacagagtaaaacctaagggggtggtatatgtaggaaaaaatatgaaatatgtctaaacccgtaactagatgggaagcatcccaggataactttcaaaaagcgtaacctacggaaatgttccaaaatgtttagtgtgctcctggctgcagataaggttgtgaactaccattaaacatgaagtgtgatatatcattggcgtacagaaaaggctgatacacactgacagattttgtaacaagggacatttaaaactgagctggtaatagacttgatttctggtgttgccactcaataggcatgactaaatagtgtatctcactgttctactttttataattaaaattttagaggaagctgagttcttgtatttaactacaagttagagactcagcccacaagctttttttttttttttaatatggtttcttttttttttttttttttgagacggagccttgctctgtcacccaggctggagtgtagtggcgcgtctctgctcactgcaatctctgccttcccggtccaagtgattctcctgcctcagcctcctgagtagctgggattaccggcgtgcaccaccacgcccagctaattttagtatttttagtagagacggggtttccccatgttggtcaggctggtcttgaactcctgacctcgtgaactgcccaccttggcctcccaaaaacgctggggttacaggcgtgagcaaccatgcccagccttttttttttttttatttttgttttgcagtatgtgaaagtgtaaatttttgtttatgtccgcacttctatttacagtaaagaacatactgtgtggagtgttgggtctgttttttttctttgaaatggggtctggctttgttgctcagactggagtgcagtggtgtgatcttggcttactgcaatcttagtctcaagccatcctcccacctcagcctcctgggtagctggaactacggggtgtgccaccatgaccggctaattttgtgtttttttgtagaggtgtgggggttttgctgtgttgccctggctggtcttgaattcctgggctcaagcaatccacccgcctcaacttcccgtactgctgggattacaggtgtgagctgctgcgcccagccaagaacattgtttcgttttttgagagggagtctctctctgtcgcccaggctggagtgcagtggtgtgatctcagctcactgcaacctctgcctcccgggttcacgccattctcctgcctcagcctccagagtagctagtactacaggttgctgccaccatgtccggctaatgttttgtatttttagtagagatggggtttcaccgtgttagccagggtggtctcaatctcttgacctcgtgatccgtccgcctcggccttcccaaagtgctgggattacaggcatgagccactgtgcccaaccgagaacattgttttaagatatgtaattcgtagagagacataatagaaactttatcttttgggccagtaggaggaagtgctcttttactttccctctagcccacactactagtctagcctcacagtccttacccacaatatacatgaagtatttcaagatacttaagatttttagttttgagggaaagctgtggaattacaggtatttaactgtgtgcacatggtgttatccatttggctgagtaaccccagccaccaaatgtttaccaaggatagttattcagtccttgaagctattttagaggaatttcattaaatatttcacatggaaacttggaaagctggaaatggatgtgaggagacagttcaaaatggtattgaaaatattaagtgattacttaaaggcttattttataataggtggcaattttggaggtagccccggttatggaggaggaagaggaggatatggtggtggaggacctggatatggcaaccagggtgggggctacggaggtggttatgacaactatggaggaggtaataaattcacctgcaacctttatgtgggaatttggaattaatgtctttgtaacacttgatcttttgtttccatgtttgtcactagatgcccataaaatttgtggataagtgtttgcttttatttgtttttatgggagctttgtcctaagtccttggtttaatgtttgtattgttctgagtattccaattttttaataggaaattatggaagtggaaattacaatgattttggaaattataaccagcaaccttctaactacggtccaatgaagagtggaaactttggtggtagcaggaacatggggggaccatatggtggaggtaatttataaaaattgaggttattcagatttttgtgattaaaggattagccttttgtgacttaaagggaagataacatactaagtagtttgtactgtgggcagtgctccatgtacggtcttagtgaaaataaagaaattttgcataaatctccacagaagtactcagcaagcagttatgacatcaaattgggattagggatgttggaggtgggggtgttcagtagtttaatttctggtggggactcataaacagctaaatacagttgcaacccacattgcaagtggtatacattggaatgagggtctttgaagttaaatccttaaaccatgattcaaaccattgcttagcttatttttgaggtttttagctaggagtaaactagctttgtcttgggcttgatgtacttttaaaaaaatcccttactcagtccaaatgaggatgagagggtgaaaggaccctttatttaaaagaatagggtcagccacgaaataaaaatgtctatgaacccgagtaatttatctcctgagtaattctgctaactggctgcaaaggattaggatctgcttgtttaaaagactggatggatataaaatagaatcaactgtagtgttaggctgatcatgggaaatcaaagtaagtttgttttctcttgctgttccaacaattataggaaactatggtccaggaggcagtggaggaagtgggggttatggtgggaggagccgatactgagcttcttcctatttgccatgggtaagtagcttttgagttttacaattattattatcttgggagacatagctgcaggagtaaaagctttttaggatcatgttatctttccttaaaatctggttagatggataatttcataacctattttttttttactctttacttctgttgaaacaggcttcactgtataaataggagaggatgagagcccagaggtaacagaacagcttcaggttatcgaaataacaatgttaaggaaactcttatctcagtcatgcataaatatgcagtgatatggcagaagacaccagagcagatgcagagagccattttgtgaatggattggattatttaataacattaccttactgtggaggaaggattgtaaaaaaaaatgcctttgagacagtttcttagctttttaattgttgtttctttctagtggtctttgtaagagtgtagaagcattccttctttgataatgttaaatttgtaagtttcaggtgacatgtgaaaccttttttaagatttttctcaaagttttgaaaagctattagccaggatcatggtgtaataagacataacgtttttcctttaaaaaaatttaagtgcgtgtgtagagttaagaagctgttgtacatttatgatttaataaaataattctaaaggaaattgtgtaattatagactttttattttaaataagttaaggagtgggtagtataattaaggtccgttgcaaagctgttgttatatttgtataagataaatgctggtcagatgtaagtgtgttgtctgcaattcatcaggattaaattatgtagataacttaagggatatctctgcaaggagaaacacctttttagatcttttagatgctgcttcttcaatgcaaggaaaggaaataaccccagcgaggtactcttcagggacacaggtctagtacaagagaactcttgacggctactaagttcagccagtcttaaaaaactgtgctgtttctacaaaactttaactacagtagtttataaggatgccaacgaaagctgagggtgtagagcaaaatagttctaagcttcagttaaacttctttaggtaagatcttatttacttttcctttcttaattttcctccctaaaagataaactaatactcttaaatggtctttcagtatagtggttcttacgtagtttaacatagctataaattgagtttaacaatttataaactcaagagaataatttttataaaccctgttttccaatctgtcatttacttaaattattttggttgtttttccctttttttccttcttttcccaccccctccccctccatgtgaagatttgggtgcttaacatatcatttttttccctgccggaattttagcattgatatgaaccatggacaagtatattctgctgccacaaagactgtaaagtgcttcatttcaacagctgaggcaagccaagtgatcattaataaagcttttcttggttccttcagtggtgttggtagtaaaatggtaggtaaaagttaggctgcaagttcaataaatcatgagatttcccatcgttacacccttgtgtattcacatttcttggatcaaacattttgagtgaactaggggtttttattaaagacatttgttgtatttatggttgtaactgtacatgcttatcaggatgagactgaaagaaggtagggcaaaaatggttgaatctattttcagatagtagttcatacttgagtgaagtgtcttgtctgcattatgaagcctggtatgtatccagtactaaataggtgggttaaatgtggtaattctagttcagtgtcttaccctgaagagaaagttgtaggttggctgttgaaattcattccttagatatgatcagtttgattgcccggctttattgcctttacaggaatgtgatactcagggcttactctatacaccaatgagtcttctttgatcctaagaccaccactgaagttgtttaggttcttttggacaaacatgataaacttcttcagatactttttttttcctttggcaggaaggtgtcttgctgcaggtaactaatgaagaagtggtcaaccacagagtcttcaagaaataagaaattctgtaccatctgaaagtagttcttgttggtgccttcatttaaaaagcactctttaaaataaaagggaaatgttttctgataaaacaaacatttagttgaggttcttgatataaaacaattacaaaatgagtgttgtttgtaaaacagtaacatcaaattggctagagagataaatgtatcatgttttaaattaggttttgtgagtagacagattacaattctattttaaatataaagtttataaaataaatactttttgtatccaaatacttggtgtaatgtttacacataaaatgtgtgaatcttgttctataaatatttggttgtctaaaagatcaccatcccctaaatttttaaaagcagtttcacaaagctatgcatattttaatattaacaggtaaatgagaagagcattgtggacattattggctgtccccaataaaatgctgttcattatgcactgtatattcagcgtttgagtactcctaaagtttctggctttacttttacgtttagcaatactggtggcattttgaaaatcatggattttaaaggttaaccggctggagtggtccagattaagtggctttgcagaagcactgaggtttacaatatgtgctagattgtcaaatgtcaattagttttattgtggtttacactgagtaaatgaatatcagtgttgctttttaaatgtgtttatttggacatttatctgaattaagaaaaccaaaaagaccaggttaatttgtttctatgataatttgttttggttttgataatgtgaggtatctaacaggtaagtcaaatttaacagcaggtaacacatagaaagcagctttctgtttgaaatagctgagttcgtcaattaaagacgtacaaatatcccaactttaagaaaattttgaaggtttaaaaatgtgtggatgtacaaagacgttgaactttgaaatacatcaggttgatatgcataacctcaaaataccaactcctatccagccaaggtcaagggaatatcacacaaataggggagaattaggtaattgcacaatagactgaaatgaactgattgaaggagggtttactgaagcatgggggtaatgttggatattcaacataggcttatttcctgtgtgtatatgttgtgttgagctgtttctcttgtagaaattgaagtttaaggtagtt

SEQ ID NO: 16217 - DNA, 13580 bp, Human; identical to SEQ ID NO: 16216

SEQ ID NO: 16218 - DNA, 36816 bp, Human
gccaatgaaacaatatggccgacatgttccataaattggacaagctaaacttgcaaatccacagttttgacgaaaatatagtgagagcacttatgaaacatcatgccagaaaataatccattcccagaagttgtgaaaagagtttttagatgtcttttttttttttttttttttttttttgagacagagtctcactccgttgcccaggctggagtgcagtggccagatcatggctcactgcaacctcaaactcttgggtttaaacaatcctgcctcctaagtctcctatatagctgggactacaggtgcacaccaccatgcctggctaatgttttgtatttttggtagagacgatgtttcaccattttttccaggctggtcttggactcctgggctcaagaaatctgcctgcctcagcctcccaaagtgctaggattacagacatgagccactgtgcctagctcgatgtcaacttttaaaagtatacactgggatatgaatttttaaaatacttttatgaggcacagaagcgaaaacgtttagagtgctactttctaagttctggagtcatagagaagagtgaacaagataattaaggtccctgccctcttagaacatatatcccaggtttgctgtttataattttaactcaatatatatacaatgaaatattattcagccttataaaagaaaaccctgttatgggtgacaacatagatgaacctggagaacattatgttggtgcaataagccgggcacagaaagacaaatactacattagcccatgtatatgtgtaatctaaaaaattcagattcatagaagcagagcatagaatggtggttgtcagggcttcagaggtaggaaagatgggagatgttgctcaaagttacaaagtttcagttaggcaggatgaatagattctagagatgtaatgtatattgtatacttgcagttttcgttttcgtttcgttttgtttgtttttaaatagagagagaaaagctctcactctgtcatccaggcagagtacagtggcatgatcatggctcaccgcagcctcaaattcttgggctcaagtgatcctcccacctcagcctcctatataccagggactacaggcacatgccaccatgcccggctatttttccatttttttgtagagacgaggtcttagctgtttcccaggatgagaatagatcttaaatgttcacagcacacacgcgcgcgcgcgcgcacacacacacacacacacacacacacacacacgcaaatgataactgtatgagatgaaggttatgttaattattttggttgtggtaatcatttcagaatgtatacatatatcaaaacattacgttgtacatcgttatgatatacaatctttgtcaattatacctcaataaaactggaaaaataaataagattttaactcaaatgtcacttgcttagagatgtcttctctcacccaagtcactctatcacattgccttcctagcaattaaaactacctgagattattgccttttttggtctattttctctctccattctaaaatgtgtctgccgtgagaggggagatcgtgtctgttttgttttctttgtgcccccagagcctagaatactgtctggcattttaaagtacacaataaatgtttgttgaataaatgaatggatttgttagttttgtgcccatttcacaaaggggcaaagtgaggcctttgagagccagaagctctaggtcagtgactgtcctagtctatccaagcacagagcagctctggttagtgtctgctcaattcctctcccctcgcccaaacgtccctgagttgcggcctcgctcctgaccgaaatccccgcgggttctcctcgcagtgtctactggatcccgccaggaggcagcagaggcgccagcacccagtccgacgggacagcggaccggagggggtttccgcttccgggagaggctgaccgtttccgcttccgtccacttggcgagtgagacgctgatgggaggatggacgtactggtgtctgagtgctccgcgcggctgctgcagcaggtttggacgcaggagaccggcgggaaggcctgaaagagatggagcaggctctgactcctgcccaagcggcttcgggggcgggacagctaggcgaggaccatcctggtcctctcagagtggagcggcacggtccctgtgggaacaggaagggttgagagaggaagcacccatcatttcaaagcccgtgtgactgtgattttcagcggaatggagggtccccaccctctcccaggcctcccccaaaccagcgtcttcggtgggctggagcctggcatgttcagaacagttctctccctacaatccacctcctcttctgcatacacacgcgatttaggggatgcggggagatagacaaggggggaatacattcagagctctgggtcttggtttgcagctcagccgcagttcttcccgggttactgagcgagaggattcctaataagcccatggggtgattcattatcagaccagcggagcttgctctgtgccctcagcattcgtcgggaaggagcagccacaccatataaaagtgaaagcggccgggcgcggtggctcatgcctgtaatcccagcactttgggaggccgaggtgggcggatcacgatgtcaggagatcgagaccatcctggctaacacagtgaaactccgtctctactgaaaatacaaaaaaacttaaccggctgtgttgggggggtccctgtattcctagctactcgggaggctgaggcaggagaatggcgtgaacccgggaggcggagcttgcagtgagcagagagcacaccactgcaccacagcctgggcgacagagtgagactccgtccccctacaaaaaaaaaaagtgaaagcggaacagttccattaccttttatgcccaggtggggagggatggtaggaagatagttcacagtactctgtcctgttacggctgtatacttaatcagcagtcacaaagtacaagttagtcaagtaaattggcaagctctttacatttctgagccatttatttatcggtatgtatttatctttgcctcacttggttgtgataatcatgaaggtaatttctgaaaagtgtttttagctcagctcctggaacataatgtatgctcatttttggcaatttggttttggctgtagctatctcccagtaagtattctgaaatttcaggtgaggaactccccctgagttttgcagtttaagttggaagctttatttctttctgaattgacatgtctttagttttagatgttaaactacaaagcctggtctggtctagtctaggacctaagacactggaaacaggaagaaatgggaaaattgtttagtcccagaaagggtgaaaggcagacccttgagctattttgaatgtgacaaaggacatttgggttttttaagagtcccaggtcataggatttgggaataaaagcaggttggtcaacctgaaacttaactactcttgctaaatcagagtgtttatcgagccaaagaaaagaactagggatatgagacatgaggcatatcccattatatacttactccgattcctgtctcccaaaacacatgtatgtgtggttaatatattctttttctttttctttttttttgaaacagagtctcgctctgtcaagcagactggagtgcagtggcacgatctcgactcaccgcaacctcagcctctgggattcaggcaattctcctgcctcagcctcccaagtagctaggattacaggcatgcgccaccatgcctagctaatttttgtatttttagtagagacagcgtttcgctatgtttgccatgctggtcttgaactcttggcctcaagtcatccacctgcctaggcctcccaaagtgctgggattacaggcgtgagccaccatgcctggccaatattttcttattaaggataatatgctaacgtcagcaaaaatctcagaggagaaagaaacacagctcatcaaagggaacattaatgattcccatggtctatgccacgccttggtagagaggggaaatgtggaagtaagtttatggactgaaaaaagtgctttttttcccacaggaagaagagattaaatctctgactgctgaaattgaccggttgaaaaactgtggctgtttaggagcttctccaaatttggagcagttacaagaagaaaatttaaaattaaagtatcgactgaatattcttcgaaaggtgagtactttgggttccagttttattctccagtttgaatcattatagcttttttaaagcctttgttaccaaagattctggaagtatatcctatggaatttggaaaagaagcatagaaaccctattcttttccctgcattagacaacttaggactgaggtagttggtgcaaatagtgacaagttggtgttgtcctgtccttcaggactctttgaaatgtttcatcctgctaactgtttggctaacttaaagtaggatttaggtagggttgaggcatttctttttaaaaatttatttattattttttgagacagggtgtctgtcactcaggccagagtgtggtggcatcatcacggctcagtacagcctcaaccttcaggctcaagcagtcatcccaccacagcctcctgagtggctgggactacaggcgtgtgccaccacatccagctaattttttttttttaatagagatggggtcttgctgtgttggccaggctggcctcggaattcctggcttcaagcaaccctccctgtcttggcctcccaaagtgttggaattacaagtataacctactgcacccagcaaggttgaggcatttctttcaacagtttatgcccatgccttttttaaaaaaacatgtttgatttttaaatcattgcctctatcataaaggaaatatttgaaaatacacctgcatattttctctgccctaagttggttattttacagttttatatcttacataatcatttggggttttttccacctggtatttcaaaacactttttttccccatgaagcttgtgctatgtttatttaatggtctcatgatttaacagtgttttaccaattttgttttaaaaaaatgaacttgctgcagtttttttgcctgcctttcgtatttggtgatgacatatcccagagtgttgacctcattcccataattattctcctgtgtgtatatattactgtcagacaaactctgcaggcattacatccttttcccaaagctgattgatccatttactcaccttagactctatcttccccactcccatgacatctctcatattatctttttttttttttttttttgagacggagtctcactcttgttgctcaggctggattgcaatggcacaatctcagctcacaataacctccacctcccaggttcaagcaattctcctgcctcagcctccccagtagctgggattacaggcatgcaccaccacacctggttaattttgtatttttagtagagacgaggtttctccatgttggtcaggctggtctggaactcctgacctcaggtgatctgcctgtctcgccttcccaaagtgctgggattacaggcgtgagccaccgtgcccggtgtccatatttcctatttgtgatctgctatgctcgagtctcatattacctatatgtgatctgctgtgcttgtctttgagtcttctagaatcacaaaattccttttccatagaatcttcccaaaagaatctcacctttctcgttatgtcattcattctacacttatatatgtttaattctctgttatatttattttaattcaaaagtattattaaatgtctaatatgtgctagagactataagggaaaagatacaaaaggaagtacagtattttgtcgaactcctcgcctcaagtaatcctcccacctcagcctcccaagtagctgggatggaagtacagcatattttactacacatttttctgtaatgcagattagctcttatatagataggagaatgctctcactgtattgtgggaggcatattggttctttgacaaatactttgccctactgaatgagcagctgaacacaaggtacacagcagaactaaaaaccacagagtaataaagtactgtgtgtgatggccattcaccctgtcgtttttccctggttcactttggccacatgctctgacttgaaagcatcacatatgaaactggtagagacaacttgttgaattgattataatcagatagtaattttcatagtgccaaaactaagcacagtagatttcgtgtgtgtaggtacacacacatacatatgtacatggtggtactcctatcctttaaaaataaaaaattgaggttgggcgcagtggctcacacctgtaatctcagctgtttgggaggccgaggcaggtgaattacctggagtcaggagttcgagaccagcccagccaacatggcaaaaccctgtctctactaaaaatacaaaaattagccagggatggtggcatgggcctgtaatcccagctacttgggaggctgaggcatgagaatcacttaaacccaggaggcagaggttgcagtgagccaaaatcgtgccactgcactccagcctgggcaacagagcaagacccggtcccaaaaaaataaatacataaaaataaacaaaaaattgacatttattatagcaggttttgggtataagatcataatctaggccaagtgtggtggctcatgcctgtaatctcaatgctttgggaggccaaggcaggaggatgtcttgaacccaggagttcaaggttacagtgagctgtcatgccactgcactttagcctcagcagagtgcacagtgagatcttgtctgttacccccaacaaagaagagaaaaggatcatatccaagtaaatttggcatttgctgttggaaatctttagattgggaaaaatgtatcttccttgttttaagtatgttaccacagagaggagtcaattattgattagctacaaacttgaaatcaggttttttagtgaatttaagaatataatttcttcatatgatagagagggctgatgaggggagcataaaacttggactgtccattccaatagacctgagtttgaatctggccttttccacttattctgtcttgtctttgacaagttacttatctgtagcccacatagaaatagtgataatagtaacaagctcgattttattatgtagatggaataagataatgcatataaataaagcatttggttcaaatctttgcatactcaagtattaacttctgttattgtcattattttatactgttgacattttgatgaatataaatttgtgatgaacataaaattgtgatgaacatgttgatgaacataaaattgacaaacataaaggtgtataggcagcatgtttatcttccattaaaagcatatgtgtcattcaccttttttttttttttttttttgctaaactgctgtatggcaagtacagtgctagatgccagggacagggaagagagccatgaattaagcactttgtgtgcatccagcagtctagtggtagagacagatagttttgtgagggtatgataagtgcagtaatagagataattatatgccatcttaaatgactatattccatgggaaaacaggaggtagtaggtctcataacagtaaaacaaaactactggcttttctggtatattaatattacctgctttgctcccttttatttcatgccttgaagaggtcaacattttgatggacatcatgtatttttttgtttgttttttgtccattgagttttcacttccaatatttgatgtgaaataaattattttctcagagatttggagaagctgagaaaaggattccatcagctcttttaactccctcctcccagtttctgttctgctaaaacaaatgcaaaaagtaagacctcagggcatttcccatggatgtcttagatgccgtgggatggacttgtcctgctgcatgtcttagcaaatcccagattgagggcatcacaccataagtacgttttcccttttggttcttaagatatttggaggtttatactcaaaatatttggagacatcttgtatgatgatggtattacgtacattattgacatgtttccattcttttcctacagagtcttcaggcagaaaggaacaaaccaactaaaaatatgattaacattattagccgcctacaagaggtctttggtcatgcaattaaggctgcatatccagatttggaaaatcctcctctgctagtgacaccaagtcagcaggccaagtttggggactatcagtgtaatagtgctatgggtatttctcaggtgatgtattgtcatgactcttggctgtttgatttttttaagtattattatcatcattgccatttacagaaataatactattacaagttgtatccttagtgaaaaggacatttgccacagtttgaaaaacttgagaaaggagttgggggggtatatgttttaacttttttaggcacaatttttaaggtttggttaaattttatatgtattctcaatatttaagggcaatcattggtactcttttgtttaggtatttccctcctgctgtgtccaggattgctgtgtggtggtgatgagtgctgggaggtgaaaaattaaaataagccatttaccagtcagcatcccaattaaatatttgatgtaactgtgatctttgagccaggcttatatattcattttcaagcagaggagttccccattttaaatagaggcattgtctgatgtgtttatggttaactgcatctggcttgggtctttctgttttcctttctttgctgaattggaaggggttactctgaagagtccaggtcttacagtgtggtttatttctcaagtgtgaatattgcacaccttcatggcttgaaaattagaaatgtaaatatgctggaaccagacttcataactgtagactttgttatgtcatcattaaaaagttcgaggtgttgtaatcccagctactagggaggctgaggcaggagaattgcttgaacccaggggcggaggttacagtgagccgagatcacaccactgcactccagcctgggcaacagagcgagactccatctcaaaaaaaaaaaaaaaaaaaaatagttccaggtatttgtgtgtaacgtatttggaaatagagatcatgtagtgtgggcactttctatgcctcttggcactattgatactttaatctgtcattcataatgtgattggacttctctgcttctgccttttgatggttcttaacgtaaaatgcatctcgtgccttgtcaggtgtgcatttgcgagtaacttgctgaaatctgttgtgtaatgaatcattttatattgtgttgtagatgctcaaaaccaaggaacagaaagttaatccaagagaaattgctgaaaacattaccaaacacctcccagacaatgaatgtattgaaaaagttgaaattgctggtcctggtatgacataatgttatccttcttaatagttgtattgaagatgagtcctttttgaagttaaaaaagaacacacattttaattacagggttaaactttgtatactgaacaagatggtgaaagcactgtggattgtgatataggaaattgaagttttaatctagactcagctaccacttttagctgccttatcttgaatgagttactttgcctctctgtgattcagtttttcatcagcaaaatgaggatagataatggcagataagtcttcggcacaagggccttctgttttctgttaagaggcgaacagattgtttgctgaaagtgaaagggccctgagttaagtaggaaggtttcaggagagtggtgaaggcttgaagtaggcggtgagacaggagcttacaagacagcttaagtcaaggccacaactggtattggaatccggaagaattttgccagagccaggtcagtgtctggagcaaatccttaggagcgagtgattattcaagataagacagtatctgatattttttctcttctatccattaggttttattaatgtccacttaagaaaggattttgtatcagaacaattgaccagtcttctagtgaatggagttcaactacctgctctgggagagaataaaaaggtatatgtacactcttctattaatatattagtatcttagaactgcgtggaaccaagcatggtggtatgtgcctatagtctcagctacttgggaggctgaagcaggaggattgcttgagcctagaagttcaaggctgaggtgtgctgtgatcgcacctgtgaatagctactgcacttcaacctgggcagtatcatgagacttcatctctaaaaaagaaaaagaaaaacgaactgcatggaaagtgctgaaaccgggaatggatttcacttttatactgaaatttaatcattcacatttgagattatgaacatttatgaagtagcctttcccctgggtctagcatgttgtgtgattttttttttttttcacttaattccacaaggcatttgaggtagccaattgatacacagatatcactgaaatagaatggataatttgtatacatgaatttgattctttttcagttaaaaatatacaagcagatccatcataaaatcaaacatggttgaattacggcccaaattaatgtttaagtctgagtttgttattaaatgtgttattaatgaatgcattggaacaaaatgtttatgctcctcttaaaaaaatctttctctctttatgtttatgcccctcttaacagcctttctctttttgtctaccccaggttatagttgacttttcctcccctaatatagctaaagagatgcatgtaggccacctgaggtcaactatcataggagagagtataagccgcctctttgaatttgcagggtatgacgtgctcaggtatgtgctcttgccttgcgtactattctctttccttattttcttgtttggaaaattctatagaacatggaatatctcactcaagaaagaacattcgactaaatcagtggttcatcagcttagttcttctttacaaccacccagtaagcttttaaaatatgtcctgagcctttcctctgaaccttttttactattttatttttttagactcttagtggaaccaaggacaaaactccttcattctacacatgtttcttgaggacctcttgtatgcaatgggtttatatcctagcagggagagaagtagtaaagaaacaggttgttttgggccttgtaagctgtgagaggcaattgagattttattctaagtgtactgggaagctattagagagttttagtttgtgaagcagggtgatcaaattaaagattagcctgggtaccatggctcacacctataattccagcactttggtaggccaaggtgggaggatcactagaggccaggagttctaggccagcttgggcaacatagcaagaacctgtctctattttttatatttttaaagaaataaaaatttttaaataatacaaattaaagattactctggttacttactgtgaagaagctagacaaagaagggagactataacagtaagtgttaggccaggcacggtggctcacgtctgtaaacccagcactttgggaggccaaggaaggatggatcacgaggtcaggagtttgagaccagcctggcaacatggtgaaaccctgtctctactaaaaatacaaaaattagctgggtgtggtggtgcacacctgtaatcccacctacttgggaagctgaggcaggagaattgcttgaacctgggaggcagagatagcagtgagctgagatcgtgccactgcactccagcctgggcaacagagcaagactctctgtcaaaaaaaaaaaaaaaacagtaagtcaagaggctatcataatccacttgaaagatgatctggtggtttggattagataaaagcagagagggagagaagtgggttggatcaacatttttttttggagacagagtcttgctctgttgcccaggctggagtgcagtggcgcaatcctggctcactgcaagctctacctcctgggttcacgccattctcctgcctcatcctcccgagtagctgggactacaggcgcccaccaccacacccggctaattttttgtatttttagtagagacggggtttcaccatgttggccaggcgggtctcgaactcctaacctcaagtgatccgcctgcctcagcctcccatagtgctgggattacaggcgtgagccattgcacccggcctcaacatatattttcaagaattttgttcattgatatttgggaaccattggtctaaattatattaagataatggttaaaatgttaaattttcataaaattgtgggaataaccaacattggcccagctgtcattgtctcaattagctacaaaataaacagattatagtccactgacagaaaacacattcattcagcaaattctggatgcctgccttgtgcagcctctagtacttgagtatgcagagctgaatgtaacagacatagttttcatctcttgtggagtttgcagaccagttgaagaaacaaccaagtaaacagatattactaaatggtgatgtactggcatgtaaatattagtggttcctaatggaatatagttcctctaatttaacttaaccatctttattatttaaaaaatgattatatattctctgattggtgttaggttaaatcatgtaggagactgggggacccagtttggcatgctcatcgctcacctgcaagacaaatttccagattatctaacagtttcacctcctattggggatcttcaggtcttttataaggtttgataccatttcttttatattatgtgtgtgtttaccattaatcataattatccattttccttaggaaacttaaaatggtttttaaagctactatggagttaagtgaaagttgctaacagccttagtaatacatgtctctgtataaatgacattctcttgaacttaaactacttttttttttgtaatttataaagacgtttaattacctcacagttctgcaggctgtacaagcatggcgctagcatctgctcagtttctggggaggactcagggagttttatttatggtggaaggcaaaatgggaacagactaattgataaacatataaaatttgttcatctacactggcaagccctttcgtttagtttacctatctgaaaaactgaattcttttttattctgacattcattgcatttggttgtgtgccttagaaacagccatcccctacccccagattcattacatttggtcgtgtatgtagaaccgctactagataccctacatttggttgtatgcatagaaacagccatcccccacctgttaatatgtcatctttgctttgtttattggtgtatgttaaaaatcaaattctaggtcaggtgcggtggctcgtgtccgtaatcccagcacttggagaggctgaggcaagccgattgcttgagttcaggagtttgagaccagcctgagcaacaaagtgagatcccatctctacaaaaaatacaaaaataactagccaggcatggtggttcacacttgtagttacagctacctgggagactgaggagggataatcgcttgagcacaggaggtcaaggctgcagtgtgccatgatcatgccactgcgctccagcctgggtgacagagcaagaccttatcttaaaagataaaattatattaaaaaaaagtaaaaaaaaatgaattataccacattgaatttagaggtttattaatcaatgcattataggacttaaaattttttgatgcttaattttatgtattttgatatgattaaatgtatgtaaaaacaattttaaagacaaattttaacatcatccataattttaaaatgcctattgtgatcaactttctttgaatccttgacttaatctgtatatcaacatgtattaatcatttatgattttaatatagtttttgtattatatttaatattgcaaacttttgtgttactttatgactgcacattttgttggatcagtgtaccaatgtttacattaatcctttattaggatttttttctattttagaggtgttgttattcagtaaatagctttgtacacttggatttttttccctctttaaaaattatttcctggctgggttcagtggctcacacttgtaatcccaacattttgagaggccaaggtgggcaaaatgcttgagcctaggagtttgagaccagtctgggcaacatggcaaaacctcatctccacaaaaaatacaaaagttagccaggcatgttggtgtacatctgtagtctcagctacttgggaggctaaggtggatgtgagtatcacttgagaccagggagaccaaggctgcagtgagctgtgatcacaccattgcactatacagcctgggcaacagagtgagaccctatctcaaaaaaaaaattatttcttcaaaaattaaaaattaaaaatgttttttaaaaatttccttatgggctgggtgcagtggctcatgcctgtaatcctagcactttgggaggctgaggcaggcagattgcttgagtccaggagttcaagaccagcctggacaacatggagagaccctgtctctacataaaatacaaaaaattagccgggcacactcctgtagttccagctacttgggaggcggaggtgggaggatcacccaagcctggcaaggtcaaggctgcattgagctgtgatcttactactgtattccaacctcagtgacagagtgagaccctgtcttaaaaaaataaacataaaaaaaattccctatggtggaaggatcataaagatcataatttcctctcggatattttgattaataaatttattttaatgtgagttgcatgttttctgtttgtttaaattcttaggcattttctttatgatggagaatgtttcaagaataggattcctgtattaaaaagtaaacatttgtggggattttgtttttgtttgcttcattttacttttggtaaatgttttctgttgaaaataagctaaatgtttactgatatgagactggaaaagtaatgttataaacatcttttggagttctgtacttcgaatataatgaagcagatctattaatgcaagaaattgtttgtataaataaattgttaaaatttacaaaccacagtaaaaaaaaaagccatttccaatttttcataaaacatatatgtgtatttgcaaagaaatatctagatttgttcattaaatgttaacaccagttaattcaaggtgagattaattatttttaagtaagtgttgctttcaaaatagaaataaaacaatgaaagcaactttcgttttagttaaaaaataataataataagttggccaggcacggtggctcacacctgtaatcccagcactttgggaggcccaggtgggcagatcacttgaggtcaggaattcgggaccagcctggccaacatggtgaaatcctgtctctactaataatacaaaaattaggcgggtgtgatggcttgtgcctgtaatcccagctacttggaggctgaagcatgagaatcacttgaacccgggacacggaggttgcagtgagccgaaatcatgccactccagccactccagtccactccagcctgggagacagagtgagactctgtctcaaaaaaaaaaaaaaaaaaaaaacgaaaaaaaaattcattcaggaccacatccaaaatggagattggaacacagaaaattcagtcctacctgttagctattctgtactaacccttgaacacaaaagtattagctgaagtagacttttgtgaattggaaaagtgtaaagaaaactgtggtgagatttttgtattttttaagagaaatgatttcaaagttctttggcatgttcatttgtaacagtattctcaactattgagggagagcacttgttctcgtgtttgtactttctcactgtgtttgtgtgtgtagaaatgtgtaagttctttttctagaaatacaggattagatctttttacacaccttactttttaaaatatatatatatacaggaatctaagaagaggtttgatactgaggaggaatttaagaagcgagcatatcagtgtgtagttctgctccagggtaaaaacccagatattacaaaagcttggaagcttatctgtgatgtctcccgccaaggtgagtttctgggctttgttccttcgtccagcaaatactatgtatatcatttcctggagtcttcattttgatttgactttgagtgatattttaaccttctaaggacaggcaaatagattttttcttaaatgtatttctgaaacaaccaataaattttgaacctgccataagacaggcaggttcaaatcttaactttcttagaagtcagcaaaaattaattagaaaataaagtggaaaataaaaagaaatcttattcacagtagcaacaaaacctataaaacacttaggaatgaatttattcagaaatgtgtaggaccaaaatgatgagaagtgtacaatgagatgtaatagaatgtttggatagagtgccagacccagttccctagttctccaaatttatttatgattttaaggcgatttcaagttttctaacttgacataatagttttaaagatttctttgaagagtaaatgggtaaagaacaaccagtagatctttgaaaaagacgattaatgatgactggcttgcagcactaggtaataaaatgttttataattacagtaagtaatactgtgtcattgatgtattgctacatagacaggtaagtggtttaaatcaggaaaaaccagaagaaaattcagtaaatattgatcactagataggaagagcttttttttcttctcatttacattttttaagaattaatttttttaaaagttatacaagaaggacatgttccttatataaaaaagtaaatgttgggaggccgaggcgggtggatcacctgagatcaggagttcgagaccagcctggccaacatggtgaaaccccatctctactaaaagtggaaaaattagccgggcgtggtggcacacgcctgtagtcccagctacttgggaggctgaggcaggagaatcgcttgaacccgggaggcggaggttgcagtgagctgagatcacgccactgtactccagcctggctgacagagcgagactccatctcaaaaaataataataaaaagaaagtaaacgtagacaggagaaaaataaaattatctatagtcccacccattgttaatattttgatgtgtaccttaccattttctttccctttttcaaaatgacagcatgtatataatgttctatatcatacattttttatgtaattaatttccttttaatatttgtattaataaatttatttcaatgtaagatgcatgtttcctgtttttaaaaaattcttatgcattttatttggtggcattttattttcttccctagagttaaataaaatctatgatgcattggacgtctctttaatagagagaggggaatccttctatcaagataggatgaatgatattgtaaaggaatttgaagatagaggtaggcactcttcttttaactttttattatggaaattttcaaacataggcaaaagtggatagaatttatagtaatgccagcttcatgtactcatcatccaatttcaacagttatgggtactgaccaaccttattgtatctataccttcttacactgcttccctcatataattccatctataatgactttggtatatgtctctgaaagaacaggaccttctttctgccctaaaaccgcaatatcattataataacaaatatatatatatatatatatatattttttttttttaaaacaatcttgctatgttgcctaggctggtgtggaactcctggcctcaagtgatcctcccacctcggcctcccagagtgctgggattatagacatgaactaccatacccagccaataataatttcttaataccattaaatagagttcaaatttcccaagttgattcatgaatttttttttttttttttttttggaaacagagtcttactctgtcgcctaggctggagtgcagtggcgtgatctcggctgactgcaacctccgcctcctgggttcaagcagttctcctgcctcagcctcctacgtagcaggaattacacacatgcaccaccacacccagctaatttttgtatttttaatggagacagggttccaccgtgttggctgggctggtcttgaactcctgacctcaagtgatccacccacctcagcctcccaaagtgttggattcatgattttttttaacagttttttcaaagtatgcatataacatttgtttgatatgtatcttaagttctataaatctgaggtttctccctctttttaaatttcttttattgttgaagaaactgggctatttgtcctaaataatttcccatatggaactatttagcataattccttgtctgtgtttctctaaagaggcttcattagattctgatttatgttttattcctttttttgttgttttcttttagttgcaagaatgcaggcaatgaggcagtgtctggttgtctctgtttttgtcatattaagattgattagtaaattcaagtatcgtcagctggatctgtccataaatttccccatcagacttttccctattggctttatcagctatttatgaccatgactttgatccaccacttcattggaggttggaaaatggtagtgttctgtcattctttctccatttgttacttgggattctcttatgctgaactttgttactaattattttggttatcctcaggtacaattcatataaaacaggtagggtagtagaagtgcttgatttttttatcaattgcagaataataggtttgttccttagcatctcaaagtgagttgtttgattttgatattattgtggtgggcttttaatgtgttttatatttttcagtcagttgtctttataatttttgtagtgctcaaattgttccattttggctaagtaacttcatattttttgttgtggttttgtttttttcaacccctttggtagttagttagttaattgctttctggtatacaatattccaggcccattttgtacatttcctgcctcagacctgaaatcaaccatatctctatggaagcctgtttccttgaatgggagtagtattttaatcacagtctagggcctagggaccatactttttaagatgataaaattttggctgggtgcagtggctcatgcttgtaatcacagcacttggagaggctgaggcaggaggaccacttgaggccaggagtttgagatcagtctgcgcaacatagcaggaccctttctctgccaaaaaattaacaaaattaacaaaagaagtagttgggcatggtgatgcatgcctgtagttctagctatgcttgagcccaggcatttgaggttacagtgagctatgctcacaccactgcactacagcctgggaaacagaatgaggccctgtctctgaaaaaaaaaaaaaaagaataacgagagagagagagaggtcgagcatggcagctcgtgacagtaatctcagcactttgggaggctgaggtgggaggatcacttgagtccaggagtttgaggccagcctgggcaacaatgtgtgagaccctgtctctacaaattaaaaaattagccaggcgtggctgggcgtggtggctcacacctgtaatcctagcactttgggaggccaaggtgagcgaatcacgaggacaggagatcgagaccatcctgaccaacatggtgaaaccccgtgtctactaaaatacaaaaaattagctggtgtggtggcacacacctgtagtcccagctactcgggaggctgaggcagaggagtcgcttgaacccgggaggtggagattgcagtgagccgagatcatgccactgcactccagcctggcgacaaagcaagattctgtctcaaaaaaaaaaaaagaaaaaaaaatgccaggcccggtggctcaggcttgtaatcccagcactttgggaggccgaggcaggcggatcacgaggtcatgagttgagaccatcctggctaacacggtgaaaccccgtctctactaaaaatacaaaaaattagctgggcgtgttggcaggtgcctgtattcccagctactcgggaggctgaggcaggagaatggcgtgaacccgggaggcagagcttgcagtgagccgagatcgcaccactgcactccagcctggatgacagagcgagactccgtctcaaaaaaaaaaaaattagccaggcgtgatcgtgcatgcctgtggtgacagcttcacgagaggctgaggcaggaggattgcttgagcccaggaggtctaagccacagtgaacatgttcacaccactgcatgacagagaaagacctggatgacagagcaagaccctgtctgaaaaaaataaataaatgcaattttttaaatgtttattttatgagaaaataggcacagagaagttagtatcttcccagggtcacatagctaataagcgatacgtctgagattaaaacctagccagtctggcttcaaagcttatgtttttaactgcttattttatactgcctttacattaccaagcctcaattttctaaactgtaagaaagcatagagttatttactgcatagggttattttgaaggttaaatttaaggacttagcatagtacttggcacatagtagcactcttatatagctgctactgttatcatgttcttcctgtaccttcttgcatccaagaattctgtcttttttatcatgagtgtatgaacatggatttaatttttcttcctacttctcattccaaatgccaaatcctgccctgtttgtttccgggaccttgaaacagtgtcaactacttttcagcacgctgttagagatcactataagaattgcagctttctccaagaggaaggttatggctccagcttgaaagcaaagcagattttcatgttctggtcctaccgagctgatgggttccaactaaagagtttgggaggccaggcatggtggctcacacctgtaatcccagtacttggggaggcccagacaggagaatcacttgagcccaggagtttgagaccggcctgggcaacgtagcaagactgtgtatcaaaaaagaaaaaaaaaaaaaaaaaaagcagttgggaaccaagtttagtgtttaagtgtggaaaactgccagaacatctgacctgtgctctgatagcaccctgagtatccaggcaaccttgatggttaacattttccaaggtttctaatagatcatggtgaggaaaaaattatgtgctttctttagctctctaataaatatatttcaaaatattcttagaataactaaatatttacatagtagaatgagtaagcattcattttccttcagggttcttttaactttattaatgaagtgttttttaccccctaggatttgtgcaggtggatgatggcagaaagattgtatttgtcccagggtgttccataccattaaccatagtaaaatcagatggaggttatacctatgatacatctgacctggctgctattaaacaaagactatttgaggaaaaagcagatatgattatctatgttgtggacaatggacaagtgagtttgtaaatttgtatgtgttttacattgactgattagaggtaagacagtatggtgaggttggtgacatctgacactggatgactgtaaattttccccaaagactaagattcaggacatcagtatagcatagaagaaagaagagggtttggacccagccaaactggacacttcctagttttccagcttgcctccacaaactggaacctctgaacttcagcaattgttcctatcagtagggttattgtgagacctaaaatgtaattgaagtttttgcatgtgaccctgcccttaattcagttgctttaaaaacgtttgaacatagtagaaaatgtaacagtgttgctcttagtgtttctcatatatagggaataaaagaagaggttttataatagcacttgtctcacaagatttatgagcgatttgaattttacagatctattcctaagcaaaagagccttaagtcttttttttttttctttaaagaagactagcaagtaactttccgtttctgttgtagtctgtgcacttccagacaatatttgctgctgctcaaatgattggttggtatgaccctaaagtaactcgagtcttccatgctggatttggtgtggtgctaggggaagacaagtaagtctggaaaatctgaagatggtaatgatatacttgatcccaagaggctacttttcatttgataccatattagaattaagaaagtccacagtttcctttagtccacataagctataatggtgtaaacccagctgagtgattttgtatctatatcatcactgccagggaatgtagccttttaggtagatagtatgtacaaagtttagtgaaaaccagactgtagacctaatagattatatataaggggtttcctctcccacaaatctaaattataaaatctattacagtacctgctcagatttcagacactattcaacaatatagcttatgcatttgataaatgtttttgttttttccttcaaagttgaacataggcaaaaggtataagttattgagattccaattaagttttaagattcactggttttgttatgttctctccaaaaatattgtttattgagaactatgtattttaatattcatactttcagcttttctattttctaatttttttatattctcaatatttataaaataaaaaggtaaatacaaccgtgtttccatacagtattcctcaattcaaaggcacagcatttttcatgttgtaacctcctgtattcactggtgtcttaggatcacttaccaaaaatctgtggcatcttagatttggtaacaaagcctaaatatttccatcctacaaacgtggtcatgcttctaaaaaaccacatgaagtagctcaagatgtttggccagccaatgcgcagaagccctaattgaacatgtaaaaggcagatgagatgtgttaaggtattatcttagatacagattatgtggagctcaaagaccttgttgggaacaacattttctaattgcgtttcttctccgtggatctgcgcttttttgaaatcaaaagacactaggggctaggcaaagtggctctcacgcctgtaattccagcactttaggaagccaatgctggaggattgtgtgagcctaggagtttaagaccaaactgggcaacatggtgaaaccccatatctgccaaaaaaaaaaaaaaaaacttagccaggcatagtggcatgcacctgtaatcccagctaaggattacttgagcatcgacgtggaagttacagtgaggcgagatcatatcactgggctccagcctgggtgacagagtgagactgtgtctcaaaaacaaaaagaataactaagaagacactaagtccttattatagtgtttatggacataaagttttttaaaacaaaccagtaagttgatcattacttaatagtatcttagtttcttaacggttggttttttggacatttagatgatattctgacacttgcttaaaattactagtgctcctattatggcatttaattcacttgtcatataatggctaaaggattcttgataatttttaaaatttttctgcactcagcagcatgtagttatagtatcctatcccacccgccttttttttttttattttttaaattttgggccaggcacagtgtctcacacctgtaatcccagcactttgggaggccgaggcaggtggatcacgaggtgaggatttgagaccagcctggccaacatggtgaaaccccgtctctactaaaagtacaaaaattagttgggcgtggtggtgggcgcctgtagtcccagttactcgggaggctgaggcaggagaatggtgtaaacccgggaggcggagcttgcagtgagctgagattgtgctactgcactccagcgtgggcgacagagcaagactctgtctcaaaaaaaaaaaaaaaaaaaaaaaaattctcacagagggggatgggacttaagaaaaaggtttgttttctttaatgctcacagattctatttttaaatgacattttctgttttaattttttgaatgataatttttttttaatttcatcatcttcctgctattccttgtacatctgtttattgaggatgtgctgtgcatggtgttggttggatgctccacaatgtgtatatgcaggtacacggaacatgagctcctctctgaaagaggctatcatctagagcagagcagtttcctgtggagcttgtgaaaatacacatgcaagccccactgtgggagttactgacttattaggtctaaagggggtattaggcatctgttttttttttaaagctctcggtattcagatacgcatccctcattgtagagccactagtcagaatagaccaacacaaaaacaaaaattcatggcaggcgcaggtagggagtaactgaaaggaacagtaattgcaaagtagattaaggaaggtttcctttagcattttgactggtcttcatgatgagtttcattttatcagagatttgaaagttgaacacttaagaagaagtgtatgggctaaagaaagctatggaaatatataatgtatttgtgggataataaaggagttttaattctgtataagcagaattttacagggcaagtagattcttgcttgggcaagctctggaaataaaactttaacagaaagtagcacattcattttggtactctttgtgttagaaaagcatgcttcattgttatgtttgagggattttttaaacaccccccccccccaccaaaaaaaggaaaatgatattatatccttggtgttatgtaaacttttttgtttaatacataaaattcagttttctcaaaatgctttttaacagcgactgcccagggcaatgcttattagtgcttttgccatatccgtagtgattctgattgcagtagatctgaacggggccctagcatcctgaggtttttttctcttttttctttctttctttttttttttttaaaggaactggcccaggtgcagtgtctccagcctgtaattccaacactttgggaggctgaggtgggaggatcacttgagaccaggagtttgataggagcctgggcaacatagtgagagacaccatctctataaaaattaaaaaattaaccaggtatggtggctcgcacctatagaattagctacttgggagggtaaggtagaagtattacttaagcccaggagttcaaggttacagtgagctgtggtcatactacttcactccagcctgggtgacagagcaagaccctgtctctaaaaataaataaatgagtgaatgaagcaagcaagcaactggctgctcaagcatctttcttaaaccttgccaggcgattctggtatgaatcaaggcttggttaccactgaacaagaggaattagtatacagagaaattcaagtgagattttgtcaaagaatttactgactttctcaacaattctagaaacatatattttgattagtaatttttctaaaaaggtgaaacatctaagccaaacttagtattccaagaaagcaaacaaattaacaaatatcttctttctctgttaggaaacttattaaaggtaaatatgtagagagtgcttttgagggctagagcataggatgctttgagttgagggctagagatgaaagacacttgaaagcacagtgtttcatgtagtactctccttgcttgatgactggcataaggcattgttaccattggcatcaaccctctcttaatagttctcaggggcaatatgtaccttagagatttaaaacatatgttgcagttttgtggtcaggtctctcaaaccttcattttcaaagatttctaagttgaaaagtctgtttcaaaatctgattgggggttttacattttttaggaaaaagtttaaaacacgttcgggtgaaacagtgcgcctcatggatcttctgggagaaggactaaaacgatccatggacaagttgaaggaaaaagaaagagacaaggtaattcaaagccttataggcataatgtgtatcaagcattgtgatttttcatttttgtttttattgagagaactgaggagaagtgtgaggagtcagtcccacctaggacaaggcttatattgctctgactttattgcacagtaagtttattttgtgaattgctgagcatttatttagaaaatatagttcttggcaattaaaaaagaccttggctttttcctcctttgttaatgtagcttagtatccgtgctgcttaacagcagttcccaaagatgggagaatattgcagactgaaggggtttgattcgtcagctcacatcagagtctacatgtgccatgctccttcttgggagcatttgtagagtggtcatagcagtcagttcttgccacccaaggccattgatgaaccttcagagcaggcaacatgatggcctttcatggcacccttagaaaagactatggttcagtttgtgtggaatttggaggaattgaaaagtcaacaagaaaaattttttttttttttttttaagtttagagcagtagaggagaggtcatgcatacctgagactgggtaatttataaaagaggtttaattggctcatggttcttctggctgtaggagcatggcaccaacatcagttggcttctgggaaggcctcagggaacttttattcatgggggaagatgaagggggagcaggcacttcacatggctaaagcaggagcaagagagagagagtagggggagaaggtgccacactcttaaatgaccagatctcacaacaactcactatcaccaagacagcaccaagccataaggaatctgcccccatgatccagctgaatcactggtctaggcacatctggcacagtcagatgaaaagtggtaagttcagtcatctagctgtttgttagtctgcctgatgacaaaaattgctttaactctttttaaccactccagctagtaattttttaagttacttttaattgtgcatagtaaaatgcacagcctaatgaatttttacatatatatgccttagaacaccaatcaagatatatttccatcaccccagagattttcctatcaccataaatcacttttgcttattctggcatttcaaataaatgaaatcacatagtatgtgcccttttccatgtgcatcagtagttcatatgtttttggttttgttttgtttttgagacagagtctcactctgtcgctcaggctggagtgcagtggcaagatcatggctcaccgcatctcgacctcctgggctcaagtgatcattctacctcagcctcccgggtagctgggactataggcacccactgccatacctggctaattattgtattttttgtagagatggagttttgccatgttggaactcctgggctcaagcgatccactcaccttgccgtcccaaagtgctaggattacaggcataagccaccacacccagctgtagttcatttgtttttattgctgcatgatattctgatatatgaaggtgccacattttgtttatccattctcctattgatggacattaggattatttccagttgttggctgttctgaatacaaagctattttgaacattgttgttcaagcccttttagaggtacatgtgctttttctttcggatatatatctaggaatggcattgctgggttgtagggctgacttacgcttaactttattaaaaattgccaaggagaaagtggtgaccgttgtatactcccactactaacatatgagagtttcattgcaccatatgtttacccacattggtgtattagtcagggttctctagagggacagaactaataggatagatacatataaagggatgtttattaagtattaacttacacgataacaaggtcccacaataggctgtctgcaagctgaagagcaaggagagccagtctgagtcccaaaactgaagaacttggagtcagatattcgagggcaggaagcatccagcacgggagaaagatgtaggccgagaagctaggccagtctcttctcttcacgtttttctccctgctttatattcactggcagctgattagatgctgcccacccaattaagggtgggtctgcctttcccagacaactgactgaaatgttaatctcctttggcaacactctcacagacacacccaggatcaatacttcgtatccttcagtccagtcaagttgacatactaaccttgacaattggtttagtcagtgttttttattttagcttttctggtgagtgcatagtgacttattgtggttaaaattttcattcctctgatgaataatgatattgatgatattgactacctttatttttctttcttttctttctttcctttttttttttgagacagagtctcgctctgttgcccaggctggagtgcagtggcacgatctcggctcactgcaagctccgcctcccatgttcacgccattctcctgcctcagcctcctgagtagctgggactacaggcacccaccatcacgccctgctaattttttgtattttttttttttttttttagtagagacgggatttcaccatgttagccaggatggtctcaatctcgtgacctcgtgatctgccctgccaccgtgcccggcctctttctttctttcttaagacagaatctcactctgtcacccaggctggagtacagtggcacaatcttggctcactgcaacctccgtctcccgggttcaagcagttctcctgcctcagcctcccgagtagctgggactacaggcacatgccaacacaccaagctaatttttgtattgtttttagagatgaggtttcaccatgttggccaggcgggtctcaaatccctggactcagcaatctgcctgcctcaggctctcaaagtgctgggattacaggcatgagccactgtgcctggcctgactgccttttcttaggcttattggtcatctagataatcttctcttgtgaagagtctgttaactcttttgcccatttatcattattattattattattttgcattagacaatcagtacttacatttatctatatattttcgccctttcctgcagttttttgattccacctgggattatttttccacaatctgaaggtctttatttttttagcacaggtctgctggggtgacagattctttcagaatttttgtttgtccaaaaatgtctttgttatgccttcagttttgcacaatgtttttattgggtatagaattctagtttggcagctgttttctttcagcatttttagagatgacattccacagaactggagaggaccagtggggctgagggaggaaataaataaaaattatactccattgtcttccagctaccatagtttcctttgaaaatcagttgtaagtttcattgtttctcctttgaaagtatgtatctttttctcagactttttttagtatttttcttaggctttatttttagtactttgactaagaaatgcctaagtgtggtttggggagtcatttttgtttttaccctttgggggctgccaaacttcctaaatctgtgggttgagttctttcatcaggttaggagaattcttggccctatctcttcaaatgctactacttttccgcattctgttatttttggtactccaagtacatatgttagaactttgtatctcacgtgtttcttatgctctaattcatttttttctttttgctttattttgaatattttctacttcagagaatattttggtattctgtgtttaaggtatttcttgaaatttttcatcttttcttccagttttcttactgttttccttttaattttttgaacatgttaatcatagttttctttaaacattttaaaacggttttagacataaaaaagttgcaagatagtacaaagaattttgtatctttcatttagtatccccagatactaatatctttcatagctatatagtatgattatcaaaatcaggaaattaacattgatacaataccattaactaatctgcagtccttattctggttgtacagttggtctcactaatgacctttttctagtctaagatccagtccaggataacatgttacatttagttatcatgtctccttctctttaatctgggcagttagttccttggtctgtctttgactttcatgacctcaacacttctgaagtctgctggtcagttagtttttttggaatatcacttagttggatttgtctgatattggctcctgttctgttaattctgtttccaggttatacagtcttataagtcttataagctgtactctgtttccaggttatacagtcttacaagaatagatgtagagttcttatcagttcatatcaggaggcacatgatattgataagcttcataattaataataataattttgatctctttggtaaggtgatagtatcagttttctcccctgtaaagttagtattttccccctttgtcattaataagtattttttaagtagcttcatcttaaacaatttcagattttaaagttgctattatcttttttcttttgtttctgttgtcttgattctctcctagccctttctttgtagtccccctccttagtatttagttatttcatcttgctcttttatctttttccccccacaagagataggggtctatgttgtccaggctggtttgaaactcctggcctcaagtgatccttccacctcagactcccaagtagctgcgttacaggcatgagccaattacaggcatgagcattacaggcatggctcatcttgcttttttagaaagatttatttgttgttgggtgctcggcattatgaagagaaaattataaagattatggctgaggttatttccctccagagaccgttatgttttcttctagcccacaggtagcataccagctgattatcttgaccctgtttgtattggccttatgcttctttagggctgaactatttaaattttacctgtatgactagggtgaggtccttactcctgaaatatggccctctggccatacttcaatggcgtgtgtgctaatgcccttccattttgccgctgcagaactgccttgtgtcacacagctgctgaaatcactgctcagctctttaattaccatttgctctttcctgatagattttttggagtcttgccttgtgcatgccagccatatgacatttgaaagaaatgtgttcacagagtctttgactcctctgtggctccttctttttggggattgtgtccttgcttctttggcagccccgtactctaaactcttgtcttctcacctcagcaagaccacttctttctgcttgggttctgtcccctttgtccactatgtagtgatttgaaaaatgcccttggggaaaaagccaagtgatgatggactccttcccaatgttttcattcttctaagaactatagtcccttcaactttgcttgtgttgatgctctctagtgacttcaaccagttgtttcatatgtttaacccagcttttaaatagttgcttttggtagaatggttagtctgctgcaaggtattctgtcatggccagaagcaaaaatccttaattacttacttgtggcctaataatgctttagaatacttgagcaaatattagcaaaacagtgaatgggttcttttatctactcttaatacacccttgatttcaattaattatttaacgctaactttttgtttgtattttttggtgttactctgtttcctataacctcacaatgttcatagtatgaagtggatataaactaataattgatgcttctggtttcatatctactgaatacactggaaaaaggtattcatgctgacattttacattttacaaattcagtttctcatagacacattcttcattgtgcataacgcattttatattttcattattttgtttgtacattggcccatgtccttctgcctcagtgtcagtgtttattaaagtttattggtaaaagaataccattagatgttccctaccccagtcttatgcctatgagacaccagggcagaagcagcagtcagtaagctatgaaatactgttttgtttttcccaaaggtcttaactgcagaggaattgaatgctgctcagacatccgttgcatatggctgcatcaaatatgctgacctttcccataaccggttgaatgactacatcttctcctttgacaaaatgctagatgacagaggaaatacagctgcttacttgttgtatgccttcactagaatcaggtaattgtgggtaggcattgttttattgtgaatcaaatgaaagcatatttagttactcaaaaatattttctttttttttttttgaaatgagacggggtcttgggctcaaatgatcctcccacctcagcctcctgagtagctgggattactgacataccaccattacacctgacttctaaagtgtttttttttgtttgtttgtttatttttgagacggagtctcactctgttgcccacgctggagtgcagtggcgcgatctcggctcactgcaacctccacctcccgggttcaggtgattctcctgcctcagcctccccagtaggagggattacaggcactcaccaccatgcccagctaaattttgtatttttagtggagacggggtttcaccatgttggccaggcaggtctggaactctggacctcaagtgattcacccgcctcggcctcccaaagtgctcggattacaggcatgagccatcacgctcagcctaaagtgttcttttcagacttatttttctgcctacaagcatctttggaaatacgtcctcttttagtattgcaagttatcccagaatccctaaacctggccttaactgcacttgccgatactcttctagatgctctatgtttaaatacctagaaagtgtcacctgatcccctaaaagaattatatttccatttttagtattatgaaatgctttagatctggctattagttttgcctaatagtatatcgtataataaaatacttcattttataggaacttctttttaatcggtgataatttcgagtggagaatgagtgtgcctaaaaaaagggaacagtggtgattgcctgatgatttttttgttttttttaaggtctattgcacgtctggccaatattgatgaagaaatgctccaaaaagctgctcgagaaaccaagattcttttggatcatgagaaggaatggaaactaggccggtgcattttacggttccctgagattctgcaaaagattttagatgacttatttctccacactctctgtgattatatatatgagctggcaactgctttcacagagttctatgatagctgctactgtgtggagaaagatagacagactggtgagtgtcttttttttttttttttttttttttagtgagagacacggatcttgctctgtcccttgggctggagtacggtggtgaaatcataggtcactgaagcctcaaacttctggcctcaagtgattctcccacttgagcctcccgaatggctggacttacacacgtgtgagccactgcacccagctccaagtgtctcatttagtagccatattagggatggggtgccattaaagcatttgaattgtgtgggagtggttttcagatttattttattcatggaaacttccactttttccctaacagttgcacagtgaaccatatcatatataaaagacaaaatgtgaagtagcactttaaaccagaaatggaactctgcccaatcagtctacttttctacaattaggcacatgagatggaaccttaggactccaaagaaaacaattggaagatgactgagagtaggatttttccaacaaacacaatgtgtttgtgggtcccaggaggaatctttgggtgtttttgataatggaaacttcttggaaaacacttgttatcttttcttaccttaggctgtcttccctctgtcatattacatagttaatgaagtagccagaattaatgtattataaggcaagtaggcatttgttaaagtcatgcctgaggactgaaactttattagggaaaaaaatcaccactgtgataatgaggtttatagttatttcagaccgtgaggactaggaaaattttttaaaagaaaggtaaaatttactgttctcatcattgcagaccttatatctcttaatagttaaaaacacatttcttaacagaaatgcctttattttttaaattgtttgtcttcatagtttaaggtaaagaagattctagttaaaacccaaaaacatctgtgggttggactatgcacttctaactaaaatttgcaagtaacatagattctttaataatgattttcaaaaaggaaaacaagttaattaacaacttttttctatcttttcaggaaaaatattgaaggtgaacatgtggcgtatgctgctatgtgaagcagtagctgctgtcatggccaaggggtttgatatcctgggaataaaacctgtccaaaggatgtaatccttcataggtttgaacactgtgtgtttttaccaaagtggccattggcactgtttgcttttttacaatcatgtggacacaagcataagtaaagaaaatttgtcaaccaggcaaaatgtggttctttaacagctagaattctaaaaagaaaaaaatcacttccacaaatatgcttatatcttgctgagcattaaaccaaaatgacttagtggaggccatgaaataacaggatttatgcaccacagtgagagtgtattgactttgcaggaatgtggtttattaattttaattagataaggaatcccatttgttgaccctgaaagggccccaagaatttacgcctcttcattgtcccattcatgtctcatttcattgttctgtgagagatacttagcctgttttacaagtaacaaaacttgagactgcacagagataagtaatttgccctggaatcctcaggaacaaaattaagattcacacccgtgcatgtttaaaatcccaaattcaggctatttccattttaagagaaggtgacattggcaatataacagacttgggttcgggggaagggggcaaggaaatgtagactggcaattttcctgaagctcaagattaactcttaacatctcattggccagatgccaatcccagttgcaaaggaaggtagaaacctagagtgaatgtccaagctaagaagaggattgctgtgatttccctagaccagtcacaattcatcccccgggcagggcatattgtctcatttcatgaaattggaatctttgtagcagcacagaatatggagattggcagtggcagcgagaggttttggggtacagctccgcacactgattattgagtcagcagttaatggaatctgccaacacaaaactgaaatgagattccatgtaaagccaacacaatagaaaaatgaatgtttaatgagcatgaattgtatcataccatgctgtttctaaaagtctccaagcttagaggaaccttagagaggatcttaatgagctataataatagcttccattcacaaactggtatgtataagtctaacatgtccacattagatcgctgctccctccaacaaacatggggaggctaagcagtttcctctcactctactaactgcaaagacagttcacctagactactgagcccttgggtccgaagactcaggagactttaggaattaaaaacaagattcagccgggcatggtggctcacgcctgtaatgccagcactttgggaggccggggtgggcagatcacctgaggttgggagttcgagaccagcctgaccaacatggggaaaccctgtctctactaaaaatacaaaaaatagccagacgtagtggcgggcgcctgtaatcccagccactgaggagactgaggcaagagaattgcttgaacccaggagtcagaggttgcgatgagctgagatcgcaccattgcactccagcctgggagacaaagcaagactccgtctcaaaaaaaagaaaaaagaaaaaacaggattcagtgaggtggaggagaaaataatgaaagactacaggagtatgttaaattaaccaaaggtcatgataagttcgtatactggaacatcatctcggataccccaggccataactatatctttaaaacactgtcttaccatagtttatagatatataaataccatttaataatacagataatatcagaaacctttccttaggaatagtatagttctgattctcctgtttttgtttatagagacgaggtcctcttctgttttccaggctggagtgcaatggtgccattgtagttcactgtgactttttttttttttttttttttgagacagagtctcactctgtcacccaggctggagtgcagtggtgcgatctcggctcactgcaacctccatctcccgggttcaaacaattctcatgcctcagcctctcaggtagctgggactgcaggcatgcaccaccataccctgctaattttttgtatttgtagtagagacagggtttcaccattttggccaggctggtctcgaactcctgacctccgggtgatctgcctggctcagcctcccaaagtgctgggattacaggtgtgag

SEQ ID NO: 16219 - DNA, 68035 bp, Human
atggattcagtttacatgtagtccagtgctgtgtgttaatgtatctcccagatttcctttaagggctgaagtctgttgggactggacaaaatgagcctcttgaaaacaggagaaatatttaacagagcatgtggtacttctgggacttgataatgagcacattgggtattcatgctcctcctgccttcatcagacttaaaaaagaaatctctcctcagggttaatcagtttaccaccttttctcggagcaccttgcacatgcccctaaaacgtttgtattatcttgtctctctgttgggacttaaccttttgacaacacttctgcatgtcttttaggcatcttttaagggtgacagtaaaaattcaaattgttataaatgtcaacaaacaaaaaccaaatcctgcagtatactaagaataaaaatattcataagaaaatatctgctggccaggcatggtggctcatgcctgtaatcctagcactttgggaggcataggcgggcagatcacctgaggtcagaggttcaagaccagcctggccaacatggtgaaaccccatctctactaaaaatacaaaaatagccaggcatggtggcaggtgcctgtaatcccagctactcaggaggctgaggcaggagaatcacttgaacccgggaggcggaggtggttgtgagccgagatcgtgccactgcacttcagcctgggtgacagagcaagactttgtctcaaaaaaaagaggccgggcacggtggcttacgcctgtaatcccagcactttgggaggcagaggccggcggatcacgaggtcaggagatggagaccatcctggctcacatggtgaaacgccgtctctactaaaaatacaaaaaaaagaaaaataataatcgggcgtggtggcgggcacctgtagtcccagctactcgggagtctgaggcaggagaatggtgtgaacccgggaggcggagcttgcagtgagccgagattgcgccactgcactccagcctgggcaacagagcgagactccgtctcaaaaaaaataataaataaataaaaagaaagaaagaaattatctgctaatgtgtgtggggtaaagtgtcatggtttaaggtgttgttaagtaaaaaattctcatagatcatatcagagctgatttgacgtggataatatataaggcttcatatggtaaccatttgatacacatgtatatagttactagaagaaaattatcttaatagaagtcatattaattttgttaagaataaatgtagtcatagcccaaaatgtagctgtttgtgttaaaaggctttgactttacaaggggtttcatttagcctctttttatgaattatatattttgctagccactgagccagctgccacttaatgtgagccatcatttggtcatcctggtggttttatagtatagttagttaagtaagtgttgccttaaggagaatgacagatttactattatagtttattatcaatgataatcttttctgcatcatttttaattgacttcttctagggctttggcagaatatgtgaatcaggctatgactgaactcttaagtgtccagtatgtaatagcaaagacagagtttaaaagccacactataggacaactcatgaagggaaatgttttgttagattgtcttatataatggtaacaagtaaagtaagcatggccatgttagttggatttggtgttttatgtaagtgaatgttaggattggtgctcaggaatgcataaagatatttttctattgaattttaaatataagagttacaatttaaacatgtgtaggagggtgttttatagacaaatttcacttgtaaagctggagaatggagaacttcagaaaaagtttacttaatattgtatactttcatcagttggacatttgaatttaatttctcattttcttgatattgaaataaaatatcatttagaaatacattatgttataaaattgacattttttttttcctccccaatacagaagctccaccatgaggcgaggtggatggaggaagcgagctgaaaatgatggctgggaaacatgggtgtgttttaaaagagtaaaaataattatatcgaactgtctagttatttttcattcttctgttataatgtggtttaagttgttttctaaattgtaaattactttagacaccacatctttgagttttcacagtgtattgaaagccttatgatgtttataaactttatcccctaaactttactctcaggaattttaccctgaggaaataaatatgcctagtgcacaataatttactatatgatgattttattgcagcattgctaataatacagaaaaacaggaaaacacataaatatccaataataagggattggtcaaataagttatctgtgtatagtggagcactgtacagtcattattcagctttatatatctcaacctggaaggataaccttgactaaaacaatgtgttacaaagaaatattttgtatgattatatgtttgtaaaacctctgtgctctgagttatggaaataagctttgaaaacaacaccccaaagttttaatgaataggattataccagttttaattttcttccccatatttcctgtattttctgaaaagaaacttcatagtgagcatataatattttaataatcagcaaaaataatgcagtcatttccattttgggaaaaaaacatcatgtacttctagccacctacacctttaatttaaagacctaataattgaaatcaagcttaattatatcaaagttcaggaaaagtatagttgaatccctagatctgtcaagatgtttagcaaaaaaaattattttttaatatttattgtgaggtgaatgttatctaatgaaagttaatattactatcaaatagattgattagatccagaatttagccactggagcattcattgtattctttcccatgtgtagggaggactacactggtttatccagttgcctcatttttacctgaaataattcattttaagccctctgtatgtgggagatagtggaagccagtctaaaatatgctctgaggttgggcgtggtggctcacacctgtaatcccagcactttgggaggctcaggcaggtggatcacctgaggtcaggagttggaaaccatcctggccaacatggtgaaatcccgtctctattaaaaatacaaaaattagctgggcatagtggtgagcacctataatcccagctacttgggaactgaggcaggagaattgcttgaacctgggaggcggagtttgcagtgagctgagatcgtgccactgcactccagcctgggcgacaacagcaagaccctgtcaaaaaaataaaataaaatatgctctgagaccacttgtcaaatttgtaattggtttaaactttggtgtagcttgctcaattgtgtacataagaacaatattttgtgatattattactatgttttgatatgcagttttgctcttgttgtccaggctggggtgcaatagcacgatctcagctcgtttgcaacctccaccttctgggttcaagcgattctcctgcctcagcctcctgagtaactgggattacaggcatgcaccaccacacccagctgattttgtatttttagtagagacgaggtttcaccatgttggtcaggctgatctcgaactcctgacctcaggtgatctgcccacctcagcctcccaaaatgctgggatcacaggtgtgagccactgtgcccagccagtattattattattgacttagctttttttaaaagtaacttttataatcataagaatgtaataaaattaaaacttgagttgatagagggaaaattcttctttgacctatgtgttttatgtatttatatttatttattataatttttttttgagatggagtcttgctctgtcacccaggctggagtgcagtggcgccatctcacctcactgcaacctccacctcctgggttcaggcaattctcctgcctcagcctcccgagtagctgggattacaggcacttggcactgcacccggctaatttttgtatttttagtagagacggggtttcaccatgttggccaagctggtctcaaactcctgatctcaggtgatccgcctgcctcagcttcccaaagtgctgggattacaggtgtgagccactgcgcccggcccaactttcctgttttatttattgccttgccttatggtttatgtttatgaggtcatcattatgttctggtcactagcacagaataaggtccatttatttatttagtttttaaaatttttttttttcaaaaaaggggggagaaaatgtaacctttgtgattggtttaccttttctttaattctagggtgggtatatggctgccaaggtccagaaattggaggaacagtttcgatcagatgctgctatgcagaaggatgggacttcatctacaatttttagtggagttgccatctatgttaatggatacacaggttgagtactttttacttaaccctattttggcatgtatttttattaggattgagaatgatttgttttaaaattctatttttactcatttattatagacaaatgattgtaagatgagaagaaataaatcatctgcttagatacttctttttcctttccatgttgcttttacctgccattgtctttaacttttatcaaagtacatagtttcaaaaagtcacgtgaggtttaaaatgaaaaacgggaaattaccacacatgggtagtaggacttgtaaactgtgagcttcactgtaggtccatttcattggtaaatctctagatgtcattgtccataggtcctttagggtggggtggtgtgtgggtgtgtgtcagtgtcagatttcctagagaagaatcttttactctcttgtctgtagaagagtgtaaactgccagcatttgggtcgccaagcagggaaggaaaggacctgaattctcacagtttaggaagtaaaatttcacttagtctctctattcattttctcattcctacctcctccccaccagctgtgcctattgtcattgagtccggtatctggaaggggtagtgtagtctttattcttggtgaaaggaaagaaatgtgcaaatgcttctttgcctgttgcacagtttcaaggatgaatttatccacacatccacttttgaaggtgcctgtgtgtttatttcatgactttctctttgttttactggtaacaagcagcttctttccaagcttccatatggccagcttcagttttatctttcgctgaactgtaaagtcagttagcacttgcctgttagttaccaggttttctgcctaaatttttctctattttcttggggattcttcttcttatcatttcattgtattttttgaagtgaatggctgtaaatatttgtgtcagtctgttacatattcccctgtccccttctcagctggctgatacctgctatctttcaggtctccatgcctcgctttcccttgatagtttgactgtcttcatactgatttaggtgacttcttgtgctcttctggagctatggctccctgaatgaatctgcatcttagaattcttcagacctttccatagttgtctgtttactggacaagagctggagctacattttcatcactatatccttagtgcctctacagtgactggacacaatcattcaggacatatttgttgaattggagttaagtattaattaactggtacatttatctggtttagtaagagaagagtgtgttgcttgtaattaagtgttttattaggcatcattgatgatgaatttagtccaagaatgtcatctcaaaataaatgctggtgcagcattgggaagttcacatgcagaaagcttgtaacttttctgtgtaggaaggtatcctgacaaattcaagctctgtggacttcctgagatgctctatgaaaaattaaaacgttaatgaaaacaggcattgcttcttacattagccagtcatggaagtctccagttcaagagagcacccttattcacataggaggaagaaaaagagattctttgtgtgagggaagaaaaatgaatattgcagtaatcactttttgattgagaatctggaattctaaatctgcttttatcactaatttttgtgtgactgtaaaacattttctgtttagatctgttattatctctatccttttctgcaggatagagatgataatatttttgctcttgttattaagatttcattataactgtacaaataaagttccattatgctgaatttcaccgagatatccaaactgtggtgctgtaaaataactttatttttagaaaaattaagttttagtgaatactttaccactttatagataaaacagcattaacaattagcaagtaaaaataactctttagatgtaataagacaagtaggaggtgctattttgtttttgatttaaaaaaataagctttatttcacagtcttgaggagtactggtcagctattttgtaaaatgcctatatatatattttggtatcatctttcttctccattagcatgtaagcaccaaaggtgcagactttgtcagttttgctcattgctattgtgaaagaaagttttcaggccaggcacggtggctcacgcctgcaatcccagcactttgggaggccgaggcgggcagatcacaaggtcaagagatcgagaccatcctggccaacatggtgaaaccctgtctctactaaaaatacaaaaattagctgggcgtggtgacgtgcgcctgtagtcccagctactcgggaggctgaggcaggagaatcacttgaacccgggaggcggaggttgaagtgagccgagattgcgccactgcactccagcctggcgatagagtgaaaaaaagaaaatagaaagttctctgaaaaggaatttggaggaaagagacttcattccagtgaacagtttgcaaacctgggagatgcagttttcactgtaaaagaagctgtggtgtcccttcttgttgattcttaaccatgctccccacaaactgtaataatccaagtgttcttgattcctttaaagctcccagttcagccatttgagcctctcatgatttcgtagtccctataccttccaacccagttaacattgaacttgaacttggagggaagaccctctaatagttcacctgtcaacctattcttcccttcacctggccccaaaaatgttttttgcttgttaagattgacttctttgccttctatcctttttgtttgttttgtttgtttctttgttttgagatagggtctccctctgtcacccaggctgtagtgcagtggcactatcacggctcactgcagcttcaacatcccaggttcaagccatcctctctcctcaggctcccaagtagctaggacctcaagtgtgtaccaccatgtccagctgattttttaattttttgtagagacaaggtcttgctgtgtttcccaggctgatctgaaactcctaggctcaagcgattcttctgcctcagcctcccaaagtgtggagattacatgtatgggccaccatggctggcctatccattttttaaattaatttttttttagataattgtagattcacatgcagttgtaagacatagcacatagtgatactgtgaaccctttacccagtttccccaaatggtaatatgtaataaacttgcaaacagtgtcacaactgggaaattgatactgatacagttaatatacagaacatttccacactacaaagatctttctttttttttttttgagacagagtctcactctgtcacccaggctggagtgcagtggcgcgatctcggctcactgcaagctctgcctcccgggttcacaccattctcctgcctcagcctcccgagtagctgggactacaggtggccaccaccacgcctggctaattttttgtatttttagtagagacggggtttcaccgtgttagccagtatggtcttgatctcctgacctcgtgatctgcccaccttggcctcccaaagtgctgggattacaggtgtgagccaccgcgcccggcctccacactacaaagatctttcatgttactctttcatagtcacacccacttctgttctccgcctttccttaactcctggcaaccactaatctggtctccatttttataattttgtcatttcaagaatgttatataaataaaacatacagcatataaccttttggggctggcttttttcactgagcataaattatctgtcaggtcatcaaaattgttgcctttttattgttcagttatatttcatagtgtggatgtaccagtttgttaacctttcatctgttagggacatcacagttatttcttggtaggctatgaacatttgtgtatgagtttttgtatgagtataagaagagtacagttgttggttcccgtaatagttacatctttagtttttgtaagaaactgccaaactgttacccaaagtggttgtagtattttatactcccactagccttgtatgagggatcaactttctttgcatccttgccagcattcagtggttttcattttatccattttaatagatggtgttgtatctctttgtgattttaatttgcatttgcctcgtggctaataatgttgaacattctttcatgtgtttatttcttatctttacatcatcattggtgaaacatttgttcatatttttttcctcattttctaattggatttagtattttttactgtttagttttgatatttcattatatattctagagactactgctttgtcataaaagtggtttgcaggtattttctcccagtctgtagtttttcatcctcttgaaatggtcttttgcagaacgtttttaattttgatgagatctgatatgttgatctttccttttatggattgtgcttgcaagtctaagaacttgtcactttggtgctagatcccaaatgttttcttctatatttttagattttatagttttatgttttacattgaagttaatgtttcattttgaggttttacaattttttttttttatttgtggatttccagttgttgcaacacagtcagttaggcatattttggtggatctgtttctgggttctctgttctcttccattgatgtttgtgtctgttccttcaccagtaccacactatatcaaatactgtacctatgtggtaagccttgatatcaggtagagtgattgctttcacttgtttcttctttgtcaagataattctggctattctaggacctacgcctctctctctcttttttttttttttcttgagacagggtctcactttgtcacccaggctggagtacagtggtatgatctcagcttaccgcaccctctgcctccctggctcaagcgattcttgtacctcagctacccgagtagctgggattacaggcacatgccatgatgcccagctcattttttgtgtgtttttagtagagatggggtttcgccatgttggccaggctggtctcgaactcctgacctcaggtgatttgcctgcctcggcctcccagagtgctgggattacaggtgtgagccagtgcacctgacctatataaatgttaaaataagtcatttatccacaaaataccttgctgggattttgataggaattacattaaacctgtagatcagttcggggagaattgacatctttactatgttgagttttctagtttacagaccttatatcccattttatttttctttagttgattgaacagatatattttggatgctgcttgtgggttaggaactatgtttgaaaagagatagcagttgatggagaatgtggattttgtgatgaaaaagtaatctctaagccttagacatcaacagaggagggtgagtgccaacacagaagaggaaacaattgcctttgggagtgggagtgaatacttcataaaggaatcgaaatgtttagcttggtcttagataaataggcattttccaaatgaaaatggagaaagacattctagtcctaattctgacctacattttcaacctcatgttcttaaattttgctcaacaagattaccctgatattctagatttgtctttttacttttacagttctgtgtttctgtttgttcttttgcctctgaggaaaaactccttccctcctcacttctgtgaactggaagtatattcattcattaagatccagatatagttaggttttgcctccttccctgtctaagccagtccatagtagtagtattttatatagagagatatataattcatagcattattgctagaaacatttattttgacacctggattttgtcttgtgttgttaggtcttaattctatattaagttctttggcgttaggaagcctgttttatgtatagtaatcccttgccaaacatggattagagataacacctcagggccttaaatttgcagttccttctgcttcctcaggtcttcatcattcagatctctgctcaaatgttacctttttacggagaccttccctgacttcacctatctaaaacaggtgtactttgccctccagtcgctctctaaccccttatccaccttcctcttcatttatttgcacctaaaatggtattacttgcatgacttatttttgtctcctcagtggaatacaagtgctatcacggggcacagacttgagtcttgttcattgccatatctccagtgcctagaaccttgcctggcacattgtagatactcaataagtattagttgaatgaataaataaataacaggttttgtatttgtacatcagaatgttaaaatattttcactcagatgctaaatcaactcagtcttaaggaatgggccacatttgaggcctgcattgtaatctgggaggtaggctctgggcatgtttatttttgtgaaagctgcccagggggagtgagtgcttcagacttagtggacagtggttgcactttagtggtgtgagattgggacagttcatatggaaagaggtgttcaggttattttctacttcctttagtacatgggtaaaagaccaggtcttttgattttggcactgctgaagtttgtgaaaaagcaggtggaggggggcccggacaagtactttagcacaattcacaaaatgaaacaagggggaatatgcaagtgtaacagacttatatttcaaataaggatttgtttgaaagctgacagcttacattgatgttttctaaacatacaaatgtggtgttttaggagaggattctctttagtgttgacaagtctaattttttggaaataaatgcctcccagatattattttgtatggatatataatatctctccttccatttcctgtgagactctcatcttgtagataagagatggaggaattgaacctctgacatagaagacttaccatattaatttatgccacctcctgtaattttgctagtacctgatgtgaaatttgcacctagttggtactcaaaaatttgttccctaagcatttgaaacttttcttcagtttttgtttggttgagtgtatccgtggcttttagttgattgtggtgactctgttggtaagtctgaggtagttaggggtgagaagagtcaagagagtagtattgctgctgcagaaactgagggacaggagtccaaagacagaagggtatgcacagtaagttttctctgttgcctcatcaataagttatcttttctaattcataagattgtgaaactcaaatgaaataatgaagatgttgccatggtaggagcaaaggaggtataagcagccattcacctcacttctttctgtgatttatatagcacagtcaacaattaattaagttctttggatatgcaggaggaaatggtgcatatagtaaatgttttctcaatagagatctagctaggaaagcttttgtgcaagatttaaaaattttgtttatagaatttgttttaaccagatgagcaaaactttctataagctgggcctacagacgtgaaagtggtcttcatatggctgttttgatgttatatggtggcatttgctcttgtgacattttacttgtagggctttaggtctaaacgtgggctaaattgtggtccttgtatatggcttttacttttactgtgctttcaattgtctgtcactatgtctggttttagttaaacctcaaatttagttgcatatagaatgttctgcaaaataaaactaatagtaggagtattgtggaattttatttatttgtttatttaagataagctctgttgcccaggctagagtgcagtagactgatcatagctcactgcagccccaaactcctgagctcaacggatcttcctgcctcagcctcctgagtagctgggactaaaggtgtgtgcccccacacgtaaattttggggttttttttttttttttttttttttttttttttttttttgagctggagtttcactcttgttgcccaggctggagtgcaatggcgggatcttggctcactgcaacctctgccacctgggttccagtggttctcctgcctcagcctcccaagtagctggagttacaggcgcatgccaccacatccagataattttgtatttttagtagtgacggggtttctccatgttggtcagacttggtcttgaactcctgacctcagaggatccacccgctgtggcctaccaaagtgctgggattacaggtgtgacccaccgtgcccagccttttctgtttgtttttgtttttgtttttttgtggattttttttaaaagacggatcttgctgtgttgcctaggttggtctcaaactcatggcctcaaatgatcctcctgcctcagcctcccaaatctttcaaattacaagcatgaaccaggaggttgaggttacagtgagctatgatagagccattgcagtctagcctgggtgacagagccagaccctgtctctaaataaaaaataaaaaggcaaagaacaatgaggagaaaagcactcactctgacatttcaaaacagtgacattgattgtaaaaatttggaggatagaatttccctgaatctagttttgttttattttgattttttttttttttttttttttttgagacagagccttactctgtcacccaggctggagtgcagtggcgtgatcttggctcactgtaacctccgcctcccaggttcaagggattctcctgcctcagcctcctgagtagctgggactacaggcgcgtgttaccatgcccagctgatttttgtatttttagtagggacggggtttcatcatgttggccaggctggtctcgaactcctgaccttgtgatccgcctgccttggcctcccacagtgttaggattataggtgtgagccgccatacctggcctgttttgattttttattttctgtttattctttgctagtacatcaaggacattcttgaaggagtatatactgaagggtgggcaacaagagaaggatttgtaggagggattatgaattgcaaaatttaatgttttgtgtgaatagagagcagctttagctctagagctccttcttgcttcccggtttggggtaagaaatggtaaaaataatactgataatattgttaagagctgacacataattcttttttttttttttgagacagtcttgctctgttgccaggctggagtgcagtggcacaatctcagctcattgcaacctctacctcctgggttcaagcgattctgctgcctcagcctcctgagtagctgggactacaggcacgtgccaccatgcccagctaatttttgtatttttagtagagacggggtttcaccatgttggccaggatggtctcgatctcttgatctcgtgatccctcccccttggcctcccagagtgctgggattacaggtgtgagccactgcacctggccacataatttttactatatgcaagttacttttctcagtaatttataatttttagctcttaattcccacagaagtcctttgagacactattattatccccagtttacatgtgaggaaactgaggttctgagaagttaaataacttgcctgaaatccaagtaactagcaaatgatggagccaggatttgaccttagtcattcctgctttggagtctgtcctcttaatacattatatggcgtctctaatttgtgagtgagtgaataagtgttttgagattttaagtatttataccacttgtactccacttttgctggagggtggattctaggcaggagtctgggatgcattgaggatgttaatgaatttagcaaatactcactgagcacctgctttatgtcagggatatgaaagtgcttgacagacaaggttcctgccttcaaagagcatatgttccaggggggaatctgacagtaaacaagtaaacaaacagacatggtaatttcagattatcagtgctatggagaaagttaactgttacagtacattgcagagatgggttctgtaggcagtgtgtcacacaatgtttaatgtcatatagctttcatgatgttggatattatctccccctttttttttcttttcctttttttttttttttagacaggctctggctctgtcaaccaggctggagtgcagtggtgcaacctcagcttactacaaactctgcctctctggctcaaggtatccacttcagactccctagtagctgggactgcaggcacacaccaccacacctggttaatttttttccatattttgtagagacagggtctcactttgttgtccaggctggtcttgaattcctgagctcaagcaatctgcccaccttggcttcccaaagtgctggaattacaggtgtgagccactgtgcttggctcccaattttttttctaattaaccccacatctgctgaattaaaggagagtgttaaatacaaaaatgaatttattatgcaaatctgcagttatcgtgtatgttcttttggacttgtaataagggagtatgttctagtattgaagaaatagaaccagagaggaatactgctgtaaaaattaaaaaaaaaaaattcaaaatagggtagcttccagcgaccatgcatgccaacagttagcatgccagcctgttggacctgacaaagtggtccctggctgctgtccatagtgcactattggcaggtctgtttttgttgaaactttgggtcaccatgtgtcagcctatgtatattgtcttctgtcattttttttttcgtagagtctagggcaggatcctgaggtcatatacattactcgaaaggagttctagtgtgatcatagtttataataatagcagttttcatattgagtgacctctacatgccagactaatttcattgtaacagctttgtttatggagaaagaggagaaagcctaaagaagttaaacaacttctccaaagtcacacaactcaggagtgtgaaagctaagattaaactcagatcggtcttattccatagtttatgtgatcttgccttttaactagattggttttcatgcttcacttcacactgaagaatatgtaagagctttcagaagtgaacttcaaagagccctcttaacttcatccagtagaagggcaatgtattttccagttccaaatttctggagtaattagttttcaaagagcagctagtagacgggtgagtactttatgagtatgtatatggaaagttaatgtgttcttgacgtgtctttttattcggtaaaggacagccgttttctatttaagtcattaaatagaattagtttaggaaagttacagattaacttgcaaattaattttttagatttctgtgatttcattggatttggtgcccatattaatgcattgtaatgtagcctttaatttgatacttctcactgttattctataagatcagccaggttctttagtgttagagaaagaaactgaactgtagattcctgactggctagctgtttaatttctactgtttcacattaaatcactctgatgctgtagttcagtttttaacttaaccttaaccctgaaaacttccattattaattttgaattcattttgtttaaaaggatgcttttaaatctctttgtatgacactgcccagtttggtagctgctagtaacatgtgttaagcacttgaaatatggctattctaaattgagatgcgttgtaaatgtaaaatacccactggattccagagatttaagaagaaaaaagaaagtaaatatctcagattttttctgttgattacatgttgaaataatattttggatatattgggttaaataaaattaatttcacctttttactgtttttaataaggttactagaaaatttttatttatgtggcttgcataatattttctactgaatagtgctaatatttgtaatcagtaatgtcaaattttgtgctgtaaaatttagacaaacctggtatgtctgtatgtgctgttagttttttatcttctagaaactaaagctcacctaattattgtcataatgaaaatgtttatttaaatacttggacctatattgcttgggattaagcttgcgataagccacatgtggaaactccccctgggtacagctgttgttaggggaggtgtgagttagagcattcattaggatgataggtgaaagaaagagaacagtgatgattaatgtgatgctagtaatgcaggccataatatgactttagtgaatcagacatttcttcttagggggaagcataagtcacattgtgtctttaagatattttcttaaaatatttccaatatttaagacatataagatattttctgtagttttattaagaataaatcatttgaaacaaaattgaaaaaaattggtgtttcttggtttgcagtcttttttgttttgctggactttattttttggccttaatgaaatttcatattagggaactggataatatttactatttgattaagttttaagatattttcttaaataaaaataaaaattataaagctttctagaagtaaaatctactaataagccctacagtaagtctcctttttagtaaatatgagtaactattatttatctgactcctcttgtatactctggaggagtggaaggattagtctttgtaaaatgattcataaatgggtttatagttgttaatttttaaaaacacaatatcaaggtcatatgctaagtatagtaaaaaatgtaaaaatatttgtactgttattagtatttgattcattacttgaggtccctatttgctctgctaggcacttcttagatgtttttgtgttagttggttgtctggcagccagggaagggggatgtactaaaagcaacatagctttctcactttgtgatttacctcccagctttgtttactggcaacacagccaaggagaaggtgaaccaatgacattcttaaagttgacctatttaaggagttattcattagggttctacttcttacacataagactcttaatatattttaatataaattttgcagatccttccgctgaggaattgagaaaactaatgatgttgcatggaggtcaataccatgtatattattccagatctaaaacaacacatattattgccacaaatcttcccaatgccaaaattaaagaattaaagggggaaaaagtaattcgaccagaatggattgtggaaaggtaagtttaatttattaaatttaattaataaatttttaaagttagaatactttttatttatttatttttttgagatagggtctcgctttgtcgcccaggctagagtgcagtggcatgatcatggctcactgcagcctcaacctcccaggctcaagcagccctcccatctcagcttccagagtagctgggactacaggcaggcgccaccacacctggctgattttttgtagagatgggtttcaccatgttgccgagactggtctcaaactcaaacagtcctccagccttggcctcccaaagtgctgggactacaaccactgcgcatggcctttctatttcttttataaaattgtaactaatatattgcctcctgattgacagggtgaaaaataatgtcttaaacaacactaccgtttaagctcatgttgataatactatagcctaggatttggcatcctaataaaagtagcatgttaatgtgtttgccaggaattaggggtgatgactcaggaaagtgtcaggaagcagttatgggagaaggtggagcaagcgtgttattcaacaaatatgtgtgcacctcttaaagactaggcagtgttctgtgttcttgggaaataacaatgaacaaagcaaagatcccttcactacctcatggagtttatattctgttgggagagaaagaatgagtaatgtatgagtacattataccatgttgtctatcacataggtttttagcatggtaatacatcaagataatgtggacctagaatgctaggagtagggggaaaggagggagtacagtcgcagtattatttactgttttttaatgattatattgtggtttctctgctgttggtttggaaatgataagttgtaaatcagtggtgacattcatattgacttcctaagtttaaatatgtcatctgaaaccttggagatgagctaaaacttaagtggtttatatttttaaatgacatgaggtatgtaatacatatgagcaattactgatttataaaagaagtaaaatattaaagtagtaattttatgtatggatagattataatcagtgtatgagagattgcttatctttttaagtcagttgctgaattttttttctagttcttgcttttactaattataacaccctccattaactgttccacaaattaagtattaactcagttcctttgtatagtgtatttagccgcataaattcacggagaagcagcgtggtggaaaaggctgggcctgggctctggagacatacttggcttcagaacttccaaactcggcagttcagtatccatataacctggtataattttagaaactttatgcttggccgggcatggtggctcatgcctgtaatcccagcactttgggaggccgaggtgggcagagaccagcttggccaacatggtgaaaccctgtctgtactaaaaatacaattagctgggagtggtggcttgtgcctgtaatcccggttacttgggaggctgaggcaggagaatcgcgtgaacccaggagatgggaggctccagtgagctgagatggcgccactgcaccagcctgggcaacagagaaagactccgtctcaggaaaaagaaaaaaaaaaaaaactttatgcagtcactcaggaccttgtttcctcatttgtgaaagaaggctaatatctgcctgctgtggttatgtgagaaataaaaatcatttgtccatacaacctggtgcagtgcctagcatgttgtagaggtgtaatatataagaagctactgttactattttatttttattctgtaacattagcaattattagaaaattccaaaaattcaaaagtacattactatctctagaaagtcaaatatattggctgggcgcggtggctcacgcctgtaatcccagcactttgggaggccaaggcaggcagatcacgaggtcaagagatcgagaacatcctggccaacttggtgaaaccctgtctctgctaaaaatacaaaattagctgggcgtggtggcgcgcgcctgtagtcccagctacccgggaggctgaggcaggagaatcgcttgaacctgggaggcagaggttgcagtagacaaaggttacaatgagctgagatcacgccactgcactccagcctggcgacaaagtgagactctgtctaaaaaaaaaaaaaagtcaaataaataacattttacatattaaggattttttaaacctggagggataaagtcaaaggctcgtccctataacatcccactgattccttcctttgcactgtggtctcatgacctaaccactgtctatcaatgatatagtattgattaaaatggcttttaggtatgtgtctcttcaaaggacttggtcttagtatatgaagttggatcactcagagttgagctgtgttgtcactagagctagagtttttatctgggggcaatagttaggctttggagggaatggggaatttctgtggacaggaggagagttgaggggaaagcgatcttgctggggggaattgatttacttagaaaaatggtgttttccggccgggtgcgatagctcatgcatgtaatccccccactttgggaggccaaggtgggtggatcacgaggtcaggagttcaagaccagcctggccaatatggtgaaagcctgtctctactaaaaatacaaaaattagccaggcatggtgttgggtgcctgtaatcccagctactcaggaggctgaggcaggagaattgcttgaacctgggaggtggaggttgcagtgagccgagatcacgccagtacactccagcctgggtggtagagcgagactgtctcaaaaaaaagaaaaagaaaagaaaatgctattttccattacagttgcttgttttgcacgtgttctttttgccagatgcgcctagggagatcataagatagaaaaagcaacttagatagttaaaattcactttaatggattttatcttagtctggactgaggtttaatcatttgtctttaaataattaagagtgattttggacagcatgattatatatcctatgggcctcattttgtatttgaggagacagggccagtggggctcactgacttgcccaagaacagagtaggttttagagtccaggtgttctgaatcctgtttgtgtcctctttttaccatttaattaagcttgttatagatggcccatgtggaaatggatcagtgttggcatatatcttaaatgccaggagtccattatgtcattgtaacagggaatccttttggttaaatcatggcactgtttttattcacactctaatccctggttgatctcttcttagctgtgttttaatgagattttattatacttaaaaattttaacatgtattagctatttaataaacgttacatactcttctgaataattagtttttgtttttattcgagcagtttgaaaaggaactgccacttgtaagtatgtggggtgttgctttaatttcagttccctgatgtctgtatgtcagtagatctgagttaatgtaggcatggttatagggccctgactttgaagaggcaagggaatcctttcatgaggagcctgtgtacattaaagtgtgaaattattttactaaaacctttgttttgtaaatctcacacttgtacatagtgtattaaaagtaatggtttaaaaaatttttgtcacagtctttgtcttgagacaattttaccttgaaatttgaaatgtggaatagatgagaagctgctatgacgtaccccactggcccaccaaacctgaggagtgtcatggagcataatttaaaaatattgtcctaagttgctacagattgttcttgtttttgttgttcttgattttgtgttgatccttgtagattgagaaccttgtagcgtgggttttttatatttgtatatcccgtgattagatggtcacatagatctgttgggagttgagacagaatgataatttattgttctggttcatgccagctcaatgggatctactagtaggactttcagtttatcttttctttctaaactcccaaaccatatacgtttgtcatgtgcttacatatgagtcaaaactttggtttctaattacattcagtgtttaaatattagagtgcttatgcaactcatttaaataaaagttgattgcaattttatctctcatgagttttttttgccattccttgtgttttttttttttgttcctaaacgcagaggctgtaggacaaagcaagagtaagacttcccaaaatagatgaatatttcacttgctatgactatgttttgattcgttgtatagaatgtaaactctttcatgtatatatcagaatatagtttcaatgtacatgaaaaaactcagtgtataaggaaaccgtgtagtattatcttttggataaagatggatttttttattatcctctccttttggttttgaaagaatagtagaaaatgtcagtacagttcctttgcgcttagaacaagaggggaaatagtaaatgtgagaaattaatcccagagagatttttaaaaaggtcttatacaaatatgctttcagataatgtttctgtctatatatctatagatagataaatgggcaagcaggggtagttaggagtatacaactgatagatagtggtttaggcttcaaattataactgacattacttcactaacattactgtagtgcattgggctttaattctttttattgagtatctctgaggatatctgatttgagacttgcagtatttaaattggctgtctaattttgtagcagtctccatggactgacttatgtaagcctaagaattctgtgggtggccacatggctcttgttaggagctggataaggcctgacacccttgtatatgatcagtgctgaccatagagagtacctgtagagtctgcatcactccagcatgctgtcagtagggcaggaaaagcgagaatgatcatagggcgttttgttccttgcacttttggttttacctgagatgtgcagctggcacagtgggtgtagtttcactctctacttgtctcttagttatagctatctatgataaaggatggaaagctaaggttaggattttatttcaggtattaagtagctgtacttcttttggtgggggaagcaagtgagtttgatatacataataccacagaacaaagatttatagttaggcaattgagaccaactattaaaggaagaaaagggctgggcgcggtggctcacacctgtaatcccagcactttgggaggcagaggcgggtggatcacgaggtcaggagatcgagaccatcctggctaacacggtgaaaccccgtctctactaaaaaaatacaaaaaattagccgggcgtggtggcaggcgcctgtagtcccagctactcgggaagctgaggcaggagaatggcgtgaagccgagatcgcgccactgcactccagcctgggcgacagagcgagactccgtctcaaaaaaaaaaaaggaagaaaagttggtttgaggaagaataaagtaaaaaatagtcgaattttagggtttcgattctaatatttgaatgtaacctgaaattttgaatgtattttgaatgtaacctgaattttggtaaaacatttagcctggtcataaatccatttggttacatgtcttgcgactagtatagtatgttctttaccatcataatttaatagttatagcatttgatataggttaaggtactttaggtagaattgttaaatatatattgacataattatataaaggacatactctgtatcatatatagttccgtttttagaatctgttagtatgttttcctgtattccaagttgttgactcagttatttttaattagtattctgtaagccaattcagtcatttcttaaatgattattttttaaaaagttttgtgtgacaccatttaagaaaatgaaaatgtcaagtcttggatttatgagacaataagaaacatatttttatcatgttatttatcagtctttttctaaataactgagggatgattccttggtatatattttaggtttaaaatccagaggttgttttgaaatattttctaatattaaagtagcttgttttgaaatttggatgatagcataagtatattgattggttatttttaaatttgaagtgaaatgataattttaaaggtagagtagccatatataactcagtttattagcaagaaaatgtcagttttagatactgcaatcaaattagttttagttctgaagtacaaaaggaagcagacatttgggaacttcagttacagtgctagtaccacctagcgttagaacactggtgttcccctggatttgagtggtgttgtgtgatatgctgtgaggatgtacatggtagttttggcccttgtagagttcatatcttcaaatggccttggctcttaaccattcttgtatacataaaaatagtataaattattactcttgaagttgagattctttattttgtcctatatttttattttacagtttctgacatgaatttggaaattgagcatccttattcagtttatttatcttggaaaaccttaatagatgagattttgatgaagtcttgatgattctctgttaactgttgacagggtggtaaatactaaagtcatgaggtttaaaatattgactagttcagctctgtgcttgcagtttttccccactctaagatcatattgtattaggaccactaaaaccgagcaagaaggaataaactaggaaaacagatgacctgttgttggtgaaatactgtatctttaaggacattgaatatttttcatgaagctcattgtcaccaagtatggaactctaaattggtgttgctttttgtttcagcatcaaagctggacgactcctctcctacattccatatcagctgtacaccaagcagtccagtgtgcagaaaggtctcagctttaatcctgtatgcagacctgaggatcctctgccaggtccaagcaatatagccaaacagctcaacaacagggtgtaagtttgtctagttggggattactgcaaagctggttggttttttttttttttttttttttttgagatggagttttgctcttgttgccgaggctggagtgcaatggtatgatctcggctcattgcaacctctgcctcccaggttcaagtgattctcctgcctcagcctcccgagtagctaggcttacaggcgtgtgccaccacgcctggctaatttttgtatttttagtagagacggggtttcaccatcttggccaggctggtctcgaactcctggccttgtgatctaccttccttggcctcccaaagtgctggggttacaggcatgagccaccacgcctggccacaaagctggtttttagcagtgagcatggcccctgctctgttacagtcagacagaagcagatacaaaccctggccattcacttataataaacatgttgaaatatgtgtgtatgagtgtcttatctaaaaatgaattatttttataatgataatttcataaatgtaagtaagtttttacagtcatactggtttctcaccttaaactagtggatcttaattgttaataagttttttcatggatttttatgaaagtaattatttcctcacaagtaatttgctgtattgctttctcaaaaatggaactaactgcaccagctatatttttgttgtgttccatgcatagaaagacaatgaaaatgttaatatttctgggttatttttgaaaaattcaaaattcataacattctaaatatgtaaatatataaatggaagtttagttggtgacccttggttatagaattgaaagtgaatctagactattccatgtggctgctttttttttttaatttaagcttttaattgcaaccctggataaattgtttcacaattaattggtgggttgccttaccttgtatatcaggtggttcattatggttagccttctctttatttattaaattgcttgctttgggagttggatatattttttttcgaaaacaccaggagtctaattaatctgagaggatccagtatcactgccttctgtaatttttgttgtcatttgttaatttaacttgtactcacaagcatattcaaatatttttcatgttacctgtagcttttaattttttttaatgtgctatcaaggtatatagcaaataataccagaaaaccttttcacagaatacgtagctttagctttcttttcttacccacattaataaaagtagaaaatagatatgttttttcaaaatcttctttgtgacactttaggaagaaattaccttttagattttacttcttaatacatttatgccattgcctaaaaaatgtatctctacccgtgatatttccagtacagctactttgcaaatgtccatttgtctaggctgagaaactatagtacagcaagaatgtatgttaacaatgtattttcctgccaatatatggctttctgttgcatgtgttgctataatgcatgtaaagggtctgaatgtttttgacacaaaactagatgtaagactttctgacgtacatcacttttgttgttttctggggtttttttggggggtatattcagtacattttgtacatttctttgaaatgctcatctgtgacttcttgctcccttgcattctgtttatctcaagaggctgaactttctctgcatgtgacaaattaggttttctttttttcttcttttaatcatatctactttgtctttttccccatcactggcatgatcatctgtgagcatggcatctactcacagttgcctgtcacattccatatgatgtttagccagagcctgagctaacccagaaatgggtgatcatccagcttgtgggacttttctgtgtagtcaggctctcattactaataaaccaagttggtattagggtgaggggctttaggtggaacctgataatactgtggtaatttcacctgtggcttactactctgtagggcagcccttcatctggagcctgcgctgtaattgaattaatgctatggacatttggacattcctaagtagaatgaattactgctttgtaattcaggtttttgtttttgttacttagatgattctcgtgaatgcatttctaaacaaacgtctagaggagccaggatgtgactttagcataacatttgtcatgggttctgcatttataaagctgtcatcaggaaacttggtccagattgccttgtaccaccctggcatctaaatatgcatttcttagaaatgaagtgcaatttcccttctcagtaaggcaagcgtccttatttttctaggtgtaaattttactgaattacccccacacattgacatggctttactttttgtctatttgtgcaacagttagctcattaataggttaatcaatatagtcagtttttttcctactgaaaccatctggtttcgtattagatttaatgtgttgaatagtacctttcataaaaactaaaactaggaataagaattcaagtaaggtttttaaatccatttttatgaaagttatttgtagtatattaattcagcagatatttattgaccatgtagtaaatgccaagcactgtgcttcagaactgggtatttacagcttatagattccaattaattttttatgggaaaaataactgaaaagttttttgggtttttcttcagccatgagaaatgttctattttatttcttctttgggactatctgaagtgaaaataaaaaacaaacaaaaaacacctaaagggctgttaatattctagaatttttctagttatcttgctacttttgcaaagaatgatcttttgtcaaatcagaatataaagtttgtggtttaagtttcagggtttttttttttcattgtcaatattcaatataagaattttctgtttttaaagggggaaataccaaactgtgtaccactaagaaaatgatgaaatgaaaaaattgttttaacctaaaagtcagatattattaactcaaaaattttttcctgctttagaaatcacatcgttaagaagattgaaacggaaaatgaagtcaaagtcaatggcatgaacagttggaatgaagaagatgaaaataatgattttagttttgtggatctggagcagacctctccgggaaggaaacagaatggaattccgcatcccagagggagcactgccatttttaatggacacactcctagctctaatggtgccttaaagacacaggattgcttggtgcccatggtcaacagtgttgccagcaggctttctccagccttttcccaggaggaggataaggctgagaagagcagcactgatttcagagactgcactctgcagcagttgcagcaaagcaccagaaacacagatgctttgcggaatccacacagaactaattctttctcattatcacctttgcacagtaacactaaaatcaatggtgctcaccactccactgttcaggggccttcaagcacaaaaagcacttcttcagtatctacgtttagcaaggcagcaccttcagtgccatccaaaccttcagactgcaattttatttcaaacttctattctcattcaagactgcatcacatatcaatgtggaagtgtgaattgactgagtttgtcaataccctacaaagacaaagtaatggtatctttccaggaagggaaaagttaaaaaaaatgaaaacaggcaggtctgcacttgttgtaactgacacaggtagatacttattaaaattgtcttcttaagaaacagtcatgcttgatcattttgctcttatgctattattggtatttctggtcaatatgaagttctcataaaagtctctaagtatgtcaaatcatgtaagttacagtaagcataacatagaaagctaatttattaaaatatttttaaaacaattagatataattgtggctgactgaaaattttcagagaatttaaacagtaagatggttgggattctgagcattcattcctcacgtagaccttatcagttggtgaagttttgaactgtgttaatataacatctatccagtgcttaaactcctgtaagaatgaaattggtttgataagagtaattgttaatttctagaagcttgcatcataatgattttttaattttgacatagagctgttgtaattaacagtggtaaactttcagtgagattatttcacatcttaagtacattggttcattgtattttgttttttaatacttttcttgtcatcaaaaacaaatgcacacacagtagcatactgtttttctgggccagtcattataaattagtatctggtttgaaattttagttccttttacagattataggatttttttatggggagagacctcagagattaatactctataatttatagctgtggaaactgaggtatagagagaagctcatggttctgtcctagaaagtgatagagactctatgtggggtgttttctgttatgttttactgagtttgatgtattcctatgtgcttttagtcaaaaaatgctttttggtatttatgaaatatttcagaataatatagatactagattatccttacatcatgtcttggccttgttacctgaaggttatttaattcttaatgcttctaagaactatgattaattagttctgtgaatgggaataaaatgagaaattttgttattgtatgaaagcatttggtagatactggcttatgcattctgtactacttgaatgtttaaaagcgttattttgagttgtttgcattatgtttatatgatattttgaaaaatacttttatacagcagaattgtgattaagattattttatgaatcatttcttgagataatatagagggtagtaaggaagtatctggctttggagttagatagtttagcatgaatctaaatccttactctgccactcttaggctgcaggactatgggcaagttagttcacctctccgagtcttagttttctttgtgaatagaagtgatagatagtccatgatgtttgcctcatggggttgtgagcttaagaatacatgagcaggctgggcacagtggctcatgcctgtaattcgcacactttcggaggccgaggcgggaggattgcttgagcccaggagtgcaagaccaacctgggcaacacagtgagaccgtgtctctaccaaaaagaaaaaaaaaattagctgggcgtggtggcacgcacctgcggtctcagctacttgggaggctgaggcgggaggattgtttgagccctaggggttgaggttgcagatcgcaccactgcactccagactgggcagcagagtgagaccctatctcaaaaaaaaaaaaaaaacaaaaaaaaagttgggggagaattaggtacatgctatcacagtcacagtttggtaaatggagtggtccaaaactgttaggggatatctgtttttggaagcctattataaagactgaccctcagtactaatatttttaagcctgagaaaaactcctttatgagatcagaactttttacaagcccagggttctttttccaggatttgtgtatcttagaggaccagacgaacaggctaaggatgagactgataatagaggaaagctctgcttgtgcctggattagggttaaaatgaccctgatgaatctctttgtagctcaggatgattagaagcttttgtccttaggtgaggacactcacctttatctccttaaatgtggtatatgtcattcagctctgatctttaatagtatttaatggcataaggataaaaatgtacagatttacattttatagactgtttttaagtacttagaacagcaacatggtagtttaaaggctctgaaatcagactgcttgagacagaatcacagctcaaccatttaataataggctatgtgacttaaacttttagtctacaagatggagatgatacgattacctacctcatagttgtgagaatttaaataaatacatacacataaacctcttaacagcagtgcctgacacctaccaagcactggataatagtagtcacttttattgttgttattttatccaggcgcgtttgtagattgcatggaatagtgatcatcaaaaaaagttttacttagcttcatgtaactaaatgtatgccaacacctttgtatttttataaaataatcagcacagtgaaataattttaagatgcactttttgactaattagagacttaattaaatttggcttctcttgaggtgatagaaataatctgtactcaattctggttttttaaaaagactccattctgggtgtaagcatgttttaaatataatttctaaaattaactagacctgatgttttaaatagtaaaaattagcttggggtttgaatgctgtctttttccttctaggagatatgtcagtattgaattctcccagacatcagagctgtataatgcatgttgatatggattgcttctttgtatcagtgggtatacgaaatagaccagatctcaaaggtctgtattcttgcttatgttttaagaaaactgatatattgttataaatatatattcaaagagattacaaaatctttttttaaaaaattatgattttccttgggaaaatcggttcttccaaattttctatattcgattatcagggaaggtatagggaaattagagtttttctttctccctatagggatcttcagggaagaatattcatcttcagctgaaggatatgtcatcgaagactaatgtaggcaggatctgtattgggcattttctaaatttttatctgtatttattccttgttaatgaatggaaattttatggtggctcttgtctttgagacttgggtcactatgctttctcttgagcaaataacttgattaactgtcctgatgcccatgaacatcccaactttttgattgtaggatagttttgcattattgaatattgctaaaatgtgttaagtcgtctggacagtctttgtcttagtgaaattgcagatatttgtgaactagtcagtattttaaaaagcatacattctgggtttttcagtgtttacctctgtctgaaagagataacttagtgttttcttctgagaatcaattcttcccttaaataaggaatcactatggcacagaagctgctgtgttaaaaccaggactttatttttgtcatgggtagtagttcctcagctctgaaaggagtttttagaatgttaaataattgattttcatagagtagctttttaatgcattgttgattttatttcttggtcctcagaataatgcattaagtaaatatatatttatccctgctattgctttacaaatttatagtaatcttgtaacttaacatgcatacaaaaggaaatgatacaggaaagtaagtttatactaaagcaaaaattgaggggctgtatgctcatgtttgataatgtggtaggtcagattgtgattcctatgcatatgtatttagtttctgttgcgtaaaattgagagataagtatagatgttaactctagaaatacaaaaaaaaatttagtttttctttccccactacttaagtctgaatctagactcttgagttgcctctttcctacagtacgaaatcaaacaaaaaccatggaaggctgagttgactgctgctttcaggttgaataaatgtatcaaaatggtcacaaataattggcttttctggaggtgctaagaaacttaaatgacatttacatggtgattgataatctttaaagtattagcttctttaaggattaatgtctaagtaaagctaaagaaaaaaaaggcatgtttttaaaatcctttgaaaaatttttgcttacatgttgttaacattcctgtaccacatacagaaataatttaatattttcctcacaggaaaaccagtggctgttacaagtaacagaggcacaggaagggcacctttacgtcctggcgctaacccccagctggagtggcagtattaccagaataaaatcctgaaaggcaaagcaggtacaaatgagctctctttgaagtcttagtgctcctgtggatggcttctggattttgctatttggcatggttgttaatagaaatgagtgcagagttgtagcaattagctttttcattcaggggttttaaggatgtcactgttaggttttgttgaattggagggtgatattttcctgaagtagagagtgaagaatgttttacaagatatgattgatttgctttgtataaatttagattggggataaaaatcatgggcagaatttaaagaagcctctttctattgtgagagttaattactggttattgtatcacagtaagaatgttaaagtttgtcttgctcaagatttgtatgaggaagtagaataacaaacagtagaacttttaatttattggaattaaaagtaaacaccagtaatcattctccatatgctttagtgaacctgttatgagaaataaccttgttgcctctcttgactttttaattttggatattaataagcaaaatcataagttgtactagtcataatacttattaagattttcatgtgtctattgcttttttcccctgagtaaattcactgagaaatgttttcttagaaattaaattttttttggtaactgattagttttctcatggttgttttgcaaagccaaagagaatttttaaaattagtttctcagaaatatattacccagaaagtagtcagaagttagatatacagtgaaatggaaagcatgcagtttagttttattgcagttatttcagtgcccttgtcagttataaaacgttgggcttgtcacaatgactccaatgaaattaaggcaaaaggaaagccagcgaacatctctgaggaccttttttgggattatagtctttttgttggttttgatcatctgtttatgtggtcttaagtatgaaataacataattgcagatacatatttatgctttgtgtgtacatttatttccaagttttataaaggttttcttggtctttaaatcttttcagagatttttgagattctagaattttgtgtgtcatgagtagatgtggagtagctgttactgaacttgttgagatttacttgtattatggtataggtagtttcttaggtattggtagtatggtttttgtggtaggttggtttttctttttgtattttctgtgtgctattaaacagatgaaatcttaagttctagaaaataagaaatagcttaaggaagtacacaatacttgtcatatattaggcatttatgaaatactaaagaatgctgaaagaagaaaaaccaccatgtatatacttgcagtagcatcttcagtgctcagagtctctctggtaggtagtcttgttacacacgtccttttatcggcagcctacatttaaaattttaaccttgacaagctcacattccttaggagtagcagagagctagtcctcttttgtcttttcttctgttacaatcttactataaatggcttattaacacagtactgtcattggttacttgtcttcatcagtttagtcacctaatttttataacattttaatgaccttctataatcacatccccttcacatctaaatgtgggtggtaaaccagaaggtaatattaggagaaatatttaaatttcacttgccattgaaaattgtcaaaaggagattgtcccgtcactagaaaaagattatatgacagtttgtattttatactcttactttaacttgatgtcatttacttttatatcctaagccttttcacgtattaggagctcaccagaatatttgctacatataaaatgaatagattatcctttattataaagtttgattacaactaagcttgtgctcagaacttttttcagtgcttttgttcctctttgcttgttattccctgatctttctttctctgggtcattatcagacatggcaccaaatataaaaatattgaggatcggtttaggaattagaatctttggcttctgtgcactagctttgaaaaaaaaaagatcagttctaatgtttggcttatatgtctagacaaagtattaggacaaatagcatccttagtcctttttgaaactttagtttcttagttgtcgtatccaaaaactctttaattagccccgtgcaaccagggtatctcatccatccatgacttcttttggaggctgcttcctgagcagtactcagtagtcacacttctcattgatgatctcattgtttggaacaatttatgctccaaatttcatggttggggccttttaccccttcctggatttccaggatacagatgttttctatcccatcgacaacttcagttttcattctaaagaacaacagttttaaaaatcgtattagtcatagatttattctcagcgatttctttttcacagacttgggtcctggcctctgatttctccaaccgttcctccacattctccatgtgcccgtctagtttgtcaagttttgatgagcagttctctactttgccctccagtgaggacagtgtgtccctgcatttccctgaatctcacatgaagcaactcactccgctcgtggagggacccacgcactctgctgcactgtggaacaggtcagccagcccaatggagaggaacacgatggtgctgcctctcaggccagggcactgggggcgcatggaccacagagactgttctctcctcaagcataagttttctgttattttcaagacaatatcttagataactagcccttcagataccaaagtcaggtaattctccaacttgtaaggcataactcatggttacaccttggaaagacagttggttgtggctgttcaagcttcagcactcctttttttggggtctagtagcaccctctgttgaagtgtgatactgacagtcctgaaattcttacagtttttcagcttagatgaatggactattaaaatttatatttacccttttaaaaccctccagaaacactgggtaatctgcttgggattctgtctttaatttgtaatagtatagctagcatacgttattcatatgtcagaaactagctcacattacacactctgctgttttgaagcaagtaggatttgacccgagatgttagtcagtttgatttgcatttatgctgtgtatatatggttgccgaaatccagaaatgcttgtatgggttgcatagttagatgaaagatgctgatgattattggtcaaaccaggaagagttgtttaagcccatgaagccagagactttgccagttttcctggtggtgcattaacgtggctgacttcacagaacagtgagtctgaaataaacaaaagagaaatgctgggtttcttagttatgtgttgttacagtgcactcaaaatagatttgtctggaatagctgaagtgatatattttgggtttgttttactcatggtacttttgtttataatagtagagatgtggctgaggttgtggttttagaatgtgatttttttttttacagcatactcttcctggaacctaatagtagtatcccaagagacctatgatgaagttgtgttttaatttatttctcaattactagtgaagctaaaggtggcaaaggaagtaaagtggcatgcagccagtaggctctccagagtgtgtggttttgttttcttgtgtaaagttgtaaatttggtttggatattaagagatgttggtaagccacactaggctccagttgtgttctctaaagcatcgatactctgatcacacttgaatgtttttaattgaacatgcattattaaaccaaaatacaattacctgtagcgggggataatgtgacatgtgtacaaaagaaaaagcttgaatttaggatgaaacctcttcatgttttgtgacctactaaattattgtttgatcagatagatggtaggaatttcatgtttgttgtacccgttagttagctttaagttttacagatagttcttttaggaaacagcaaagaatattcagagaaatttatatttttcgttaacttttccccactaccgagagctgtacagtccttttaaggttataagagggagttcatctccctgatcacttctcatccatgtccacctccagggactgtgtgttataggatattttatatttatcttctggtgtatttaaaaaaaaaacaaacctcccaggacactttgaatttattataagtttttatctgctgatgaagaatataatggaagcgaaccattttagagttttcttttattagataaggagataataccaatagagataactgtatttggaatttactgaacatttttatatgaaagtaatggaaaacaaatttcttgaaaaagtgagggaaaatcagtttataacatataaccattaatttttttttatttttaaagcagatataccagattcatcattgtgggagaatccagattctgcgcaagcaaatggaattgattctgttttgtcaagggctgaaattgcatcttgtagttatgaggccaggtatgtagaagttgtgtgttacaattcttaatgaataatttggttaattatttttatataatttcttgaactataatcttttgaagtggatttaaatgttacagacgtgttatgaggttttagccttaatcatctcatctatgccccccacaaccccccaccagtgctagataactttaaacaaacagcttactagttccctgatgagaaccaataggtcatgtagtaggaaccaaaagaaattggggatcatcgtttttactgtcttttgaagagtgaaataaaagaattagatttttttttaatggaagaggactttaatatttattccctctaatcttttgtttttattgctaagaaaaaatcttgtaatccatacttcctgatactcagtttttttagtgttaaaacccatttgcctatgcaattataagtaaataattgaattattggcattcttaatatctcttcacttaaaagtgttaagagtgttgtcaacttgttagcaccaactttttgtataggtctttatcttatagtgatctgaaaccataattataattggctgtttcagtataggaagaaacacacacacactcatatatatatatcttcctcataatttaaaaaaccgttttgaaataattggaatagttgtaaaagtagagggagtaataattaaaaagagaagtcttcatttttttttccttgtcaaccaaacacagacatttttacctatatcacacagcaagcccttacacattgctggcaagtgttaaagtattcaataatttcaaatcgaaacagagtcttagatcagttacatctttttttttttttttttttttgagacggagtctcgctctgtcacccaggctggagtgcagtggcaccatcttggctcactgcaagctccacctcccaggttcatgccattctcctgcctcagcctcccgagtagctgggactacaggtgctcgccaccacacccggctaatttttttgtatttttttagtagaggcaggatttcaccgtgttagccaggatggctaactgacctcgtgatccatccgcctcagcctcccaaagtgctgggattacaggcgtgagccactgtgcctggcctagttacatctttttagtcttgattcagagttgtggctattcaggcatctaatctgaagaaaaaatatttgagctcagcatcgtctaatcataatagttttttttaaatttgctaattattttatttaaagtatatttaagttaaaaagcattaagttcaaacgtgcatgcttatattttaaactgttttccattcatgacatgccaaacttttcctccccagctaactttgcctttctcattaacagaattatgttttaatggttttcattgtcacttgatgctgtggccaaggaattgaaacttactttaaatgataattaagtcaaatacaaatacgttttgaattgttatactgctttttattaccacaggcactctagagctgagtttatgttgtgctcagtaggctagtctctttttctctactaagttaatgaatggtggcctggacttcagatggctagacagttatgtgcagtatctggagggtgtgatgaagcccagaaatattcccagtccttgaatttcgctagttggtaaaatgcgagctccgtttacccttgctaaggctgcctctgcagggtctctccctttataccttcatacccagtcccccaccaagatgaatgctggctggggagcagggctgcctccaggtgaaagtgtcaccagctctggtggctttggactccaggagccacaattgtgtgtaggcactaggcttctgttgggtgtttggatggtgcatttatatttacccacggtaaatataaatttacctttataaatttggtcaagcttcatgccttgcaaaataattggggtgactatatgaggacagaatactatatagtgagccattcaagtgccacttaagtgcagatgtttaagaagatacataaagtgatgaaaatgaatttaacttgaagaaaaaaaaaatgcagccgtaagatttttgtcccttaattgtgattttctgttttctagaaggctattcctagtgaaagtttctagaaaatagtttctggatacttgttttgtggccatccaacaggttatattttccttatctgaggaaaatttttttaacaatttgcataagagaaatgttactgagtttggagtggggactagattgtggggatgatctgctcagtttgatgcactggtgagttttcactatacatagcttaataatggggccagcaaaggatagaatgtgaatatgaaatggtagaaatacaaagtagaatgtgtatatgtgggtcacagtttgcactgctgttagtagttggcctatacttacagtagagagcaaactttatatggaatcagtgagaaggtagattgtacatgaataggtaacgatacacagatatcctagaatcacagatctttaaagtcatataatttctaaaccccattttcttgtgcttttgtaaggacccactacctttcttactttatggatgtattttagtatgtagaatggacagtgacagtggtttgatggcaatttttttcccccagagatgaagtcttgctcttttgcccaggctggagtgcagtggtgctatctcggctcactgcaacccctgcctcccaggttgaagccgttctcctgcctcagcctcccgagtagctgggattactgctcccgccaccacgcctggctaatttttgtatttttagtagagatggggtttcaccatgttggccaggctggtcttgaactcctgacctcgtgacccgctcgccttggcctcccaaaagtgctgggattacaggagtgagccaccgcacccggccagcaattttttaatattgttgaatccaacaccaaatacaactgtctgaacaaagcatattgccagacagaatatgtcctctgtgctttaaatgtaggaataagctgtttttgcagcatacacttaacgaagttttggtaatttatcctgtatgggattttagttgtaatagatgagtcacggtaatgaagagacactttgagacactttggacttttttgtaattgtctttactcatttattttctatggaacaaagctcatttcccagccatcaactcaaggtatttggcttcccttagtatggcaaacctaaggcaaaccaaaggaaaaaggttttcgttttttgtttgtaacttccttatagtgtctaatggctcttaaacagttttctctgggtacattttacatgagtacataagtagatgtactatattttactaagtaatgtgcttcggaaaatttttgtgtaaattaatgttttgaaaatgaaaatattgtaaatataagaacatgatatttatagggattataaacacattttttttttttttttgagatagaatttcgctcttgttgcccaggctgaggtgcaatggcacgatcttggctcgctgcaacctccacctcccaggttcaagcgattctcctgcctcagcctcccgagtagctgggattgcaggagtgtgccaccatgcccggctaatttttttgtatttttagtagagacagggtttcaccatgttggccaggctggtctcaactcctgacctcaggtgatccatccacctcggcctcccaaagtgctgggattacagatgtgtaccaccgcgcctggactataaacatatttgggtttctttttttgagatggagtttcgctcttgttgcccaggctggagtgtaatggcgcgatctcggctcactgcaacctccaccctccaggttcaagcgattatcctgcctcagcctcccaagtagctgggattacaggcatgcgccaccacttctcgctaatttttaatttttagtagagacagggtttctccatgctggtcagggtggtctcgaactccccctctcaggtgatctgcctgcctcggcctcccaaagtgctgggattacaggcatgagccactgtgcccggccttataaacacatttttaaaaaatgtgttatctttaatttgtaaactcagcttttacatgctgaatctatatatctggcataattattacctgaaatttacccttttcaacaccagaccttttttctgctttctgataaagtttctaaactattttatgtttctacatatatgtctaaactgttaggtatctactttcttcattagtggacaaagcctgttgaccataggtcatccttttctaggcaagtgcaaggttgtccccatggaggtcatggagtttgctttatttgccatcctatacccagcacctcgctaagtcctcgacacatcaagaattgttttctttacaactctgtcattttccttcctcttaggtatttcttatctactagggacttagcactgagaccatttataatattactatttttataaacataaaaatgcatgtgattttgcatctactgctgagtaacttggaggactctttcttcttggctctcatggtctggatgttgggagggtgccagaggcctatgagtaattggcaactgtttgtatatacgtttcttaaaacaaggcacgtctccatgctgtgtagtaaatatttattgaacatatatatagaataaccattatcctattatataatatgtaatttggtgaaacattgctttattattttgcttgtttttactataattttttttcttgattctttacagagtgataaaatagaattttactaattatgtataattccataattatagttttgtggtgaatgctccaaatgtcaaaggtaatgtggggcactgagacacacagatttaaaatttaccattttcaattaggtccctcaaagttctggaaccctggctcctgcccagagtgatgtcctaccatgtacaatgctgttggcatctcaaccactgtggagccacttcaggagcatggaattggtcaattgggaattgggtggtaataggatgagtacattttgtctgtttgtcacatagcactgttttgtgtagttcttttgtttatattctttgtctttgggggatgaaccctggccaaactgtgccttgtattaggggaagaaaacctctttttgacagcatattcctgctctgtggtggttgtgatatcaccagcatatggcatgctggcatctctgcaaaggggccagaggtatgagttttaggagaaagcttcagatacaagagccaaacctggtattttaatgacatagttggcacatctacatgtgtcatttacactattcagacagttgtgacttttgggggaaaacaaggctgtaaattttaatgcctatctttaatccctaatgagaatggagttaagtggaaattataaattagtggcatggggagatatcaacatatttgataaatatttgagttgaaaacttcctagaataacctccattgtgttttgttctcgctctaggcaacttggcattaagaacggaatgttttttgggcatgctaaacaactatgtcctaatcttcaagctgttccatacgattttcatgcatataaggaagtcgcacaaacattgtatgaaacattggcaaggtacagtgtatcaaactgtcattttgtgtctgtgttttccttcttttagctaatagtaaagacagttcaagttttctttaggattgtcaggatcacttttgttagaattttatcttccaggaaccactcctcagcatcccagtttgagacctttctttgggcaatttccaggtagctcaatctcaaaggatagttttgtattgccaaaattgttcatgtgcttccttggttgatgtaagatctgattatttgcttatattacttctagtctgtggttctggttttcttcccatggagccagatagatgaaggatggaattttttaacctggtttttctcttttatttcattttaattatagttttgttcaaaattagaactgatgggttgataacaagtggagacactttaaaacctttatcttcttaaaatcattggatatgccaaaagttagttttcataaaagtgggtctttaataatagtttcaaaatggttgatgagttggcttgagaaaaggtgattaattttaaaaatatttaaaattgtagatgtatttaaaaatatttaaaagtgtagatatattccatattaactcaggactcaaatttcttaaaagtataaccagcctattatgctgtaaaccaggggtcagcatagttttctgaagggagccagataaagtttctgtcactcaacagaagttctcagttctgcgttgtgaatggaaagcagccacggggaatgtatatgaatgggcttggtgtagttccagtaaaaatgcatttactggatgttaggccaaggtttgtcaactcctgggcagtattaatgttccaagagatagacttcttgcctctgttttcacctctgcctcttcctttttatgcgttaatttgaacaccagtatctgctaagtacaggtgactgctagatgctgctagtccagaagggaatatctaatccttgcccttgtgggagcttgctttagtaggagagagagagaaaatgtgaaggaactgattatttcctggcgtcattatgtaggagtgagtgctgaatgataagacacttattatagctattctattaacacaaagagaacacactaattaactttccagttataagttgggtaactaaataaataaatcccaaatacaggaatgttggtattgtcaagtggaacgtgctttaaatcctctttgaaaggaggaagtcagtggtagcatccaaacgagggctagatagggatgggtgactgaggtcagtactgtggtgctcctgtgtcctgggtattgaagccctagagcaagcatcagcctgtgcctgaggttatgaggatgtgagagagagctgtgacctatactcctacacagtcacatgcacacggtcccagtagaaggctggagacagtttcagtggcatgtttctattcttaggggaaaaatatccacagtagtgttcttctaccacccttgggaaatcctatctcagcttcatattctccctgtctcagggcagctttcactctgaagcaaaatacctcataccagatatacccttctgttcttaaaaatgtcatactttaagcctaaacaaaacatacttatttctttaatagattatttctttaatagagatcttaatctgattgtaacctacctacagtaaggtgtaggtgagagatgaggaccgccctcctagtctacattaccaagtggattatgaaagacatagttttgatcctgaggcctcttgggaaagtttcctcccatttctggtccagttctattttgtgatttcttagtcctcgtattagcatgggggccacatagcaactcttgtcttcctttttcttttctctaattaaaacaaatcctttttgtggatagatcctatgagatgattttttaaaaagtatgtccacatgcagagagtgtagataactattctcagacaagcagttgggatgactggccactttttccttctgtattctaggcctgctacagtgagtggaatttaactgtgatattttggttttaggagagtagcaattactgatttgtctaatttttctgttccttaaaggattctcataaaccattagattaaatgttttgacagttcaaattcacccaccggttttcaactcttcaaaggtttatagaagtattgtcagtatagagaaactgaaataataatttatgctgtgtttttgtttttttgtgtttaaattttttttgttggttattttactcctcaaacattttcctatccaatatgctgtattttggtagttaataaggagaaagagaacacactaattaactttgcagttaaaagttgggtgactaaaatggtacttcagccaattcatttaaaatgctttgtgaggaaatagaaaaaagagaggataagaagactattttgcaacattgggtctaccagatggtggctgtggctgtgattcgttgcctttgctctgtgttgatagctacactcataacattgaagctgtcagttgtgatgaagcgctggtagacattaccgaaatccttgcagagaccaaacttactcctgatgaatttgcaaatgctgttcgtatggaaatcaaagaccagacgaaatgtgctgcctctgttggaattggttagtatctagcttatcttgtactcaaaagagttgctttgagattcttgaatatcagttaattttatggagtttttctttttattagcttcctctcacttgtaaaaccgtttttagcattgcttacaattgtgtgacacacgagataagtgctggaaatataagtaaatggttgataatcttcgcaataaataagttagaatatttcttacttattcttaaaaaattgggaaggtttcattcaacatttgtaaacagttttttttttcccaaaagtgaacggaaaccgtatttaaagctaggtggtggtatgggtttagagttgcgtgttaagtctgagtcttgttactctctgcacttcagcctcccggcacatggagctattcctgtcttcactcagttctagaagtcaccctgactccaagtgctctcagtaactgtccagtctctcctccatctccatccatgctgtctttaaaccttgtactttgtttccacagctgctcccagcacttaccctgcttttttgttgattcttccagccgtgtcctctggaactctttcatacttaagcttccctgagtcacctcttcctttcttaacccactcattaccttctggcaagataccccttttcttgccattctgttactagagccagtttgtccctgccatactcagtataccacaggcttggaaggtaaagttaactgtcttagcttgccattgtcactttcaaccattattcctccatcttcatccaaaaacccttcttcttccaaagttccctgtctcctttgtacccatgaaatttactaatgactgagtgatgatgcagagaggctaatgccattgaaagaagaatttgttacttccatttcccgagaggaggggcacaccgtgctacacaggactactggggaagcaccagggtggttaggagacagaagctgaaggagtggcagacggagcgcctaggctccagagcctttgttagggtttttttcagaaaggcaaggcagggctgaggaaacactttaggagtggctagtttgagtaattctggtgggctctgggctataggggtggtccctagttgcctggtagctggccctgggacaatttagggcaggaggtggttaggttgcatatgacaagtgtgcttccaggtaagaggtttactgtctttaggaattagccagccctgggagggcagtctctccccagccagcaggatttttaagatttcaaaacactgcgagatacagaaaataaaaagtatgattaatacattcccagcattcctacagctactggctagcctaccttttaccccctgatgttggcccacagacattggtaacatttcacttaggaattctatattccattgtcaggcacaattttatttttttgtttttaattgtccttaattttcatttataagtgatcatgtgaatccattcttttaagttcaagcatatgtaatgccaaagtcccactttatatttccactcctcagtgcctttcccctcccctgaactcactacttttatcattttggtgtgacttcccagaactttccctgttcgtgaatctctgtttatataagtcttctataaaaccaagatatgtcctcaatataagtcttccctttggagattttattattcacggagaagcccacctagcagctgagctctgcagatccctgccccttctcagggcttggtgcccttttcctccactgcttctgtggcccctgcccacacctacaccgtgaacctcactgcctgtctctgtgttttgaggactcttctaccctcagttcccactgctgctttgggctttctggtttccccagtccagtcgcgcactttttattgtcatttccctacctcctctgtctcctgtggttgggaacatgaactactctttgatcatggccttcaattcctacagacacccactctgaagatcaggactgctgattgggcacggtggctcattcctgtagtcccagcactttgggaggctgaggcgggtggatcatgaggtcaggagatcgagaccatcctggctaacatggtgaaaccccgtctgtaaaaatacagaaaaattagccgggcatggtggtgggcgcctgtagtcccagctactcgggaggctgaggcaggagaatggctggagcccaggaggcggaacttgcagtgagctgagatcacaaccactacactccagcttgggcaacagagtgagcctccatcccccaaaaaaaaaaaaaaaaaaaaaatcaggactgctttctctattcctgcttctggttagatgctgaagtggcacttgcgttagagcaaagagaaacctctgtccaggtactctgttggttataatctaaatacttagcaaaattctacaccttatttgaaataatcaaaatttattttcattgtttttagaaacttgatggataacctgtatgaagagatctttgttgagaaatttaaaaaataattgtgactatttcttggatgacttttttttttaataggttctaatattctcctggctagaatggcaactagaaaagcaaaaccagatgggcagtaccacctaaaaccagaagaagtagatgattttatcagaggccagctagtgaccaatctaccaggtaaatagaaatattttaacaatacttttattacaggcattacaagtacttttcatatctataatatagaactgtgagacctctttttgcccagacatgaatataaaaatttttaagtcttattgagtgccatgaaaaacaaaatttggaattctgcattaaatatcccctaaaatgatttgtcaggaccttaatgttacatttttgttttgcttctattcagttttactttaggtatttctcaagtagcaagattctaagaaacaatgttaaaagggaggatgatgaaattgactttcagtcctttaaataaatgattattgaaatagtttactcctgggctaaagataaaagttttgagcttcgattctcctatgtcatgctgcaggactagcgacagttttctgagtttattaaacaagtacttttaaaagtataaatagaatgtgtgtgagctgtattaggaaaaaggaaacgtaaagaaggattgtgttttcaattaactccactcatggaaaaaaaccttccatcttaacctttctcacctaaggggcaggatgttcagttatttcatatttttgtgtagttacctatttattataaagtgcctctgtcagctttgtaaagtcttccatcttcatttatagtgaaagttttaaaattcatttgttaaaagtagatttagtggcatttttagatgcctatttttaagcctaataaaagtatgtccgaactaacttagaagtttctgttaacaggccataaatattaaacgacagaaatggcattttatggtaggttagttttaaagcttcctgacccccgtagtatataacttaaaacgatgtattagtgtcagaaatgtgtaatatgacatttttgatggttagtttcacatttaatttgagaatactttataaaatcaaactagcaaattactgtagtagacaacacagtttaaacatttttaataagaaatcttactgaagttttatataagaaggaactggtatatttaaagttgcatgtaaaatttgagttttaagtttattacactagccatctgtattagttttctaggggtgccataacaaagtaccacagactggggtgcataaacaacagaaatgcgttgtctcacagttctggaggctggaagttcaagatcaaggtgtcagcagggttggctctttctgaagcctctgcttggcttgtaggtgaccctcctctccctgtgtcttcacatggccttccccatatgcatgtctccgtcctgatctcttcttgtgaggataccagtcatgttggattaggctcatcaatatgaccttgttttatcttaattaccctttaaagattctgtgtccaaatacagtcacactgtggccgggcatggtgactcacacctgtaatcccagcactgtgggaggccgaggcagatggatcatttgaggccaggagttcaagaccagcctggccaacatggtgaaaccctgtctctactagaactacaaaaaaaattagctgggggtaggtggcacatgcctgtagtcccagctactcaggaggctgaggcacaagaatcgcttgagcccgagaggcagaggttgcagcgagccaagatcgcaccactgcactccagcatgggtgacagagtgagactgtgttgaaaaaaacaaaacaaaaacaaatacagtcacatggtgaagtactggggtcaggacttcagcatataaatttggggaagacacagtttagtccaaaacaccatctttaaatcgaaccctttttgtagttttctttgttttaatagaaatagggacgttttagctacttgacctagtaatcctaccattcaccttcatttgcttcctggctggaaagactttatttctttttttttttttttttttttgagatggagtcttgctctgttgcccaggctagagtgcaatggtgcgatctcggctcactgcaagctctgccttctgggttcacgccattctcctgcctcagcctcccgagtagctgggactacaggcacccaccacacagccggctaattttttgtatttttagtagagatggagtttcacctctgtctcggtctcctgacctcatgatccgcccgcctcggcctcccaaagtgctgggattataggcatgagccaccgtgcccagtgagactttatttcttgaagggcaagtgtgaagttacatgtcctggccaagctgaggcacagccttgaatttcctaagggagatttgaaagatagggcagcagagttggccttctcttcttcagagccaggttctgtattgctcacagtggttcatgtggttttcataaaatccccaaatccttaacctgactgttatagaacatttcaggtctataaaatatctcccttctccattgttactcctgtcctgaagtgtgttccacagattataagctgttcctttaaaaaggggtttcatataggagagggaaccttctgtggtggaggggtttgtacagtgaaagtcctgggaattattttagaaaagaaacctatttatctttgttaaagactagtaatttctcaaagatatttggtgataaatatacagtacctatttatatcttgtggaacacgctttggaggaacttggctctctaaccataaccaggagaaattcagtggtaacttgccccatctccaacctctttagtcccttgtacccataaatgtttagtgaccacatacgtgctgcgcacagtaataaacaattagaataactacataagaaggaaaaacacaatagtaagtttttgctttaggagactccacagaataataattgtgtattacactaataaatacgtttcttaatatgatccggttacctaatgaaagaaaggattgaccccaacgactattacagtttgaagaaccatttctactttttctctggatctttgcagggctttttacctgcgcatgcactcttcaatgaagggccctctgcacctcattcagcctttgctaggtttgtgcatctagcatatggattccctctctatcccattttcagagaaccaccatgatcatgtaggcattcataaagtctgcactaatacagtagctacgtagccaagtgaagctagtacaatatgagttaaattaaagttaaataaaactaccagttcagttcctcactgccctggccacatggcaagtgctcagtggtcacatggagcaaggttctcctgtattggatagcagacgagaacatttccatcactgcagaaagttcagttgaacagcactcctgtagatggtgaaaactttattctttgaagtttactcctctatgtctgtattggatagccaagttctggatgccaaggaggggacattattggccacttttaacctagggtaatagttccccttcaaggacagatgccaagtctttgtcccagttgcttgaccaggagcctccttgactctctcttcgttgagatttgattctaaaagagcatattttccttcaccttttccttaataggtggctgcactctttgggcccggagccccccttactttgtccatagagttgccatctttcccttataaacacctacttaattgacgtatttagttaaaactagcagccctcttcaaggttttggtcctggctccaagtttaattttcccacccccactcaataggagttggaggtacaccacatgccctgcctccctcccccacctccggttcaggccatttcattccatcagatgagcctgcatggagaagaactgtgcttctttcatagagggatgtccacttagattagattgattacggttaacttggtgatgtttaatatagcctttcctttgcacctgtagtgcataatttgttgtggtatactcaagatactctaaaattttaaactatggggtttccaccccaacacatggacacactaacacaacccaggatgatgattgtctcttgctaatcttggaagtccctgagaacagatttgttccccagaactgtaacggaaagatcatggtcagattatgggagtgggaagtgaggcaatagtgggagggacaaaagagagacacaaagtcttccctgatgttaagaagtcttatgacaaaaaagaaataacaaaaagagcaaattgaagaaaaaagtctttcttaaaagcaaatagctgtgcaaagtgtctacctttgacaaacccaagtatgtaatttgtctattcccttgtgtttctcctccccattttgaaaagcacttaggtttcacttaaaattttaccttttggtgaatggtacttctctggaggaatttttttttttttttaaattgttaactcggggtctttggtatttacttgccctttgttctggcttggactttaaaatggcacaattgtgaacgagcacgcttaacgccttcatctcacttccattaaggaataaagtgtctgggtttaaacttgtctgacccacattgatgacttcctaaccttgtgttatatactggttccagaggttttcctggcagaacttggactagatagtttttctgctactgaagaccactcaggaggatgggagctatgaacagaagttagcagacttcactctgagctctcttttttaaacacagggtcttgttctgtcacctaggctggaatggaatggcaggttcatagcttactacagcctcaaactctcgggctcaagggatctttccaactcagcctcccaagtagctgggactacaggagcgcaccaccacacccagctaattcttttttctattttatagagacggtctacctcagttgcccatgttgtcctcaaactcagactgttggcctcccaaagtattgggattacaggtgtgagccaccacacccagcctgagttctcttttgataagttcctacagaagaccagaaacacaacgctgtcttttcctcattgatggaaaatttttacttgatggtgtggaaccattttaataagcattatagtttccctcagttactccaaacctctttcccaaatttgtggacctttttaaagcatttagggcaaattgaagaaaaccaagactccaacttagagcaacagaattaatcagtatcctttaggtggggctcaaacgttacatcttgcagaataggacatagggactgctgcctgctggcccagctgtaggagagttcatatctcttcagagagatcatccttttgattaaaaaaaaagtctgtcttctaccccaaccaccagttggtttggttagggtccttcatcttcaggtcagtggtatgtgtgatagcatgtaacatttctggactttggcccattttgtgaattcttgttctgtttttcactgaaaaaatgtggctgataccactgtgagatttggtgatgaccgaaatcataatagatcccttacatttcgtgagttggttagtatgtctgtaagtcacactatagacttgtttaaatgacagttgattccttagttgattttgtgactaagatacatatcttggtattattcactaataaagaaagtgacatttttgataacttgagttatacatattttaaaagtttctggttcatctatatgtggagtccaaattgagaagtagagtctagaaatacatctactagcatgattttgcaccaaaaaattcttcagcctgtggatgcttcagttatgttgcctaaagactttaaagattattttaaactagttgttttgtgcataaatggtgggtattttgtgttaataaacttgttattagtagcttattctgcatacttaactatattccctttcctaggagttggacattcaatggaatctaagttggcatctttgggaattaaaacttgtggagacttgcagtatatgaccatggcaaaactccaaaaagaatttggtcccaaaacaggtcagatgctttataggttctgccgtggcttggatgatagaccagttcgaactgaaaaggaaagaaaatctgtttcagctgagatcaactatggaataaggtttactcaggtactgatcattgaacagattttgccatctgttgctctttatatttttacatagtcctacctctacaactaaaccattagaccctcaatgcttgaaattaagtcttaaaactgttgtatccccagagccttaagaaggccttttaaggcactgtgtggtaaggtgtagccccagataagactgagactgaggaaacttagctcttggggaaatatactaaaagattatgctttggaggccagttattagagaacttgagattataattattctaattaacagtgaaaaaataaaaaagatgagaaaaatatttttaatgttgaaatattttttaagctgtagttaaaattaagtttcagcaaacccctccttatgcaagcttttggaaagctgcagcacagatggctgagtagtttccattttccttcagattatggatttggatatgtttttttttttttttttttttttttgagatggagtctcactttgttgcccagggtggagtctcactttgttgcccagggtggagtgcagtggcgcagtctcggctcactgcaacctccgtttcccagattcaagagattctcctgcctcagcctcccaagtagctgggattacaggcacccgccaccacgcccggctaattttttgtacttttagtagagacgtggtttcaccgtgttggccaggctggtctcaaactcctgaccttgtgatctgcccgcctcagcctcctaaagtgctgggattacagatgtgagccactgcgcccggctggatatgtcttgaatttgtatgtacaaacaacaccatatcataaggatttgaaatgtgatgagttaattaccctctgtgcctacactgtggacctcaggagttttgtttccttaggcatggagatagatgatgtttgggctgtaagcacagtgttggaacacacattttattagcagaacttattaacatagttacaaaagaattttcgacaagtcagtgatggcatagaaaagaaagaaaggggccctatgcggtggctcacacctgtaatcccagcactttgggaggctgaggcaggccgatcacctgaggtcaggagttggagaccagcctggccaacatggtgaaaccccgtctctactaaaaatacaaaaaaattagccagacattgtggcaggcgctgcaatcctagctactcgggaggctgaggaaggagaatcacttgaacctgggaggcggaggttgcagtgagccgagatcatgctattgcacttcagcctgggggacaagaatgagactgtctcaaaaaaaaaaaaaaggaaagaaaggaaaaatatcttttaaaagtactcattactttcactttgttgggaaggtgggtatttgtatttaatagttgagggtataccaaacagtttttgttgttgtagttttacttttttgagacggagtctccctctgtcgcccaggctggaatgcagtggcatgatctcagctcactgcaacctccgtctcctgggttcaagcgattctcctacctcagcctcctgagtagctgcgattacaggcacccgccaccacgccaggctaatttttgcatttttagtagagatgaggtttcaccacgttggccaggctggtctcgaactcctgacctcagacgaatccaccagcctcggcctctcaaagtgctgggattacaggtgtgagccaccgcgcctggccacgtttctttttaatagatgctgagcgtgatagtgagtaaccaacatgtttaatattcaaagttaaaatacttgagaacaattattaggtatataggaaagtggaatggtagtttctccacgtttgtctttccatagccaaaagaggcagaagcttttcttctgagtctttcagaagaaattcaaagaagactagaagccactggcatgaagggtaaacgtctaactctcaaaatcatggtacgaaagcctggggctcctgtagaaactgcaaaatttggaggccatggaatttgtgataacattgccaggtaagctcacctcagaaatgatattggtaattatatttcagtacaggttgttgtaagtaatagaaaatgaagaaaaccaaggaggagtttgaataaagacctgtaaacccgttaatctggtattctgtagaagcaggcatcagcccaaggcattcagcttaggttaatgcacttggtttcagcgaggcccacacacaggaggttggtttgacggcattgctgaccttggcagcctttgcttggcatctttgggctgttaactttactgcatggacagaaagaaagggcaaggctgcagaccaaagggactgctatagtttcgggacttggtgaaacttttttcctgaggaaaatttcaatgtagttcttaaaaacaatgatacaggccaggtgtggtggctcatacctgtaatcccagcactttgggaggctgaggcagctggatcacttgaggccaggaatttgagaccagcctggccaacatggtgaaactccatttccactaaaagtacaaaaattagccggacatggtggcattcgcctgtagtcccagctactcaggaggctggggcaggaggattgcttgaacccaggaggcagaggttgcagtgagctgagatcgcgccagtgcactcctgcctgggcaacagagcaacattctgtctcaaaaaaatgatacacaaaggcagactatagtagctagaaaaatgatggtgaaggagagcaacttcatttacataggtgtatacatttaattggtaaaaagatgaatgaatcactgtaatgtctgaaaactggtaaaagcatttaaaaacgctgttttttttggggggggggggggttgtttgttttgagacagagtctggctctgtcacccaggcctgagggcagtggtgcgatctcggctcattgcaacttctacctcctgggttcaagcaatcctcctgtctcagcctgttgggtagctgggattatggggcatgccaccatgcccagcgaatttttgtattttcagtagagatagggtttcactatgttggcaaggctgatcttgaactcctgacttcaaatgatccgcccaccgcagcctcccatagtgttgggattacaggcatgagccaatgtgcccggtctgaaacactcgtcttttatgtcagggccaactacttaatattaaacttcatgtaagattcgtgaccaatatgaagatgtgtggttttacatgtcattttatattgcactgtatttcatctgtgaaaccaaaattttgagacttttgacactgaaagctacttacaatatgaagtatagtttcattaaagattagctcatgccaaccatacatggtgcattcatgtatatgatgatattgctaagtcgtgagacgactgctcttaaacagagaaactcccaagttaccatgaaagcaggaattataaattacaattagagaacataatttataaaatacattttttatcagttggttatcttgaattatatttacctacctgttatgatacacatgtatctcaaatagtaaatagtggtcatttatttatttactttaaaaacttatttatgtagagacaggatctcgctctgttgcccaggctggccttgaacaatccttttgccttgacctcccagcgttttgggattacaggtgtgagccactgtgctcagcttttagtggttatttctataagcagatgaagtaatgtgattatcttcttaaacatttctatgggaaaatccaattcaatttataataattttttctgggaatatttcttgtttaatggcctggaacttcatttgttcattatacatggaaaggatcatccaaaacacgaaataactttcctttggaaagagaactggtagtaatttgttaatctgttactgagttagtaattctgtttgcaatgggacagcccgctcatgccagagaagctcaaaaggctctgaaggaaatggtgggtgaggtcagcacatctttgagacctaataatgctgatggaccatttggtcctccttcaagagttcttaaagatctaagaattgtttattggctgtactgtaaacacaatgaaaggagagtcaagaaacaacatacagagaatttatctttctcttctgaatatttgctatacctcagcatacataatcttggaacctaaaacttctcttggaatcaagaacattgtgtttaccattcacttgtgctttagctggaaaatatgtatttatttgtgcatatgttagctaaaatctacctttttctaaatttctcaacttatttttagttgacctaagtgtccattacggtttttaccttaaagttctagtgttccataatttttctttcccccttggttgccagtgtaactaatttggtatttctggcttccttgaagggagactatggcattcacttttataatcttctttgtaactgtttacaacttttctataactcttttaaacagttccatactactttagtactagtgaatacatatggaatgaagcttttgttttttaattctatcacttacaggactgtaactcttgaccaggcaacagataatgcaaaaataattggaaaggcgatgctaaacatgtttcatacaatgaaactaaatatatcagatatgagaggggtaagtatatagtaacattgtaaattctgactttgtgtaatgtatctctcatttttgaggcttgctctcaaaagggttattgctggtgtatagggactttatatgtaggtctttagctgctttgtaatacaaggaaaagagaaacaaaaattcttgacttcctccattttgacctccttcattttagaataattttcttagattcttactgtacttttccaaggtacccctgattaaccaggggctaatatacatgtcttccctgttcttgtttcctagaagtagatatgactgtgaggaatatgaatacataaattttgtacctttaagttcctttttaatcagaaacatactctgcatctgctgtatgatgacctagaagggagtgaaaccacaggcacatcaagatgcctttgaaacaggcaagaggcatcaaaatgtcaaaaccatagatttttgtgtggggttttttttttttgagacagtttttgccctgttgcccaggctggagtgcaatggcgttgtatcggctcactgcaacttccgcctcctgggttcaagcaattctccttcttcagcctcccgagtagctgggggtacaggcacccgctaccacgcccagctaattttttgtatttttggtagagatgaggtttcaccatgttggccaggctggtttcaaactcctgacctcaggtgatccacccacctcagcctctcaaagtgctgggattacaggcacttgcccccatctctactaaaaatacaaaaattagccgggtgtggtggtgcatgcctcatagtcccagctactcgggaggctgaggcaggagaatcacttgaacccaagaggcagagcttgcatgagccaagatcgtgccaccgcactccagcctgagtgacacagtgaggctctgtctcaaaaaaaaaaaaaaaaaaaaaaaaaaagaacctttgtaggtttagttttatgtgtgcatatgtaagtaaagggttgttctggcttgatgtgggctttgttgaaagattagtcactaagccagccgtaattgtgatttctccctgaaatactgttataatggcactttatggaggggtctgcagtgtacctgctgttcatcactcccgccaatattttttgagaagtatttcatttaaaaaagataaaaatagtgaagtttccaagtagactgtcctctcttaatttttttttatcctaatttaaaaccttagttgacgagaacatcagtggaatacagtattccacttgtttggattttctgattttaaagatcttttggtatattttgggagaattggatactctgaagtttgagatgaatgaccactcactagctactttagaaattgtttttgtaataagtcatatagaatgctgtttgaatactttcatttacctttattctagaaacaggatccaggagatagtgaaaaggatttgctgaggattttgcttagctgaattcatattttcactttagttttcctagaagcatactctttattctgggttctaggttgggattcacgtgaatcagttggttccaactaatctgaacccttccacatgtcccagtcgcccatcagttcagtcaagccactttcctagtgggtcatactctgtccgtgatgtcttccaagttcagaaagctaagaaatccaccgaagaggagcacaaagaaggttggtggtcatcaatgtggttcttttttaggtgctgcttatgtccttggaaagacggcagttggttttaaaattgacacagctttatgtgattttaaaaatttatattcttcattatgatgaatcagtaataaagtttttttatttgtaatggacagaggattaaaggccctgcccgatgatctgaagaggctattttatatattttctttttgtagtatttcgggctgctgtggatctggaaatatcatctgcttctagaacttgcactttcttgccaccttttcctgcacatctgccgaccagtcctgatactaacaaggctgagtcttcagggaaatggaatggtctacatactcctgtcagtgtgcagtcgagacttaacctgagtatagaggtcccgtcaccttcccaggtacatttttgtagtcctaaatataagtacattttatactcctaaatataaatacaaaaatacaagtttacaaatgaaaatggcatttttatttcttcatccgtttaaccaagaaagggagaacgggccacttgtttgggtagatcatgatgttggattctaaataagcaatatttgggttgagtgaaagtgcttttgcaaagatttgccactcttgcaagttgtaaagcatagctgaaaggcagtcctcctgtggactgccattgtctgtgacagtggtcatcatgcagacttactgtattcagcaaggcagctttggtgattagtggtgaagtagaggccttatgtcgaagggtttttgcagtatttgcaaacaggtctctggagatttggatggtttaattcagcgtgtgtgggctgtacatgtgatatactgctggtccttgaaagtaaggtagcaccttaagctatattgggcaagtttatttgtgcctctgctccccctgcatggaaggaggcggaaggagatgttaaatactggctgcaaaactaggggaaagggcaatgctgatatgcttgtatggcgacagatacccacaattagttactcctggcaagataagattggtccacccagttgatgggattgcatgtttccaaagggccagatgtggatgcacaggtaggccctggccaaaggaacagtggattctgtcctgtaagttagagaaaattcagcttctagaaaccctttcttccagtgtgctgctctcagagtagaattatttgtatttttgggcagtctctcatctgaaaggtgaacttttgacccaggactgttacctgtccagaattttaacatgtgcctcaggccttcacccctccctggggtgggatctaatttgagcttcaccaaggctattcatatctgttggccccaattgcaggacattctgtgagtatatttggacttacctggtcatgtgatagtggctggtagtatatatacacttctttccagactacacatagtacttcaggcttcaatgacaaaaggccaagacgttccaaaaatgtgctgatttggaggtggctttcctagcttgatggtctgtaccttacattgattatccacagtattcaaattgaaatttaaagtggcgtgttaactcccaaacacctcatctctgagcatgctttaacttcctactcatatgtttggcattttatagctggatcagtctgttttagaagcacttccacctgatctccgggaacaagtagagcaagtctgtgctgtccagcaagcagagtcacatggcgacaaaaagaaagaaccagtaaatggctgtaatacaggaattttgccacaaccagttgggacagtcttgttgcaaataccagaacctcaagaatcgaacagtgacgcaggaataaatttaatagcccttccagcattttcacaggtaagttaaatatgggaaccctctgctgtagtttcaatattctcacccccctgctccaacttaggacctgtctcacttccctttctcctctgtatctgacaccacatccactggggaggggaggggaggggaggggagagtgggcttgtctccatctcctgcatctgcaggatgtagacacagagcagcctcccgctgaagcagcagggaagagacgggggagggcatgctaagacagaaacacactgatctggggcaaacacatcaatggccacacttgaatacaacagagcggagatgtataatcctgcatgggggacagtaacaacctgagtccctgtttcaatgttttgcttcccattttctactagtgcattttgcccaggttctgctgttgtagtgggtttctttaagttagtactcttaattccttattcttgctcttaattccttattcttgctctaaccattttgaagatttaatcagctttgatattggggaactgttaagaattcgtacagatcagaaaagtgagatttgaaaacaaagtctgttttgtgaaaaagagaaaccagctaccatctacaattagctcaggtttgactttgacctcgtcttttccactaggtggaccctgaggtatttgctgcccttcctgctgaacttcagagggagctgaaagcagcgtatgatcaaagacaaaggcagggcgagaacagcactcaccagcagtcagccagcgcatctggtgagccttggaagtggcatgtaacaaaaatgaagacaaagagtaatggagtcactgttgtctaattattgcagtatataatgggcaaagtctaagctgttgcattaagagctcttcatattgggataatatctgaagtatacagtatgagtaaatatcatcatatttctagttggatttgtgtctgtactttcaggatttaaacacaccactttttactttttaaaaagttggaataggacattaccacaaatgtcttaaatacttgttcagctagttgtcctttgagatgaatacattaaaggatgttggttcaaaatgcatcacaaacatcaaacccacatttagtactacccatcatagatgagcaacatgccaaaggtcaaattagtaagtggcaaagcaaagagagaattggagagcctgtactttgggccattgccattcactgcctctcacttggggcaggaggggaggtgtaggctagggagcctgttgtatttgggaggagaaaagagaacccaatactgtcatccagactatccatactatcattttgttgaggatcttatatccatctgctcttagtgccaaagaatcctttacttcatctaaaggcagcagtgaaagaaaagaaaagaaacaagaagaaaaaaaccattggttcaccaaaaaggattcagagtcctttgaataacaagctgcttaacagtcctgcaaaaactctgccaggggcctgtggcagtccccagaagttaattgatgggtttctaaaacatgaaggacctcctgcagagaaacccctggtaattccttaactttgacctttatgagatcttaatatacctggataatgtgtgaatatagcaattttatcctttgttttcttaacaggaagaactctctgcttctacttcaggtgtgccaggcctttctagtttgcagtctgacccagctggctgtgtgagacctccagcacccaatctagctggagctgttgaattcaatgatgtgaagaccttgctcagagaatggataactacaatttcaggttggcttggcctgtgttagatggcccaaggctgagatgtagtcgtctcatgatttgagaacataaacagactaaactatgcagatttaacccatttctctaactctgataagcttaaagcagctacccccaaatcttttaaattctgggacttgctttgaaaagtaacaaagcccattcctttgatagctgttagtgacatagttgtagaaatgcagttttcctttatccatgcagatctctgactttctccttcaaaaagactggtcctcatttgaagtttttcccccttcctagatccaatggaagaagacattctccaagttgtgaaatactgtactgatctaatagaagaaaaagatttggaaaaactggatctagttataaaatacatgaaaaggtagtaattcatcacttttatcaaatgggaaaaaatggcatgtcacaatggctgagggtgtactgagttgttttaaactttctgggaaactgtactcattagggttaatgagaaagtgatatcctttattttgccatgttgactaagtagcaaataaggttccaaatatgttgccctcaaggtcttacatgtgattaaaaaaccataggaagtgggctgggcacagtggctcacgcctgtacttcacttcgggaggctggggtgggtggatcgtttgagaccagcctggccaaaatggcataaccccatctctactgaaaaatacaaaaaataaataatctgggggggtggtggtgcccacctgtggtcccagttacttgggaggtggaggctgcggtgaaccatgattgcaccactgcatggctccagcctgatcgacagcttgtctcaaaacaaaataaaaaaaaatttgagtgttctaggattttattttttttgagatggagtctcactctgtcgcccaggctggagtgcagtggcaggatcttggcttactgcagcctctgcctcctgggttccagtgactctcctgcctcagcctcccgggtagctgggattataggcatgtgccaccatgcccacctaatttttctattttttgtagagacggggttttaccatgttggccaggctggtctcaaactcctgacctcaggtgatccgccctcctcggcctcccaaagtgctgggattacaggcatgagccacaccgcacctggccaggacttttttttttttttgccaaagtcaatttttatatataaaaaggaataattagtcttaaggacctttcctaattcctaatgacatttcttctctccccacctttaggctgatgcagcaatcggtggaatcggtttggaatatggcatttgactttattcttgacaatgtccaggtggttttacaacaaacttatggaagcacattaaaagttacataaatattaccagagagcctgatgctctctgatagctgtgccataagtgcttgtgaggtatttgcaaagtgcatgatagtaatgctcggagtttttataattttaaatttcttttaaagcaagtgttttgtacatttcttttcaaaaagtgccaaatttgtcagtattgcatgtaaataattgtgttaattattttactgtagcatagattctatttacaaaatgtttgtttataaagttttatggatttttacagtgaagtgtttacagttgtttaataaagaactgtatgtatattttgtacaggctcctttttgtgaatccttaaaaactcaactctaggaagcaactactgtttattatactaaaaggctgaaaaacctccaggccagactgctaagctctgaaattcctgagaggtctcagaccgggattctacttgttccaagaaagggtaaagcttctaaaccatcttattcttgtctccaagcatgaacacaggagcatgttaagaaaatctttactacttcttccatgcggagaaatctacatattttgaattagaaacaccctcacacccacttgaagatttttttcctgggaacattatgtcccgtagatcagaggtggtgttgtctttttgcttctactggccattgagaaactttgatgataaaaaagaacggtatagatttttcaaacgtatataaaatatttttatgttatatgttatgccataactttaaaataaaaatagtttaaaattctatgctagtggatatttggaactttttcctcaaacaaacaccccacactgacttcagcaaaaccctaaaactagctacagattactactacgaatgaatcattaagttttgtgtctgcaacaatttagaagcactaagcccaaatatcaggaaatgtgtgtatgatggaattttctaggacaaaacagatcaagattaaaacagatcaagattaatgtataaaaatctctactaaaacagatcaagattaaaacagatcaagattaatgtataaaaatctctactgttaccaggtgctggcatacaaggtagtgtgatgatagtttagtttgtaagataattcttgtcctaggaggacaacttgtgggagagaagctacactaacatggaagcctaacagagcttgcttactggtggatgtctgttttctttattggtagtttggtttagaattgtgatgattacaatggactcgtgactacacaagcagtaaaaagcagccagctgtgcttttacaccatggtttcacacaaagcagctaaagaaatatcagaatgcctaattttctattttataaaagccctaaaggcatatggcagaagaatgctggaaaaatcactgtgggaagaatatgcataaataaagaagtatttcttacgtcaaaaaagtcccaagaatcacaaaatctgcagaagcttggttaatcaaatactgcagtactgatttaatcagtataaaatcgaaagagctttagatctgtaataaaaatccaaatttggggaagggcaaactttaaaacagcagccaagtagagaagggttggggaagggagaggtgagtgaacaggcacattggaactgtggggacatgtaactgaccactgtcaaaccagtgtaagtttcttggtttctcatggaaaacattttatacacctatttttcttccttccatacttaagtccatcagtgtccaaatacgtctgttccattttttgtctgatttttgttgggatattacaacacagtattgcatttactccagttcctgctccatgtgaaaaaattagatgatttcaaatactttcttcagctccacaataagctgccagtcactcttctgcatttcatctctgaaccagtctttgagtgcatcaatggactgccggctgatctgcaatgcccgaggcacaaacagggtaaacagaacataacaaacgtgccaaagaaagctgtggccccagatgcccgctctcactgtactaaaaagcttaagcagaaataaaaaacagggcttgcctgcctaagggagtagaattccaaaatcacatctggtttgcatgtcaggcacgaggggacctaaaagtcctagctttctctgttggtgctgctttcctgatagagcaacttcctcaacagacaaggcccagctagaggtcaagccctaatgggggatccagtcccatcagattctacaatcaaactgaagcccaaggagctacaggtacaggtgacccaagaagagtgattc

SEQ ID NO: 16220 - DNA, 16082 bp, Human
cccaatttttaaaaatacataagtacacatatacacaggggtgcatattcttccttgtgcctcaggctccagtctggcttggatcctgtattcagttaaaattttaatacagtcatgcacttcataatgatgttttggaaaaagactgcatatacaacagtgcatatacaaaggtggtcccataagattacaatggagttgaaaaattcctattgtctagtgacatcatacctgctaaaacatcagaatgcaatgtattactcatgtgttacttgatattaataatgactatgtcactggtttatgtatttactatactttttattatattattatttaacttattttttaaaagttaactgtaaaacagcctcaggcaggtccttcaggagggattccagaagaagacactgttataggagatgacagctccctgtgtgtcactgcttctgaaaaccttccagtgggacaagatgtggaagtggaaggctgagattgatcataatgaccctgtgtaggcctaggctaatgtgtgtgtttatgtcttagtttttttaaaaaatggctaaaaagttaaaaaaaaaaagaaaaaaagcaaaggtagaaaaaagcttgtagaataaggatataagaaaaatatttttgtacagtggtacagtgtgtgttttaagctaattgttattacaaaacagttaaaacgtaaaaaaatttggaagatttataaagttatagtgagtgaaagtttattaaaggaagaaaagtattttttataaactgagtgtagcctaagtgtacagtgtttatgaagtgtttagtgggtacaataatgtcctagaccttcatgttgggccaccactcactcatttactcacccacagcaacttccagttccgcaagctccattcatggtaagcgccccatacaggtgtgccatttttatcttttataccgcatttgtactgtaccttttccatgtttacatatgtttagacacacagatacttaccatgaattacaatggtctgcggtattcagtacagccccatgctgtcaggtttgcagcctggaagcagcaggccacaccacagagccgaggtgtgtccaggctccaccatctaggtcgtcaaagtacattctgtggtgttcgtacagcaacaaaatcgcctaatgacgcaatcctcagaccttaccctgttgttaaggtacacatgactcttattttgttcctcccggatttcctgcattaatttttactttttaaaatattacattaatatattatttgattgccagtttttctggtgctcccttaaattgcacagcctgccagcccttccctggctcccctttctttttctgcttttcttagtgcttcaacagacctgggacgttctttttctttctttttttttttaattttcttctttttttctttttcttgttttgttttgttttgttttgagatagagttcgctctgttgcccaggctggaatgcagtggtgcgttcacggctcaatgcagcaacgacctccagggctcaggcgatcccccgacctcagcctccggagaagcttggaccacaggcgcgcgccaccacgcccagctaattatatattttttgtagagacaggtctcactatgtcgcctaggctggtcacaaatgttgcttttttttccctccaggcagagctagtctctgttttgcctacctcgccccctcctgggcccagttagaaacctcatcacataatttcatttctttaccaaacttgaaaccttctaaacttgaaaccttctaaacttgaaaccttccaaactcaccacttggcggcgttgatccatccgcccgcgcacaaagagaagatcgcggaacttcagagttaaggggagccgtttcccgcagcgctagccggcagtatttccaaggcgcaagttgcggagtttctgtttcctttttcctctggcgagctttgcgttccctgtgcgccggaagtgatcccctgcgtggctgggctgctcgggttagatcgtcaggtgagggaggaagggatagccagcgcgaaggaagtgctggagtcgtgtgttttggctgcgcgtgatcctgcgtgggtcgggaggtgtttctgtgtaggtgtctggccctttcatcagtcgtgcggaggaccgcgtgatttccttccagttctcctcggttttcaggtggtggcgccatcttcggtaaagggtgtccacctctccctatggtgtggctggctagcccgggggtctctacgctgcttggtctttgttaacggagatgaaggcagtaatttttcagtaacaggtttcagatataagtcccttggtgatgctaatatttatggaggccttactatgcattaagaacttttttagaagtttagaaaatggcagtgaataaagcagatacaaatctctgctctaagggagcttgcatagtaatgaaatttgagaagacagtggattggaagtgggattaactcagaatcaaaattttgtcgatgggttggaggaagaggaagttatttgggaccaaaaagacatacaggtgtgagtttatttgggagggaggaaggaatcctcatcagatgtgcaggaatgttggtacgttgtggtcacaaaattggagtgcataaaaattatgaatatagttaggaatttaggactggtgagttgtacttttgccataagaggtaatgtttttttcttattttgtttttttccttcaggaaaagcctaaagattagactgtaagaaaagaaaatagaagccatgtttcgaagacctgtattacaggtagtcacttgtctgtattaatactgagatgtattactatcagccacagtgatcagaagacttctttaggcttttaactacaggggcaaaagacctttgagctcacccacccacctctatactcatttgatatggaggattggggacgattttgccagtgtaaattatgttcactaaaacaaaaaaaaagttcaggtttattcacacgtaataggaatcattaatttttaaaatgtgtgtgtgttgcttgaatttaaccagtgagaggacattaaaggtctttagtgacctaaagactgtaggaatcattgttccaacttttttcttaaggcatgtagttgcttttttgaccatctacctcctgtgttgctaaacgttcctcttcccccatctttccacactgaagagagcatctcaagtctcagtggtcaccagagatttcactatgtagaaaatgccttctcattccacttagtatgggtcctcacttttccagacactagcccaccttgagccagcttagactaccatttttcctcacttaccacattcgggcaccagctcctgtagattcttctttggctctcctactccccatcctcctgtgaagaccaatgaagaaccagttcctccatgactctgtcattttccccaccttaatcctatattcttggatccccactttaacctgtatgtatctttaatctatttttttctgtattgaaatgtgaaacatgaaaaagttattgcttcttaacactaacgttacagtattaaaatgtctttaaataagagttaaaagtttaatttaaaaaattatccaagttaaataatcctttcctaatcttctccagtagatttttgtgtgccccaaatgagacattgttattataaatctctgtgtaagatttatgaggtctagcttgtctgagcactcaaatgacatttccagaatcatgacacaggttctcattagcagtttgattctatagtatgttgtactcatatctttattttcttatctgccctctgctcctaagtttagtgataggattagatagccaacagcaccctggggattggtgtttatttgattggtggacttctgctttttatattaacagtactgccacttcaaaaatgtttctctgatagaatggctagctctctgagctctgaattcagtgatgtgtactcccatctttacaggagctcttgaaattaaggaggcagcagagggcttcgggaaagcagtagcattggtgtcaagggccctgggtccttgagatcacttgccacatacttcctgcaggagcttgggcaggtgatgcagtctctctgaggtgttttctcagccctaaatgggaataattttacataacttgtagatttagttttagaattgataatagataaatcccttagctgatattcagtaatgattgctgctattatgtggtagtgactacctttgctgacagtgatgtgactttgacttggacagtcgagtctttgtgtttaatcaaagaaccaaatttattagaccttttttgatgcactaaaaacaggaaatttcctatgaaatatttataaaaactgtattaggctaagctcactactgaagctgtttaatttttgcaatagccttgtgaagtaggtattatgtatcataatttttgcttattttaaaatgaaacactttagattagtcatattaggtatcctaattccttttaaggtctgaaggagcaaccaggggaaggcagtttcatagacacagggaatctgactttggaatatgttcctgttgctgtgtcagaaagtcattcatgtgattagttttagaatgtattgttttgttggaatgtaacctatctctcgttctctaaaccagcagaccccaacctttttggcactgataactggtttcatggaagacaatttttccatggaggaggggggtgccgtggggatggtttcaagatgaaactgttccacctcagatcatcaggcattagttagattctcataaggagtgcacaccctagatccctcgcatgagcggtttataatggggttctgctcctgtgagaatctaatgccactgctgatctgacaggaggcggatcttggtcagtaatgcttgctcgctgcttgctgctcacctcctgctgtgcagccaggttcctaacaggccacagaactctactagtcctcagccctggaggttggggactctcctctaactggctgttcgttatgcctgagagtaaggctttgcatttattccacacctcctgacacttgtttgatcattgcatatgttattaatgaatctacttattaaattattaattataaagcatctcttttaactctcctttggtctaatgatggattaaatcagtacccatgttggatctaaatttcttaatttctaaagtctactgtaaccaaaatacagtagtaatataccagttgtttatactaaaaaaaaaaattagaggatgtatatattgaatatatgtagtactttttgtctctttttgtctttccagctaatgaaagctggattttgaaaatacttggcagcaactcttaggtacaggttggatttacaaatattatcatactctgtaatgttaaagtgatactattttgatttttccttttgtgtgcaaacacagaagtgccataatcaaggagatgtcgcaaaataaatgggagtactataacttaactttgagcatgccttctagtaccttccttctacctttgggcttctgcattaggctgctcttgaagtgtttgccggggccttctggcactctgttgggagaacatgagaagagcttctcttctcttctggaattttcaggaactactgactatatggtgaatgaacgtgagtaattcttctgtttgcatttgcctttcctaaaaaattaaagccatgttattcatttgttcttctttaggtacttcgtcagtttgtaagacatgagtccgaaacaactaccagtttggttcttgaaagatgtaagtagctaatttccaagtttaaaatgttatttttagtaatttgccaatctcaaatgtgttgtagaagaggtatgctgcttgggttaaccatgttgccattgtgcttttagctcatgtttgctcttcagatcttagccttgacacatcaggctgtggagacatagtataaactgagcccctattctccttatcagccagttactactcattcttgtcaacactgtcctgcataagaatttccttgagtcatatttggttatctgagtcttcccgggttatgttgtattaggctgagattgtaaaagatattgtttcttcacagaaatattcccttgtgtttataaagattttcagatctcagatttgttcttttagctccacagtcagttaaaaaagatatcttaaagaatttaagatctagagcttacagtttgttttgtggggctgctttctctatgactattttcttctttcttgccaactctcttctctcgcaacctctccttattcattccttaacttattttctgatcttccagaacttgggttttacttaatgcagagattgaagttgaagtcatatttatagcatttcttctggacatttctctcagtcttgagtgtggatttctttttttttgagactgagtcttgctctgtcgcccaggctggagtgcagtggcgcggtctccgctcactgcaaactctgcctcccgggttcatgccattctcctgcctcagccttccaagtagctgggactacaggcgcccgccaccacgcccagctaattttttgtattttagtagagatggggtttcaccgtgttagccagcatggtctctctctcctgaccttgtgatccgcccgccttggcctcccaaagtgctgggattacaggcgtgagccaccgcgcccagccaggtgtggatttctttaatggtcagcttagaggctgctataaaaaaataccatagaccaggtggcttcaccaacagcatttatttctcacagttctagaggctaaaaatccaagattcgtgtgccagtatgattgagctcttggcgagggctgtcttcctggcttgcagatggttgccttctcaccgtgtcttcatatggtagagacagaaagttctgaactcttcctgttcctatagggacacctcaccctcatgacgtcatctaagcctaattaccttttaaggatcccacttccaaataccattacattgagggttagagcttcaacatacaaattttgggggaaggggcacaactattcagtctatagcaggttgtctcatttggtcttgatgttgtgtttcagccctgaatcgtgtgcacttacttgggcgagtgggtcaggaccctgtcttgagacaggtggaaggaaaaaatccagtcacaatattttctctagcaactaatgagatgtggcgatcaggggatagtgaagtttaccaactgggtgagtacaaaagactggggttttaattttatcagcaataaatagatattatttattgccagttatctaatttagagataaaccactttaaacaagatctgtctttcattctgtttgttctcttagaaatcgtgacattggttttcctgggcatgttgtctgttggcatttgtaaccaatttcctatttttatgatttaggtgatgtcagtcaaaagacaacatggcacagaatatcagtattccggccaggcctcagagacgtggcatatcaatatgtgaaaaaggggtaagttgaagagggaaggatcttatgaattgaatgatttaaagaaccgataagaagtgttctcatggcaaggagtgtgtagtctcttaaatccctgagtactactaatgactgtattaatttaagaggtatttactaagtccttgatactatatgcatggcatgttgccatgtgtgactaatttgaagatatataaaacatagttttagctttctaagaacttacagtttagggcaaacagggtgtgtacataaatagaaatagatgaggcaggagagaaggcaaagtgtatcaagtggcatttgagcaagtcaaacatctgctttgaggaattcctgtgcctctgtggccggggatgctgagggtggcttcttgcctgttggctgccacatggtatttccagcagaggatctggaatgtctgaagcctgacatgccaacttcatcttcgtggcagttattttatatttgatgattttctgtaggcttaatagttcccttttggaaggcttggattgagtatgtataaaaagtatgttttccaaactcatagaaggacaaaacggtgtgtgtaacagcagttgtattgatagttaatatgtttagaaatgtacttgttttgtagaaagaaaacatattttatgaaaaataatttagcaatcactaaaatttttcttttcaataactgtatagcttttcttcctatgtatcttcattgccctttatgtatgtttatgaatatgtgcacatacacacacaaacacatataaggtatttcaagggaagtgtctgcactcccacttactgattgatgggtgtgtgtgtggggtggggagcacctgatgtttcactaatctttctgtgttgtacttttttggtggtggtagactctcaaaactggtactattgtcatctttccactcttgaaaatcacgattaggtttgttatctagtttagcctctagatagtgtagaaatagtcttagtaattacctctaagtggtatactaagctgatacagtgtagaaatagtcttagtaattaactcagggtaatattatactaaactaactacaaatccatattttgaattttaatcatctaagtttctaaggtcatagaaaataattgataaataagtgaaaatcaagtctgttagggactccaaaatcaaaggtcaaggaaaatgatacattggaaattattcctagagatttaaatgttgccactaaatttccctttgaactgttttgttttattttttaacttccgtaagagaaatagctgacagatgaaaacattgtctgttttacctagatgttaccaagtctgtttggacactctgtttcagtactcctaatcctgaaccttgagaagtggtagcaaaaattagcttatatatgattatatatttcatccttgtcatatactcagtaccaccctgacctgactcttataaagcatattaagatctcaactaaaaactgtacattttatttatatcaggtctcgaatttatttggaagggaaaatagactatggtgaatacatggataaaaataatgtgaggcgacaagcaacaacaatcatagctggtaagaagcttgtgaaaatagctgtttttttctttttctccttttcttttttaaaagcttggctacactgtaactaactagggttaagagtaccagtacttatgagttaaggcaactcactagaagatgtccataactcttatttctctacttgctaagagtttgtacatttatcccttcctttaaaaaattatttttatacttacagttttagtcacaagtaacttttgaataaagcctaaaactgaattatccatcccagtacttattgttgagaattacaaaaactctgaatgtattgtcttttggaaggatctagccctaaccaggaagaagcgtatgccaagataagaattacactaatgtgagtgtgcagatttattcggaacctctttggtacttagtatgtgaaatttctatttgaaattaagatttttttaattttattttttttgagccagaatctcactctgtcacccaggctggagtgcaatggcacaatctcggctcattgcaacctctgtctcctggattcaagtgattctcctgcctcagcctcctgagtagctaggattataggtgcgtgccacaccacctggctaatttttgtaattttcgtagaggcggggtttcaccatgttggtcaggctggtcttgaactcctgacctcaggtgatccatccacctcggcctcccaaagttgtgagattacaggcatgagccactgtgcccagccaagaagtttttaattttctctttttttgtttttgttttgagacagggtctccctctgtcaaccaggctggagtgcaatggtgtgatcacagcttactgcagcctctacctccccaggctcaggtgatcttcccacctcagccttctcccaagtagctgggacaacaggtgtacaccatcatgcctggctaatttgtcaatttttttgtagagatgaggtttcaccatgttgcccaggctggtctcaaactgctgggctcaaatgatcctcccaccttagcctccccaaatactggaattacaggcatgagccattatgcccggcctaatattctctttaaacaaaatacagtacaacatagaaaagatgtacacgtaaaggttaaagaagattaagaagatatcccttaggaaagagtttttaaacttttgaaaatgctataagaattttgaaaataatatacccctctggatgtctgcaagcgacattaagaaatttttttcaatacaaaattgtgttatttttaaatgtatcaatggaatctaaatagcatagcaatgtgatacctactatcctgtaaaaaaataccagttcagcatttggaaattttccattattcttttttctttgaacttgttttactgtttttattttcccctcagaagtgtatcttaatagtatatggtatagttaagaactttttattaccctgtttgtaacaaaaatgcatgcataaaagaaactttaaaatatttaaaagaattctatgacaaattcttctcaattgacttatcattaaagttgtttttagtacctaattgatcaaaacaattttaatgtatttaaattatattggaaatatgtctttaaatgagatagatggtgcttttttcacttcttgagtaaattgctaaaattagacattgtgaattttgtgcttttgtttgcttttatggacataaatactaagaaagctttttaaaataaatacatggcaataaactaaattttactatattaatgtttctgtgtttatgaacttctgagatatgcccaaattagattttttttttttttttttttttttgagacagcgtctcactctgttgccccggctagagtacagtgacacgatcctggctcactgcaaccttcgcctcccgggttcaagcgattctcctgcctcagcctcctgagtagctgggactacaggcacgcgccaccacgcccagctaatttttgtatttgtagtagagatggggtttcaccatattggccaggctggtctcgaactcctgacctcgtgatctgcccacttcagcctcccaaagtgctgggattacaggcgtgagccaccgtgcccggctagataatattttttaaaaattgatttttgggctggatgcagtggctcacgcctgtaatcccaggcctttgggaggctgaggtgggtggatcatttgaagtcaagagttcaagaccagcctgggaacatggtgaaaccctgtctctacacaaaatgcaaaaagtagccgggtctagtaatgcgtgtctgtagtcccagctactcaggaggctgagtcatgagaattgcttgaacccaggaggcagtgtttgtagcgaattgagatcacaccactgcactccagcctgggcaatagaggaagactctctcaaaaaaaaaaaaaaaaaaaaaatttttttttttttactatggaaaatgtcaaacatgtataagagcagaaaaaatggtaaaatgaactcctaccatttcgcttcagtgtcagctgatggacagtgttatatccatgcctccagcgacttgacctacacctggattattttgaaacagattctagacataagtttattcataaatttccatagggatctctaaaagataaggtgtctttttgaaaatgtaactaccgtgctattatcacacctaatattaataaattactgttaatttttttactaaatatcgtagtgttcaaatttccttgataacttcataaacattcatacattatattacatgatttctaccttaagtctcttagatttgccttttatctttcttctttcctttgctccagagttcatgtcttaaccaccataccttattaataatttataatttgtatagaatgctcacatggtttcttactgctaagtttctttgaaagtgtattaaccttgaaaagcagtgtaggtattttcctaccctcctgtgggtcccaatataaaccacaagtgtgggcaaactttagattgttcggattattgagttgttactaataagccaaacggaagcatttcagatgatatgctgttttgttttttttccttgtcactaggttccactagcacagtcagtttactttaggtttatgtctaatggtaaaattgaagagctcttcagtgacatttgaattgaagaaaatagagtttattggttgatctgttttattggtgatttttttttctcctagggatcctatctgtaactaaaaaaccaccaccagtggatggcactcttggctttttccacagtgatattaattcgagtagtttgttctgaagtaaccgttctggaccaaaacattctagtttttggaagactatggtcatgaacaaatattcagtccttggtggataattttatagttacaagaatcttttggaattataaaggaaatgcagtcattcctccatgtcccttgtttctgcatctgtggattcaaccaagcacagattgaatatatgtgaaaaaaagaaaccaataaaaataatacaacaacaacaaaaatacaagtgaaacaatacagtgtaacagctgttaacatagcatttaccttgtattagatattgtaagtaatctaaagatgatttaaagtatataagaggaagtacataggttatatgtgattactataccattttatatcagggacttgagcattgtggattttggtatctataggggtcctggaaccagtcccccaatggatactgaaggatgactactacttgcctctgttcttttgtttatttttagctaactccctctggaacagcattttaagagcaacgtctgatatttttggataaaaatgctaactctgtgatgttgattcataaaatgttcccaagaattggtatattaaaattattctgggccaggtgcggtgctcatgcctgtaatcccagcactttgggaggccaaggcgggcagatcacttgaggtcaggagttcaagaccagcctggccaacatggtgaaaccctgtctctattaaaaatacaaaagttagccaggcatggtggtgcacacctataatcccagctactggagaggctgaggcaggagaatcgcttgaacccaggaggcagaggttgcagtaagctgagattgcaccacttcactccagcctgggtgacagagactccatctccaaaggaaaaacaaaaagttattctgtattgtaatttaaaaataaaatttcttctatttgaatttttaaagttaaaaacgtaagtaaatcctgtcattgctaacagggccacatatggactcttactctttcctctagacccccagagtgtagaatgtgatacacttttgtccttttctctgaggatgtgctgcctagtgtcgtggaatctgcctgaccattgcaagcatccaattttgtgaccagttcttttgcaggaaattgtttctgagaagactggaagacaagaaatatcccacctcttctaacaagatctgaattgttcgaaaagcagccagtgcctaacttgtagctccacttatgccaactgtatatatacctctcgtgagcatagcaagtgatttaatattttgaaaagatggctaaaatccttttaatgaacagcactaaagttatatgtattagaggagaattattgaatgagatggagaaagagttctgaaattaatatttacattttggcttttttacagataatattatatttctgagtgaccagacgaaagagaaggagtagaaaggatgattcttctttggccatcatttggtacagtctcatttccaagtcatgtataatctttatggcttccaaggacaagaattaaaatactcttttacgtaaaatgagtaataatcttttttctgactgtcgttctcgctctcctttttgtggtataatcttggtagctactatctgttatggcatttactagttgtttattcttctaagggtggtttctatgtacaggtatacaaaatagtaaactttcaggctcatttgtgttatggcaaagggataaatatgctttgggaaggtctcctggtttttgtatacacttttattacaatattgatttgtccaatcagtgaatttactgagcatcactgtatgtgagacatttatcccatatttgtaaatattgattttcttaacgttttgctctgtagacatgaaggcaaggactgaatcttctgtttgcctgcactttaaaccatgctttacatagaatagccactcagtaagcattgatagatgaatcatcccaatgggattctaagcttcagctcaaattgaagggagttgctgagcagtggttagtgtctaacctaaacatctttaagactaacctaccttcttcatatcttttgtttttggacagtttcattagtagcattgatgaaacatagtttaccagcaataaggacctgaataattagagatgaaatcgttcatctccaggtgatgccacaggagctgtagttctgttctttctctgcccctgttatctgtggggaaaagaaagagagatcagactgttacagtgtctatgtagaaagaagtagacatgagagactccattttgttctgtactaagaaaaattcttttgccttgagatgctgttaatctgtaaccctacccccaaccctgtgctcgtagaaacaagtgctgtgtcgactcaaggtttaatggatttagggctatgtaggatgtgctttgttaaacaaatgcttgaaggcagaatgcttgttaaaagtcatcaccactccttaatctcaagtaccaagagacacaaaacactgcagaaggccgcagggacctctccctaggaaagccaggtattgtccaaggtttctccccatgtgatagtctgaaatatggcctcgtgggaagggaaagacctgaccatcccccagcccgccacctgtaaagggtctgtgctgaggaggattagtaaaagaagaaggcctctttgcagttgagataagaggaaggcatctgtctcctgctcgtccctgggcaatggaatgtctcagtgtaaaacctgattgtatattccatctactgagataggagaaaaccgccttagggctggaggtgagacatgctggcggcaatactgctctttaaggcattgaggtgtttacatatgtgcacatcaaaagcacagcacctttttctttaccttgtttatgatgcagagacatttgttcacatgttttgctgctgaccctctctccactattaccctgttgtcctgccacatccccctctccgagatggtagaggtaatgatcaataaatactgagggaactcggagaccagtgctggcacgggtcctccgtatgctgagcgctggtcccctgggcccacttttctttctctgtactttgtctctgtgtctctttgttttctcaagtctctcgttccacctgacgagaaacagccacaggtgtggaggggcaggccaccccttcatctggcgcccaacctggggctaagggatctattctatttatttgcgctgactgaattttttcttccactaatttaatttcttttgttgcctctggggttaatattcttttaagtctggttctcctcttaagatagagagcaaatttgacatggcataagtaggaatgcctaaagttggccgaatccaattaatatcgcctagcaatttttgaaaatcatttaatgtttttaatgtctttttttatttctattttttgtggcttaatttttctattttctatctgcatccctacataatgaaaaggagtagaggtttgaatcttatcagatactattgccagtcctgcgttggcaacctctg

SEQ ID NO: 16221 - DNA, 6623 bp, Human
gcccacctggagatgcaaacttatcagtatctcttccccaccttctccatcacactcctctggcctccgtggagatgcatacctgtcagtgtctggtagcagtgcaatttgaatgtgtctgtctccagcatctcaatgcctgagcttccctgttcaggagacagctgggagccgatggcaaagagcctatatgcaaaggaggcaaagttgctctaaggaaggagtgcttctcaaacttccactgaagtgtccctatttgctgaggagttcacattacagcctgggacagtcaggagaagtagtgtgaactgactggcagtagtgtcaaaatttctaagttcatttgaattctgtgaatattttacattcatactttgttacaagacattttacatctaaaactttgggtaaaatgaatactctaggaatatgtgccacgcttactaagcttgtgtttaagcaaaggccggcacatctgatatcacaattgagagcagaaaaagtttaaaggtcatttagttaaactggctttctttaaatatgaagaaactaaggctcagagaagagaagttgactttaagtaagatgacacctcggccgggcgcggtggctcactcctgtaatcccagcactttgggaagccgaggcaggtggatcacctgaggtcaggagtttgagaccagcctggccaacatggcaaaacccctctctactaaaaatacaaaaattagctggtcgtggtggcacgcgcctgtaatcccagctactcgggaggctgaggcaggagaatcgcttgaacctgggaggcagaggctgcagtgagccgagatcccgccactgcgctccagcctgggtaactccgcggcccctccccacccagcaaaaaaagatgacaccactgccgttattacctaaaatctagatctggatcggttgcgtttttcataacaccagaacgacgatttaagaaaaggtagacaaattacaagcgctgccgttcaggagacgggggacttacgagtggaacatggaggccagcataagcttctcattagaagtgaggcggggccggccaaatcgaatggacaccgggtaattagcagggttacccagatactccagcacctctttcccgtcggccgtgtacctgccattcacgtccatgccattgatggccagcactgcatgacccactgcagaggtgaagctaacggtcagcgaaggtgcagcccggggattccgccgaggggacaagggacccgacacaaccccttttcccccaaccccgcacctacaaccagcccacttctacagcactggggccctcccacccccgcacccgccacgggcccgagcctagcccacctcggatgccgtcccgctggccgaaagcaaccaacacacgctcatcgtgtagcttgagcagcagatccagcggataactgaaagttttctcagcctcagcccgtggcgcgtagctgtccaactggtaaatcaagccgccagctttgttcaccacatacacactaaaaatcgccatcgctgccttgccgctcggaaactggtattcagcctctacccgacggcccctccccggaaccgcatcacagcacttgccgccggccccaccccagcctcctcctcctcctcctcctcctcccgcgccccccgtgcagccacctgctgcacttgcgcactgggagcgacacgctcgggcataagtagtgccggaaagttagctgccgagacctggtggattgcttttcgtttatcagtgcaggaaaacagcgctatagtactgcgtcacaactagcgcagactccggcagtatttaggcggtgcggcttgggaactagaatccacttcctgtcttccgcctcaggctagagggcgagcgcttcgccgtgggacttcttctgcctggctccgcctcttgccccggaagtactcacagcggacggtggtttttgggcccgtttctgagcagcgcttcctttttgtccgacatcttgacgaggctgcggtgtctgctgctattctccgagcttcgcaatggtaagcttcaggggtgtgaagtcgccggcgttcttgggtttgaggactcagtggggagagccttcggcgggagcgctccttggcctgccggcctcggttgcagggcgggcgcggttattgcttggcccatgtgctctggtggtggagtttgcgggggctgagggcgcagtattaggggactttggcgctatttgaggacctggttgcattcccgctgccctcctacagccgcctaaggacgacaagaagaagaaggacgctggaaagtcggccaagaaagacaaagacccagtgaacaaatccgggggcaaggccaaaaagaaggtagaaataagacctctctgaaagagactaggggtaactctctcgtaatcctctagtaataggtaacttgtatagtaagtggtttttcaggtgtagatttctagagtcaaaatgtgagagtttatcttcccgtcaccactcgttctttttcccattaggatcatgaaaatgggtctgttgtgcgaagtgtctgccgctgtgcctgctgtgttatttttaactgatctagtggggctcggcccctgtttgaaggccaaaaacgtgtcggtgttttttttttgtttttgttttagtaatgtgtaatttatccttgataacggtggaacagatttctctgacgcagattactcgagagggaaagggtgcttctgccagaaatactaacttgtttctgttttgttttggtgagcagaagtggtccaaaggcaaagttcgggacaagctcaataacttagtcttgtttgacaaagctacctatgataaactctgtaaggaagttcccaactataaacttataaccccagctgtggtctctgagagactgaagattcgaggctccctggccagggcagcccttcaggagctccttagtaaaggtgaggggtgtatcctacatgtgtgtttttgtaggttaaattgtcttgaccatgttaagcatcttcagtggttttgctggaaaagcagaattaaaaaaaaaaagcgtggcttgaccattggctgttagtaatgtaattctgacgtcttactcctgatcctgagatgaattctcagggttcttagccacttttgtgccgtggaccctgtggcagtttagtgaagcccaaggatcttttatgtttcgagtaaatggatgcatagaattacagggacaaccgtttttgaaataattagattactattttgaaacaactttgaaaatgtttaaaacctttatggtaaatattttgttgatgtattaaattttaaaaccagaaatttagtacggtctactcagtagtatggtctgattaccataattccacaataataaggctcagctaactatagtgactgaacgtctataattctagcactttgggaggccaaggcgggtgaatcaacggaggtcaggagttaaagaccagcctggccaatatggtgaaaacctgctctactgaaagttagctggacgtgggggcacacgtctgtaatcccagctactcaggatgctgaggcatgaggatcccttgaacccaggagatggaggtggcagtgagccgagatgacaccactgcactccagccttagtgacagcaaaagactgtctcagaaagggggggggggtggaagataatggagccctaatttaaaggaaaagtaaggatagatgatcgttaaaaactaggattctcggttaccgaacgtcagattaagcaattctggagccaggtgcagtggtacccttgtatttctagctacttgggaggccaaagcaggaggatcatttgagccaaggagttttaagaccattctgggcacctctgagagaactctgtctttttgttttccttttctttaaatagagatgcggttttgccatgttgcccaggctggtctcctgggctcaagagatccacctgtccaaagtgctgggattacaggcatgagcctctgcacccggccaaaacaaaccttactagagtctcattctgttgcccaggttggagtgcggaggggcagtcttggctcaatgcaaccaccaattcctgggttcaggtggtcctcacctcagcttcccaagtagctggaattacaagcatgtgccaccatgcccagctaatttttgtatttttggtagagatggggtttcaccttgttggccaggctggtgtgcaactccttacctcaagctatctgcccgtctccacctcccaaagcagtgggattataagcatgagccaccgcgcccagccaaaaaccttactagtttctattgtagcatctgttaagcatctcatcgtgctattctctccccctaggacttatcaaactggtttcaaagcacagagctcaagtaatttacaccagaaataccaagggtggagatgctccagctgctggtgaagatgcatgaataggtgagtaggaatgtgtgggctcatggtgtaggaggtagatacaaagctttatggttctgattcttttaatttttttttacaggtccaaccagctgtacatttggaaaaataaaactttattaaatcaaatgaatgagtatgtctgtttcctaagaaagacaatgataaagaatttggtggaaggtataataggggtttgttgactttgcttttagcctcatggtagttggtagagagcatgattagcttttttctgtatgtgactgcttcttcattgctgcagcttcagttttgaattgatgtctgaaaggaaataaagggttaacacgatgatgaagggtgacatctccaaaaaggaggttggatgggtaggttggagacccggcactgaacacacatacctggactgccagcggcgtccattattccagacgcggccaaaagagggcagccagcctgcactggtcctggagctgtgatcaaagttggccccaactcggtctggggggagttttttcaacttctgtttttcctctgtacaatgatagggaaacttttatttttctttattgaagaatatagagatggggtctcactatgttgtccaggctgttttcaaacttctgggctcaagtgaccctcccacctcagcctcccaaaatgctaggattatagccatgagccaccacacacaggcaaggaaaccatttttgagtgtgaagatttagacgatcctctcttgaattagtttacttactttctttaagaaattcttcataggatggtcctatttcttggttcccagcaatgtattcttcatcttggatcatccagggaggtgtggcacctgaaaaaaaaattaaggcttttttttttttttttaagtcttcaggctattgtgaaacatgtcctagctgttagcttacctctcctcattaagagctagaaatgtctaaaagcaaagcccaggaattctggagctttagaaggccctaggctaatttaaagcgacataccccatatgtgacagtcattttaaaatggctttgaggcacaactgacataaacgatacacacttaaatttggtgacttttgagcgaagccattacaatctagaccccaaacatccccctgtaagtatcactgcccccattaaaatattttcatgtccaggcaatcggtgatctttcagttgctttattggtttgtattttttaggattttctgtgtgtggacattgaggtggggtctggccttttgtttttttgagaggagtctcgctctagcccaggctggacacaatctcagctcactgcaacctccgcctcccaggtctcggttcaaacaattctgcctcagcctcccaagtagctgggattacaggcgtgcgctgcgatgcccagctaatttttgaatttttagtagagatggggtttcaccatgttggccaaactggtcttgaactcctgacctcgtgatccgcctgccttggcctcccaaagtgtcgggattacaggcatgagccaccacgccggccaggtctggacttctgagattcatctgtgtcgtacgtatcaataattctgtcttcatcctggaatactattccattgttaatccatttgcctgttgatagacatctgaattgtttccaatttggagctgctacaagtgaagctgttctgaagatttgtgtacaagtctatgtagacaggctttcttttctctagttaggggtggaacggttggataatgtggtaggtgtatcccaaactgttttccaaagtgactgtaccagtttacattctaagagcagtgtatgaaggtttggtttttctacactgccaaacacttggcatgatcagtctttaatttctgccattccaatacatatgtagtggtatttcactgtggttttaatttgcatttctctaatgactaatgttgaacattattcatatgcttttattgggttgtttccttatcaagttgacagttcttcatatattctggatataaggcttttaccgatacatacgctttatcttggccaactttatttaaaaaaaaaaaaaaagtccgggcacggtggctcatgcctgtaatcccagcactttgggaggccg

SEQ ID NO: 16222 - DNA, 43562 bp, Human
  misc_feature (1)...(43562): n = A,T,C or G
atcagtaacactgtgcatagaaaccaccgttaagcacttcattcacctgttacagagatgccaaattagctcttcagtttagcttattttagagtgctagttatatttgaacttgatacctatcctccaaaaaaaccaaaatatttccgaacattaactcacagtctttcatgtcatctctgaacaggaaaggggacatttgctgccttttgcttcagaaaaatcaaccaccatactgaatcatgtaatggaaatacttatatcttgttctgaggttgctgctcagatcttgagtgaaatataatcacatggtaaggggacctgggccctaaacacttcatcctgtctacagctaaagaatagtacagtatatgagaatccatcaggatcatcacttcttacatgtgttcgtattgtcagcacagaatacgtagcaagtgttctacagacgtcgaaagaactagcaaacccactgttgtttgtggcgctctcacttcctgtactattttattactcaagataagcctaaaagaacagacaaaactatcacgaaaacgatttcttaacagaactattttaaaacaagagaatcctcaattaaaatcatgccattttctttctctgaaatctttaaattacagatgtgctcatctttgttgcctggatatgagttctttcagctgggcagcgggagactcaaagtagtgacttttaagggatcctaccagaggtgggggagccaatataaattacgtatcctaatctgagacactcttctgtcctaatacctgaagcttatagcttgtcaggtggcttttccatggaaaaacgaggacataagagagagggcggaccttaagagttctacggaggagccggtaacggcagcaggcttgtcaatcaactgcaaggttgcagcccaaaagaaaaagaactcacttgatcgctcatcatcgactcctcagaggccctctaggactaccgagaatctcttgccctttggctcttgcccccgacatctctcctggccccccgccctgccccaggaggtctggtcctctcacccgctgccaaattctcacacagcctcaaagggatcctcagggcgtaaagcagccccagccccgccacgaaccacaacgaggccccagtccccgccagcccggcccgcagtcgctccctccagcctagcgtcgggtttaggccagggacagatgcaggagacgctccaacagctgcggcttcacccacgccgccacggtccgccatcttgccgctatcgcaggcgccaggagctgggaggggagaaggacaggaaaccgggagtcgggaatcctgggatagtggcggacctgaagttggcctctgtgaaggctgagtcctggggaaccgggaccgagaagatttcgaaggtggaggagcgtgtctcaagattggggctacctgttctttcgtggggcagggaaggggcggacagcagcgcctattctggaggaactggactgagatgtgaccccgaagtgttaccgcttccaaacgaaatgagggtcacctttcacaccgccccccccccggggttggaaaagccaccgatcgttccagctgccgagcagctcttaaagctttggattcggctgtcgtggagataacgggcaccagaaaaacttgtaggagtagcaacagctatttggtcggatggaggccagaagccaagaataatcgaaacacgctgccagcgcccattagatggatgggaaatgagtgtaactcattgggaaagatattagacttcaaatcacctaaggcaaaccctacttcctggggcgcgggcgcgggcgctggcgttaggagacgtcactcccgcgcataactgacatggggccctcttggtcggcgtttccgggcgggtccttccgacggccgccgcggtgattccatcactcggctttcttcccggcctgcctcgcgcccgtagccgggctgggccagaacagcccaagatggccgacttcgatgatcgtgtgtcggatgaggagaaggtaaggggtccgcctctctctcttacctcctcccccgacagggaactggggcccggcccggctgcgttgggagcctagcagtgtccccaggaaaaagaagcttcttggtccatgctgacatacgctctccgcagtcgggacgcttccctcttagggggctttcctctgcctcacggtggccccagttcctcgttcctcgactctccttttctctcaggcctgaggcacagcccaggggcctccctgcaagggaacagacgtttcctttattggatcgtgactgtggacttttttctgtaattttgcgagagggtggtggttatgttgcgacatatcaaaaagcagttattttaccgcctttagcagttggggctcaccccatccccccatttgtagatataattggggttagtttagggcgagtcacttcctggtcaggatggcctcttaacttcccttttgctcctccttcctcaggaagtgattttgctgtcacgactcttcgacaaggagaggtcccaaatgttgtccatctcactacacatgcactacttttctcctgtactgtcgcctgtctgattcgctataataaatctgtgagcctcagggcatttgcttcagaatttgaacaccagtctttccctatagacacatcccttttaacgataatttttgaaaattttgtttcttgttaacaaatctagaatagctgatggattttcttaacctccagaaaggttttctgtaacacataataaaccttatgttaacacgttcaagactgaacaaagcatcctgccttctttgatgctccactgtggagtctttgatcagttgaatttgtcagtgtgcattttgtatgctcatttcttgaaaagggtcttaaatacaagagcacattctaaggtggaataacttttcttctgacagttgcacagtttcataacagtttgtcaggcttttcagtaagtacatggttttagggcacgtagaacttagaatgacctcacaaggcaacttattagacaagaattatgacatttgtctcccactgtggctattagaaaatgtgtccccttgagtgctctgtaaatctacctgggtgtttttttcaataagaagttggtatgggaaggggactgttatgatccataagtcctctgtacggaataacttgatatatgtagatatggcatgccattttgaaatgtttaacaagccattgacaacagcgttagattttctcttatttggaaactgatcttcatacatgtttaagatttaggacaaaaacatttatgtataagcctatgctggaaatcgatctataataaattgttctaaggcaaatagttactattcaaataaaattaagcaaaaatcctgttacaatacaactaaacaatttttttttttttgagacggagtctcgctcggctcactgcaacttccgcctccccggttcaaattattctcctgcctcagcttcccgagtagctgggattacaggcacccgccaccaagtccagctaatttttgtatttcttgtagagagtgggtttcgtcttgttgcccaggccggtctcaaactcttgggctcaaacgatccatccgtcttcgccacttaaagtgctgggattacaggcgtaagccaccgcggccggccaaaatttcacaaataatttaaataataaacttttaagtttattgtgcctacctgatacacattgaccagtgttgttggatttttgtctttgataccaggttagaatgcctttaattaaacttgggaaaatatatattttaaaatgccaattaagatgcctttagatactggcagtgttttaattaataacattaatgtcttgggttatggttttttttttttttttttgagatggagtctcgctctgtcacccggggtggtgtgcagtggtgcgatctccgctcgctgcaacctctgcctctctggttcaagcgattctcctgcctcagcctctcgagtagctaggattacaggcgcccgccaccaagcctggctaattttttgtatttttagtagagacggggtttcactatgttggccaggctggtctcgaactcctgacctcatgatctgcccgccttggcctcccaaagtgctgggattacaggcgtgagccaccgagcccagccagtattgttttttttaatagcagatctgtgaccagtttcctcttctagcatactttttttgttgccaagtatattttaatattgttttttatctttgttacattttctaaaggcagtgaacctttagaaaatttggtgataatggactcttagtttccttgtaaatatttatgtaaaagctagtaatatcatctattctcataactgctgaagtttttttaatcactttataaagaggaagttgggttttgttacctgaaatggtcatgatgagctgtctaaataaaacaggaagttgaaagtgtaataacttttagaaataaatcttttagttgtagctttgagttcacagtttctgagaatgaacttgagctctttagttacatgcttagcaagaccaagatactataattaggaatcctgaaatatgagatgaattacttctttgggttcttttcattgtctatttcctttatttcattcaacatttgtaaaacataaaagcaaagagaattttggggggctggaaaaaagtgtgactagcatattttttcccttcagcctaactagtggaatatttgtgtacaatttcaaaagtatggtaattgagaagtcatgctttcagtttagacaatgctttcagtaataagataaagttttcagtattaagaaaaactacatgctttcagtttagacaatggtagtggtgttaaggcatttttgagaaacaagtttatcaaaattatttagtagagcagtagaaaatgttgtaaatagatgaaatatgagggctttgttagagcacatgaaaaatattttatactttttttttttttttttgaaacgaagtcttgcactgtctcccagcgggctggagtgcagtggtacgatctcggctcactgcaacctccacctcctgagttcaagtgattctcctgcctcagcatcccaagtagctgggattacaggcacctgccaccacacccggctaattttttgtatttttagtagagacagggtttcaatatgttggtcaggctagtctcaaactcctgacctcgtgatccgcctgccttggcctcccaaagtgccgagattgcaggcgtgagtcactgcacctgccaaatatttatgcttttaaactggatccttgattatgtattacctccttaatttactagttaccattgtaggataaagcaagccctaaagattgtttggtgtggctgttttctaacaagtcatcaattaatattaaaactgtcattcttccatcttcacttttcagttagttttgctgagaggtattcatataatctgttaagacatcctaggacaggccgggcccagtggctcacgcctgtgaccccaacactctgggaggccgaggcaggtgcatcatctgaggtcgggagtttgagaccagcctgaccaacatggagaaaccccatctctactaaaaatacaaaaattagctgggcgcagtggcacatgcctgtaatcccagctactcagtaggctgaggcaggagaatcgctggaacctgggaggcagaggttgcggtgacccgagatcacgccattgcactccagcctgggcaacaggagcgaaactccgtctcaaaaaaaaaaaaaaagaaaagaaagcccgggcgcggtggttcatgcctgtaatcccagcactttgggaggccgaggcgggtggatcacgaggtcaggagatcgagacctgacctcaggagatcgagatcctggctaacgcagtgaaacaccgtctctactaaaaatacaaaaaaattagccgggcgtggtggcaggtgcctgtagtcccagctaatcgggaggctgaggcaggagaatggtgtgaacccgggaggcagagtttgcagtgagccgagattgtgccactgcactccagcctgggtgacagagcaagactccatctccaaaaaaaaaaaaaaaaaaaaaagaaaagaaaaagaaatcctaggacaggagcataaagcctaataagcaggtgcaaactcacatgtccagtcttgttagtagtactgatttatcataatttcttccagaacacttagctgttttattacgaccaggcttaatgctaaacaaagtagtgtaaatttgtcagaaaattcagatcccaggtttttctgattatgtagccatgcttttttcactatacttttcttttccatataggtatgaatgaaaaaccagagtagagacatccatttagtggattataaatgaggtattatgggctgggcatgatggctcacgctcgtaatcccagtactttgggaggccaaggcggtcagatcatctgaggtcaggagttagagaccagcctgaccaacacggtgaaaccctgtctctattaaaaatacaaaattagccaggtgtggtggtgcatgtctgtaatcccagctactcaggaggctgaggcaggagaatagcttgaacccaggaggcggaggttgcagtgagccgagatcgcgccattgcactccagcctgggcaacagagcaaaactccatcaaaaaaaaaaaaaaaaaaaaaaaaagaggtattatgatgtaatggaaaagagtgattgtgagtgttagatatggcctttccctttcgtgcttctagccaccttgtcactgattttggaaacctcacttaacctctatgggtgggcctcaatttccatctaaaatagagaagtagggaggaattggatcaaaccagcccaagaaaatttaattaactatttcaaactctaatgaaaaatctctactttaaaaattgaaacacaaaaatgttctgggaggttctattcattgtctgctttcctacatttgccctgattacaagactgagttccttgataattgaaaccatgtctctttatctagtgcctagcatagtgccaagcacacagtgtatgcacagcctattggtatgaaagagaacacaacttcattaattctcatatctctccagttcacaccccttcatctcctgtaaaacaccccttcccctacaattatttctgttagtctctaggtgtttcttgtattcaagagtatgtccacagtttgggtgcctctgtgcattccttctatctgagcatctgccatcattggtgctctgccatgccactgctgggaacatttgacccctctgggagcatcttcctaatagatcccataaactgcaaagccttatggttaccaaaatgatggtgtatatatatacttggagccttgcaaagcccctaatgaaagtatttccttcaccagctagaagtactctcctttagcgatcagattaaaacacacacccaggtgtgtgttttaaagaaaaaggacccaagagggaaaaagtttccaaggcatgaatgaattaagagtggcaaatgctactgagatagaaagattaggacggagaaaacagcactcactctgacagtattctttccaactggatttggtaaataagagtgaagaggtacctcgagtgagcactgggagaagtcatactggaagggataagcagtgattgacataagaaagtaaaataaattcaggttcatccagacacccccataatcttgccttgacccagaaacattgtgttcacaggactttcagcttcccacccccataagtaagcttcctaattatgatatcttggtcttgccaagcatttagagggccttactctgtggccctccagatagtgatttgaatgattaagtaaacctctttttagataagtgttctagtccagtctaacatcagcttgttggtctttttggcactgtcattgtccagtaccagcacattcttggctccttgccacatctctggcctcaatgtgggaggcaaagacagtgagcatttccagagtggtgagatgggtgcagcacataatgaggcgatgaccacacagcatctctgaacagcatgtccacacagggctcgaagtcattatgctgcatgtccacctcatgtccacaatagctgagcagttgagattggtggagtggaccttctcattactcatcatctagaggaaggtcctcatcatctctacttctcaaaggggtagaattgaacctgaacctgcttgacagacaagagcccaagcctaaccaaggtggctgccatggtgacccttgccctgaaagccatttccattaatttaaaaattgtaggtatataggaactataataacaggcttaaaattaaaatttgctctgtttgttgggtcacacgtgtaatcccaatactttgggaggctaagccgggacgatcacttgagctcagaagtttgagactagcctgggcaacatagtgagatcccggtctctaccaaaaaaaaaaaaaaaattaaaatggtgggacagggcacaagtaaaaagtcgcctcctgcccctgtcttccacccacccagtttccctgacaagtagccaatattaccaattcctcttgtatcttttctaattctatgcatatacagacacacttttcacttaataatatctctaacctgtccacattccatctaccattattttcactcaggacctttttttatgcttgaattatttttaacaacatttttaattatctctctgcctcaggcctctcctttctttatacatccttcctggtttatcataaattcttcacagctataacgtattacaaaattttgagcagtgtgtaaaatttatctttggtacaactgcacatacagattgttaaggcagtgtcagtgaaatggaacattgatcgaattctgttgagtgtagtcatggtataacatactgtttaaacaagaaaacagcataatggcagactgtagcaaaggaaggtggtaagagaactttgctttgtggattctttgttttacatctgggtaacatttaagtgcttcttttgtgctaactatgtattaaccatgtatttatctcacaacatccttataggacagatacttatgcccattttacagtagagtaaactgaggcacaggcacatttgaggttaaaatatatgacccaagtgtccagaactaataaatggcagagtggatacaatgctgttgtctgctgtcagagcctatgctcttacccattttgattcctttaagtagatagtaagatagtaagcagttttgatgaaataatgacatagtcctaaacagcaaccaagttaatcatgtagtaacctggatgcctttatagacactgaaacattggtgttctgtggtcctgattgcattataattgttgctgaatggccaggtgcggtggttcacacttgtaatcccagcactttgggaggctgaggcaggcggattacttgaacccaggagttcaagaccagcctgagcaacatagtgaaaccccatctctagagaaaatacaaaaattagcccagcatagtggcacacgcctgtagtcccagctacttgggagaatcacttgaacctgagagtaggaggttgcagtgagccgagatcatgccattgcactccagcctggcctggccgacagtgcgagactctgtctcaaaaaaaaaaaaaaaaaaaaaaaaagaagggccaggcgtagtggttcacgcctgtaatcccagcactttgggactttgggaggctgaggcaggcggatcacctgaggctaggagtttgagaccagcctgaccaacatggagaaaccccgtctctactaaaaatacaaaattagctgggcgtgatggcgcatgcctgtaatcccagctactcagcaggctgaggcaggagaatagcttaaacccaggagacggaggttgcagtgagccaagattgcgccattgcactccagcctgggcaacaagagtgaaactctgtctcaaaaaaaaaaaagttgcttagtgctctttgagcttaagtatgccgtgaagagttctagtatttatgctgtgttattaaacaggtgttgaaaaacatggctctagaaatttaaagatcactaaagtccccgtaacaaggccaaggagaaactttacagtatgacagtatcttagaacatccttgcctatggcagaatctgtgtttccttcaaaaacagatttctgagttccatcctaggtatattgaatcagaattttttggaaccagttgtcaggaattatttgtaataagcctcccaataattattggaatacttgagaaccattatcttagtgaacttgctgtggttcaaatcttagtcctctgcttatttagctcagaagcttgattgatcaggatactaaaccaggtctctctcggggataaactcattttagctaggcttatgaaactaatgtataaaactggaataacaatttaatacatatagaaggaactaagttctttttttcagataggtcaggaacatgggaaatcaagttagaatgttttaatggagcatagaattagaacaaaggaagttaactagatagtccaaagtattgatggcattttgtttcataataggcatatgtacccaacaccaaaaccaagtcacgtctttgtataacagcattggacatttttcctctagataggttcatttgttatcacattactagcaggggagttttgcaggactggttatgtgtcaaaattttgcatactgcagcttctcctacagtctgcccgcccttggttaatgacacttccattctttagttgctcaggtcaaaaacattagtgttatctttgactactatttctttcacaatccacttgttgtccactggtaaatcctgtaggctctgtctttaaaataaacccagaatttgactatttcttaccacacccttattctaaccactctggaagaagccattgtgacctctagattattaaaatactattttttatggtttccctgcttctgctgttgctcctgcccagcagtctgtcctcgatgaagcatccagagtgatctggttaaaatgtaggtcagtacatgtcacttttctgctcaaagccctccggtggcttcccatctttttctaagtccctatgttctgggatgttacctctttgccatttatctctgactttatctcctacatgttcttcttctggtctttgttccaatcacgtattctcgctgaataatctttgcatttgttcttttctctggagttcttttccttctgtatccctcatttcagatacttaaccagaagtcatctccttagtgaagctttctctggttattctgtccagttgcaaatcctaacatttcttgtcccttttctttgccttgttttttctccttagcatttatcacttgccaggtagtattttacttaatcttctctgttgtctttacccactagaatgtaaactccatgaggacagtatgctagtgagtcaccattgcctaaaacatagtgggtcttctgatatttgttgaatgcatgaatcttgcttggatagcatctgtcttgatttcattgttaactctcatagggcagtctgatttccaagttttgtgaggccatattgaggactccagtacttctgtattactgatagatttttattaatggagctttgtcctcagaaagctttagcaagtggccattgccaatgacatacggaatgaaaccagatttggtattaccatcattactgctatctgacttaccttagttcatccttctcttttattctctccaaatcctctgttctaccaaacaagagagtgttttcccactaccttttttgttcttattccctcactcatagtgccctccctttcctcccttccaccctatctaaagtactttgcagagcccagcttctccttttctctgtagttgtcctccaccaacccagctcaatatccaactccttactcttaagttctgtgccttatgttatctgtactactgctttggcagttttgctgcttagaattatagttgtttttaatttttttattttatttttgggacagggtctcactctgtcaccaagactggagttcagtggtgggatcttggcttactgcaacctctgcctcctgggctcaagtgatcctcccacctcagcctttctaatgagtagctaggactgcaggcacgcaactaatttttaagtattttttttgtagaaacagtctcactatattgcccagactggtctcaaactcctgggattacaggcatgagccactgcacttggcactcggccctggcaattattttattttttattttttaattttttatttgtatttatttttatttttgttagagagtctcactctttcgcccaggctggagtgcagtggtgccatctcggctcactgcaacctccgtcccccaggttcaagcgattctcctgtctcagcctcccgagtagctgggattacaggcgcctgtcaccacacctgcctaattttttgtatttttagtagagacggggtttcaccatcttggccagactgatcttgaactcctgacctcgtgatgcacccacctcgtcctccctaagtgctgggattatagaagtgagccactgcacccagccggattttttattttttgagacgagacatcattgtgtcccatgctggtctgaaactccttggctcaagcggtcctcctgccttggcctcccaaagtgctgggattacaggcctgagctcactgtgcccagcctgaattaaagttatttttaaatgctggcacatctttactgagggctattatttgtataaattgttttgttaacagtggtaaagtatacagagattggaaagccaaggtgcttactgtatgttatattcgtcttatgttgtttgtatctaccaggatgaattgcactttatattagcttaaggtagtggctgtcaaccctgacagcatgttagaatcacctgaggaagcttttaaactgatgcccaagccctaccccagactagtacatcagaatttctgcaggtggaacccatatgtcaatatagttaaatcttcccaggtgattctaatgtgtagccaaggtccagaaccactgatttaaggcaaaagataatttgttggcttacctctttgacaatcctactctttgtctttatctttagtattcacctcagtgcctgagaccaaatgaattgttttgtggtttgttttgagtgaatgaacaaattgttaaacacaaagagctgaactttttaaaagacaacataactcagaattcagtgatgtctaggtatttgcttagggaagaaaattaaggatctgctgtatgggagtctgtctcatgttacctcatgggttcttaaaacagtcctagatatgagtaggttttataatcacaaatgaagaaactaagacccaagcaatttagcagtaaagctggcatgtgaaactgtatctgactcccagtgattttgaggaaaaaaaaaattggtaaaaagatatactttaagttagaatgccgtaacatgccagatacataccagatcttaaaggcaaaaccgttcttgtttcccactgctgctttttccatctagcctgggttctcaccgccgaactttaccctttcaaacttgacatctacatcattgctcgctaacacgtgaatctcaaggtacctggtgtggtcatttttccctaatttattttatttattcttgggcaacctccggaccagaataggttcaaagaggctttttcctaattttttaaccttgtgggtatttttttaagcacatttaagctcctaaacaagttgcttatgggatgttttcactcattttaattttttttctgtgtgttgtaaatgttatgcttaaatgtgtcatttttaaacactactaagtggtatgaaatacaatgactcttagttaaagtaaaaattattctaatgcatgttaaaacagtaaagaagactattcaaaattattatggccaggtgtggtggctcatgcccgtaatcccagcactttgggaagtcaaggcgggcggatcacctgagatcaggagttcaagaccagcctggccaacatggtgaaaccccatctctattgaaaatacaaaaattagcagagcctggtggtgggcgcctgtaatgatcccagctgtttgggaggctgaggcaggagaattgcttgaacccgggaggtggaggttgcagtgcgccaacatcacgccactgcactccatcctgggtgacatctcaaaacaaaccaaagaaaagactattacaataggggagaaaaatcaggctcaactcctaatacagtaaagacagctgggtatttacgtatagccaataagcagagttggggagaaaattattaagaggagaccatgagggtagggggattcatgctgaaggcagttcaaagacttacacatcaaaagtagggaatgaagaacttgatcagatatcaagggtgggcagattcttgctaaaactgggctaggcaggccaaagacagggggatgtggggcagggaggcggggtggggtgtcaaatcctagttcaaaagaggccttagagagaagcctaaagtttgccattccatgtgttgtgagatgtacataattgctttagtaaatagtcaagtgtttaagacataccagaaaagcaattattccctagagtttgtagaatgttttaaagtgaaattgctctacttaaaactaacttgcctgacttccctacctacttatgtctaataaaactcataattggctactaatagagaaaacaatttctaaagactattaaaatgacttttgaaagagtgaatgtgaagcaaattatttggaaatgccagcatctattttttataatgttgattctgatttaagatatatctttatgctttcaagtcttatctcttgctgataatgataaactatatacatctacaattttatttctaagtacattctgtgtatctccaggtctcagctgggaaaataatatttagtttatttagaattttaagaaacacagataacagtaacttttatttagtgaaaccagtactgtatacattattactaactgtggtcaccatgcagtgcagtagagcactagaacttatttttccagtctcactgtaactgtataccctctaatttctatctttgatatctttcctttccccatcccttccctgacccctcagcctctggtaaccaccattctattctctgtttctctgacataggcttttttagattctgcatatcttatagtgagatcatacagtattcatctttctgtgtctggcttatttcacttagcatatatctttcaggtccatccttgttgttgcaaaagacagaatttccttctttttaaaagctgtatagtattccattgtgtgtatataacacattttctttatccattcatctgttgagttgattgatacttaggttacttttgtatcttgattattgtgaacactgctgaaatgaacatgggggtgcagatatctctctgacataccaatttcagttcctttggctatctatccagaagtgaatttccgaatcatatggtaattttagtatattgcggaatttccatgctgttagtattttccaaaatggctgtactaatttacattcccaccaacagaagggttcctttttctccttatcctggcccaagacttgttatcatttgtctttttgataatagccattctgacaggcatgaggtgatatctcattgtggttttaatttgcatttccctgattagagatgttgagcattttttcatatatctcttgcccatttgtatatctttgagaaatgtctgttcagaccgtttgcccattttaaaattgggttatttgttttcttgctattgagttgttttgagttccttatatatttttggtattagccctttatcagatgtatagtttgcaaatatttcctcccagtcacttagttgtctcctcttactgttaattttctcctttgccatacagaagctttttagtttgatgcaacatccgaaatatcttcaaatgggaaaaactcccttaggaaatagcattgaattctgtgcaagcagaacttaccaggataagaataacatcctgtacatatctctttcaggaaaaataaatgcaactatttattcttgaatacttttggaatgggttagagtgaaaataagtaaaataaatatttacggaggcatagtttactactattatactttctttaagtataccctatttggaaaactttaaaaactttgaaatatgtgttattacttcaaagggaaattggaacagacattttcataaagcttttttggtcagtaaaaagttgtgtagttattggtggggattattattatggcaatgatagagaatataaagtggctaggacccaaaggatttctagaacaagaggattattttctttgaagtagtaatttgatagtaatttgaagggtttgctcagtttataatttaaagtaagagttatcctgctgtgaccagttaagataacagtagctgacatttattgagcctctcctgttatattttaagtattctgctaaagatttgaccatatattgtctcatttaatctttacaacaatttttttaaatttaatattgggtaggttggtttctggtgaaaaccagaaaacctgctacacaaattctaaaagagctgtaacaactcccaacaatttttaaggagtacatactatcccactttagggagaggatgtggttcaaagagatttttaagtgactgaaattcaaaactgggtctgtccaatccagagcctatatttttccattttgccatagtacctcataataatctttaaaactgagaacatttcctttacatcttcttattcaaaaaggattttgtaaatatttactcattgcctgccatgtgtaatttaatttgctagaccctgtaatatatagaagaggaaagcaaggcagtttccctcccaaaaaaacttgagtctttggaggcagactagtatctatagaactaattatcagtagcagttatattttaggtgctatgataagcattcaaatacactttgaacactttttacggttgggttggaagaacccaaccttaaaaaatgggaaggatttagacagaccaagatagggagaaaggcacaactttcaaggagagtatgagtcaaggccaagaggtgaaatctttaatacattcagtagactaatgaaggaggtaaagatttttattgaccagggagacatgctggcagagatttggctcctaaagtatacaaaactggggtggtataaactgaccaggcctttgctgataagtggaatgtggatattatctagcgaaagaattctcccttttctgtctagaattatccaccagtgcccacaaagagttgcagttgttaaatatttaacttaaagttcgtttgtatgtgtttgtcaaggacttttttttttttttttgagacgagtagctgggattacaacacccagctaatttttgcatttttagcagagacagggtttccccctgttagccagctggtcttgaactcctgacctgcctcggcatctgaaagtgctgggattataggtgtgagccaccgtgcccggcccaaggaaataattttaaaagctagtgatggctgggcttagtggctcacgcctgtaatcccagcactttaggaggctgaggcaggcagatcatgaggtcaggagttcgagaccagcctggtcacacggtgaaaccccacctctactaaaaatgcaaaaattagccaggcgtggtggcaggcgcctgtagtcccagctactcaggaggctggggcaggagaattgcttgaacccgggaggcggaggttgcagtgagctgagatcgcgccactgcactccagcctcggtgacagagcgagactctttctagaaaaaaataaaaaataaaagctagttatgaataggtgcaatgttgatgaaatgtgtggggtctgttattaaaagattatctaataagctacagttttataaattccttaggacattttcttaagattcttgctaaaatatggtatatgaaaatctaagaaaattaagccacttctagggaaaatgaaacttaggacttttcagtgcgactgatttttaaactttcagtacagatactagtaatgtgaaaatgaaattttgaatcttgcaaggattggtttattattatttcccccttttagaggtaagagaataagacgaatgggaagaaattgaaatttaggaaatcttatcttttgttggttatatattttaaatcccccctttttaggttaggaacaaaatataattaattttatgctagtaattttattgtaatatttaaatatatgaaagaggaaattatgtaaaagcctcggatagtctccctttaaaatattcaaggagttacaccgtttagtgtagatactatctgatgaatacagtgtgtagtgaaactgttactttatgaaatagggacagttttttaaaggcttttttttttaagcagcagttcagtttttgttcaactaaaaccttcatattagtgattctcaagttagaggagctgacatacctcccctttatgggagataactgccttctttctttcactctcccacccttgagaatgattgactaaatcactgttaatgaaaatgtcatccctcatctgtattgtagcaaagatattttttcagtcactaactgcttagtcatttccctctccccttttgctctattaatttcatcttagctttgacccagttttgaagttggataaaatgttaacttttaaacttatttatcattttatctattcttctcaactttgtaacaactgcatttttcacaagcatagctttgactcaattcttggttaaaacagtctaaaaggacagtcaaattcatgtgacacactaaaggtaatcctccagacttatacttccttttaatactgcatgatatagttgaatgtctaagttacaattccagctccacccatttattataagcatgcaatcttagacaaggcacttacactccctgaacctatttcttgatttataaatggggataatagtctctcccctgccttctttaacaagctgttttaaagatcaataaaagaaacagcttacataagagttttataaacaataaaatagtattcattcattcacattcctagcatgttctaggtctcagtcctgggtatactgcagtgaacaaacataacaagttcttttgttctgtgtcaggggttgacaaactatggccagtgggccaaatccagtccaccatctgtttttgttttgttttgttttgttgtttgttgagacaggctcttgctctattgcacaggctggagtgcagtggcacaatcatagctcactgcagccttgaccccccaggctcaagtgatcctcctgcctcaacctcctgagtagcttggactacaggcatgtgccaccatgcccggctaaattttcttgttatttgtaatagagataagatcttactgtgttgcctaggctgggtctcgaattcctgagctcaagcgtttctccagctttggcctcctaaagtgttgggattacaggtgtgagctgctgtgctgggcccactgcctgtttttataggatctataaactaatgcttttggaatggttgaaaacaaaaaaagaataatcatatttcatgatgtgaaaattacatgaaatacaaatttcagagtacaaaataaagttttattggaacacaaccatgcttaacagttgggacagaaacgctgtgactcccaaagcccatctgccctttacattagcagtttattgactcttgctctatgatcttggactttgggggatgttggacagtaaacatgtaagtatatgttaagtggtggcaaattccttgaagaaaaataaagcagtaaaagggctagaattgtgaaggttggaagggtacaacagctaatttatatatgggagttagggaagggtagtttatttggcaggtaacatttgaacagagactaaataaagattggagtgaataatccaagagagcatttctggccaaaggaacaagaaatataccctgaggcatgagtgtagctgtaagtctaggagctaagtggtatgagtggaggaattagggaaggaggagccatggaacagactttagatttatttattttttgagacagagtctcactctgtcaccaaggctggagtgcagtggcactgtgttggctcactgcaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattataaacccatgtcaacaaatggagcacttctcaaacttttttactgtcaggacccctttacatacttaaaaactgaattttttttttatgtggcttatatctgttaaattagatattaaaactgaggccgggcgcagtggctcacacctgtagtcccagcacttcgggaggtgaggcgggtggatcatttgaggtcaggagttcaagacgagcctagccaacatggtgaaaccccatgtctactaaaaatacaaaaattagcggggccttatggcacgttcctgtaatcccagctactcaagaggctgaggccggagaatcacttgaacctgggaggtggaggttgcagtgagctgagattgtgctgccgcactccagcctgggtgacagactgagactgtctcaaaaaaaaaaaaaaaaaaatactaaaactgatttttaaaataactcatttgaaaataataaacctattacatttaacatagttatttgttgtttaaaaaaaaacctttattttccaaaatagaacaggaattagtgtgacaagtcacattgttttacattttgcaagtcttgtaaactcctgcgttcagtttgttaccacatgttgtcttagtttgtgtatattgtttcctgtactcggaatgccttccttgatcttaactactcatcctccaatccatctcaaacatcacagcctctgaagactaccccgcacctttttttttttttttttttttttttgagacagaatctcactcttatcacccaggctggagtgcagtggcgcaatcttgactcactgcaacctatggtacctgggttcaagcaattctcctgcctcagcctccagagtagctgtgattacagttgcctgccaccgtgcctggctaatttttgtattttttttagtagagatggggtttcaccatcttggccaggctggtcttgaactcctgacctcgtgatctgcccactttggcctcccaaagtgctgggattataggcgtgagccaccgcgcctggccgaccaccctctttttaatgtaggtatacagagttgattgcatcttcctttgtgcctcactctgcatttattacctgcttgctacattactatctaggcatcaggtccttgagggtagtgacaatgtcttatccagtcttcggtctttatttattgatacttctcttcctagtttgccgaatgggtgaattattacttttttatatgcggtatcagttcatcttctatcgaaacaaactgctgttctttcatttgtaccaattccatcagattttgtaacttttgaaaatttgggtgggacttcgggaatattagtatcttgaattttcagtttggtaattttattatacattcaaatattatgttatataagtagtatgtaaaatatggctgtggctttattcctttttccttgcagggaagttacttttttgatagtgtgtgaatatgtatatacttattttttggattacacacacttgaccgaggagttttataattatgtaaagattacgggaaatgcaccttgacagaaaggggatagaccatagctcactccacagatttgtcacaaatagaccaaaaaaaaggtttattattaaaagtaggattactgattttttaaataagagattgataccaacagttgaaaagtgcagaaatgtgattaagtgtacatgccaaggaaaatatagatagaaatctttattgtaacggttagtcctatgtagcataattttcatgagttgagcaggatttcttcctgattagaatctctctttttattgtttttgctcagttaatataaggagccttatggagcatttcctctccaccagttttcatcccagaaaaaataatacactatctgtaattaccctgtcaaggcagggttctaaaactttatgtacctaagaatattctaacatgtatttttgtggcgtgaattcctgatgcctgtttccaggtagtccacataccaacttttgtcttccaagtcttaaaaaatgtgtaggatttgtagctaaaagaaattttgcagatcttctaatatgactctatgaggagatggattatcatgagaaaactcaggaccgaaaaaagttagtaatgtttctagaatcacaaatctagttagctaatggaccaacagagacagttattggaacccaaattttccattctaccttgctccatcaatcactaggcctttcttgactaacggtttcatcacagagcagcttttctttgtccttttcagaataagagtgaacttacagtaagattatctgtataagcctaggaatactaaagttgtaaagtatttctgttttgtttattttcttttttgagacagtctcactctgtcgcccaagctggattgcagtggcgggatctcggctcactgcaaactctgcctcctgggttcaagagattctcctgcctcagcctctcaagtagctgggattacaggtgtgtgccaccatgcccggctaagttttgtatttttagtagagacagggtttcaccatgttggccaggttggtctcgaactcctgacctcaaatgatccacctgcctcagcctcccaaagtgctgggattacaggcgtgatctaccacacccaacccaaattgctgggtttttttttctaattctcttctcccagcttttttttttttttttttttttgagacagagtctcccacagttgcccaggctggagtgcaatggtgcaatcttggttcactgcaacctccaccttccgggttgaggtgattctcctgcctcagcttcccaagtagctgggattacaggtacccaccaccacacccagctaattcttgtatttttggtagagatggggttttgccatgttggccagactggtcttgaagtcctgacctcaagtgatccacccacctcagcctcccaaagtgctgggattttacagtcatgagccactgcacctggccccagctttgtattcaagagactcttgaacgtatttttttttctgctgaagaatagtttgatggggtcatcaataaacttaaaattgtttgaaggaaataagtcaacagaggataactagctagaaataaggctcagtttattgttagatataccatgttcttctttgccctaccttagggagttgaatcatcttcatactcattattacatcaaatattagggaattttcatcctttctctcatagtatgttagaactatactgagagacccatttgtggtgagtcctatttattatcattactagcattattactatgtatagatactgccaaatatctatatattggtattgccaaatgccaaatagataggagccattctggaggatcttacatcagtttaagaatcaagaaggaaaggatccagaacagtcttagagtagattaactggagaattgctctctggctagttggaccacttagctcctcccttctctcctctttgggctaagctgaagacaaaaacagcatttgtcctcagaatatagcactgagtatgagcactgggaccatagatgcagagtggtgtcccacatagcctgtggaccttaggctcactcagaagataaactgctcacataccctgatgagcagaagcaaatctactctttccctcccctgtagtcactagaggcaagctaccagcaaacaataggcaaactaaattaaagtcagagcaccatttatggaaaaccaataccatgaaggggaagaatcaaattcaatgaggataggatctaaatttttaggaaacaatcagtagaacaagactttaaaatcggtagttatactgggcacagtggctcacacctgtaatctcaatgctttgggaggctgaggtgggaggatcacttgaggccaggagtttgagaccagcctgggcaatatagtgagaccctctctctgcagaaaattaaaattttttaaaaattagccaggcatggtgaggcacacctgtagtcttagctacttgagagcttgaggcaggaggatcacttgaacccaggagtttgaggttacagtgaactaggatcacaccactgcactctagcctgagcaaccaagtgagaccctgtctctgagaaaaaataactacaaaaattaaataagtagttagtgtcctcataaagatattgtatacacactaaaataaattgctttgctctacatacttgccagtgcaaaaaaaaaaaaaaaaaagacaaaaggaattaccaaaaatcttggaaattaaaaattgaatagtcaaaataattgttatgctgggcctgttgatgagtgcctgtagtcccagctactcaggaggctgatgcggaaagattcctgaggtcaggagttggaggctgcagtgagctatgatcacaccacagtactccagtctgggcaacaacatagcgagaccctgtctcttaaaaaaaaaaatggagcaggaaaatgggcacagacgaagagcatattaatggattggagtagagcattttccccagacaaatcataaaatgacaaaaaagataaaatatagaggaaaacaatgagataagcggattagaacctaacattttatcatccatttataatagtatatccagaaagggagaatggcaacagggggcagaggacagaggctaggttgaataacaggagaaatattttccatagcattccttgtgccctctaatacagtggtgaatagtagaggtgataggagtcatctttgccttgtgtttaaagttgatgacttagggcaggcacggtggctcacaccaataatcccaacactttgggaggccgaggccagaggatcacctgaacctaggagtttgagaccagcctgggcatgatgagacctgtctctacaaaaataaaaattacgaagttaggtgtggtggcacatgcctgtggccccagctactcaggaggctgaggcaggaagagcgcttgagcccaggaatttgaggctgcagtaagccttgatcatgccactgcactccagcctggacaacagccaagaccctatctcaaaataaataaattaataaagttagtgacattgcttatgtttcattattaaggttgttgtagaattttggtaggtagtcctttattaaattaaaggtgtttattttatatctaccaaaaattaatagttttggttttttatgatattggagtaggtgttaatttttttttttttttcagcatgagttgagatgatcacatggttttggtcttttaatttgtaagttacagtaacttattatattgaaccgtccttgtattgggagaattggtattggtatactatttaatttgctaatattttatttagttttgcttaaatgttcataatcaagatcatagctttctctttttgtgaatgtaatgtatttggtcaaaaactattatcctgtttttgaaagacgaattcagatttatcaaaacacgtatattcccaaatcagaatgtacctatattgatagtaacagctttggggtgctttatgaaaagaaaatttgaagactcctaaacagtaaatgtttaaacagaacatttttttcaagggatatgatgaaaatttataatttgttaattatttctccttttatatgttactcttcataattctcctaagtgtaaattttgtttctctttaggtacgcatagctgctaaattcatcactcatgcacccccaggggaatttaatgaagtattcaatggtgagtaaagattagtattttaatccctccttaattaccattatttattgagtacttgctgtctgttttaattcttacgacttgttgtagccatagctaagtaaatcaagattcaaaaaaattgaaataacttgtccaaggtcccccagttagtaaatgtcaaagcaagaattcaaacccaggtctgagtgaaaataaagctcctaacccataaattaggatgcctatcttatgtgagaaaagatttaatgcagattagtatcaataaatgtagaaacaatactaaattattttcatagttttatttttatcgttatagatcatagcttaattttcttcattgctttcacttaggaagtcacatgatatggaacacttttttgggccagtggggctgaactgactatatctggggagcttattaaatatgcagattcaactttatcttcccctcaagattcacattcattagatctgaggtggaactggttaatctgtatttcatcaagttctttaccaggtgattctgaatcgcagcaggttggggaaccacaattaaatacatttacaactttccatactatctgctgtcttaatacattttacaagatggaaaatgtgatggagcatcttaaacttcatggtgaaataaataatcataatcccattttaagttattaagtttgtcttaaagatgccttaagcaaaataataattgttgtgcatcttggttcagtttagcaaacatttattttgagattctaattttatattagaaagttagctactcgagaggaactgtatgatattcctttgtacctggcccagatggtagaacagtcaataataatctttattgctaaaattggaaaaagtaactaggagaaacataaacatttgcttcagggagtataagatataatagaagtaaatcaagatattttttctaaaattgtttgtggattttgagcaccaacagcaaaggaaacaaatgcagcctttttctagtcttttacattgactaaatgtaaattcttagtaacatttttaataaattttcctgttgaatttttctttttttttttttttttttttgacggagtcttgctttgttgccagtctggagtgcagtggcgtgatcttggctcactggaacccctgcctcccaagtagctgggactacaggtgctcaccaccacacttcgctaattttttgtattttagaaaagatggggtttnnnnnnnnnnnnnnnnnnnntcaggagttcgaaaccagcctgaccaacatggtgaaaccccgtctctactaaaaatacaaaaattagccaagcatggtggcaggtgcgtgtaatcccagctgctcgggaggctgaggccggagaatctcttgaactggggaagcggaggttggaatgacccaagattgcgccattgcactccagcctaggcgacaggagtgagacttcgtctcaaaaaaaaaaaaaaggtgactagacttctgatacacagctttttaaaaaggttgtagaccccacattagattctccaaggttaagaatttcactcttactgactgaattgtgcccagctttcttgatatgatgttgtagaaacgcctgcaattcttaatctatgctcatattaaaggattcatttaaatacagaattaacactctttaactgtagctttctgtaaaccatgtttgtcatttgctataaagttccttgagactatatagcacacataattgtacacaaatctgtgaacattagcatctttttatttgcatgtttagaatttctactcatatagtacacctgaagactaattttacaaagcctgacatttaaaaattcaatctagaaatctgctaaaatttctcaaatttatcctccactgaacattgtaacatttttcctcctcagacgttcggctactacttaataatgacaatctcctcagggaaggggcagcacagtaagtatctttccaaatccacttagaatgttactctaacattggataaactatgttgacagtaaactagcaccctgaaaacaaagtttaaaatacttcaaagtaaagcagttggttttagcaattttcgttgttttttttaattggagaaaacatgttcccccaattgttgtttacttcctcaaagcttactataatatatgaactagtttttatttctgcccacatttgcccgattaaagcagagtttaatgttagctgttaggttttcctttatagttgttctagttcgtgttgaatttttttaaacagctagctatacataggaatgatctgccagtgaggaatgataatgtttaagaatagcaaatattaataaagtgccttaatagttaaaattaaccataagataaaagcatgattagcttacctagtcattgactccttaccactctgaagctaattaatctttctaaaatattttcattgtgtccttgccttcaaaaatattacagtggtgcctctttttttttttgatatcttctataataaaatctaaacttgctgtagctttcaaggctccctgttgtctggctttatcactactctacttttcaacacaaagttctgtttcagttgctgtctacccaactggctcagagttcctttgtaaagagttggataatggctagagtgggtagggatggggagacaggacaaggacatgttgatgcagagcaacaaataattatcataaagtcattgggtatgatatataattggtttagattttagccatagaaaacagttgtaagagctgctgcctgggaaacaataatctgccctgtccatgctgcttttttggaactcattttgggactagattctgcaaacgtagaatttgcacagctttactgtaattgtcatcgtgaatgataccctaattatacattgatttaaggaagctaggctcacatcggagatatactctaatgatggtttctcttagattcatagaatctgccatagaaaaggacattcatgatttgctagtttaactcctctctactttctttcactgaaagaatctcatcaacatctgtcaatagacagttatctaatctgaatgcttctaataataaggaattcacaatctcacaaggcaagttcttcaatttgcctgccatattggtcccagttttatccttgagaactacccacagtaaatatgctctgtacgtcacttgataagctgaaaggggtggatgttgaatatcacctaagtgtcattgcaacctaaagcctgttatcctctttccaatagaaccaaagagaagttggtatgtagcttctcggccttttggctaagattaagagaagttggtatgtagttcagatacttcattttctttaattgcactgacactaaagctttgtatttataactattctggttcttatagactataggttcttggggaaccctcttgttaagagaattttcctggacccaaatatttgattttccatagagaagaaaaattcagttttatttctgtattaaagcatttcagtcccttggccatagtcctcatagtaactgctcaattaatgttttcataatcattgtcataattattgccttcagtctgtataaaatgaagggcttgaagtagctaagatttaccatctttcctggatttccaccagtttctggccaccagaaccatccccagataattccagcgcttctggaataaatagggtgttgtaagttatgttaaagagtgaatttcattctgacagagataggaagtaagattgttttgagtagagaataacataatgagacttatattttagaataatcactagctcctgtgtagaggggcaaaagctgaggtaagatgagtaattccaagacaatgagaatagttcagggatagatgctactggttggactagagtggtagcagtgggggtggtgggaagaagtcagattctgaatatgtacttaagtagagcctacaagatttactgatggactggatgtgaagtgtgagaaaaagagaagaatcaaagatcaccccaagtttttggcttaggcagctggtaaaatggagatgctgtttacttgagatggaattaaaggtaaggacattttggtgttggtgttggtaatctatagtcttaggacatatactagaataaaatatttacttcctactcgttttttttttaaactaacatttattctactttttatgaataaattgtatcctttctgaagagctaatgtgtttgggattaattttgctacatggggatgtggtgttttaaggagtaaaacacagtaataacttttggctgggtgtggtggctcacacctgtaatcccagcactttgggaggccaaagtgggtggatcacctgaggtcaggagttcgagaccagcctggccaacatggtgagactccccccgatctctaaagaaaatacagaaattagctgggtgtggtggtgcgcatctgtaatcccagttacttgggaggctgaggcaggagaatcacttgaatccggaaggcagaggttgcggtaagccaagatcgtaccacagcactctagcctgggcaacagagtgagactgcatcacccccaccccccaaaaaaataaatacacaaagtatacagtaacaacttttaacaaaataagattgaaaattagctttagaggctgggcacggtggttcatgcctgtaatcccagcactttgggaggctgaggtgggcggatcacctgaggttggaagttcgagactagcctgaccaacatagagaaacccagtctctactaaatatacagaaattagctgggcatggtggcacatggtaatcccagctactctggaggctgaggcaggagaatcgcttgaacccgggaagtggaggttgtggtgagccaagatcacaccattgcactccagcctgggcaacaagagctaaactccatctcaaaaaaaaaaaaaaaaagctttaaatatttgaagaagtttaaatgtttgttactttgctttatcttgagaagcctagttttaaccactgcttaaaactagtggtctccatccttttgtagttcataagtgtgatggttgagttttcacatgcatgtgtgagatgtgcctccctcaaaccttgttatgttggcacattacctgtctgacatggggaaaaaaaaaaactagcagtctattttaataggttaaaattgggaattctgtgagaagactgatactttttaagaatataagtgtagctcttatttccatctttcttttatcttgtcttttgctttagctttgtaaaatgtattagagagccattaaaaatgcagaatttcaaaaatcaagctttggacaaatagtaatattaggcatgtactttgattatttatgcattcctcttttaaaaataactactttgtgcctgaggctctacttttatacttgactcatgctcaactctcacttcaccttcttcgcatgtcagatgccttctgacatttaattatagtttctcgtgactttgagagccaagaaaaaagatcatttccaaaatagtgtatcaatggaggattcttttgaattactgaaagcttctgcccaaatgattaaaattgttggcagttcacaataattagattgcttcaaactttggaattagccgagtgtggtggtgtgcacctgtagtcccagctactcaggaaacagatgggaagatctcttgagcccaggagtttgaggccagcctggcaacgtagtgagactctatctcaaaacaaaccaactttggaattgtctaagcagaaggtcttttggagctcaggagcagagaggaaaaggtaatttcagagtttaaggagcttccaagatctccgtagagaggagtcccttcagaaagctggaaggcattatgttaacactggatgtctggggagaagggaaaagtacagggtactattttcacatttcctttcactattctgtgaaccaccttttgtgtttatttacacataattcttttctctctccctctttttttttttttttttaaaaacttttaaaaaaaaacagtgcatttgcccagtataacatggatcagttcacgcctgtgaagatagaaggatatgaagatcaggtaataattgccttttagacaggctatgcctggcagatagtagagatcctattaatggaaaccaaagcagatgtctgaaccaggtgctgaataaatttgtcttagtttttatagtttttgtgtgtactgtacgtgttaggatattcttctctttctcataacactagcagtttctttgacaagaaaggagagcagcctcttaacaagaacagtgaaaatggaagtatttaagttttacaggttttccagctgtctttaattctccttgataagagtaacaacagacattatatttaatggaaaaacagaggcgttcctcctgaaatttagactacttatttattactttaggattttggtggttgggaaatgggatgagaaaacagttcactttgtgtattttttcatttttgaaccatgtgaatgtattacctattttaaatgctaagtgtaatggccctaaagtttcataatgactctggaaaaatatgtgaaaaaaatacaaaagtgtacataaaagttattacagctatgtataaagtacatatatagttatgtataagtatatattagaaaccaagaaatgaatattattagtatgggggatattttgtagtttaaagttgacttattcataaatacaatattcttaataatacgggacttggttgaaaaattaatatgaaagaaatctgactaaatgaaaagttaactgcctcagaatttttattgatgtgtttcataaaaggcagtaagaattgtcttttttacagttactcatatgtttaatgattctttggaaggtcttaattacagagcacggtgacctgggtaatagcagatttttagatccaagaaacaaaatttcctttaaatttgaccacttacggaaagaagcaagtgacccccagccagaagaagcagatggaggtctgaagtcttggagagaatcctgtgacagtgctttaagagcctatgtgaaagaccattattccaacggcttctgtactgttaagtatctgactgcttcgttatcagagagtgttttcttatatttaccttatcctttggaggctttggcctaccaaacatccctactttcttcttagccatgctctcttctcctctgcattttattccctaaatcattttggaaaggggtataaatgaaatttttatatggaaaatttctttttaaaatcccaatgcacaaaaaatttaggtatcagtgtattctgttttcacatttgacttatgaaaaatgccttacacccatcagaaaaaggtctttggtttttctttttttctttcttttttttaaattaaccttttaaattaatttttttttgtttgtatttttacccagatctaaaaggtctttggtttggacatggagaaaaaaatggtatactaagattgttgagagagcttttgctcatatttatggctttttgatataggcatttttacacaaactacttctacatagtttagatgtttatattcagtaatcaaaactattagaactaaacaattggctggacatggtggctcatgcctgtaatcccagcactttgggaggccaaggtgggcagatcacttgaggccaggagttcgagaccagcctggccaacatggtgaaacctttacttaaaaaatacaaaaagtagctggatgtggtggtgtacacctgtagtttcagctactcaggaggctgaggcacaagaatcacttgaaccagggaggtggaggttgcagtgagctgagaccacaccactgcattccagcctgggcaacagagtgagactctgtctcaaaaaaacaaaaaacaaaaaaaacacaaacaatttttttttaatcaggagtgattttctttttgttgttgtttttgctgttgttgttgttgttcttttgttttttgagactaagtcttactctgtcacccaggctagaatgcaggggcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccctcttgactgtaaaaatagataaatttggctttattattttttcctttataaaaattatggcatattaagaaaaatattgattagaatattttttatttttaaattgacaaaaatatgatatgtacaacatgatattttgaaatatgtatacattgtggaatggctatattgagctaataacatggatttctatacatatttatcatttttttgttgtgggaaaatcagcaattttcactagaatattttaaatatacaatgatgatgaattacatggcagtctagaatacagttaagagcacctactttgaagccttactaactggtttgattcctggccctgccaattaattagttgtgtgaccttaggtaaattacttaacatctctgtgcctcaattctttgactgtaaaatggaaataattgtttttatctcatagagttgttgtgaagatttaatgaattagtaatatatgtaatatatgcctggaacagtgcctggcacaaagtaagctctacataaatgttagatgaatgttaggctaggtgtcattatgtttgatttttttttttttttttttttttttttaatgagaatacccattatggtggactggacaagtatagaattcctgttgggaagccagtattgcaaaggggagacatgatagactcccatttagaaattgactgtttaatcctaaatatactttgaatttattgtttgttacctgttcaaagtttgtcactacccattcttaatttggagagctccagcaccaaataaccctactgtgtccttagctatcaaatgacctacagaaagtcatggaattgttgtgatggtgtctgctgtatataagtatcctatgtcttatgtcttcagctgacctgcttagtagtccgtaatttcatctccttattccctatcacattttctacatagtatgttccaaacatttttcattgtcctctgacaggcatctaatcccccatgttttgtaaggattgaaactgacagaaattttttttttttttttttgagacagagtctcactctgtcttccaagctggagtgcaatggtgtggtctcggctcactgcaacctccccttcctgggttcaagcgattctcctgcctcagcctcctgagtagctggaattacaggcgcctgccaccacacctggctaatttttgtatttttagtagagacggggtttcactgtgttggccaggctggtcttgaactcctgaccttgtaatccgttcgcctcagcttcccaagtagctaggaccacaggtgcacaccaccatacctatctaatttttctctgtgtgtgttgtgtgtgtgtagggactacaaggcatgagccaccaggcccggcctatttctccttctttgtctgccctttccaccttgccctttctccctcttctccactttttcccttctctcatctctctctgcatcaccaccacgtcagtacatattctttgcctgctaatgccatttcctctatctacttctgaaccctttaattttttactttagtctccattctacagaaactgctctgagtttactaatggttcctgagttacctggtccagtgtccttttccttgtccatgacttccgaatggcatttcacactgaagccaatcaaccacttctagaaattatcttttacttaggctgctgtcagcaacccctaattcttttttttttttagagatggagttttgctctttttgcccaggctggcgtacagtggcatgatctcagctcactgcaacctccgcctctcaggttcaagcgattttcctgcctcagcctctctagtagttgggattacaggtgcccaccaccacacctggctaatttttgtatttttagtagagatggggtttcaccatgttggccgggctggtcttgaactcctgacctcaggtaatccccctgccacagcctctcaaagtgctggggttacaggcttgagccattgcacccagccccctaattattcttactctatactaagttctttttttcccctacctttgtaaatgtaggcattcccccaaagttcataattcatttaatgcaggtaaagtaacacagacttcggtgtcacaaaaacagtgggtttggattctacctttaccacttccggagtgaccttaggcaagaagctttgtgaacttcaacttcttatctgtagataacactgtatttcatcagatttattagaggaaaaagaaaatacatgtaagaacatattttgtggactataaagcactattttttttttcttactttcccttggtgattgcatttccattcacctctcccacactaaagaagagttagtgtttctaactactaactagacatctccatctgtaatttccagtttgttaatgacaccaccatctttttagtcactcttgagttccttctttcctttgcccatcatttgcaatatactgctagactttgattgtacttctacattctgtgtgcaactcttcctttccattcccattaatataactctgacttgttgcctagattaatcctgtggcctcctaaccaagcttcagcttttcttcgttttatcttgaataccagtattgattattctcccacaatattagttctagtcatgttttgctgtctctccattgcctatagaataaaatcttaaacttcttactttacatctactattacatgacctaaatctaccatcctgttttgtctttcattagtccacttcacacacaccctttaaacctgacagtcttgttcactgaacaagtccttagtttcctgtcttgcctttattttcagtctctgcttatcagaatctcatctgtcttgtatgacccagcctaaatggcacccgccttctaccccaaaccaagagcagtatttccctctgttttcattgtatcactgtctctggtagaacctaacatgttctgctttgttttcatatcccatgtgcactattgtgttctaagctcattttatgtgattctttgtctcccccaaggatttaacactctgcttttgtacaatgcatgttgtttaaattaaaagtgtttggagtctttaactatttttttttcccaacaataggtttatgctaaaactatcgatgggcaacagactattattgcatgtattgaaagccaccagtttcagcctaaaaacttctggtaagaagtagatattctcttctatttacatctgaaagaaaccagcagttgagacttggtttttaatccaactagcttggaataattatttaacttacagacttcagttttccatctataaatgagggatttagattccttacagttctaaggttttataattatattttcctttaaaagttactcttattttgagtgagaacaagtgattagtaaagtgccctgttgaaaatctgagttttacttggcttagggttactgctacttgagttaattgtgtaactcagcagcctattcatctgattttggaagagcctcccatgagcagaataggcatggttttccatttcaagggaaaaaaggaaaaatgaaagacaaaataacttagaaaaggcttatggtcaggccacttagatccagacttacatttgagtagacagagctttgggtttgccaaactggaaatgacagtttctctctctctttttttttttttctttttttgcacccctctttcccaacttctgtacctcagtggcaaatcacctctttcttgtgcttattgctaattctgcaatgttgtgtgtgtgttttaataggaatggtcgttggagatcagagtggaagttcaccatcacaccacctacagcccaggtggttggcgtgcttaagattcaggtgagattccaacatgtttatagacttaaaacttcacatctttaaaacatgtgcaggttgctttggtattaaataaggaccaagtatgtgtagatgcaaagggagactgatggcagtgaatagaaatagaagcctccttcttggggtggtaaacagagagagctattctgagttgataaaggatagcatgtagagtgtatggcaacatggttattgttatttttccttcaatggtaacataagatataactaggaattatcaaacagcagttttaggaaagatttaaaattaataataataataattattattttttgggacagagtttcactccatcacccagactggagtgcagtgacgtgatctcagctaactgcaacctccacctcccagcccaggctgggttaattcctaaaaattataactagagagaatggcaggtgttttggaatataaatagccaagcagaagtagattgattgattgattgattgattgactgattgattgatttttgagatggagttttgctcttattgcccaggctggaggtgcaatggcatgatctcggctcttcgcaatctctggctcctgggttcaggtgattctcctgcctcggcctcccgagtagctgggattacaggcatgcgccatcacgcctagctaattttctatttttagtacaggcggggtttctccatgttggttaggctggtctcgatctcctgacctcaggtgatccacccgcctcggcctcccaaaatgctgggattacaggcgtgagccactgcacctggcccagaagtagatttttaatgctgatgtcagggtagacaggcagctgaataagatagctgttaactcatttgatgcctgtctggattgaagtttaatatcctagcagaggtttgactttctaaactcagggtgatttaatatttaagcctcactaactgtaaggtcagaataggtacaggtaaccgagaagatcagtacctaatcgtacctgtattatattatgtgaagctgtgctttaacaacaattaccaagagttgtctttttttttttttttttttttttttgagaaggaggagaaggaggagtctcgctctgtcgcccagcctggagtgcagtggtgcaatcttggctcactgcaacctctgcctcctgagttcaagcaattctcttgcctcagcctcccaagtagctgggattacaggcacacaccaccacgcccagctaatttttgtatttttagtagaggtgggatttcactatgttggccaggctggtcttgaactcctgacctcaggtgagccactgtgcccagccaagagttgtcttttttaatgctctaatttaatcaagtgcataggtaataaattctgtaaaagtaaatctgctctttttatatatacctatagcttcctgcaacaagtagctcctggccataggagcatgcccaactcaggtgagacaggctggtgttgagttcacagctctaggaggagccctcagtgatatgtaagagttggtagataaatatggcagcttcctcaagtaggacaactttcaagcacattctgtttagtcttccggagcccaatacccacagctgtaacctgctcataaacgtacctctaaggcttccttcccttctgtgtcccacttcttctgtcccctactgtagctttgtgagattcgctcctgaataaactactttttctctaatctttgtcttggggtctccttctgggaaggtgcaacctaagacagcatactgttctgtttctgttaacaaaatatcttagtagcctagcgctctagatctcttgtaactgtggcattagcattaacttcctagaaccatggtatcagcattgtagaagcttattgtaaattttgtgtaaataaattttactttgtttctagatggaaacagccatttgtattttagctctgccagtgcaaacctataaaataagagcacacatcacaaa

SEQ ID NO: 16223 - DNA, 13197 bp, Human
taaaatagggctctcacctgtaaccccagcactttgggaggcccaggtgggaaggtagcttgagcccaggagttagagaccaacttgggcaacatgatgaaatcccatctctacaaaaactacaaaaattaggccgggcgtggtggctcatgcctgtaatcccagcactttgggaggccaaggcgggtggatcacatggtcaggagttcaagaccagcctggccaatatggtgaaaccccgtccctactacaaatacaaaaattagctgggtgtggtggcaggcacctgtagtctcagctactcgggaggctgaggcaggaaaatcgtttgaacctggaaggtggaggttgtagtgagccaagatcacgccactgcactccagcctgggtgacagagtgaaactctgtctcaaaataaaaaaaaaaaaagaaaattagccaggcatggtggtgcttgcatgtaatcccagctactcgagagactgaggtgggagaatcatctcagcctgggaagttgaggctgcaatgagccatgatggtaccactgcaccctagcctgggcgacagagtgagaccctgtctcaaaaaaataaataaaacaaataaaatagggagattatcctggattacctgggcgggcctactataatcacatgggtccttacatgggaaagagggagacagaagagtcaaaaccagagagatggcctcatgagaagaatccgactggcattgctggctttgaagatggaaaggggtcatgagccaaggaatgcaggcagcttccagaagccagaaaagacaagatagtggactcttccttagagcctctcaaaaggaacacagccctgctggcacttttagtccaggtaaaaacttccagataaaaacaatataggccaggcgtggtggctcatcctgtaatcccagcaatttgggaggcctaggcaggcggatcacttgaggtcaggagttcaagactcagcctgaccaacatggtgaaaccccgtctctactaaaaatacaaaaattagccgggcatggtggcgcaggcctgtaatcccagctactcgggaggctgaggcagaagaattgcttgaacccaagaggcggaggttgcagtgtgccaagatcgtgccactgcactctagcctccatctcaaaaaaataaataaagacatagatgacagctgagaatttggaaattgattctttaaagcaacggttctcaaagtatggcccctggaccagcatcatctgggaacttgctagaaatgcagactcttgggccacatcccagatctactgaatcagcaactcggggggcagaggtagggtggagcctagcaaacttgtaacaagccccccaggtggttctaaggctcactgaagtttgagaagtactatgttaggataacggtaaggtttatgactggacagtggttcttaaagcatggcccccagataagcagtttcagcatcacctgggaacttaggcaaatcatcaggccccaccccagactcaccgaattggagactgtgttttaactagccccccaggtgctacggctgacgcacgctagctagagtttgaagaccactgcctaaagctctccctgcctgaccacccctggaaaagcttcactcttagtaggtatttgtacccttatttgtaaagcccgcttcttgggatttaaggacaatcagtaggatacctactgaccaatacaggtctggcttatagtaggtgttctgtgggagttcgttaaatgattaatttaatacaactctgaggaaattggtgaagtagatgtgggattcgaacctaagtccacccggcctccactattgggactcaagggagctttatttccgctgcccacgcgccgcctgcacgcccgttccctctcctcccgggagggggcgcgccaggaccctaagaggcctggctgggaggcgggacttcctgcctccgcaggaggcacttccggtccaaaccggaagaccgtgggtagctgcggcggggctgacccgtcccgagtgccaaagctggggttctacttgagatttccctcgtggtgccagggtccggcgagcatcacgccgaggcccattttccagacgaccacgacgaggccggggtcacgtaagtgcacgcatgcgccccctccgcgcggactgcgcgtgttcgaggagcggacccgcagatgtaggaggggagggacgcccccaatccccagtccccgcggcaggctcacgtttcgcagtccccggcctgtcgttattgcggatccgactgagttctgtagccttggaggtctaaagggtcctggagagcccgcagcgagggcgggaagccggccggggaagtcgaggctgccttgtctgagggcttttgtggggtcgtgctctccaccagcgccctccgcctgtctaggatcgtttcaggctatgcggttccaagagaaaatatttttgtttctattttatttttgagatagaaccttgctctgtcacccaggctggagtgctgtggcatgatcttggctcactgcaacctctgcctcccagattcaagcgattttcgtgcccagcctcctcggtagttgcgattacaggtgtacaccaccacgcccggctaatttttgtatttttagtattgacagggtttcactgtattggccggactggtctcaaacttctggcctcaggtgatccgcccgccttggcctcccaaagtgctgggattgcaggcgggagccaccgcacccggccaaagggaaaagatttttgtatagcgagattctaatgctagcgtttgcgtttcggtgcatgcgagagcactggttcagagctctgcctctgaatcggatgggaatcaagtcttggctgtggcagctaagagctgttggactaaagttcttgctgagccttcgtttcctgaactctgttaacagggacggcgatagaagagtgcagcatttagcatgcgcctggcagatagatgctggcgcttggtcagcgagcgctgctgttatttttgcccctgttatttttgttaattaaaaaggagggatgctatggctgctcatacttctagaggactgtatttaccaaagccttgtgatgtaatttttttttttcttgagatggagtttcgctcttgttgcccaggctacagtgcaatggcgcgatctcagctcaccgcaacctccgcctcccggcttcaaggaattctcctgcctcagcctcccgagtagctgggattacaggcatgcgtcaccacgcccggctaattttgtatttttagtagagaccgggtttctccacattggtcagggcagtctcgaactcccgacctcaggtgatccgcctgcctcggcctcccaaagtactaggattaccggcgtgagccaccgcgcccggccccttgtgatagaaatttatttttttcaacccctagtgcattttctgggaggcactgtgcttgacagtaggaagacgatgctcagatgcagtccctggctgtggagtaacttgagcgtcttgggggtgtagtctgtaaatgtatgatgacggtacttacgagccgggagagaggctgccccttgccgtctttctgactccatctccaccgctctccacctcgctcactctggctgcctcattttctcacacacttcactgctctaggattttcacagttgttgaccgttcggcctggaaccctcttcccagttgcgtacatggttctctccttcactaggttcaggctgtgctcaaacgccaccttctcaacgaggcttttcctggctggctttgctgaaaccacgccctcagcccactaccagatccccttctcctggacgggtggttggctttaatacagttctcactactgcttggccttgggctacatatttgttttttgttatctgcttcctcaaagaacatatgcttcccgtagtgcacttttcactcctcaggaactctggcgccccttaccagcttccagtctctcgaggtggccagtgtggtgcttggtccttgtttccaggatggacttccccagctccctccgccctgcattgtttctgaccggcccccttggtctgagcgacgtccctgacctctctttcatgtgcagctggcgagacgcactgactctgccagaggcccagccccagaactcagaggtgaggatgcaggcagggggccctggcagctccagggacatcccttccctgggtcccccgtctcacattcacatcagttgacaaggccacagagtggtggcattcacacgagtctgctgagacacaggctctgccacctcctctggggtacatgggctaccctgccatccctagacggatgcccccactatgccgggtcccttatgagaccgtgagaatgctgcctgaatcagtcggttgacccctcccttcctggaacggagagctgagttgagcgagaataaacaagtgaactttatccaatggataaggtgtttacaaaatgtgatcagagcttggaatgaaagcagaaggatgctgaaacagcatagtagggttgggagaggggaggatagacctgcagggtttctgctgcctctggagggacactggccctttgcttggaatcctcagccgcctagttccccttggaaacaccctgtctgggaatgaagcctggcagaggcaagtgggtgagcaaataaaaagagagacagtggagcagaggcttggggaacgggggtcagggatggcatccttacgagggagggtctggcgtcaaattggggctcctctgggagtctggtttcctagctcttttgtcccctgaatgtctgggccgaaacatcccaggccagcccagcaaagggaggtggagccgcctgccgggctcccagagtgactgcaaggtctcctgaatggaagtgaggttacgtgagatgtggaccagccactggtggcatgaggggcttccttctttgagagccagcacaggtggaggtcggaaacaggagctctggggtcaggctgcctgggttcacatcccagctcttctctttaccggctctgtcttctggggcaaatggcagtgtgcctcagtttcttcagcagtaaaatgacaatgccagtcatcccagcttcgcaggattgttgtgaggattggatgagttgataagagatgaatgcctgtgcacagcctggcccagggagggcattcatcatgatactgtccttgcgattgtcctcccttcagaatggggcactgcatgtgaccaaggacctgctgtgggagccggcaacccctgggcctctccccatgctgcctcccctcatcggtaagggtctcattcccccgggctcactccacactgctccacctattcttcccactgctcccgctcctgagaccttcctctccctgctaagcctgtgcctgctcaggacccttggatacctccagtcgcccagggcatctggccgcactcctgtgccctccccagccctttccgtaacctccttctcagatccctgggaccctggcctgactgcccgggacctgcttttccgcggagggtaccggtatcggaagcggccccgagtcgtgctggatgtgactgagcaggtgagtgggcccacgggggacagtgctgcgtagcctggagactgtgcttagtgacctggcctcctcttctccccagatcagccggttcctcttggatcatggagacgtagcctttgcgcccctggggaagctgatgctggagaatttcaagctggagggagcgggggtgagtggcccgtgactccaggggtggggactccctgctgtccttcaggggtgaactcgagggtgtgtgagcctgacaaggcctttccatgcagagccgcactaagaagaagacagtggtcagtgtgaagaagctgctccaggacctcggtggacaccagccctgggggcaagtggctgatgagaaaggaggagatggataggcatagctggtggtggggatgtaggaggtgctaggacgcacgtacagctttccgtcatacccacttcccccctgctccatgcagtctgagctgtactttcttataccagacttccaactccaaatcatctcaggggaaagcagatttacatttgtggagttcaggcacagctgcatccaggtgttcaaataatgttcatagagctgtgtctctctttcctgtctcgtccacttgcctctccctgcacagttccctagacaggctgtctctaggtagcagcaagatggcttatgatctaaggaaagagccagtgtccttcctgcggcaccagaagtcccagaaaggactttggttggcttggcttgggtctcacacccatctgtgaaccagtcactgtggcaagggcaatggaatattgttggtggccaggtctgggtcacatgattgcttccggggcatgggaacaggatggggtggtctcccaaaggaagaaattctaggtaaataagaaatgtgtccactgcacttggcctccttgggatgggacctgtcctcccctgagtgccaccgagtgatcctcctgctgttctctggtccccaggtgtccctgggcttacctcagcaaccgacagcgccgcttctctatcctcgggggccccatcctgggcacgtcggtggcgagccacttggcagagctgctgcacgaggagctggtgctgcggtgggagcagctgcttctggatgaggcctgcactgggggcgcgctggcctgggttcctggaaggacaccccagttcgggcagctggtctaccctgctggaggcgcccaggacaggctgcgtatcctttcttgcgagacaggagattccagcgggctcgcctctggtagaggaggtgctcttggcatggtccagagaagggcaggaatttggggggcttgcagtgatcatagctcgtgcactgatccttagtgagaggcccagatttccaagaggtcgttctgaccccaggtgacaatccccaattccttgggaaacctggacgcatccagctccagggacctgtccggcaagtggtgacatgcaccgtccagggagaaagtaaggcccttatatacactttcctccctcactggctgacctgctacctgacccctggccctttccatccctcctcagctctgctggccgtccgctctgactaccactgtgccgtgtggaagtttggtaaacagtggcagccaacccttctgcaggcaatgcaggtggagaaaggggccacggggatcagcctcaggtgaggggggtcaggttggtcggtgaggaggggctggaggcagggctgagcagcccgatgtgaatgcattcctgccctgtagccctcacctgcccggggagctggccatctgcagccgctcgggagccgtctgcctgtggagccctgaggatgggtatcgccgcttcctgtgaaaccccccaccctaacgaactgaactccgccctgttgagcatgtcgcgacccttgagccccttccccatcagcctgtccccctgcccacggcttgcctgtctccccaaggctgcggcaaatctacagggaccctgagaccctcgtgttccgggactcctcttcgtggcgttgggcagacttcactgcgcaccctcgggtgctgaccgtgggtgaccgcaccggagtgaagatgctggacactcaggtacgggctggcggcagaggacccaccccgactgcgggagcggccgcagagcggtgagtcccaggctggctgcggcctgggcgaggacagcgtcaccggcctgggactgtggggagggctgaccctgtgtttatcttccagggcccgccgggctgtggtctgttgctttttcgtttgggggcagaggcttcgtgccagaaaggggaacgtgtcctgcttacccagtacctggggcactccagccccaaatgcctcccccctactcttcatctcgtctgtacccaggtgagtggcacacaacaccgccccgccccacctctgctctgtctcagatggtcactagaggctgctgcttaccagcggctctgctgggcccagacaaccacccagcaaaccaaactcaaccctggatgaatctgtggcccaaacacgcagtggatcccacagtcggtgctaacaggcaggtggggaagctctcccagggcctccccttagtagagcttcgaggtgcagccaggggtggagcaggggaggaggggcctcggggtggggcttccgtgcagagctggagagtttctgctgtgcaggaggcgggggctctgaggaagcaggtctgtcctccacccgccctcccggggacattcgtaggcgtgcctcgagcacaggctcccgggtcaggagagtgggggtggctgcgagaaggccaggcaggtttctgctggcaaggctcccccacacctcttctgagcacccctttcccacttgttctgtctgtccaccggactgtcggtcagaattggtgaaggaagcggcacctgttcagggctggcaggtgaagtctgagaggcacgtggaggctgatgggagatgctgctgcccctcagggctctgcactcacctggagagccacatggggcctggagggccactacacagctcagctcccaagttcggccacatcccccttccttctcgggccccagttctctctctacctagtggacgagcgccttcccctggtgccgatgctgaagtggaaccatggcctcccctccccgctcctgctggcccgactgctgcctccgccccggcccagctgcgtgcagcccctgctcctcggaggccagggtgggcagctgcagctgctgcacctggcaggtgagggtccaggccagggtgggcggcgtgtgggagatggggcggtcggggcctggacagggcctcagctgtctgtccttcctcaggagaaggggcgtcggtgccccgcctggcaggccccccccagtctcttccttccaggatcgactccctccctgcatttcctctgctggagcctaagatccagtggcggctgcaggagcgcctgaaagcaccgaccataggtgtgctggggtgggggagtgagcttggggggcgcagtggaaaacatcccctccccccgctaggccctggaggtcattgtcattcccgtcaccaggtctggctgccgtcgtcccgcccatgccctcagcgcccacaccaggcctggtgctcttccagctctcggcggcgggagatgtcttctaccagcagctccgcccccaggtggactccagcctccgcagagatgctgggcctcctggcgacacccaacctgactgccatgcccccacagcttcctggacctcccaggacactgccggctgcagccagtggctgaaggccctgctaaaagtgcccctggctcctcctgtgtggacagcacccaccttcacccaccgccagatgctgggcagcacagagctgcggagggaggaagaggaagggcagcggctgggtgtgctccgcaaggccatggcccgagggcagctcctgctgcagagagacctgggctccctccctgcggcagagccaccccctgcacccgagtcaggcctagaggacaagctcagtgagcgcctgggggaagcctgggcaggccgaggggctgcctggtgggagaggcagcagggcaggacctcggagcccgggagacagaccaggcggcccaagcgccggacccagctgtccagcagcttttcgctcagtggccatgtggatccctcagaggacaccagctcccctcatagccctgagtggccacctgctgatgctctgcccctgccccccacgaccccgccctcccaggagttgactccggatgcatgcgcccagggcgtcccatcagagcagcggcagatgctccgtgactacatggccaagctaccaccccagagggacaccccaggctgtgccaccacacctccccactcccaggcctccagcgtccgggccactcgctcccagcagcacacacccgtcctctctagctctcagcccctccgtaagaagcctcgaatgggcttctgaggacacaaggtgggctgccctcaagccccagagagcccctcatccttcctctgggaccagatgtgccttccacagttgaaacttgagaagcagagctcgccaccttctggaggccactgtgatgatgagccaagcaatttggagccaagttgaagggacagggcaacaaaatacagtagtagtttcttttgtattttgtatattcgcctgaagatcatcccgcaaggcaggctggaggtgccggtgggcctgtgttgctgggattttagtctgtgctgggaggcagggctccgctgcgcctcagctgtgggggcctcaggcaggtccctcagttctcacgccttcctgtccagtggaatgggggccaggagtgctggctcctcgtgtttggtgagggtggagtgaggcccctgcagagctgctgatgaggtgggcacagcggccgttggcagctgctgttgtgggttgctttgtcaatctctgccccggtctgatgtttcctacagggagatgccttggatccaggttcagggactaaatacacttggcagctgaagatgaattggaatggtcacgttttttaggctggacagcgtcccgccacagctactacctgacactgagctcatgcagagagatgatggctgatgttccttctcccttgggacatgggtctggcacctgtgggctgtcgatagtgccctctgagcagagggtcacggtcatgtcagtttgggggaattctctgttgtgcctcacagactcccccctttctttcctccctccccttctcattttgatgtctaaagcatcaagtccctcttcctcggagtttctctagctgcagtggaagattctgttttcctgtggggaaaatgctcacttgagattttgcagggacccgggtctgtctggtttctgatgacatagtaagagaaaggtcttttttcaggttggctggtgaaaggaattgcatgtgactcacacaaacaggagctagcccaatcatacactgactcgcgtgggtgttaaaatgtttatcatgcctaagggagacatttataattaaaccatttatgctacatataactggggaaaactatgatgctttcggtgctgggaatgcagtgaggtcccacgtgggcagagcttggctgggctgggcaactccgacacacgtctctgggggtgtggcggcgctctcagtcggcactgtggaaggaagggtgacctgtgctttctccctgtcactgtgactgcaaggacaggggggcagccttggggttcagtccaggccaaattcagtgtcctcaactgggcgtggtggctcatacctgtaatcccagcactttgggaggccgaggcaaacagatcacctgaggtcaggagttcgagaccagcctggtcaacatggtgaaaccccatctctactaaaaatacaaagattagctgggcgtggtggcaggcccctataataccagctactggggaggctgaggcaggaaaatcccttgacgggtgcctgtaatcccagctacttcagaggcggaggcaggagaattgcttgaacctaggaggcagaggttgcagtgagccaagatcacatgactgcattccagcctaggccacagtgcgagactgtctcaaacaaaacaaacaaaaacaaattattcaacgtcctccaggcctgcccccgcccgaggctgcacgggctccagctcagactgcacttttctgtgctggttcctagagtggaagagaaggccactcagtgttcccgggaaatgcactcaggccgctccctgcttcctgcctgcaagtctggagtcagccaggcagctgtcttcaggaaaaagcctggccaccgatgcgtgctggatgagagtagcacggtctgggctccacacagcccccaatttgggagtgcacctgaaggcagatgctgaatgaaaaaacagtcccagcttgcttgttctcagcactaaccggctgctccccaaaaccgcatctgccaggcacatgtaccagcctgcagtatgaggggaggccccggtacattcagcatgtttttctgggtcttctgcagccaggcctctggctgccgtccctgcctggtgcccctttgcccctttgccttccctgccttgaaggccactaggactggcctgtgattcacccgggcctgggtcactgtgaagcagccacgcccttgtgtggctgtcacctcgcttgccccacactccccagcagtggtgttggtggtcccctccaaaagccctggtctagaaaggctgaggccagggatggtgaggagggggtggaaatgcacggtcattaggcccccgccccaggagatctgcatgaccacagggggattgtgacccccacacacagtcagactcggctgcccaagaggaggctggctcggtggcttcctggcccaggctggctaccagcaagtggcagcttcagacccgtgaactcaggaatgggaccttcagaggatctgtgtggtctgtcctgggtgacccctccagcaacatgaaagctcagggtaaggctgagtgactgccctgccccacccatcccaggccggggagccaacattgtctccactgtgctctcggccccacgctcttacccggagaagaggctgcaaggaagtcgctgtccctgtctccagtggaagtgagtggtgcagcatctctttggcaggtggggggcatcagtggctggccagaggggtcctcgtcgctgagctcctggatcaggggtcttggggacttggtgtcttgttttcggatttccgagtccctcttagcttcttttttaaagatgtctgtgaagggcacccgagccgcctttgaggtgtctttagagactgcaaatatatttgacagagtgtctgtggggaggttttccagcacagggagtgacgtgtagtccagttcagggtcactgtcatcactcaagctcgagatgacctcaatcttcggaaagcacatattctatttacagaagaaaaggtgtctgaaagtttctgttttcacaacagaatcgctctacaatgcaccatgccagttctgcttt

SEQ ID NO: 16224 - DNA, 26049 bp, Human
gatagtctttcctttatgcaaacacaaccttggtgtctgtgtccaaatttcctcttcttatgacgacatcagtcagactggattagggctcaccctaagggtcttgttttaatcacctctttaaaaagcactgtctccaaatacattcacattctgaggcactgggagttggaacttcaacatatgaattttgggggatgcaatgtggcttatgattaacctctactgtttccacttgtaaaacttttaacacggactttgtcttgttcatatttgaggacctttacagttgctgctgtcttctgagcacactctacctccaactcttcatacaacacgtttttctcaactttcaagccttagcaccatcatctgacaagggccgttccaaaccacctggtctaaagtaaccctaagcgttactctgtcacatcactgtttcctctctttcacagcagtcgccacttacttacgtccagaatatcagcttcaggaaaggtggggatatgtgtttttacacgctattatacccccggcatctcacacacagtcacaagtgaatgagattctgtagccacttggtacattacaatgattttatttacccctgggaaaacctaaagggcttttaacatccaaatcggtgtttgaatttcagctctaacatggattagctgtgtgaacaccaagtgcgttacccactctgtgtctcagaatccttaacaacacgatgacaataccttctttccggttcttatggggattaagtgaactaattagccctaaggtgaccaggtcaacaatctgacgtagaactcatggtatcagccgagatgctattagcttgagggtgttccaaagcgtcggacctgggaatggttttcgaaaacgtgtttaggtggtacccagagcattaaacaccagggtaggaacgctaccctattttcagtggttttttaaattcttttttgttttgttgttttgtttttgagacaaagcctcactctgtagcccagactggagtccagtggcgggatgtcagctcactgcagcctcgacgtcccgggttccagtgattctccagcctcagcctcccaagtagtggagaccacagatccgtgccaccacacccagctatttttgttgtatcttttgtacattttttgtatattttgtatatattttttgtatgtatattttgtatattttttgtatatatatatatatatatatatatatatttttttttttttttgtagaggtggggtctccctatgttgcccctcgctatggtcttttcaattctttggatcaaaaccaggctttgttctcattcatgtgtctttggcacccatccctgcctccatcccttgccatttcttgagattcttctgtttagcagagatcactcggccagacacgcatcggcagcagcctgggaatgaagccagcctgcctggggcggcccccgccgcgctcccccgggactccgggctgctgtgaggaaagcagcaactcgtggggtcctggtgaagagaaaacgacctggaccctgcaaagcgacccagaacaaagggagcccgccacccacgttatgaagacaaaacacgtgggtaacacggcccaggcgggtggcaggcgtggcggaaacctctctgaggctggcgaggactactgagtgtggagggggtccctgaggaagggagtccccgagggaggatgggcctccgagggggccaggccgacgtcccgggaaggcgacccgcggctcggggaagccaagttctgggtcgtcctctgacttcggcttttttgcggtctgccgcgctcatccccgcgcccgccaccccgcgagcttacccgagcctctcagtcagcagagcgcccgctgagtggccgcgcccgcgcgcaagacacaggggaggggcggggcggggcggcgcgcactacgcgagggacgcagctgcgcacgcggctccgcgcatgtgcggtgaggctcgcggccggagtgcggcgctgggcggaagctaccatggcggccgagagaaagacaaagttgtccaagaatctgctgcgcatgaaggtgcggggacgctgagagcgccactccgggcggtaggggcacccggtccttccaacctggccggggccgaggcggcgggcggacaagggacaccagagaggcctcagagggcttccagctctcgtgctcattcattcacttagcgcctgctctgcactgtttactgggaaccagcttacgaattaggccgactctctcaggaggcccgcgggcggatgggagcttgagtacacagaagcagtcagggtacagcttacccagtgcagtgagggtagaagcgctggggaccttggggactcaccgagcttctcgagaagttgttgcttacttatatatgcaataaatatgatatatgggaagtgtaactccttagctgggtaatttaggtaaattcacttctttctctgaatatctcttttcctcatctttaaaaagaagagcattaggctacatgagttcaagctcctttttaattttgataatacttcttttagtagagttcttcagagaaacagaatcaacaagatgtatatgtgtatatatgtgtatggagagagggggtatttttaaaactggatcacacgactgtggagatgcaagtctaaaatctgcagggtgggccagtaggctggagacccagagaagtactcagtccaagtccaaagacagtctgctggcagaactccctcttcttccagggagaagagggtgagtctcgcagggtagtctctaggttactgggagggtggaaggcacagcgtcctaaactaggagaaactgagttcagaagtctgagaggcaagaaagaaaaagaaaaccatggaaatttccaagaattagagacaattcagtatgtctggaaggcaagtactaagaaatggggttgcagagtaggcaatggtcacaacgtgcagggaatttgaggccagattaaagatattttcctttattttgtgagcaatggaaagctattgaaacggggaacagtatcaagaaaatggcaaatatttatagtactagacaatgattgaagtggtttgcgtatattaacctatgcaattcacataatgacactttgaggtgactacaggcagtaactctcttcttacagctaaggcaactgaaacagaaataagtaatttacccaaagttacacagctaataagtagtgtagacaggacgggaattcaggcagtctggctccagaaccctggctctttattactactctgtactctgtgatgcctgtcactaagcactacttctagagagtagcaaactgttacatgtcatgtttaaagaggtggaatttccaaaagagggaaggaagcattcataatgttttgaaagataggccattcgcagtggctcatgcctgtagtcccagcactttgagaggctgaggtagacaaatcgcttaagcccaggtgtttgagaccatcctgggcaacatggtgaaaccccatctctacaaaaaatacaaaatattagccaggcctagtggcacgcacctttagtcccagctacttgggaggctgaggtgggaggatcacttgagcttgggagatcaaggctgcagtgagctgagatggcgccactgcactccagccttggtgacacagggagaccctgtctcaaaaaaaaaaaaaaaaaagagagagagtaaacattatatgggcaagatttgaatggagttgagctaggatggagttagggatgaatgggtgaatgagggtggaggacaaattgcagcataacttagagtttgtcaagcactttcatgcatattagcaaaatttgaatctttactgaacagagtttgattttatggttggtaataacattaacttcagagaagtggagtgaattggccaagcagatattggaaagattttagcagttgttttagctcttggaataagccagatgatgtactgggtgactcaggctcaaactaaatatccgagttgcaactaagaagaaagaaattaacttaaatgtccacccccaccaaatggggagactcaactggacgttggaagcaaaggagaaggaaaaagatcacccacattctctatttggtttagcagctttggtcattgataagaaaaaacttactggcaagatagcaggagacactgtctatactgatagaacagagtatactgtgagaaggcatggagtagctgcacttagggtgccttaaccagagctaagtcctatatagcatgggtccccaaccgccaggccatggaccagcaccagtccatgacctgtaaggaacaggctgcacagcaggaagtgagcagcgggcaggcaagcgagcgaaacttcatctgtatttacagctgttccccatagcttgcattaccacctgagctccgcctcctgtcagatcagtggcagaatcctagattctcctaggatcagaaaccctactgtgaactgtgcatatgagggatctaccttgcgctctacttacgagaatctaatgcctgatgatctgtcattgtctcccatcacacccagatgggactgtctagtttcaggaaaacaagctcaggtcttccactgattcttcattgtggtgagttgtataattatttcatgacatattataatataataatagaaacaaagtgcacaataaatgtaatgcacttgaatcatccctaaaccatctacccttcccctctccaccacccgtggaaaaattgtcttccaggaagcccatccctggtgccaaaaaggttggggaccactttttaggcaagtataagagggttgaggatttaatcctgactcacttcaatgcctctgacttggtcagccattgcagggtgatcctaatgggaagaagaaaaagaaggatgtggatggaaggtcttccagtatggaatggttgtagagggtgcttatttgtgattttggcactgttagactctcagaacagggcttggcaaactttctgtaaaggaccatatgataaatattttggtcttatgagccagacagtctctgttacaactactcagctctgccagtgttgttcaagaccgaatgaccatggttgtgtaccagtaaaactttatcgacgacaacagacatctagcctgaggactgtattatgctgatgcctgctctgagtcctcactagttttggaatgtgttctgaaatgctctagagtaggagaatcgaacttgtacctaagtctggaggtgcttgattcatattcacagggagttctgtcctttctatgtgtacagaacatatgtatatggctgttgtataccaaaagaataggtacatgactaaatgggagaaaaaagggcagttgggcagtattgatgagttttaccacgaggaatattagtgatgaaatgaggcatctgcatttaaagaaaaccatcccagaaagagaatctggaaaaataagataggtctaggttcatttccattcagagaactttcactgagtgagctcttttgtgtaccaggggtgccgcctaagtaccaatgatacaagatgaacaagagtcatggtctattcagaatcgtagtcctgggagacaccaaagcagcacgatggtgaacaatattccagtgttgatgaggctgtcttgagaaggtgcttctttataggagcagacctaggaagagccaagccaaatgccaaccaggaagtcttaccaaaggacacacactgtaggcttaaaagagtaaatattttgccaggcagaaaatggaaacgtgttaagtcgcaaaggcaaaaggactgggaagtatagcgtgcacattccagaaactgcagttctttcctgggatgaggatgtacacacaggtaaaatggatgacgactgcaaaacactagtctgcaaacttgttttcttttactttttacttaaaatagtgatagattcacaggaagttgcaaaaagtgtacagggatatcccgtgcgtccttcatgccacctcccctagcggcaacattttacaacactaggatatgataaagagccaggacattgacagtgagctgacgcagatttcaccattttacacgcactcattttgcgtggacggttgctgggtcatatggtaagtgtatgtttagtttgctaagaaactgccatgctgttttccacagtggctgtaccatttactttcccaccagctatgtttgagtgatcagtttcttcacattctcttcagcacttgatgttatcaccatcatgtgttacttaacacatgatttaacaacagggatacgttctgaaacatgcattgttaggtgatttcatcattgtgagagcatcatagggttcatctacgcaaacctggatggtatagcctaccacacacttaggctatatggtacagcctgttgttcgtaggctgcaaacctatacagcatgctactgtactgaatactgtaggcagttgtaacacagtggtgtctgtgtatctaaacatatctagatatagaaaaggtacaataaaaatgcagcattgtaatcttatgggaccactgtcatatatgggttccatcgtcgaccaaacatcattttgcagtgcatgactattttattcgtgaacgttaaggttttttcatttaacttagtagtcattgttaaagtgcttatgcctaaaaaggcttatgtttggaaaaggtggaatagaaggaggagaaatatgggacctgggccgggcgcagcggctcacacctgtaatcccagcactttgggaggccgaggcgggtggatcacaaagtcaggagtttgagaccagcctggccaaagtggtgaacccccgtctctactaaaaacagaaaaattagctgggtgtggtggcaggcgcgtaatctcagctactcgagaagctgaggcaggagaacctcttgaacctaggaggcagaggttgcagtgagctgagatcgtgccactacactccagcctgggcgacagagtgagactctgtctcaaaaaaaaaaaataaaaaaaaaaataaaaaagaaatatcggacctgaataagggaaagaaatgggggatacatagaaaccagtggaagctgaaacctaactgctaggaggcttctgggtattttctgattttattttctccagtgttgatattttatcttgttgctgtggttagcctcttaagtttgttcacttgttccctgaagaaatacaggtattcatgctagtgagagactggcagcaggactgttatttactgccatattttgagtcaactttctgcagatttgataagagcagctcaagagtttagcagcatttcagaggaaaaataaaaacgaagagcagacttatagatgtacctttgcttctgcctacatttatcgggctcttactgtgcttcagtcatcatattgggacagatgaaggagatgacccagacacccagtccttaaggtctccagaaaagatagatgctcagaaagttcagatgtggtgagtctattggagggagccatggaagcatttaggacagaggcactgattttactggcactcatagaagtctagtagctttacctatgtcagacgggcgaggagttggccaggtggaagaggataagaagggcatttcaaccccagatcagcaggtgccaaagccagtgggctctgtgggtgagcacaagaccttcgaatgtggtgtcttagcccttaagttttccgaaggaaatatacattgtgcattttctcatgccctgacacaagccctcatcgtctagtgtaaagttggaagggtagagctaaaccgtttgatcacttgccccaaccctcaatcttgagatgggttccatagataaatgaaggagaacaagtagaagaagaaaattatttggggtttcctcagttctaaaatgggaaaagtttctgacattgattttgtttgttttcacagtttatgcaaaggggactggactcagaaaccaagaaacaactagaagaagaagaaaagaaaatcattagtgaagagcactggtacttggatttgccagagcttaaagagaaagagtaggtttattaaaattgatactgatgatgcttgtggcattcagaaggaaactcctggtaaatttaactcatcattccggtgacataaagcccatgaaattgtttctgttcagtttattgatttagtagcacaactaaaaaatattaaacctatagaagttgtacatggatttatacatttttactactccccctcccagccactattttgtccttttttacattgaatgaaggaacctagcccacatatctctgatagtaacagcagacctttggggaagctgtaatgttctctctatcaccttaagttctaaagattaggggtgtacttcaggtctctccagttttgtttcggttacagagttcattaggttgagcattttaaggcaggtcagaagtttttgtttcttcttttaaattgttactacttgtaataccatccattttagctaacatttactgaatctatagtgtgtaccaggaactgggctaaacactttacatctgtagttattgaatcttcgtagcaaacttaggaactgcctcctatgattctgtcactttgtagttgaggaactgagcttaagggagggtaacttgcccagcttcacccagctagtcagtgctgaaggctggggtagacagtttctggcccacccctaagcttggctggtgcctgatcaacaattttgaatgaaggagtgttggatttatttcatccattaatttagctgaatccttctggaagctatttttcatttttccctgatactttcctcaccttagtaagctctgttgtatggtagttttacttaaactttggtcaaatgactgaagatgctgcttactgtcttgaggcacatttatgtgtttccattctgtacctgatgtttgggctttgatttggaatgttatattcccctgttcatttggctgacctctggacattgtttgaaggttagatacccttctctaaagatagaaagtatgtcccaccaggagggatcgggagaaggtactttttttctctgcttctcagaggaagcaagatgttggtgaggagggagaagatagtgccaggggcagggtcacagggaggaagggacctttgctgctggagctataatttacttttatgccttaagtaaacttgccaaagtgttccttccagttgtttattaaagagcaggactgtttctatcttgtttccagtatttttcccctaatacagcatattattcccagaaaatgacctttacatttctttctgggaaggtaaataatgcctttttgccattactcagcatcctgtttatgtataggtgtgtatatcagctcaggatgttggcaggagaagatgacactctcagactgaggagagactatcaaggtgtgggtggggcataggggggcccctcggggcagtgcagcacctcctagcatgtgtagtgggagtgattaccacctgagcttgcagagtcaacgggtgggtggggaatagctgctaccgaatctgcagataagttgtgtagagagagcaccttacaggagctgctacctccattcacgggtacggccagcccaaggtcatcctagcaagggagccaggtacctggcagcaaaggagcccttccgtgcattacgttcaagtcagcctcccaggccagagaaacaggtgaagacgggaagtaggtctggaggggtgaatggatgacatgtccttggtatacgtgttgtattgagttgttgtttttaacactctaaatagggagatcatggaatggattggttgattaagcacatgggctctgaagtcaggcagacctgggtttgatgcccagctccgccagttgtttacttgtcaccttgggtgagttacttaacctgttttgtgtcatttgtgtattgggtatgatgatagtacctgtccagtacattccgagaagtagatgaggtaatatatgtaaaacagtcaccataacaccaggcataaagcacagtgattgtcaccattgtgtgtatttccttatatctgaatatatgaagtacacccattcctttctactcacttatgtttgtgtatccttttttgctagtgttgtcttaactattctgtgaatttggagattgcatgtgtctgtgctctgaaagtctcgactttcccatttttaatgtcagccgtatcagtctgtaattcagtgaagataattagggctattcagtgttaacactgcctcacaggggacacttttagccagtggctagaccatgtaggggaatgatgatctagctgctgtgcctcaacttggaacaactgaagggcattcctgactccagagctctcatatgtggctgaggccttagtgtagccacattgcccattatcttctccctctgcccaatccttctttctctgttttcctagaagggcatctgctgaacaacactgcctgctaagttttctgcatatatgtctgtctcagagtctgtttccagggaacccgatatagtgtgaattcctaggagtgaaatttaccagatgaaagattttgctatctattgccttattgtttttttccccaaggatatggtccagaaagagtgtgcaagtataggcagtttaattcctcctttgccgtagcaagttgtttaagaagtatttttggctattgtacatcttatacttgtgttttgtggtctgtttggagtcagaagctatagggacctgaaactaacaagttagcctgccacactttcactgatgctggtggaagataggaaccttctgggtctgagatgtaggggagggacaatagcctttccttccacccatttgaagttcattagttggggtccctgtaacaaaagacagattaacaaagagaaaggtatacacttttatttcacaaaagttttaggtgacacaggagccttcataagaaaatgaataccgaagaactggttgaacctgagtgtttttatgttagctttgatgaagagtggaaagttgtgaagaaatatgatgggagcaaggggtatgaacgaagagtaataagccaggagaaacttagcaagtcttttgttcagattcctctctctgtcccttcttctgagataaggatgttgctttcctctgagtgtagggagggcacctcttatgtgagatgcttttatgacctgcttcaggggacagtcagaaaatcctacctgcacgtcatttttcagattcctccagtgtaaaattttcagtatgccaagatgccatattttgggagtagtgtctcctgaacaccatcagaaacaaaggacttactgtacagcaagcagcacaagcatcaagtttgcgtcatttctcttttgtccccaactcctatgagggatggcgtgaagtggcccaggtggatgctgtgcacccagtggatttgcatcatagctgagatctcctgagcttagaaaactggaaccttggataacggaccacaagcagacttgccttcggccccaagagaggcatctgtattatgctggacagtaagcaaatctgcccttcgctttagaggaagactgtttttcaaggctgctcgctatgcagatatccttgcaaagatagtccagagcaaccgggcagttagtgcctcactcaaaaaatgtgcaggaatgtgagacccactgagaagggttttctaactggagttttgccatggtatttgtggctttaggcaagtccagctttttctgagcagtagtttctcatctgcgaaatttatgaaataattttgtgggtgtgttttagcctgaaaattatcctcattaatgaaaattggataattaaaatacaaaaagaggtaagttttgaaatatttcacttgcttgccaactctgtaattaatttttctaattcttaaaaccatgcatgtagatacaaaacacctgtgctcctttttatattaaagatacggtgtcaatgcaaacccgtgggaaaaacctctgaggggccagtagtcctgctctgaatccagtcctgacctctggaggttgtctttctctgggtccctcctttgccttaagtgaaagctttgatgtatggtgctttcctgagagagatgatttactttggaattgaggaggtctcatcagctgctccctctataaggaataagattgggcaattgagagggaatcccaagttcatagaaaaagctgaacagcaagttctgtgcccaaatttagattccctcagggagaggcggttctgaagtaagtgagtttctagccagactagagggccagtgagagaggaaccaaaatcacagtggttctcagagttttggaactcagaagctatttgcatttataaaaattatttagaactcctaggccgggcacggtggctcacacctgtaatcccagcactttgggaggccgaggcaggcggatcacgacgtcaggagatcgagaccatcatggttaacatggtgaaaccccgtctctactaaaaatacaaaaaaaattagccaggcatgatggcgtgcgcctgtagtcccagcttctcaggaggctgaggcaggagaatcactggaatccaggaggcggaggttgcattgagccgagattgcgctactgcactccagcctgggcaacagaatgagactccatctcaaaaaaaaaaatttatttagaacacctaaagagtgttttgtgtgatttatatttgttaatatttactatgtaagaaattttaaaaattatttaaataacaaattcattacctaacacatttttaatgacaaataactttttcaagacaaaaaatttaacgagaagagtggcactgttttctgtttttgcaaatctctttaacattgtggcataatagaagacagctagactctgaacgcctgcagtcagcctgttaaagcatgttgtattggttgaagtatataaagaaaatccccctcacacaggtgatacagttgaaaagagaggagtatctcaatggccttttcagataattctttggtacaactccaaaactcagtcagtagtagtttcttcagagtaaattgcaacgtggaatctgaaaacaccagtgaatttttcatgtcttggtctgtcttgtattccaaatagatcttttacctgtatatgatttcttaacatcctgcatctgtcatttggaaaatgagttgtatagattttcccagtgttaactcatcttgttatacaatatcaaaaatcacattcattagtatcaccgtgggtttcaacagaaaagtcttttaagtgttgggaagctatcaagcccaagatgacagataaaagctattcggaattctaacttttgcttgaaagcttgaattttgttattggcagtaaatagtgtcagttattccccttgaagtgtcaggttcactttatttattttcaagaaaatgtctgccaaagaacccaaacccgcaaaaccatagttacggtgtgacattgaaaaaaagtgtctaattcatctctcggttcagtcacacaagtgcagttagattatttgactatgatgaagtatctttttttttttttttttttttttttgagacggagtctcgctctgtcacccaggctggagtgcagtggcgagatctccgctcactgcaaactccacctcccgggttcacaccattctgctgcctcagcctccaatgtagctggaactacaggcacccgccgctatgcccagccaatttttttttttttttgtatttttttagtagagacagggtttcatcgtattagccaggatgatctcaatttcctgacctcgtgatcctcctgcttcggcctcccaaactgctgggattacaggtgtgagccactgcgcccggctaagaagtatcttatatatagagtttcaatttcgtataccgaatattttttaaagtaattgagggctaagattaacagaaataaatttgtgctgtgtcatcaagaacattctaatgtgaaactggcatttttctttgaactgtgagggcctggcagtgaagaatgtaactaccagggtagtctggtatcactgctgctttcactcatgctaagattcgttttacccagagttgcttttgcacagtctgcaaatgtcaacacagtaaaagatgacatcttaatgttatcatgcaagtaactctgacctcctgctactactctgcattgtctccattccaactgcaggggctttatgtttctcaggcaggttagattcccttctcagggcccccacttatggggacttcaggtgttcttcacctgggcatcctcatatcttgcttcctcactgcctcctggtccttgctcagatgtcacccctgacaagaggcctatccagaccactcttttaaaagacgcctctcctctagtctgccctcagtatctccccttaaactgtgtgcacgtgtgggtgtgtgggtggtggttgcattcagtggaatgtacttaagtctacagctgtatgtgttttgatagtgcatgcatctttgtaaaccatactcctatcaaggaaacatttccatcatcacgtaaagatcttcatccctctttctagtcagtctcactcctgctctgatgcaagcactgttctgatttcttaaaccgtagattaattttgtctgttcttgaacttcataaaaaaggaattgtgcaatatgtgcttaactgtgtcagcaaaatgttttggatattcatccttgttttggaacatcagtaatttgtttctgttgctaagtggtatttcattttacagatacaccacggtatatctattcattcttctattaatggacattaatagagaagtgttataacactttcactaaggaagtatgagagttcaacatttggagttagatatctttttaattttattctagtggcatctcattgtggtttttaattagcattttcctgatgactaataatgttaaagaactcatgattgggttgtttccagttttttatttttttatttttatttatttattttttttgaaatggagtctcgctctgttgcccaagctacagtgcactggcgcaaccgcggctcactgcagcctgcttcccaggttcaagcggttctcctgcctcagcctccggagtagctgggattacaggcgtgcaccaccatgcccggctaattttatttttaatagagaccatgttggccaggctggtcttgaactcctgatctcaggtgatcgctggcctcggatacccaaagtgctgggattacaggtatgaggcaccacacccagcctgtttttttacgcttatggataaagctggtatgacattcatactcaagttttgttttgttatgttttcatttcttttgtaactgtggaattgtactttaacagaaattttcagactagtttgttctatgattttacactttcactaaggaagtgtgagagtccaacatttggagttatgtatctttttacttttaactattttagtggcatcttattatggtttttaatttgcattttcctgatgacataatgttgaagaacttcttcctttttggccatttccatatctacctttgtgaagtgccttttcaaatattttggccattttaaaaattgagaaagttttgtttttgttttgtttttttaaatattttatatcacatatttgttcatcccccatccagccatcagtttattgtatttttgatgcagtaagttgcagacatcagtatatttctttctgaaatattgcagcatgcacatcattaactcaagctcagtgtttctagggtttttttgagacaaaacttacatacatctgtgcatgtaggagttatttatgttctgaatacaagttctttgccacatatatatatagtgaatattttcttctagcctgttaatgttgtcttttgatgagtttctattttatcaattttttcttttatggttaattccttatgactctcgtctaatgaatcattggctatgccaagatggtaagatattttctgttttcttctagaaattttgtagttatagtgctgacatttttatccatggtttgcctctaactttttgtgtacagcatgaggtagaaatcaaaggacatgtctttcatagataacctgtgatcctattaactttttttttttttttgagacagagtgtcactctgtcacccaggctggagtgcagtggcgcaatcttggctcaccgcaacctccacctcccgggttcaggcgattctcctgccccagcctcctgagtagctgagattacaggtgctgccccaccacacccggctaatttttgtatttttagtagagacactgtttctccgtgttggccaggctgatcttgaactcctgacctcaagtgatctgcccaccttggcctcccaaagtgctgggattacaggcatgagccactgcacctattaacatttattgaaaaaattttctttgcttattgcattgtttatctctaagtctgtcatagttttatatatcataaatagagttttttcaaacttatttgttgtgtgtatgtatggggtggaggggtgtgtagaaattgaaggttgtacgttgacttcgtattctgtaatgctaaattgactcactgacaagtagtttttttgtggattccttaagattgtttacatgcataattatgtcatctgcaaaaaaagacagttatacattttatctcctcttgttgatttatttcatggctaaggacccaatacagtattgaatagaaacgacaagagtagtccttgaattgtttctgatcacagttgggaaagcatttactttctctctattacacatgaagtgctgttttcgtcaatgcccctgatcagtggtcagagatactcctttattttcgtagtttgctgagggttttcatcataaatgatgttgaattttgtcaaataatttcttatgagaagatcatgatttttattttgttaatgtgttgaaaactattgacttttgaatatcagaacagccttgtatttctgacatacactctacttggtcttcatatgtaacatttaaaatttttaaattcaatttgctgacattttattgatgattttcacatctatatttaaaaaagatattagactgtagagttattgtaatgtctttggttttggccataaaatgagttggaaagtgttcctacctcctcttcttagttcttggtttgtgtaaaattgaaattatttcttccttaaatgcttggtgaaattcaccagtgaagccatctggatctgaagctttctctgtgaaaagatttttagtaatgaattccatttatttgatagatataggactgatccagtttttcactgcagtttttttttcagttatataatttatttttttaaattgttttttcccttaattacataagttctattggtgtttttttgcagtctctatttcttaattcaggctttctgtttctttcttcattgcatgcatgttttcgtttaaatccttgaataaatttacagtaactattctaaagtccatttctactaatttcattttcagttgttttctttctttctatgaggggattacattttcttgcttccttgcatgtctaggaattttttattgtgtgctgtacatttgtatgtattacattgctgactacctggattttgttatttttcttaatagagtgttgaattttgtttcattaggcagttgacttacatgccaatcagcttgattttgttagggtgtgttttgtagctaaattgtctctactcctaaggtgtggcctttctactaaatatcacagagtgtttagcttgttctctcctctctggctaggcagaactcaaacatttccttgctctgtgcaagctctgttatttcttcaacatgcaattgcagggtaaattttttttccccaggtatggtaggctggaaaatggtctcccagataatatctaggttttcatctctgaaacctgtgagtgttaccttatgtggcaaaatttaccttgctggtatatgagtaaattacagatctttagatgagagattatcctggattatctgggtgggccctaaatgtaatcacttttccttataaggaggagaggtgaggaagatttgacacacagaaggccttgtaaccgtggaagcttctggagggatcccaggcctactaacatctggattttgtacagaactgtaggagcataaattctgttgctctaagccaccaattttgtcagcttaaatttgttacagcagccacaggaagctaatgcagcaggtgttctcccagaaatcatctctccagcagttactttttccctaagtctaaagactcatcctgcacatgtgcagcttcatggtcagccaaagattcaagggaacccagtatgcaggtcctgaattccatagtgtagctccctttcagtggtatcctcacccagatattccagccaccgccataaccccaaacttcagtttgtgcctttatttttttcaactaaagccccaatgaaacagtttgtctcttaagctcagcaagacagggttttgtgtgagtcccccactccctgctccacaatctggaaattgcctccaggcagaaagctccgcattcatggggtctacttcatttgattttcttctctcaggcatcacagtcatatgcttggatttgttcattatctgaaaatggtcattttatattttgtcctgttttatataattatggtgcaggaaagctagttccataccaattactcccctacagctagggatggaataacctgctttattttcatccattgtgtgatataaatgtttcatgtttcattcattatttggcccctctttctatagactgtaacctccaggagagcagaggctccttttttttctttttttttggaggtgagtgtttcacactgtcacccaggctggagtgcagtggcacaatcttgactcattgcaacttccacttctgggatgcgagcagttctcctgcctcagccacctgagtaactgggactacaggcatccgccactgtgcccagctgaggctcttttactggtggctgtttccgcagtttgatttaatacacacagtttggtttaataagtgtttgttgcataagggaatctttatgagaatcagagcctactccggcaaacaagccttaaaagccacatgtttgctttcctgccatgctttagggtttatggccaggctggagatagatatgtcaccttggatttacggtcatgtggtggtgactcagcagagaaattctgctgcagacagaaacatcctggtccagggaacgcaacctgccccaatgccatcagtggtgtcgtgctcagccccgtcagcagcaacagtggttttcctagggtcattctctagcatgattttggttctggtgcaaccacctagcgaccgttatttctgcccgtcttccaattctgccccttcagccttcccggtgattctgagatgcccagtacagctggctctttgtgtcacagattttgatatctacaaggggtcctggaaccagtcccccttggaaatgaagagcctacagtgttcttacagtaaattccttctctgctgaagtcatccagggtcagcctttggtgtttatagctaagagctctgactgataacactgttaaagctgctcaagcctctgatttcccactacttctcctggatttgtaataagaatttggtgggggccaaaatctcagaagtcaccactaaagaacttatccatgtaaccaaaaaaccacctgttccccaaaaactattgaaattttttgaaaaaaatctgtgtataagtgcaccacacagctcagacctgtgttcaagaatcaacgtaaatgcaagtacaaaaaagactggaaggaaatattcaaatatactaacagtcctttttatcctcttggtaaggagcttacaggcagtttataaactcatactttattctgctttccaaattacgttccttaaaatgtgctgctttgataattagagaatggaatttttgaaatccctgagaacgaaagacaaaatatgccagaaactttattaaaatgatttggagtagtgtgtcactgtatactgtatgtgtatttttacatacatattatttcctttctgaaaaagaattggaaaaaaatatggtgaggggatgtaaacacaaaagaaactttgcttcaactttggcaaattcaagtttattgtcaatactttagatctttatattatgtagatatttatgcaaattaaatgtggtgtttaagagaggctgtgcctccagcttgctgctcttgtctcctaatgcctttgctgaccaaattaatcagattttatttttaaccctaagttagaaatcttactgtatttttacttcattctactgagaaccataggttgattattttttttattcaaagtgttggcttttgtttgctgtgctttatatatggagaaatgctatttttattttcccatttaggagtttcataatagaagagcagagtttcttactatgtgaagatcttctctatggaagaatgtcattcagaggatttaatcctgaggttgaggtattaaatataattgcttcaaattaaaaatttttccaattgaatttttttctgctaataattgggcttaggtgtttctccaccaggtaccatttctactcattatatagaaaataacaagtcttgaaatatcgccatagctatttaaagaaattggaggcattgcagtctagttttatggtagaggtgagtagataatttcatatagcagtatacagcccttgacagagccaccataaatattaaaatttcaagttgtgtcttttacaggaacgtcaagattttattcatatcatgctattatgaaaagttattttctggcacctatacatgtattttttctaacggaaaaatgttactttagaattatgtcatttgactttttaatggactgttgtaatccaagcttgtaagtagatttttaaatgaatcctttcgacagtttgtttgaaaaatgaatatttgccttataactgagctattcatttgaattttcctgctccaggatagagaagcagacctttatttaacaaatattcattagaactctggctcatatgttaaaagccatcctatcaagtacttgatgaaccaaatggacacatgagatataaatctttagtttggtaaatattacttgaagccagtgtttcttgcccttggcagtgttaacatttggggccagataattctttgtggtggtggctttcctaagagaatgacgaaccacatccctgtcctctgttctctaccaactaaatatcagtagcacacacacaccccaccctcctacccagctgtgacaaccaaaaatgtttccagacattttcacaggttccctggtggggaaaatcatccccagttaagaaccacttctctaggagccacagttaactaagccaattgccagagtttattgaaagattctaggttagttttccttttcttttttggcggagtgggaggaggcatgtgtgataattaaggtgttatgttagaagtgtttgtttttaatatatgctggtctcgctttgactttctttaattaagcttcagattgagaaggagaggggctgggcagtggggtgaagagggaagaaaaaggcagggattatgaagatgtggtattcaaagagtagggtttggataggcgagcattccaaagtatgtctgctgcaatgggaaaggagaggtgccactgcccgcagaaattgatggggggcagggacgggtgttagaaaatggccctaattactggattctgaaacactgaatacactccccctaggaaaaggttttaaactattatcactcttttaagccttagaaaaactagttaagactgatttctcatcttttattccttctcctcttgctaaaaagaagagattacacatttaaaaaaaaaaaggtcagaggataattatcacaaaaaggtttatgtgaaagagttggaggagagaccctgtggtgcatggatgttacatgggatgcattatccactctaaagtttaggagggtaaggctgaggtgcagattccctccattaaacagggccagccttccacttctcccacctcctccactcaccaccaccaccaccaagagatgcatttaaaattattactgacgactagtgtttcttccatatggcttaaagatgggtgggggaagttcagggaaaatctgaaagtttattatttcttcccccactcaccggaatgtgtcagcagtatgcctgctttaaatatgagtaactaatactaagatttatgatcttaaatacactttaaattcaccctaagtataattcagtggggctttgccttactatttttttgactcagagcttacttctcttacaccattgtggtatcaagtattacagagagtcccttatcaattttgactagttctctagattatttgacttcagtttctctgccttcaggtaagtttgacatcagttcctttcacaagcgttttctagcctgaaggtcagcactggtgtatttttcagaaattgatgcttcagatgaatgctaagcacaaagcagaagaagttgaagatgaaacagtagagcttgatgtgtcagatgaagagatggctagaaggtaaccgtgctgcgcagcagccttctaatctggacctagcattcattggctctcccaggaatgctcctcttaccccacagtgcacggcagctttcaagggagtcccccagtaggacgatgactgtgatcggccttctcttaatggcctacgggggccacagacctgtctcaggctgccagttgagggcccatttccagagctgctggaaatgtgtattttaaaatgtacatctctatttatttagggtaatgcaaacaccaaaatggcaaggaatttaatcactcttagagaagttcataaattgttaaatcagatggtttcttttaatgatagttttctttttcgtaatcttttttattgcatatttggtctgatattcttgacaaggcttgatccctacctttttatttgaaattaaacgtgtgctgcctgtcctcttgacagatatgagaccttggtggggacaattgggaaaaagtttgccagaaagagagaccatgccaattatgaagaagatgaaaatggagacataacaccaattaaagcaaagaagatgttcttaaagccccaggattaagatggatgccttaagcgatggcccaggggtgcttggtggaagtcagcagggcatctggagctcatcccaatggtgtctctatagttattaatactgtaacgtttacttgtaaagagattatcattttagaaacatgctgtttttgaaacagatgtgtgatggatgttgtacatcctttgcttcttggtattcattcagagtggatttttagcccctgatctacaaatgtacattgttacagggctgcttcctaaagattttttttacctcaggtttctcttaatatagttctccagtcactgaccttgaattgacttacataaactactgccaatgtttaaattgcccttatgtttatatttattatgtcaagccaattcgtacatacaatttggaatcaaatgtcataagaatttattatataaatttatcaagaataaaaatgcctctccagccttaagtatttacatgctcccaggtcattgtcagtttatggtattatgttgttttatttaaagcattgaattgatagaaaaatttgctctgtaataaaaatctactttcacatactttttatattttcttgtactttcaaataacaattttagtctaattcagtaatataacttttttccaaataataactttaaaaaacagccattgatcagaatatagtgatgtattaggttgaaccataagaaattgccttttacaggtcaaaaataacctttagtttcttacggtataacccaacagaatttaccactgaccaatggtaccatctcctagtctgaactctattctaaatgctaagtacagaaagaagcacatagaattaagtgtgtgtatgtgtgtctgtctttctgtctgcagataagtacctaggacttctgagaactactgatttaatttcgctcccaggaagtgaatgaggtacatgtctcctctctcctcaaatctctgtaaggaaggttttattgctctgtgacctcagttctctggtgagttatgagaaaagataggactttgaagttaatctggccttttttttttttttcactgtgagtatgagaatgatgcacctcccaactctgggaagtaacgagttcttcccagtgccttaccagcaccacaatccacggacttactaccggacttactacgtgtcttatgtacctgtctgcacagtcgacttctgattgacaaactcatttcaccataaaagaagtggggtaatgggggcttatgcctcttgagtgcactggtcttagcatatcccccatcacccaggaatagcgggcataataggacgatggaatggtctgctgaagacacatttatggccctaggtggaatacaactccatctgacaaatgtaacgtgtgctttgattgagtgaccactccatgggactgttcttggtcagaatgcacggtctggaatcaagcagaggtagatggagtggtcccactcatgggtgatttgtttcctgcttctcttgagttcccaagggaggagtgctcccgctaggggacacaacaatggctccattgagacaggaattgagactatccagtcatttcagcactgaaccaacgggctggaggttactgttttggctggtgcaagtgatcctggcaacaaaggggcatttatgtcgttcctacacagtggatggtgagaaaggcatctggaacccaaggattctctagggcatttttagcacttcccatgtatgccactaacttctaagggacagctataacagtctcaaagaggggaatgattgaggtcctttagggaatgatgttttggtacaccccaccccgtataaatcctgagaagctgagctactggctgagggaagaggaaccatgggatgtgtaaggaaagaaggaaatttattatttcagccttatgactagccagttacagaaacaagttactgcaactgttacatggagggttggcactccatatcagtgagttccagatatcgacttgactaaccacagaaagtactcaaaaaataaaaatacaataaaaaataatataaagtacaatacagtatgacaactacatagcattgacattgtattaggcatcataaatcatctagaggtagtctaagggatacaggaggatgcacgtaagttatatgcaaacatgctgtctaaggtaaggggtttgagcatctgtggattttggtatctgcaggaggtcctggaaccagtccttggatacccagggatgactgttttcttctgcgtgtgtgtgtgtgtgtgtgtgtgtgtgtatgtgtgtgtactaatttcttctcttacctccttattttgttttcttagggcgttaatttcgctatttagtcgtagggtaagaatattaggtgggtttgtgattaattttaggtgtaattaactgatagaatgtctgctgggactttgtgtctcctcattttggagaaaggctgagggtatcttgtacaaaggatgtttgcagtgtattcggtagaaacagttgttttccttgttgcaggaagtttaggttagaagtctgtggatgctaaatgg

SEQ ID NO: 16225 - DNA, 41318 bp, Human
  misc_feature (1)...(41318): n = A,T,C or G
tgacagcatcatcatcatcatcattatcatcattacaatcatacacagtatttactatatatacacaaatctcttgacatagattatctcatctaatccccaccacaactatctgatgcagatgttattatgcctgttttatttattttttagaattttttattttatttatttcaatagcttttgggggagcaggtggtgttttgttacctggataagttctttaatggtgatttgtgggttttggtgcacccatcatctgagcagtgtacactatacccaatgtgtagtcttttatgcatcaccccccactccaacacttacccccaagtccccaaagtccattgtatcatttttatgcctttgtattctcatagcctagctccaacttatgagtgagaacatagaatgttcagttttccactcccaagttacttcacttaggataatggtctgcaactccatccaggttgctgtgaatgccattatttcatccctttttatggctgagtagtattccatggtatgtatataccacgaattatttatccactcattgattgatgggcattttggctggtttcattttttgcaattgcaaattgtgctgctataaacaagtgtgttcaagtatcttttttgtataatgactccttttcctcattttcaagacagcatcagctgcggtagtatagggagaatgcaagattgccctaaggtctcctggataagtattcgtgtttctcaggctaatagtcaaaactattacaaagttcagctggaagtttccttctccctgtggtccttcctcaatttcactggcagccctcctcaaggacccctgtgagataaagtcagaaatgacttccctgggcaccaagagtacctacagggctcttcccactgcttctacttttatatttcgttttgctctctaaattcatcccagctctaggtaaggttaaatccttctcctgtgatctggatttttaggttccctagtgggtttgcgtgtttggaggcagattttttcccccactcacactttgggcactcacagtttttcagctgtctcatggagtttgcagcggcaagccacttctttcaaaggtcctgtgaattcttttggttttcctggtatgttcatgcagtacttcttggaggaaaatttcactgtgtgagtctccacatgctgttctgtctgtctgcgtggaaactgcaagttagtcctgcctcctatccaccattttccaacaatctgtcgttaaccatttcaaagtatagaattcagtggcatttagtacattcataatgctgtgtaaccacaacctctatccagtttcaaaacactttcatcacacccaaaagaaaactccatactcattagcaatccttccccattcccttctttccccagcccctggcagccactcgatcatgcctattttaaattgaggaaactaaagctgagaaaagttatacaatttttccaacatgactctgataatagctggtgaacgcaatactcgaacccaggacttgtgattcccaagatcagactcctcccatatacctgtcttttatttcccaagtgcttgggcaatcagctgcacttaaaaagcctttacaaattgagtttactaatgtgagtaatatatgattttttaaaaataataattgtccctaaaggtgaaatggatcaaagcccttaaaagtgaatctgtggtgtagtaactgttaacataattgtcttattttattctcatccccttaaagaataaaactgatgaacaagtgaggatgctggtgtaactccctaacttagtttatagtctgtaagcagaagagtgagtctaaagtacatatcaccagacagtgtttctcctagcatttcgctgttgcattaatcaacaagttaaaatataaacaacggctaaccttgggtttcaaatttaacattccttatctcttagaccaggtttatccactgtgctggggactcccaagccagcactggctcatactgattcattttgatctctgctaataccagagtcctgcgtggcagagccattggcaccagaaattacaagtacgtaaagtaagtaaccagatataatctctgatttctttggatgaggaaagtggggtctggagttttcctgttttgttattgtgctccagggaagaaccaccttatcagaaagcagctttctctgtccaaccctggaggagctataaagctactccttggcccaaagtataggagtagtaaatgtttggatacttataatgggacaatatcattgattcaaccacttaataatctacccagcagtatacttacctgtcttccatgtacacaggtaagtatactgttgggtagattattaagtggttgaatcaaatgggaaaaacttggatttctaatgcaagaggaaaagtctctttttttttttagtgcttccatcagcagcttctaacattgtctgagatcatagtttttgaagggtgactaccaaatgttggcatttggcacaagtgggaagcaaaaggcaagcccctttagaatttgactaatctgttctgtcatgtcatctttttttctgttgttaaaagtgtttcgtgcttcattctatgtattatgtcaaaatttattgatttccatgtgattggcacatcttttttactaatcctgctccagttaaattcacaagatcataaacatcaagggtttgaaaatcatttttagatattcaggtctatgccatctgttctgcagatggagaaactgagtccttggttattagagtttcccctgcatcctagggaatctgctatggccttgtaactggcacagaggacctaaagcctgggagaatttttatttgcttgttgtggttaggaacatttgagtaaatgaggagctgctgctagaggacagaaatcccagagtatggccctccttggacccaagtttcttaccagctgtgctcctttgttcccaggggctaagtaggcaccttcacccaccccaactgccatccagctgaatctctctctgattactcctgaaatgtcacaacccacttgaggatagggtatcattgtgcagtctgtgccaaccagtattctgaagtattttcatgcactaaggtgtaggagtgtgtgtgtgtgtgtatgtgtgtgtgtgagagagagagacagagggagtagggaaggaggagaagatggggaatgcataaatagagggctggatacaaatctgacagtgccaatggcttcctagtaaatgcataggtgagtcacactggaaacagttaaacattggctaattgatacaatgctagcctcaaatatagtataatatgcattttcttgacatcaacaaataaaatctccgggtcaataaaataaactcggaaaataaaactcttgcccagaagttttcaactttctaggttcaaggagcccttggtgtgcaatttcttcaaggtgcccccagaccatagtttctcctattaagtagacaaaaacttaataactatttatgttctaacaactttgtagttttttgaacaagtaatatacaaactaaaagaaaaataatatttttatttcattcttaatcccaattacttaataataaggtttatgtgcctgctgagcactgcacaacttctcaaaccttggaatcagatcagacatgaacccttcatttctattctacctcagttttcatgcaatacttgctttttgtcatagcaattgtcaaacacccagctttgcaaagatatgatgtcagcaaatggaacacagtcttttacaatattaaaactgttaactactttcagctaatacttagcatagtgttcaactgacatcaagaatcactgtgcttcttcaaaattttaaaatagctcagagtgccgctgcagtttggtaatgacaggcgtcacctcatgttttgacctctcatgatctactgtcctactaaaccaaagcggacactcaatctgacttcagtaaattatatatttgcattttacaactttcaagaagaggaagcagtataaaattcacaaaaaagcatagtagtttctaaccctgtagttaaaaatcagtcacttttatacaaccaatagcgatttcccaactcatttagtaattttatgttgcttaagttattttacttgtttttttcactcaattttcacccattggcatctaccttcctaatttagtcctattttcttatttttatctcttatttattttatatttagtcagctttactgaggcttttctcattaaaataataataataaatttatcttaaaacttccaacaacggaatggccaaatttttattaaatatctatgctggggttcaatcaggctggtgggaaaaatattaaagatagttatggagatagacacaaatcttcttggaaggccgagaagtttgcataacttcagtaatagatatggttgaaggcaacctgatctttacctttagttaaacaaattaaagtagtaacaaaggaaggcagagtagtttacctacctagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaataaagtacgctgacacacagatattctgagggtcccaggtgcttacaggctccctgccgaatcgcaactgtttacagggctcagcagggagcctgtaagtggcttggaccctcagctggactggcagagcagaatatctgtgtgtcagtgtactttattcattcatcgcgtggtcaggggtctgcaaggaacagacttcccgcagctggtgccccctcgaggagcgctgccgcatatgcacataaggagcaataacatttttaatgtttttgcatttgcacgtgaaatcgcactccaataaacagcggtggcatgtcagtgtgcttttcaccccaacaaaatcccctataaattgttatcaatcactctgtctaaatgcaaagcagtcactaacaagaaattatttttagtttaaataaaaagtggcgtggggagacaaaactttttctgaagaagcacacttaaatgttttaaaccactttggtttcctccaggcctctcaggtaggcatgaccagctacaggatgcgatgccagatcctccgatcccaccccaggccctgcccctgccctcccatgaatggttaatatatatataaatatccattttagcagtgacattcccagagagccccagagctgtcaagctcccttctgccagggtgggggttcagactgtcctgtcacctctggggtgcctattggcatcctctccccctgtgcttactaatacagtcccttccccatacccatcaaaactggaccaactgccctcgtctctttccctagggccaaaatttaggggcctcagccccccgccatgcctctcctctttccacctggcctgttctgtccctgagccctgtgctctccatccattccatggctgagagtcggtgatgctgcctctgccttctgatgctgaactggccttgtttctacaagtacgcttctcccacagctgtggctgcagggacttaacttacagggaggggcctgtggcagctgccaccacagccacaggtgcactgtgctcaccacacatctggtgcagccttttctggcagaggctcttgtgttttctcattttccgttcctctcactgtggctaacaggtgggggtgaggggacagaagagggagggctgcctaccacggtctggggcttcaggaatatgagtttgtttatttaaatgaatctcagtctttcaaataaaaaataaaaaatcagtttgatttcatataattgtcaatacttgaaggagtggttggaagcatgaattttgatctgagagtgaagctgatattgatattgtgcgcctccacattcatgtgctctcatgttggcttttctcacgtttgacaacaactcatatgggaacatggtgatacaccaagcagatctgaactgaaaacttaaaagaaaaaaacaaaaaacctttcagggtgactttgaaaccgactttgtgtccttttttctttccctctctttcttctatcatcattcttatatttccctactcatttccttcactttctaaaacacaatcattaaacacacatttctagtttaccccatggctctgattccagatatactgtgactttgtcttcataaataaacctgaaattttcaagtcagacatccacaaaaatatcaaattaaaccctctacctgcaccacgaaaagctcaaaagactgccaggcatggtggctcatggctatggtcccagctactttgggatgcagaggcaggaggatcacttgagcccagacattcaaaactaacctgggcaacatagtgagacctcatctccttaaaaaataataataagggaggccgaggcgggtggatcacctgaggtcgggagttcgagaccagcctaaccgacatggagaaaccccatctctactaaaaatacaaaagtagccagacgtggtggtgtgcacttgtaatcccagctactcgggaggctgaggcaggagaatcgctcgaacccaggaggcggaggttgcagtgagccgagatcatgcaattacactccagcctgggcaacaacagtgaaactccatctcaaaaataataataataataaggaaaagccccagggagatttactgctcagagaagtctgactacattggtccagctgaggtatggtggtggcccaggtagaaggcttctgtatattggatgtttaacaaaaagttgtgtattttttaagactagtcaagtacagtagtgagaaagggggaaaaagtagaacaaggagttcaatctgtaactctgtaactgtaaacaatcaatcgagttagcgtactacctttggactagccaataaaaggtaattttgaggaaggaatctttgacctaggatattagcttacagcaaatttttactgagttaactttttttttttaaaatggagtcttgctctgtcacccaggctggagtgcagtggcacgatcttggctcactgcaacctccacttcccaggttcaagcaattcccctgcctcagcctcccaagtagctgggattacaggtgcacaccaccatgcccagctaacgtttttgtatttttggtagagacagggtttcaccatgttggccagctggtttcgaacttctgaccttaagtgatctgcccatctcgtcctcccaaagtgctaggattataggcatgaaccaccaccccggcccgagttaatttttaaattgaaatggatatagatgataaatgaattcattttacccatcacaaaatcaacccattgccaaatagttacacaacagctattatagaccaagtgtgttgttaggagctacaagaaaataagagatgagccaaagaaaatgcctactttggggaaacatataccttatatatacagaagactaatagacatgatcagttcatcaacaatgtcttatggatgatacactgtcgttggtctagcactcaagagtaaggcaagcttactgtggggtcaggcagcttctcacacctctgtgaccacctccagcccctactctcagtgctccctaactctagagcccactttcttcccttctctgcccactgaagtctattcatccttcaaaatctggagcaaatagtaatcgtctgtgttgttttcctaccaacccattgtcagaattggcacctctttctttgtgctcttattgcaatttgtacataagacatacttctgtcttagcatcttacacagaatcttgtaattatagattttcacgtctcacttccctaccagactgattgctgctctagagaaagcgtcatgccttattcttcctttgcaatcccaatacacaaacttgggcttagcaatatagaaaccacggagtgtttgatgcctgagctcatcagagaatgaatcacagatctgagttgatagaatgttatagggcatttcgtttcaccctctatataatgtgttaatctgcttataatacctccaaatatttgtcatctagatgctgcttgaataaagccaattttagagcttgaaatgctggaaggtgctataagcaaaaatgtgccttttcagttccaccgctggccataattctaatctttctctccatgttgatccttcaaatgtttaaaggcaaatgtttacattactgagtcaggtgcttagattaagagacaacttagatcctcttttgcaaagtgagcccagggcagttcagtcccctgctcaaggtctccacagctagctcacagcagatccaggtctccagctgtacttccctctgctccaggcacttggagtaggtagttccttcttactaaaccagccaggtgctttcagtcagcagtgggtacctgaaactacattctagtcaaggaaatatataacactggtcctttctacactaggagcccattccttctgtctgggacacccttctggacaccctggcaggataaacactactagcctttctccaggcccccctctactggcctcctctctagtttcaggggagataggaaaattgcctcaccctctttctcatcccagctcatggaaatggctcctcaccctcccctaacacaaagaacctgctttctttcctgctgtcctgctgtgggcactaatgtcatgctatggtcagacctgctgtctttatagagccagcatgcttctgtgcacaactgccaatatcatatgtatatatgcaatactctttcctttttcctggaattgtttttctcataaaagtggatattctttatcaaatggctactatgtcatacaaaaatgagtagcatttggccgggcacagtggctcacgcctgtaatcccagcactttgggaggctgaggcaggctgatcacgaggttaggagatcaagaccatcctggctaacatggtgaaaccccgtctctactaaaaatacaaaaaattagccaggcatggtggcgggcgcctgtagtcccagctattcaggaggctgaggcaggagaatggtgtgaacctaggaggcagagcttgcagtgagccgagatctcaccactgcactccagcctgggcaacagtgcaagactccatctcaaaaaaaaaaaaaaaaaaaaaagagtagcattctatcccatcttgcgagtgagtaaactgaggctcaaaaggggtaagtcattttcctatatcaccaagttgactcatgatagaataggattctgaaacacatgtgtctacccccaatacccatacttcacaactgcctctctaaatgtggggtcaccttactcctgttgggcccagagaggggaaaattatacaaggtttttgattttatagtgtccttcagggcctaaaacatgaattcccctagaaggaatctactggttcttccccagtaaattatatccagttgctatgggaagcaaccagccctgcaacacttttacatgttgcttgaaaaaagaggacctttttatttcattaaaaaaaattgagcattttagtctctacagttaagactaaaatattgaatattttagtctctacagttgagctgcttctctcaggttcctaatccaaaacaaaaaaagatgcatatccagctttgagaagagaattcacctgtgaaataaaaaatagcaaatttttagaaaaattatgtctttgggggcactgcacttaacaaacttagggagataaaactgtcacaaaaatatattgggggaaaagctaacatcacataatttagtgacaaatgtgtgtgctactgaccagaaatgctataggaattaaaagaacagaggctcattgatgtgaaaggcagataccaattcttggaaatgcttttaaagtttcaataacttacagctactgagcacttactatgtgccaggagctattctgagacgccttacattattaactcacttgattctcacagaacacttcaaggaagctactattgttttctttatatttgtgatgcacagaagggttaatctgtccaagattacactgtcgtaactgatagagccgcgctttatctcaggcagcctggatccagagcctggttgcttaatcaatgcactctgttgcctctcggtgttcttacacatgtgtgttattaacacatggcctggtgccagaagattctctggcccatcccagtggtgactgtgccatgtgccctggaggtgaatcagtatccaattgagaagggagggatggctttgcatgcctacctttctaccacaaaccctccctggcagccaccctctctctctcccactggtgaccatcactggtgacctgtgaaagggacacaccaacagcacagctggggccctggcattgtgccaggggcaggatcacacagggcagtgccgcggtagcacccgtggtgccacaggtgtggtggctcctggtcccaactccaccccaccagctgctgtgtggtgttgtgtcaggtcaccacaccaatcggagcttcagttttgtatgtgataaagagattgtgtctgacaaggtgaccttttcctagtctgctgatctatgcagttctagggccacagaatggagactagaggcagcagctcagtctgaagtgcaagactttatccagtaaaaggtccaattccagcagctctgccagaagctacagccttgacaactgtacgaacatttggcactggtgctgcatgaggggcgggaacataccaagcacagggttaaccagtgacctgaacattttccttctcacattcacacaccagagacccgctacagaagattcaaactgagcaaatcgcctaatcttccaaattctttttcctggcttgttagagcagccaagggtggggtggagcttgtgaataaaaagcctgcttcatcttcctcatgcaggagaacatggccaagcgagttgccattgtgggagctggggtcagcggcctggcctccatcaagtgctgtctggaagaaggactggagcccacctgctttgagaggagcgatgaccttggggggctgtggagattcaccgtaagtggggtttcaacaactttatctgtctattggagaatggcttggcagctgggaaattatatctgtgcttctttcacaagggttggtggccttgaggaaggttagaaatgtctgctgaacaggggaccatgaggagccactgaaattgtaaaagaaacaggacatgggtgagctagggtggaagtcagaacagacttgtacactttatctagagccaaggggaagaagtgtttccaaagatgcccaagaagtatggaagagaatggagtaactgggccaggccaggaaagcctaggagcaaaggagcaggaccagggcgtctgaagcagggccagagacggcagtgttaggagcaagagcaagaatttcagcctctgcctgcaagactgagctgcttttacctgcttcttttcccagcctggctccgtctgcattacagactcagggctctgtgtaggatgagctccataatcaaggtcctgctgacctggcaatcccagtgcaggccaagaacaaacagaagtaaagaatgtgagttttgagtcttttttttattccctgagcagaagaaaagtaatatactcaagtctcagcagggttactgcctggatcggagaaaggaatgaaggggtgaggaccgaggaaaggggactataaagcccacccttgcctggcctggggccccacgagatcacaagggcccttcttaaagccattgaaaccctgaagccaggcagggaaaatgttccctgaactccatggcttagtcagggaaacatttgcatcaaatctttccagagtttctattttccctccttttgagcaaaaacatttcccatgagctttaaatttgctgaggagaaagctgtcagaaagagtgaaaagaagcaaggtatcagatagccccgcctcagatcccctgaggggctgagagaaagacacagcatttctctgttacagaagggtagaatttggaactgaagtaaagtaattattttctagctcagtgagtaaaactccagagaggccaaggttactagtttagtcacagtcctccagcataggcggcttggctcacataaagaactgcatatcttaaagtgtacccaccaaatgtgatcatcaatgcatggagactgccaaagaggacaaggtaaaagagcatgcctcttctcaggaatcaaaccacatatgttccaacaggatggcagaaacctgacacctaggccaaaaatctccccactcccatgtccatcgaagacattattatcaaacatgatgcctttcccctagggagcctcagaatccttcttaacattattccaaacaagcatacctaatcagtcagggtcaggagttggcttgaaagatgaaactgcctaactaaattagccgagttatttgactaaagtaatctcagtcaaaacaaaaactaaacctaaagatcaaaagcagtacttagcctcttgcagcaccagacataaatgctccttgtataggtcacaggcacctaatcatcaacactaaaaatcactgatctaagaatcaagagaaatgagtctggatccagctgggcccatttccagctgtgtgatgcaggtaggtcaaacaccagtgcacaaagcacaaaaccctgtgggggacacaaaaatgaggattcaccctgccctcaggagctgtcaggtagatggaagaaggctaggattctgcaagtcagaaacagtgctgtgagcatttcattgagagcaggatgacagccacatttaggaagccagaaaaggcttcactgaagaggtagtgtgtgatggactttgaaaaatttcaacaggtagacaagattgagcagaagacaccagggagggtagggacagtaaagaaaaagtactgggcatattcagaaagtaaaaatagctttttggtgcataaggtacacgtaagaggaagaatgggagggaaaagggtggctgcatgtttgggcaaggggtttatactcagttttaaaagcaataggtaatgaggaacaaaattaaggagatttcctggttgtcgcgtttgttttgtttgcatgataggaagacccaaagatttttgtaggcaaatagaaactatctggatgaccagaaataactgagcacataaatccaaattgagacacaatcctggcaggaaaagggaggagtggaattgtaggtaccagtggaagggttagccctggcaaggtggggagacaagagatacaccctccccagagattggaggggaagggaaggtgaacatggaagagaaattttgaggtagaggaagaagatataagagcactcacaccagaggccctcaattctatcgagaaaatatggcacctgcaagggtaaagagggtgtgggggtggcaaatggggttggagaattagaaaaatagagaaggtcagccaggcacggtggctcacgcctgtaatcccagcactttggaaggccgaggtggacagatcacctgaggtcaggagttcgagaccagcctggtcaacatggcgaaatcccatctctactaaaatacaaaaattagccaggcatggtggcatgcacctgtaatcccagctactcaggaggctgaggcaggagaatcgctggaacctgggggacaagattgtaccactgcactccagcctgggtgacacagaaaggctccatctcaaaaaaaaaaaaaaaaaaaaaaagaatattgtggagaatgcaataggacatcaaaaagattagtaagaggaatatcaagcagtagccaaggtaaaatggcacccaatttacaagtcattccagctctattacctcatttataaaatgaaaacatgggaccagtatgaaacacatacaaaagctgaattagtaacgggcttaggaaaatccaccctcaccttcatgcagcagccttctcttgacactgcagcctttttaggcacctctgtaataccttgagatttctctaaagcttgactggacattcctaaactaggcaatcttgaaggtgccttcagctctaatatgcgatgagtctcctgagtctttctagagacattcctttccctccttccccaacacacacaggacacacacacacacacacacacacacacacaaaaggttagagatgtctttgcactcaaggtaggtggcccatttaaaacctgtaaaatcaaaaaccctgccctggcaatggctgtgcttgctagaaagtgttcagaagggaattcttactgccttagggtggaagggaccataatgcaaaagtagaaaggcaaattgcagagatccaataaaacacatgtggtgacagtttccatttccagatggggagaggccccagagaatatagacatcataaattactgcattttggccaggcgcggtggctcatgcctgtaatcccagctcttagggtggcagaggcaggaggatagcttgagcccaggagttcaagacctgcctgggcaatataacaagaccccgttccgttctccataaaaaggaaaaaaaagacaaaaataaataaataaattaccgcatttcattggatactcacaatgtcatgactctggcctctcccagctaccacagttttaaggaaaagagagataaggcaggagttacaatgaaaaagaaagaacatcatacactggggaaggagagagggtggaaaccattaaaaagaaaaatgctacagggataaagaaccacttctgacccaagtagaggctggacatgtgtgtgaaacacttctcagactcttgagagggaggggaggcttaggaaagtaaaactgtaggttgactatcgccattaaaaagtgatacttgaaacaaaatttgaggaattatcatcaaatattactttcagagaattttagtataggaagagaccttggagaattagaaaaatagagaaggtcagccaggcacagtggctcacgcctgtaatcccagcactttggaaggccgaggtggacagatcacctgaggtcaggagttcgagaccagcctggtcaacatgacgaaaccccatctctactaaaaatatgaaaattagccaggcatggtggcgtgcgcctgtaatcccagctacccagtcttcaggtaaaagcacacagacatcatctagaggtgactaacagtactgtggggtaaaaatacactgtgcttcatccttcacctccctgtaacatttgctggggcccagtaaccctccctagaatgatattttcctcatgtgcatccagttcttttcctcggcacatgcacgctttcatttattcaacaaacattgattgaaaccctactatgtgccttacataccacattttttacattcagtgagggcaatgatgaagtgtaaaaatacttcacacttttaaatcacaagaatagttcctcaactatttcttctttaggtttggtaaatctgattcctgtaacctttcattaaaagccttatttctaaaacgtctattcgtatattcaataaacatttttaattactatcatcctagtggggtacccctgacaggcccctatcctcatggagcttgcattcttggaggttccccaaatttcctctgaggtttccacagctctcctgcgatatagacccagaaactggaccctgtcctccagtgagagtctgactctcacactaggcagaaggggcaacaaagtaaaatgggtgccagctgttttaaggaaattaaaagaaggaagaaattaacattcttggagaacaggagacgtgaatgttgtgcatatagagagaaggtctctatttaggggtgaattttattatcactttatatccgtttttaaaatgagaaagaaaagaactgacctgacaaaattttcttcccattgcctacactcctgcctgaaggatacaagcttaagaaagtaaatttccatggtagctgtgaaagaataatacaaataatgattaatattattgacagcctagaggcattgttccattagtaccattagcatgatacgattgcttcattgttccattagcatgatagctatcactccaatttctcctaggggctatgtaatattgcggttccagcatatagatatggaaactgagagaagttaagaaaattcccagatcagccagctaaaaatgtagagcttgagtatgaacctaggcagtctgacattgaggcctattctgttaagaactacattgcatgcatttctggagtctgtttcacagctcaagaatcaggcaaatcctgggctgcgtctcaaagagtcccagcaagtgtcccagtggtgatggtgacctcccaactgtgctgcaggaccaaagtggaccagaaggacagaaacacctctgctcatgctcttagtctcttccctctttccatggttcaaccctcctctccttttttctctactcactcatttttctcttcatgaaaacaaaaatcttctcctaagtcgccccatccatttttagagggcacgtgcttccacactcggagttcaaggcaactggtggaccccccaccaggtacaattcccagagtgtctgcagcacgggtgggagggtgcagtgtgggtattgaaggctggcagggcctgggaatcactggggcagattgcacagtgaggcgaacactggaggtgaggggccaggtcccaccaataccattcagaaggggcagggactcatactccctgtatatatgctaaatactccagaccttttctatttccaggagaaacaatcaatagaaggaaagagagacaagagtaagtattggtcttagattttatcctaagggctaagtttcctctgtaagctacagtttctcatatgttaacatctgtgatacattatttcacaacaggcttcagtgtttcctggaagcgcttcatctttctgccttgaaaattatcttcctacgttttgagaaacagaagggttatttttccctctatttttgttagttcattggccttaagttctcataaaataaatggttccctggcttatccagttccaatgaattgctgatatttaaatatgccattacaaaatgctttaaaatttttaatttgtgtgtgtgtatatatatatacacacacacacacacatttatatatatattaaatttatatttatatatagagagaaaaattatattttgggtatattgagttaaataaaatatactcttaaaattaatttcacttgtttctttttacttttttaatggggccactggtaaattcaaaagtgtttatgtggcatctatacatcctattgggcatcctaaagcactctcactcaaaatatggtccatgggccagcagcgtctgcataggagcttcttataaatgcacaatctcggacaggggcagtggctcacgcctgtaatctcagcaatttgggaggccgagaagggcggatcacgaggtcaggagatggagaccatcctggctaacatggtgaaaccccgtctctactaaaaatacaaaaaataaaataaaattagcagggcgtggtggccggcgcctgtagtcccaactactcgggaggccgaggcaggagaaagtcgtgaacccaggaggcggagcttgcagtgagccaagatcgggtgacttcactccttcctgggcgacagagcgagactccatctcaaaaaaaaacaaaaacaaaagaaatgcacaatctcaggctcaccctgacttacagagtcagcatccacatgtttgttagactacccaggcaattcctaacaaaattaaaaggcgctgagctacagagctgtgcttctcaaacagtgaagaacaatcaagtttttttccaattaattgtagactgttgtcaaatataataaaaaagaatccggccgggcgaggtggctcatgcttgtaatcccagcactttgggaggccaaggcaggcggatcatgaggtcaggagattgagaccatcctggctaacacggtgaaaccccgtctctactaaaaatacaaaaaaattagccaagcgtggtggcgggtgcctgtagtcccagctactcgggaggctgaggcaggagaatggcatgaacccgggaggcagagcttgcagtgagcagagattaagccactgcacgctagcctgggcgacagagcgaggctccgtctcaaaaaaagaaaaataaaaaagaaaaagaaaaaaaaaaagaatgcttagaaaaatgaaaatgacacaaacaaaaaatacaaaatgtaaatttgaaatttatagagtcagaaattataaaattaatttcagtaagtgtcattaaacaacatagatataaaggaaaacaattacaaaaaatgaacacattgttctttgaaagtgggtacataggcaattgacacagagagtcatcattacctttgtaactttttgccacacaaatattttgtatgaaattgcagttctccatgttaaacactcgtagacacattttaaatacacattttttatattactatttaaggtttttaatatgacaattaatcttgcttcctggttgtcaatttacctaatctggtttgaatggatggcaatgctctttgcaggggataatgtgtatctaaactatttctaaacattgcttaacagcagtcaaagtagagaaaggaggctcacagaggtatgttgattgaaatgaggaagagatttttaaaccagtctcagcaagttcagtgtattttttttaactgctatccaaaatgaagctgatagtgctacatttttttaatgtatcttcagtcttttatccgtagccagttcaaataacttatactgtaagattaaatataaataatctttcaatgaaagaaaatgattccagattttatgcacttttggataacagttttcaaaataaccttaaaacatcgcacatgataatacagtcctatggcatatgactagtacacaactcaaactcatcacacaagttagacaaaaacaagactgatttatatcctgttcaacaaaatggtgtccacatgcttacatattgagcaatgtcaaattattgctataaaagtttctaaatgcttactcttgatttctgtatttatcctgtaacagactagtaacaaaccattcatatcagtattgctctgcagactatgtttgaataacactgcattagatattccagctgaataaaatatcaagatttaaatagtcatctttcgcaagcattttagctgagtctgtgtgacaggtgggccacagacaagcaggttgtaatcaactcttatcagtcaatgagataaataacattaatttaaaccacagagatatgtttataattttgttatctgtgattgctgtgtatttcagacagatacaggaatctatatatgatatcaattcacatcctttgcagaaacagagaaagccctctccatatgtgagatttatgttcatgtttctacttgttcacataaattaaataatttttatttcacaggaaaaatgaactatacatatgcaagatggtaaataatgttaaaatacaagaaccttgccactgaaattagaataatcctccatactactccccaaaagacagaggcaatgtatattaaagacattactaaaactgtttatcattcaactttgcagtagtcttatgagatattggtatttgctagttatttgagtaaaaactgagggtgggaaatttgttagtgctttgccacacacagttgtccaatctggaaacctttgactgcttcctctctcaacccctaaatctaattggttttgcaatcctatgtgttctaccttaccgccatctcacaaatctcacccttctgggttccagctatcattgcctctgctcatgccctcattagcaatcaagtggatttgtgtattaggctcctggctagcgcccccttccttccttcccagctccctctaattcaccttttgtagaacgagagttatctttccaaaatttagaagtgatatgaatcacttctatatttagaacgttcagtagattggcataaccttcctgtaaaatccaaattccttaactttggatacaagatccttcatactctgaaccatcttctccataatcatttccagaataccccataaaaccaaattacctagcaattgtccatcattcaaataaatactacttcctgattctcatgtatttctatattctcctgtgcttggcaatgatactgtgtgcatctggaccggtgagttcttcccaggcttatttatgagcatgcaatgaatgttcatgtgtgtgcactgtttgtacaggaacatgttgaagaaggcagagccagtctctacaagtctgtggtttccaacagctgcaaggagatgtcttgttactcagactttccattcccagaagattatccaaactatgtgccaaattctcaattcctggaatatctcaaaatgtatgcaaaccactttgaccttctgaaacacattcaattcaaggtaagacacaaaacatcagttagtagtcagaaagtatttcctacctattttctcttatctctccagcctagccctgggctctgtagatgagatactaaactggcaatattaatgacacctggctgtatttattttctccctatactcactccccacttcaagtaaatctggaggtgggggaggatactttgtgtaaagattcacaagtataaaattttagtttgcaatacttatatccaagtatcttagggaacctaaaaaatatcaagccacattttcagcttgggccaaatgcctgcccacatggacactgagaaccaccaacccccttccccagtctcctgtttggttttttgtctgtttgtttgtttttgagacagggtctcactttgttgcccaggctggagtgcagtggcatgatcatggctcactgcagcctggacttcctaagctcaggtgattctcccacctcagcctcccaagtagctgggaacacaggtgcacaccaccacacccagctagctttttatattttttagcgatggggtctcaccatgttggccatgcagtctcaaacacctgggctcaagcaatcctcctgccttggcctcccaaagtgctgggattacaggcatgagccactgctcccagctcccactctcttcttgactattcttttataggaatggacacgtgcagtggcccatacacaagagaaccttgctatgtgaaagaaatcttttctagatattcttgagaatagaaaaatctttgaatattgttattctacaatgcccccttcctctcccatttcagaggctggagacaggaggaaggtagtaggacagggacaaatgaataatatatcctttttgtcctttttttttcctttttttctctgtttcctctccaagaaacatatgaaaatctatgtttcccttctcctttctccctcccctgtcagaggtaaggatgatgaggaattcacagagaattatacacagaaaacaacacaaatggagacattgaccaaaacaagtggaaaataaaatttgcattcacattcacgaccttaaaagtcctctgatatggtttggctgtgtcgccatccaaatctcatcttgaatttccacatgttgtgggagggactcagtgggaggtaattgaaccatgggggcaggtctttcccatgctgttctcctgatagtgaataagtctcatgagatctgatggttttataaggcggagcttccctgcacaagctctctctctgcttgctgccatgcacgtaagatgtgatttgctcttctttatcttccaccatgattgtgaggcttccccagccacaaggaactgtgagttctccattaaacctctttcctttgtaaattgccaggtctctggtatgtctttatcagcagcatgaaaatcaatacagtaaattggtaccagtagagtggggagctggtgaaaagatatcaaaaaatgtagaagtgactttggaactgtggaaacgtcagaggttagaacagtttggagggctcagaagaagaaaggaaaatgtaggaaactttggaacttcctagagacttgttgaatggctttgacaaaaatgctgatagtgatatgaacaataaagtccaggctgagatggtctcagatggagaggaggaacttgctgggaactggagcaaaggtgactcttgtttggttttttgttttaaaaaaaacctctgcaattattagtttattagtatcatccgggacttagatgttcagtattcctcctgaaattacataaacaaatgcaaatggaaagaatccaagtcaaaattatataacaaaacagcactccatcacaaaagcgtgtaaaattacaataacactattttaaaatactggcatcttaagaaaacgataatcttgaaaatcacaaaattgccaaattgttccctaaactgctaagcagataatcatgactaatgagtgagtttgttttgtaaagaaaaatcattcaaataaattgaataattcatactgagatgcaaaatttaagtgtcttctttcctcctatttggatttatgagggggcaaaccataatataggaaaatatacgctattttgaatgtggcatctttgttttaaaagctggcccaattaattaaaaatacttttaatggaaagtctcatttcctgagcagtccatatttagataaatgggaaaagacatctatagccagcattttcatagtcttcactgagactaatgtcaacaaaaaatttaatatggcagtcctgtattttaagctcacgcttttggggatacattctcaggtcttctttaatgtgggaactgcaaaatataactgccattacatggtaatgggagttaaagaatagagtcctcatgtaaaaattacaacatacttttctattagtccttcaaggactaatttcaaaatgttggattctagtaatcccatgctttgagtagattgattactcttcagtttgtaaatgtaagtgggctatgtgaaatttcttaactgatcaagattttggatgttcagttatggatgaaaactatctcaacttaactttacccccatatgatatgcagggtgtgtagacaaaagctttttattagctaactatatgaaaggataaacactgtaataattcatgtgattcaaaatgggcaaaagcaaagactagcttcccctccaaaagaaaaatttcagacctatgaaaaggacaacaatactaataaaaaatttgtatttacttagaagcattcagaatgtaaacaaaacagctgcaacttttttttttttgcaattacagagtggtattcagttaacagaacaacaattatttcctataagctgcatcagagacagctgaagatgaaaaaactaccatccccatatataactaatttgtgctgtgcaccaacaagaacatgctttaaatttccatgccaatttacaacccgcatactgcaccaggcaaggttagtggctattgaaaacaccaccaggagagggctatctaaagacacattcggtagtgtgttaactttataaaaaaagacactgtacagtttaaaaacaaatcctacacagacttacatttccatttttttctttaaaaggagtgacttgtgaacagtagggttaaatgctttatagacgagaaaaaaaaccgctagaaccaacttattcatcatcttcttcatcttcatcttcttcatctacctcctcatcataatcttcttcatcttcctcatcttcctcctcttccttctttttcttgcttttttcagccttgataaatcccttttttgctgcatcaggcttccctttagctcaatatgcagcaatatcctttttgtatttttcctttagctttgcagccttcttttcacaaggctgcttgtcttctgcagcagtgttattccacatctctcccagtttcttcacgacatcactaatgggcaggccaagttgttctcctttaatttttgggtgatactcagagcagaacaggaaaaaggctgaaggaggcctcttgggtgcattgggatccttgaacttcttttttgtctcccctttgggagggatttaggttttcacttctctttcataatgggccttgtcacctttgccatatcttcaaattgtcctttctctttagcagacatggtcttccacctctctgagcctttcttagaaaactctgagaagttgactgaagcatctgggtgctgcttcttatgctcttcccgacaagtttgcacaaaaaatgcatatgatgacattttgcctcttggcttcttagaatctcctttgccaatgtttagttatttttccccagtgaggcacagagttgcccagtgcccatctggctctcacttgccccagtgctgtctctatggagctcaatgtactgcctcttcttatgttctagcaatgagactggagatttatggaactttgaacttgagagatgatttagggtatctggcagaagaaatttctaagcagcaaagcaataaagaggtgacttgggtgctgttaaaggcattcagttttaaaagggaatcagcataaaagttcagaaaatctgcagcctgacaatgcaatagaaaagaaaatcttattttctggagaagaaatccaagccaactgcagaaatttgcataaataacaaggagccaaatgttaattcccaaaacaatggggaaaatgtctccagggcatgtcagaggtgttcaccacagcccttcccatcacaggcctggaggcctaggaagaaaaagtggtttcatgggccaggcccagagcccccatgctgtgtgcagccaagggacttggtgccctgcatcccagctgctccagctgtggctaaaaggggccaacatagagctcaggcagtggctttagagggtgcaaaccccaagacctggcagcctccacattgtattgagcctgcaatacacagaagtcaagaattgaggtttgggaaccttcacctagatttcacaggatgtatggaaatgcctggatgtgcaggcagaagtttgctgcaggggcagggatctcatggaaaacctctgctagggcagtgcagaagggaaatgtggggtcagagtccccacacagagtctctactggggctctgcctagtggagctgtgagaagagggccaccatccttcagaccccagaatgttagatccactgtcagcttgcatgtgcctggaaaagctgcagacactcaatgccagcctgtgaaagcagccaggagggaagctgtaccctgcaaagccacaggagcagagctgcccaagaccatgggaacccacctcttgcaacagtgtgacctggatgtgagacatggagtcaaaggagttcattttggagctttaagatttgactgccctgctggatttcggacttgcatggggcctgtagcccctttgttttgaccaatttctcccatttggaatggctgtatttacccaatgcctgtacccccactgtttctaggaagtaactaaccaacttttgattttacaggctcataggtggaagggacttgccatgtctcagttgagactttggactgtggacttttgagttaatgctgaaatgagttaagaccttgggggggaactgttgggaaggcataattgcttttgaaatgtgaggacatgagatttgggatgggccaggggtagagtaatatggtttgtctgtgtccccactcaaatgtcatcttgaattctcacatgttgtgagaggggtccagtgggaggtaaccgaatcatgagggtaggtctttcccatgctgttctagtgatagtgaataagtctcacaagatctgatggttttataaggcagaatttccctgcacaagctctctttttgcctgacatcatccatgtaagatatgacttgctcctctttgctcctgccatgattgtgatgcttccccagccacatggaactgtgagttctccattagacctttttcctttgtaaattgcccagtctctagtctgtctttatcagcagtgtgaaaatggactaatacatcctcctaaacagatttccaaagagtattttattccacttccttattttgcaatggacacagtaaaaataaagcattatcataatgaatatatacaacatataaaaatcttctttttaatgcatcaaaatttctgaatttgaagcatttcctttaccacatgctgcccaagaccttttttattttgttgttgttgtttgaaacaaagtttctgtcacccaggctggagtacagtggcaggatcttatctcactgcagcctccacctcctaggctcaagaaatcctcccacttcagcctccccactattaatagctgggactataggcacatactaccatgcctggctatattttttttaatttttagtagagataaggtctcactatgccgcccagggtggtcttgaactcctgagctcaagctatcctcctgccttggcctcccaaagggtggggattataggcatgagccactgttgccaggcacaaggccattttagaacaatttttaaaaagctagatgttcaccaaagttttaaaaagtaaacacaaggccaggtgcagtggcccacacctgtaatcccagcactttggggggccaaggtgggtggatcaagaccatcctggctaacacggcgaaaccccatctctactaaaaatacaaaaaattagccagccatggtggcatgggcctgtagtctcagctactcagaaggctgaggcaggagaatctcttgaaccagggaagcggagattgcggtgagccgagattgcaccactgcactccagcctgggcaacagagcgagactccatctcaaaaaaaaaaaaaaaaaagtaaacacaaatagctattactcagctgtgatctgtagttgattttgtttggttttgcttctcattcctctgtatatattccaaatttttaatgacaagcttttttttttttgagacaaggtctcactctgttgcccaggctggagtgcaatgacactatcatggctcactgaagccttgacttcccaagcacaggtgattctcccaaatcagcctcctgagtagctgggactacaggcatgggccaccacacctgggtaattttttgtattttttttgtaaagatgggattttgccatgttgcccaggctacatatttattatttttatgattaaaaataaatctattttgaaagattttaaactaactgaaaatttacttttagaaaagacagttgcactacaaatgtagaaacacaataagcacttcaaatagtataaatcaaatagtgaacccattaagagggacttaagaagcctatattctttaaaaactttaaaaaagaaagaaagatagcaagccacttggtgagtgaataatttatccttttaaatttcacttgtctgagatttattgtacatatatttcctgaaccaaagcctggtaatcatggacatgtatgtactcactaagagcaaaaaatagattctttgaaatgtggactactctcaaaaaaattcaggccataatgttagcacttttcaattgctttctagttctggaaaaacttcagcaacatattctataaaacctcataagctaatatacacaggaccaaattcaggttttcaattatatcttacccatgtatctgtcaaagaaatttttgttaaagagacagccctgtgagaaatgaggttgcataacagaaaggataatgaaaaaggcatcagaaacttaggttctaattctgattctgtcactttctgtgagaatttgagcaaatcacttaaaatttttggatgccaccacttgtcttagatatctctccaagcttagactacctccatctagggaatcatgattagtccggtaacctgattaggtttctagggttatacttattaattatgtttattctgtgttctagaacttttaaaatatcaatggtacatcaactggcaagtgcttaatggaacattgacaactgctaatcatatctgtgattcttttttcagaccaaagtctgcagtgtaacaaaatgctcagattctgctgtctctggccaatgggaggtggtcactatgcatgaagagaagcaagagtcagccatctttgatgctgtcatggtctgcactggctttcttactaatccttatttgccactggattcctttccaggtacagcattttctgtaactaactttaagttttctcgtgggagccattctgatgcttgattggtctgggaatgaattcctatggctgttccattaaatagttaaagttgggaggtaggaggaggctttttttgttttgttttgtttttttctagccagcattttctggccagtttttggctttcatttgttccaaacaatctgtgaatacataagagcaaaatggataactttataagtatttttatgctttaccaagattcaatgtccctcaagtgactggtagcactcagaaagtcttctgagacatgggatgcttacacaagtcattaacttcagcagcaggtacacattgccaaagttgagtttagaggccacaaaagtcaatctgtgaaaaaagaaaaaagtaattttttctatttgttcctcttatgtgagtgatagcaattagattagaggtttacggcactggtcaatagtcaagagggagattagtcttgggagacaacttaagacatctttgggtctcagttttcttatcggccttttgcaaccatagtcatgttaatctatgccaaattttaactggattttaactcaatggaacagaaaatgaaatggtttggtttatttcatctgtaacaagcattcaaaaagttaaaactttcagaaacttttctccaaatcatctaatgattgcctagaatgatcccaagactcatcttaccacaataaatttaggagcatgctatggttctggatctgcccccagaggtcactcagatcaggttagattaggataaagcatatcctgaaaattgccagagaatagaatcattgaattggaaagaaccaagttcagtcttcttcccaatgcaggaaattatttttcagcaattctgagagaggctccatagcctcttcttgaacccattcaacaatggaatctcatcatcacagaagacaacccaattttttgtcattcttgcctgcagagcaaggctctgagcagccatccactccaaaattccagaaaggagtacctagtcactgcaagaatccagaaagttccatggcatagggagtaaactacattcattcagcacttacagtatattgcactaggtgctaagaatatagaggtgaataaggcaacatgtaacctgtattggaggaatgaatagagttttatggagtccagtggagaaatcacagtctgcatatgacctgtagtgattccaataccctaaacatacacctctcatggtcctggatttgccccccaaagtcacacaagtttacatcagattaaaataataaagcatacctgaaagcaattgagccaatatgctcagtttgagtagaagaggtagggacccagcagctatgaattctagcatatacaaccacctagctgatagtcttgagtcgcccacttaacttttctaagcctcaaatttacccacaaattgaagagcttggattactttaaccaacagtacacatcacaaatcaagcaagaagagctctacaaggcttgcagtctttcttaaaacccatcttatctaccactgtcaatttaaaatccctggctaaatgattaaggagtctttgagctctaaaattctgtgattttagagttgaagagcagttctcccaacctctctatctcctgacttacagcagacttgcttagatggcacacactccttgcgatggttgttaactgtcaaataaaattcaaattcactgaaggtatttaaaaatatgtatcacaagctctagaagcaattccagagaaggtgcactaaaaagtcgtagtaaaaataataggtatcacagttagaataaacgtatgatttcccaagatgactacttttatcattcacatatatacattctgctatttaccttttttcttttttatattataaatttttttcttagataggacattctgctacttactaacacagccacatttacctaatataagttcttactctgtctttctgtgagataagagaaagtattagtctgttaagagacagccacagagtctcatttttgtccatttgtgaccccccaaaacaaagcctatccaaagagaatctaaaacaacatgagatccagagataactgtattttctgcttaggctttccacctctttcttcgcaacagttctctgatccatattgggttcctgtgctgagtaaatattggaacttggttgcatccttgctaaattccaaatgctctgtgttgtggttaggttttaacttggattcgtgttagatttctactaattcaaggtgagctaaagagccagcaggccttgtaatgccactccccacaagtatatacatttttcccctgagaatgtagaggtcttattactttttttaggaaaaaagaagttctttgtttagcacatattacttctgattatgtaatgttgtcttaagagtattttctgcttaagttattgctgttaaaaaagaaaaagagtattttcaaaccttctccattcatgtgatgtttcaataagattcagcatcactgcctaaggtatcctatcaagttagcccagttgattgaatcctggtgtaactgacatcactcctttttctctgagccaactctggccaacccagcaaactcagcctgagttacagtcagtcaccaagtgaacttctccaactaacatgaaactttgtgaatagggacaacattttatttatcttattccccccataccatctagcacagtaccaggcacaaagcagagatcaaaaagttttctgaaaagagatactgactcacagttcccttaagcttcttgcttatgaaaagcttatataaatcaagtattaatcaatagaacattattgtcctgttgacttttatcaacctttaaaatgataatgactccttatacttttgcttaatatatctttatgccataatatttcagctcagtagttaactatctagtaagtaaaactggaggcctatctagtgagatggagtaataaccccccttaaataattacctgccaatgtcttgtaaagtcatgtattcatattttctcaaacttgagaatactagtaaaaatgaccaaaatcatctgtcaaaagaatgttatcaactgaagaatatttatgtttcattcactgatcctgttaattctctgtgtgacttctcttttattttctataggtattaatgcctttaaaggccagtactttcatagccggcaatataagcatccagatatatttaaggacaagagagtccttgtgattggaatgggaaattctggcacagacattgctgtggaggccagccacctggcggaaaaggtacattcctgatgttactgggtgaagagctttatcttaagatgcatgcctcaagcaaatggtgtttgacaccatgataaatgttaaaggaataaaatgtctcacatgcaaacaacagattactaaggaatttaatttttactgaatgttcacaaatttttctatgaattgcagttgtcatcttccctccaaaaccaacttctctgacttctttttacttttttttttttttttgtcattttcccagccatccaacaagagctacaggacatgtttcttccctactcagtcccataggtcagaaaattctaccaactttttcctgctactatctcccatttgcccattcctctccttattaattaccaacaccctcatcaggtccatgctacctcacactgaggatattgcattgtcctcctaataatagttgtagaaatagttaatatttattaggattattctgtggccggcactgcactaaatgtgtttttactgcactactttatccagtcatcaaaacaagccactgaagtaggtactgttagtatccttgactgcacatgaggaaaccaaggcttagagaagttaaagaacctgcctgaaatcttaccactagcatgtggcagagccagttctcaaacccaagtctctttgactcaaagcctacgttcctaactatcctcttctacctcctaccttcaggcttctcaagggttttgccctgcattttatttttgccttgtaccactacccaaggtcactgccacccacaacaagccatctagaccccaactaccaacaaacaaatcctcagaagagcctgctctcattatagcactctcatgctgaaaaacctctaattattctctttacctgaaaaaaataaattgcagacgtagtagctctgcatcagagagttttctataatctgaaccaaatctgccattttaattttaacttctgtttcttgcatgataatcaactgtagcattttccagttcctgtctttagttcccctttgctcacgctacccctctctcttcttcagagcccctttctcttctattacaatctacctttaccttcccagatatctcactccaacacgaagtgatctctccctattcagaatgtaagtaatattgtaatttgcacccctcagttttcacttttaaattcttaatattgcaaattacctttcatcatatatagtttcttttcaactatgctgtaaactcattgagggccattcagctaactaatatatactagttgctggctccccagtttggtgggggaagaaacaatctgttaaatcagctgttttgtatcagcaaagcaacagattgcttaactaattattttctttgtaaacaattgtacaggaaactccttattaagtactaaaactattagctttgtgaattcggtcaactggtaaattcaaacagccaatgttaaaaagaacaaataccaaaagtaattgtagtactgaattttgctgtcatttaagccaatggtttgcactgaaactctgtagacaactctgatactgccattccctgttcttactgcctacaatgatagtgagcacaccaagtagcaatcacctgttcattgttttcttacatagactttaggtccctatggtttactaaaggctggcagataataagtattcaataatatgtcttaaggcattttaatactctagatgctctgaatcctaatctcaaaaggattaactttaaaatagaagttagaagaaccaagactatcttgtcaggggtgtattttgagagtggcagacttttcagtgcctttccattcatgacacttcttgaatctctggcagaaccagccagccgtgttcacagtgtcaaatgaagggatgtctttgattgcttccaggtgttcctcagcaccaccggagggggatgggtgatcagccgaatctttgactcgggctacccatgggacatggtgttcatgacacgctttcagaacatgttgagaaattccctcccaaccccaattgtgacttggttgatggagcgaaagataaacaactggctcaatcatgcaaattacggcttaataccagaagacaggtaaatataatgtgactgccaagggcttttaggaagaaggagcctctgcctgtccagcagcctatacaagccaggcagtaccacagcaacatggctgaatgtgtgggaacacttgatacaaatttgcttgataataacagctaactgttcttaagtactcagaaagtgaaattatgtatttcaccttgtcagcaacactttacgtattattataataatccttttattatggagaaactgaaacagcaaaattcagccatttacccaagctcactgagtagtaagtgaactctgtgaccttggcaagttacttgatcctcagctgtagcaaccaaaagagaatgatttgtctatgactttgttgataaaagaaacacacttgcccagtttcactgtgtgggaaaaactgaatcccatagttgcccctcaccatctctctaatggtagagccttcttcccgttgtcaagattgaccttggcccaaaaaatggctcagcttatacaagatcagctcacaaagtgtttgtcttgtgattccaaaggtatagccagaaaaagacaattctgcccttgttcctttaaatacatgcatgtttcccttataaaactttttcctaggaagagactagagctttcagaagttctcagccactctagaagtccctggtttcccttgtagcccttcagctctcagccccactctagaatgacagtgacagatgaatgctaaaaatcagcaagagaaacagaagctagagaaggtgctggcttcctcttcaggcttccaaactctagtaaatggcaagcatattttataatccttcctgaacattcatgaatccccttccactgaagtaacatctcccaagacttgcagcaattcttgtccaaccaaggagagagccccagaatgagagagggaggtaaagagaagggagagctggctgaattgttcactgacaagtctcctccctgttcatgtttttgtttaggactcagctgaaagagtttgtgctaaatgatgagctcccaggacgcatcatcactgggaaagtgttcatcaggccaagcataaaagaggtaaaggaaaactctgtcatatttaacaatacttcaaaggaagagcctattgacatcattgtctttgccactggatacacatttgctttccccttccttgatgagtctgtagtgaaagttgaagatggccaggcctcactgtacaagtatatcttccctgcacatctgcaaaagccaaccctggccattattggcctcatcaaacccttgggctccatgatacctacaggagaaacacaagctcggtgggctgttcgagtcctgaaaggtaagtataagaaatagcagggcatgtgtttttggtgtgccatgtgattctggatactggaaatgttgagactattattcctcctgcttctatttaaaataacagaatctttaaaagcaggatgcattctattgtttgctgaattatactgtcataatgatttgttccattactgcataaatggtatatcagggtcaaaaatatatatatttttttgatataccaaaaatataacagttgacataggctgtatctatgtcaactgtgatattttttcttttttatttttaagacacagggtctcactatctcgtccagactagtgtgcagtggctatttataggcatgatcatagattactgcagcctcaaactcctggtctcaagcaatcctcctacctcagtctcctgagtagtggagactacagacatgcacactgcacacagctacctgttattttgactaaaacaaaatgacagttaacatttctgtcagttgactgaatcaactggctcaattaaaatttttaaactcaagcaaatgagtgacaacattcagccaaactagttgtgagattctgctatatcaaataattagtgagatgaccagatgcttatcttttcagctgacggcattattaccaggagcatacaaccagtcagctcaggctgctaacatttttgccagaaggatcaatgagtagctggtactagacgtgaaaggagagccatagtaaagcatctttatccataagtcaacagctagacctaaacttaagttgcatttgaggtttttattttaatcctacaggtgtaaataagttaccaccaccaagtgtcatgatagaggaaattaatgcaaggaaagaaaacaagcccagttggtaagttaactacttaatgcaccctttttaaattataactgaaattggtaaaaaaaaaaaaaaaaaaaaaaaaaaaaaaaaggaaatgaaaaagaaaaaaaaacaatagcagagagatgaaagttacattggagaaaaaaagaagcatctgagacttacaagaaaaatactaggagagcctgtttaagaagagagaagggaaaggggaatttagaatttttaatgtccccaaagtcatcacttcagcccatggttttctagtatcacatagagtttggattccaaatcaagtactacataattaaccctaatctaccaggtacattattccatatcttatccataatcaacaggcaagcagttgtacctatttactctgacactagaagtgtctgctcattcattcactgaacaagtctctatcagctctattgtttttattcggagtgtggcttttgctcttcatttataattggctggaaaaaaggaagaagaaaaacaaaattttgtagcatgtgaaaaaatcatatgaaatggaaaccatactggccataaataaaattttattagaacacagccatggttattcatttacatattgtcaatggctgtttttgtgttacagtaccaaagttgtttagcagttgagatagaaactgtaatgtggctctcaaagcctgaacatttactgtctggcctttttcagaataaagtttattgagcacttctctatgggaaaggttttcacttatgctgtgctctgtggctaccactcaaggctagagacaatggaagactgatggccagcaaagtaaagagtcttggccctcccctctcactctcaatccaaccaaaacatttctgattgttttgtggtttgataaaaccactttgttttatctgttcatctgtttctgcgtttgatatacattttcacttgaaataaaggttctgtggcaaaaaaaaaaaaaaaaaaacagcaagttttaaaatcattgcatctaaggaacttattatcactctcttgttcatatatattcccaaacttcaagggttgatctatccttgtcaaggtaccaaattccaaaacaataatagcattttagatgtctcttctttatcctcaacctgggatatgatttgatcttcattatggaactccagtgtaatagataactaattagaactgctataaaatgaaaatcttcttgtcacgcatgtcagcaaacaattttaggggccaggtgcagtggatcatgcctgtaatcccagcactttgggaggctaaggcaagaggatcatttgagctcaggactttgagaccagcctggatgacatagcaagcccccatccctacaaaaaaaataaaagttatttaggcatggtggctcatgcttgtagtcccacctattcctaagccaggaggatcgcttgagccaaggagttcaaggttgcagtgagctatgatcatgccactgcactccagcctaggtgacagagcaagaccttgtaaaaaaaaaaaaaaagaaaaaagaaaaaaagaaaaggaaaagaaaaattaattaattaattaaagcctaataccagcatttcagggaattttaccctatagatttttgtggcttttcacattatataaatcattggatttgttattactgaataatggaattttataaagatttagaaattttaaaatatattttcctctagaaattgctaattatttcacaaaagaactaagatgcattatgagcactcagagcacccattaaaagccatatgtataaagtatcttttgaagggactcatcttgatttaagaaacagaaggagaccgttagataggtagggaaataaaggggaaaatgcagaaaccatcccaaattctgcagcagtatttgtttgctttgggcacttgtacttgttctaagattatcagtttttttgtcttcaccttttcccccaatcttccttttataaaggtttggcttgtgctactgcaaggctttacaatcagattatatcacatacatagatgaactcctgacctatatcaatgcaaaacccaacctgttctctatgctcctaacggatccacatctggctctgaccgtcttctttggcccatgctcaccataccagttccgcttgactggcccaggaaaatgggaaggagccagaaatgccatcatgacccagtgggaccgaacattcaaggtcatcaaagctcgagttgtacaagagtctccatctccctttgaaagttttcttaaagtctttagctttctggctttgcttgtggctatttttctgattttcctataagtaaaagatctcctaaatggaagatgcacagagtagatttacaatgctccaattcctctcttacagcaatattgccttcacagttataaactgtattcaaatagtaaaggccaccctctcgcttccctggctggccccagggctaccactggtattcctgagcctctcccagctccacttctaatgctagagaatgataactaagacttctgtgcatttgaaggttgttggaaagttacaggttcattttagaaagaaagctgttcttgacagcactctgagccatcatacctctttcccatataaactattttcacagatctcaactaaaaccccttacttcacaaatgattgtgttgtgctgaaatggtgctcttatagtactggcttattaaaagtaaaaaataaacctaaaaattgattgttttaagtgatcttttgttctcttattaaagattgggaaaagggagaaaaagatgaggattctatgaataaagctcataaaaggatagggggttcaatgagttactttgagagtttcccaaaggactgtacctgcctgggactgttcattcctccagaacactctttataacaaagctgttactccagctggcctcccaaagacccaaatcagattccacagaaaaccaccacctccacgggctcttagaaccagcctccagcagccaaaggaaaaagcctacctgcttagatcctccttcacaaccctgctgtaagaggcaaatggagctgcctccttttaaagagtcaatgagaaccaaccaaattcaattggaattcattagataaagagcacagccaagaagcttttaatggagagaaagcagggagaggaaaaaagggaaagaaaaagaggaacaaaagcaaacatcgtgtcaaaagcagcagtttcaatgaaactagacccagcctatctcacagttacagctgatgaagatatgactcataatcaggaaaggctttgcttcacttcatctcgtggcttatatggaaaaccctgtgggtaaacctcacctcacagagaggtccacagtttggatgcagggacaagattcaaaaactgtggcgtcaggaaaagagtgatctctgtagggccagtacagatacagatcatttctccccaactttgtttggctctgccaactcttcagtattgttccatttcttacttttccttgtgacctgtttcactcttaccatagaaacacatgatgaagaattgcccccactgcatacaatctagattactcctagaaatgcttttctttccattgaaacaaagctgatattttaactttcctcatgaagctggctggggagaagtttagtgcccaaggtgaaacaaggaaggataaactcctcaggccacagtggcaaatcatgacacaagcggccacctgaacctgatcatatctactgcactgggagactgaatatacatatggtcaatgaccagaccatttacagcaatagatttataacctacaacccctgcagcaatcagctcagaacagtcaggacttgtttaatgagtgccagcttctctacttgttgcccctgcttctaactcaggagtgacgaaagaaagccaaataagcttctcaaaccagtcccatctgatgtcttgcttctagttaacctacctccaccttccctatgccaacaaccatcagtgagagtacctgaagccttccctttctttcactataaacacacacaaacacacacacacacacacaaaacctcccctgctgcctttgaatctgtgccaaacattagtggtggtgccagcaaaaaaaaacatatattatgtaaagactacagcagtaattataatgctgcacattttatactattttaaaattaataaaatgccaactgttatctcacttaatccacacaataatgatgtgattgggaagacgactgtactacatacacaatttgacaagtaagaaaactcagataaggagatgtcaattgatttgtcccaggtaacaggtaaaatgtggctgagtcagaacatgagaatccagaacatacatcacaggctttttaccatttaagcccactgtctccaatgttcaaatgactccagaagccttaatagtgatattgcaaaagccatattacaagaatgttactccatgaaagtatctgtaggtctctctccctttcccactctccctatgagtgtgtgtggacctgtctgcctgtcaattgtcaatcgttcatgctgtgcctagaatttcatatctttccctttatatatatctttaatttctgaatccatgggtttgaatctccacatgcatctttttccctgtgcattccttttttttcctgactatggctgtgctaggcctcctctatgactatattatagaacagactcaaaagtctacaa

SEQ ID NO: 16226 - DNA, 31739 bp, Human
agcagtcattgcgcaattctcaaaagcagttggggtgtcctgtttaaagggggtattgagaggtgaagccagctggacttcctgggtcgagtagagacttggagaacttttctgtcttacaagaggattgtaaaatgcaccaatcagtgctctgtagctagcaagaagtttgtaaaatgcaccaatcagttctctgtaaaatggaccaatcagtgctctgtaaaatggaccaatcagcgctctgtaaaatggatcaatcagcaggattctaaaagtaaccaatcgtggggagaattgagaaaagggcattctgataagacagaaacaggacatgggaggggacaaataagagaaagctggccaccccagccagcggcagcaactggctcgggtccccttccactctgtggaagctttgttctttcgctcttcacaataaatcttgctgctgctcactctttgggtctgtgccatcttttaagaactgtaacactcaccacaaaggtccgcagctccattcttgaagtcagggagaccaggaacccaccggaaggaactaactctggacacaatatttttttttctttttttaaatttttttctttatttcttctaaaaaaaagtgggatgcatgtgcagaacgtgcaggtttgttgcataggtacacgtgtgccatggtgatttgctgcacctattgacctgttctcctctaagttccctctcctcaccccctaccctacaacaggccctacaacattcccctctctgtgtccatgtgttctcattgttcaactcccacttatgagtgagaacatgcagtgtttggttttctgttcctgtgttagtttgctgaggatgatggcttccagcttcatccatgtccctgcaaaggacatgatcttatttctttttatggctgcataatattccatgatatttttcaaaagaaaatatttgctgccaacagaagattttatattaaaatctgtatttgcagcttttactgaaaagaacctaaggccttgccatattgggctcattttctcaaatagcaacatttagctgaactgaatagacagagaaagtactttccagtcagatcatatctggcccactttcctcgtgtatgttaccctcctcactcctgtaggcatttgcatgtgtagtcacaagcaaatgtggtttagaaattgttcagtgaaccatgttggaaaatgtccctaaacacaagtcctaaagatggtctgttatattatcttacaagcacacagtggaaggaaaaacagttaagttttctatttctgccacagcttctataattattacctttcttgtgccctaggttaatatctaaaaatagctttatgctttctcaaacacatttcaccagctccctctgctgatccaatctgaaggacaaaacagcttaaattccttgtaagtcctgaactttaaaatcacatttctggggttggagaactccaagcatgaaagaacttgatgaggtaatggtcatctaaataactttctcctttggacagctcctatggtaatccaagcaagagtcagggtgtagaagtttgtttccaaaagtagaactcctgtttcgctgagaaagctgtaatttggggtgatttggcgccctctacagactataatggcaaaagcgacgctatcatgtgcttcccatagctttagggctttgccagaactatgacgttgaggagggtggggtaaaggggcaggaagcgtttatgttctgccaatccaacagctgtattctaactcaccattccgccctcccttaagatcacggaagtatcacgcttgcctcttacacaactttttttccttagtctgtatactttctgctgtcactagcataacagaaaagacgaatggcttttgttttaaactgagggcacttttacaaaagtcatctttccatttatttttctttcagaaaaaagaatttgggttttgagcttttttaaaaaaaaaagacaaacactttccttgactttgagaaataatttaagtcaaagaatctgctctatgctaaccaaggtaagtgtcctggattttttttttaatggggaaatgatccagaaactgctttcacaaaagatgaatgtttttcttggagtgtgttccttaagaatgaatgtgattatcttcttttggggtctcttgactagggctaaagcaagagaattaaggagagagtcaggaagcaaagggaagttgtaaggaaacaaagttatgttgtggacagaaccatccaaaaggaaagtgtcagtgagataaacagaatcatgagactttcagtgactccagtgacctctgatttcatcttatgaatgagatggaaatgccagccattgggaaacaaataccccatagatggcgtgggaaaaaaatactgtaacaaagcaagagcatggtaggatgatgataagaaacataaaatgatcaaatttcaaattcaaagaaatcataattgattacatgatttgcaaatcacccaagtctctccatgtctcataaaggattcctacatttgctggtcagtcaggtatagggtggggttttcccgttgtacaaaggtctagttcaataggtcaggtctcctttctgccaagggactaaatataagcaacctatggctggcacggtggctcacgcctgtaatcccagcactttggaaagccgaggagggcagaccacttgagatcaggagtttgagaccagcctgaccaacatggtgaaaccccgtctctactaaaaatacaaaaattatccaggcgtggtgccgcctgcctgtagtctcagctactcaggaggctgaggcaggagaatcacttgaacccaggaggtggaggttgcagtgagccgaaattgtgccactgcattccagcctggaagacagagtgagactccaactcaaataaataaataaataaatataagcacctttgagcaaccaagtaccttatgaagtccactttatagtttgcagagtttgcacacacgttctcccaatccttcaagcctgcagtattctcgcctacctttgaattcatatctttttttttttgtgcaccaattacttggttttcagacataagaacagtcctttcaagcttgaaggaaacaaagagaaagccacttgaaccctctgttttacaaatgtggaagcactggctcagagaaattgagaattgtgtccagggttacaagctgcttagaggcagaagcagaactagaactcagatctctcaatttccagttcactcactaccttcctctactgactcaaggcaaaatttaaaaaggttgctcccattcagaaatttatagtctgtaaatacggattaattttaaaaggtgctaattcccaatttgtttctactgcctgtagagtctctaagtcagtccttaaagtgcttttgcccagcacgtttttaaccccacaggccactctgtgtcactaactaggtctctagacagggataataaacaggccaggagagtgcaagcattcatgcctagagcatgctgctaccataggacttagcacaaggtagtatcagcctctccatatacaacatcttaagagcagtcacggtcttttttaaattctaagactttactactatttcttagttgcagggtcttcattatcttcagggccccatacttagcttaggacctgcacttagaggtacccagggcatatttgttgaatgaattaatttgcttccagtctattcacgtcagtatatttttcactttggcaattcagttagcagtcatttctttttaccttatgattgcagagatagagcacagcaaagatctgccagccccaggcctctacctagtggcctggaaattcaagtattcttattggtggaggccatttgtttctgattagaagctgtctaaacctcctactcctcaactcaaaggaaaacacaggtatgtctgcctactcctttccaaacttgttgatacattttatctgtatgaactgtcttttccaaggagaagagaaggaagacaggagacaagtagggaggtagagaatgaacactgagtaaatattttgtgcaaggcacttttttgtgtaagtaatatcaagttttttaaaatgcaaacaatccttcaacatagatatttttattattttacaaataatatatctaaggttgcttcagtcggttgctcagggtcatatggctagttggtagcagagaaagttcaaacccaactctgctgcctccaaaatccattttcattgcattccatatagctctctcaactaaatagggactcccaaataaaaagtctaagaggaaaaatgatgcattttttaatacataatgaagccaggtatggcaatctcagccttacaaaggcaaggcagcaaatacattcagaaattggcagccctaggaaatccttctgatcctcattgcaagttcatgaatctgccttagggtcaggtaagtctaagggttcctggaggactcaggagtctttctttactccctccagtcagtaaattctcttagattttgtgcctggggcttctgatctgattaagagacaagctacagagccatagagaaaaactccaagcccatcccaaaggtgcagcagcaaacctgagcaaagatgaaggaagaggcttagtgacgggaaccacaggatacctcaggctctcagaccaacagcatgttcacatcttggtttcagatcctgaaatccatactcagtgcaaactctgcctcttaatagcagtgtagtcttaagttgtttcaaatgattatgctgatttcccatttactggtcctaatagctcaaaaaatatatgctctcttgtttccccaaggcaaataccactgtgataagtgacatgagactacaaaaatcacacaggggttatacagcttgatctttcctcaaaaaatgctgtatcttcaaaggcaaagtgaaatgagttatatatatttcataaaacaatggaatactttgaggtctcaactatcatttgtgtgtcttctgaattggccaagtgggttgcagggaaatgcagggaaaagcagcacttgcaactaagtctacatgacatattaagggcctcagtgtgacataaacttgatttactagaattaactcagcccatttgattgaggcaaaagcaatgtgatatgtgcagaaatgataaaatccagaaaaactggtaaaaactggtcctatatctccatgtgtgtgtatgtgtatacttcctccagttcccgctgacaagcatgagcatccccatttctagctgacatcatcgtgggctctagaatatcccttatgacgttccttggggactttattttctattatggtcagtcttgcctctgcaagctaagaacctcccctcaacccatgtaatatccttgttttatggcaaggcatgaccgtgaccagctattctttaggactctaaatgctttgaatcaaaaccaacatttctactgactgaaattcctaggattcagaggcaaagtgatagcaaagagcccctttaatactgacaaattctagcatcccaacggggtcaaggtactgtctacactctctaatagtaataccacagattgagtactccttatccaaaatacttgggaccaggccgggcacggtggcttacgtctgtaatcccagcactttgggaggctgaggccagcagatcacttgaggtcaggagtttgagaccagcctggccaacatggtgaaaccccatgtctactaaaaaatacaaaaattagctgggcgtggtgacaggcacctgtaatcccagctacttgggaggctgaggcataagaatcacttgaacctaggaagtggaggttgcagtgagctgagattgtgccactgcactccagcctgggtgacagagcaagactgtctcaaaataataataataataataataataatagttgggatgagaaatgtttcactaggatgaacatggtggctcactcctgtaatactagcactttgggaggccaaggcaggaggatcacctgagcccaggagttcaagaacagcctgggcaatatggtgagaccccatttctatttaaaaaaattaaaataaataaaaaataaatgtttcacatttcaagtcttttcagattttggaatattttcattttacttcctggttgaacatcccaaatctaaaatctgaaatactctagtgagcatttcttttgaatttcatgtcagtattcaaaaagttttggattttggagtatttcaaattttggatttgggggtttgggctgctcaaccggtaatagctaaatttagttgagcacttactatgtagcaggcacacttctaaaaccattccaacatttatcagtcatttaatcttcataacaaccctttaaagtcattattattattactattaaaacggaagagttccctgagcccccgcagaacttgctacaggggtgtggcttgtttgcatgttcaaaccccttatgggaaggggagcatgcagacaggcaggtgcaggagccagggctagtgcttttgggctctggccccacagtaggatctagaggtgtcataaaattaatgctcttttagcagttgctatttacagacagctaagtattactagttcagtggagattcaggtgacagtcttttacaccctgcccttttggtacccaggtccttgtccaaagtccaggaagaatcaggtcacatggacttgaaggatggtgaatgcgggtattttattgagtggtggaggtggatctcagtgggcttgctggggagctggaaaggggatggagtgggaagatgatcttcccctggagtttggccatcctgggccgatctttccaaccatccccagctgaactcctcttgatattcaaacactccttctcttctctccttctctgccacactgctctgctctgccactggagcttggggtttatatgggcatgggatagggcatggtgggccagagtggtcttggaaaaggcaacattggggtgcaaaaacaggaatgcctgttctcatttagggctgtaggtttccaggcttgagggtggggcgtttgccagggaactgctctctcctactcagtatttccttgcctcctgttagtatcactattattaccattcacattttacaggtgagaaaactgagtcctagacaggatagttagcccaagatcacacagttaataagtagtgaagccaagacttaaaccaaaacaatctgatttcagagcctggatttttaagcagcatgtgattctgcccccactcaaagatgaaaaaaaggcatatatagcactacaaaaattgagtcttttgacaagggctcccttccaaacttattaaataaagaagttctgcttgactttcctctaacagagcataccatggccaagaaagttgcagtgattggagctggtgtgagtggcctctcctccatcaaatgctgtgtggatgaggacctggagcccacctgctttgagagaagtgatgacattgggggattatggaagtttactgtacgtggttcatctctatcagtcatgatctggccatttgctttgtctctgctcagacatggtggctttagcctgccttggtgatcaagtaagggagtggcttactgcaacggcacaaacaagtgcataatgcagtgttaaacattaggcaggatgcagtctgattggtgaggaatcttgagaatgcgcagactcgggtcagggacagttggaagagagaggaaaaaagagttaactctgataaataagcatagtattggacatttatgatgatttctggaccatggacattctaagacaaagcagcagagtgtaacatcaggcaaactgaatagcattggtgaacataaaacagattacactctagggagaatggaagttggcaacagggagtggaaccacaacccccagacattgttcaggtctttaggaacagaactggcaagagtgaggcatggccccagatcttggaaggccttgtgggagggggagggttccctgtcacattttcagaatacaaagaactcaggcactaaccaatcattctttgaagtggaatatttagcctcggaggctacactcaggtccaggccacctgttaggtgacttgagcatcagacagtggggatggaagtggttaaataccacctgcctctggtcaggattggtgctggttactggaagtagcagggtatccagtagggacggagggatctgccccagtagtgaagtataaggaggtatcagaaggtttatgcctgtaatcccagcactttgggaggctgaggtgggaggatcacttgaggccaggagctcaagaccagcatgggcggcatagtgagaccctatctctacaaaaaataaaatgaaaaacaaacaaaaaaaataagatggaagctaggcaggcccaagtactaaatgctataggggaaaagaagagtggcattcgttcaacaggcgtgagagagaagccttcatagaagacatgttgtttgctattaatagatctctgatggatgatgaataaaacagaataagcaactacatataagcaggagtaaccataaccctaggattatagtatactaggagaaaaaaaaaatggtatattgttaacctcatcaagccaccaaatgttaatgtggaaggaaaatattgggtctggtttatgtagcttctgctatttgaccccacagttggtttggtttacttcttctattctaaagtaatacagattaagtttagaaaacaatcttgaggtaaacaaatagggaaaaaaaagaaaaatataaattaagtaagtaacaatactcacaaattagtactattaacatttcaatgtaatttctctcagtcatatatatacagttgtctcttggtgtccgtgggggtttaggtatccctttggttttgctgtggataccaaaattcacaaatgctcaagttcctaatagaaaatggcataatatttgcatgtagcctacacacatcctcctgaatattttaaatgttctctagattacttataatgcctaatacaatataaatgctatataaatagctgttacactgtaatgtttagggaataatcacgaggaaagaaatatgtacacgttcaatacatatggaagcatcctttatttttcccaaatattttccatccttggttgattgaatccatggatctagaacctacagatacagagggccagctgtactattttttttttcaaaaatgttatcataatattaattttcactcattcaacaagtacttatcatgtccttctgccaggacacaatgataaacaaggtagacaggggctctgccctccttgtagtccggtgggaaacagaaacagtaaatagggaattataacacagtgtcatcaagttcgtggtagaagtacaggatgcagcagggccgcatcagctaccttatgcagcgctgttgggtcatggatgacttcttagagaaagtgacagctaagaaagaggcttaagggagaaacagagattagcttcagccacaagaagttcattggtgtctttaatatagacctatttgttttgttgttttgtttttgagtgatggagattgaatcaagataagttgaggacttcatgaaaaaacagaggctgcagtaaatgattcttctatgaagattgagataggatggagagagacagggctgaaggggacataggttgagaggatgttttgttttgtttttaaaattagagtattttgtgctgatgagaaggagccaataaaggaaggtagattgggaatatacggagacaataatgagaaaaattagtaaggtattccctgaggaaaggcaaaaaggaacatgtccagggcatgagtggagggagtagccatgccaatgaaagaaggaaaagataaacaagacagataataagccctgcattcatggaattgtttaaggacaatgttagtcttggagagccctatttaatttggttagcttctttgtggtttgaaaaatatattgattttaattatacaatcccaccaatgatttctgataattatagcttagagacctaatgctgggtttcctggaactctttaaaattacaaatagtggctgggtgcagtggctcatgcctgtaatccaggcactttaagaggccaaggcgggtggatcacttgacgccaggagttagacaccagcctggccaacatggtgaaatcccatctctactaaaaataaaaaaattagccaggcatggtggcacacacatgtaatccaaactatttgggaggctgaggcatgagaatcgcttgaacccgggaggcagagtttgcagtgagtcaaaatcgcaccactgcactctagcctgggtgatagagtgagactccatctaaatcaatcaatcaataaaagtaaataaaattacaaatggaacattaattgctataacccgccctcagtgaggctagcatgagccaccatgatctctgttctcttcctcctatctccattatcccaacaagctaactatgccttcaccacaggaatcttccaaagatgggatgaccagggtctataagtcattagtgacaaatgtctgtaaggaaatgtcatgttacagtgacttccctttccacgaagattatcctaatttcatgaaccatgaaaaattttgggactatctccaagaatttgctgagcactttgacctcctgaaatacattcagtttaaggtaagatactttgggttatggaagatgaatagatgggggctggcctattcagcaatctaatgaaaattggatgtttaaagtaaactttttattgattttatctccaaataaataggaagataataaggactcctcacttccgctgctgctcaagttttactcgaataaatcgttaaaatactgaattggggacgggtgcagtggctcacacctgtaatcgcaatactttggaaggccgaggcaggcagatcacttgaggtcaggagtttgagaccagtatggccaacatggtgaaattccacctttactaaaaatacaaaaattagctgggtgtggtggtgcacacctgtgattccagcttctcaggaggctgaagcatgagaattgcttgaacctgggaggcagaggttgcagtgagccaagatcatgccactgcactctagcctgggccacagagtgagactccatctcaaaaataaaataaaatgctgaatttgctgattcctcctctaaatgccaaactctcattcaggatgaaattttgactttttttaagagagaaaaaaagaattttgtccatgaagcccattggggaaaaaaaatctagatgtctgaaccacagaaattacaataaggcaaaactaattttcctaaatttcccaaaacattgggcattgtaactcatctctttctcaccaggaataaaacgtgattgtttcttccttccactgaaagattcaaatgtcttgagttaaagtctatattgccacctttgtgagtttgcataagttacttaacttctctaggaagatgataaatcaatattaatagacctcctgtcatgggacttggcctactaaaagtaacagacatggttaccacaccagtcattgcatgaggtccaagggtgttagtgagaagtgagtgtttgtctttcacttttagaccactgtgtgcagcataacgaagcgtccagacttctccgaaactggtcagtgggatgttgtcacagagacagagggcaagcaaaatagagctgtctttgatgctgttatggtttgcactggacatttcctgaatccccatttacctttggaagcctttcctggtgagtcatttctacctgagaccatgcctatgcttctgggttcttctagaagtaaacttattgatttgcagttggaaataccgccccatgattatagatggctttatattcattctcaaaaataatatgtgcaaaattactttaaaagttgtataacgcactatgtaggtgtcaggtcttatttatttattaatataaatattattgttattgcttaagctttctaatgtgtgtctaattcaaattcagtgatcacataaggttcaaaacaatcagatctgtcatgaaaaagaacaggctttgattttagggattaaatctcaggtaatttgaatcaggactggcctgtaatagaacttacaggaagtgagagtatatgatttttttttaaagaaacaaaccagaaattaaacatgtaaagcaatatattcaaccttctctagagttggaggttcttggacaaataaaactttaaaagggaaaaaaaagcaatatagtcacccttcaaaacagtcaacataataatcatacaattctttggctgggcatagcggttcatacctgtaatcccagtactttgggaggccgagggaggccagaagtaggagaccagcctgggcatcatgctgaaaccctgtctttactaaaaatacaaaaattatctgggcatgatggctcatgcctgtaatcccagctactcagcaggctgaggcacaagaattgcttgaacctgggggagtggcggttgcagtgagcaaagatcacgtcactgaacttcagccggggccacagagtgagactctgtctcaaaaataaatgaacaaataaataaataatcatacaactcttaaaccagggctatccatagaaaggagttttagaaacttccatttggaaatgcttttcactgtgacaacatattctttttaatatactcatgactgacaaattgccatcattttgaggtcaaaactgattatttgagaagccaaaagctattcaaattcagttgagggaaataaaattaatcaattgaggattactaaaatgtaataaagctactcttttgttacatattagtggccctaaaggcaattgaataggtgagtttttgaagtatcttcaaggaattaaaagaacttttaaggaaggaaaaccttgaagaataaaacatgcaaacgttggcaaaatgaaggaaaatacttcttataaatgtaatcacaaattgacaaaatatcctactcaaaaaggaatgaagtgaaaattcaatacataattttgcaaggaaacaatattataaatggtggttggcttcaggcttgctgttgatctgggggctaaacacacaactgtacagtactaaaggaatataaaaacacctcttatgacattttctataggaaaatgtgctgtaagtgccaaactattgacatggatgctttcggaatttattctcttcaagtttgggattgtttaccctttattccacactaaattcagttccacatagactatccttttttttttttttttttttttttttttttttttttttttttttttttgagacagggtctcactctgttgcctgagctggagtgcagtggtgccatctaggctcactgcagcctcaacctcctgggctgaagcaatcttcctgcctcagcctccagaatagttgggactacaggtgtgtgtcaccacacctggctcatttttgtattttttgcagagacggtgacttgccatgttgcccagtctggtttcaaactcctgggctcaagggatccacctgctttggccttccaaatactgagattacagaactatgactttttaagattctgtttctgcttttaactaaccaccacaatatctttcacgaatagctgtaggacccctgttgaaatgaatgttttacttgggaacatgaactcttctctgcatagaaagtaccaggattatttctacactattgaaaaaaatccatagaaatcacaagctttgtctataacatgtcgccacaactgtttgaaagttgacattgcaacacatgcataccctttttaaaaatctatattgtcaacctaatggaagaagctgaggcataaaatgtgatttcaaagaatttacttgagtcaaaatacaattttaaagagttaccttgaggatagctgcttgggaaacatttccaagttgctttgggaagtgctctgttcagcctttgttacaagcaggtttctgaagggaacagggaacaaggagtgcacagatacaaagttgtttgacaggaactctcattaatttatagaaatagcattgattagtcattggctgtacattgtttaactataggctatgagttatgacatccagcatatagcattgtcagggtaatttatggctacttaatgtcagtaagtctagagcccaaatagcaagtgtcttcaagaggcaattatttaacttatcatggagagtgacatgtgactgctgttagatttcaatgcctctctgggcgtgataacttaaaggggacttgcattcctcagataaagtttcttttctttccaatataaattgacttctgctgttttcctgaattagtagttttaatttatcaaatatatttcttttttactttttggcactgcattgacataatcattgactcagaactatctacacattctctattttttcttcttcaatatgtaattacggagaatctgtcatttgcaagtcattgtgtgaggcaatatgaaagatataaaatccatgagcaaagttgagccctccagtaaattccctccaggaaaacctcataagtggctgaaagtcccactctctaatgcgtttgatgcatattctgttcccacttcttggaaacttcttcgtgctccccttttccaatttctaatcatcctttaacaaattcttaatttaagaaaatccccttcaaatgccttcactggctcagtccaggctggacgtcccattggacccatcttaatgccttctcttctgggagggagtatagtatcatgcctgacagctgagctccagagtcagacatcttgagttcccatacaggctctgctacttactgtatggttctgggcaagttgcttaacctccctgttttgtttgtttggttggttggtttttgtttttttgcactgcaatctcagcagtgcaaaacaaaaacaaacagggaggttaagccatttgcccagggattttttttttgtctcaatctcagctttgacaaaattgaataatactatggtccactctatgggggtgctgtgaggtttaaattcgttaatacagacaaggtgtggtggctcatgcctataatcccagcactttgggaggccgaggcaggcagatcttttaaactcaagagttcgagaacagcctgggcaatatggtgaaaccctgtctctactaaaaatacaaaaaattagccaggcatggtggcatgtacatgtagtcccagctactcgggcggctgaggcgggaggatcacttgagcctgggaggcagttacagtgagctctgatggtgccactgcactccagcctgggtaacagagctaaattctttctcagtaaataagtaaatttgttaatatgtataaagttcttagaagcctgggactagcatagcaagggctaaataattgttagctattttctgtttacttacttacatccccattagaggacaaagtctttatttatttatttattttgagacagagttttgctcttgttccccaggctggagttcgatggcatgatctcagcttgctgcgacctccacctcccaggttcaagcaattctcctgtctcagcctcctgagtagctgggattacaggtgcccaccaccacacccagataatttttttgtatttttaatagagatgaggtttcgccatgttggccaggctggtctcgaactcctgacctcaggcaatccacccaccttggcctcctaaagtgctggaattacaggtgtgagccaccgcacccagccaagaggacaaattctttgaggatatgggtcgggcgcggtggctcacacctataatcccagcactttgggaggctgacgcgggcagatcacttgaggccaggagtttgagaccagcctggacaacatgcgaaacactgtctctgctaaaaatacaaaaattatccgggcatggtggcacgcacctgtaatcccagctactcaggaggctgaggcaggagaattacttgaacctgggaggcggaggttgcagtgagccaagatcacgccattgcactccagcctgggtgacagagcaagaccctgtctcaaaaaaaaaaaaaaagttctttgagggtgggaactgccttttgtcctcacattccttagaccttagacctagcatagtaccttgggtggtgttgaaagtgttgaaagaacaggctatataagatacgactattagccaactttttcctttagtatccctgcagacttgatctgtggggcttgtccttccgttgcccctggatgaaatctcaggcagttttctgcttattctcagataatgaaatgtcctctgatcattataagtcacccaaaaacaaaaaaaaatctcattttcataactaaaatgtcctgttcaggcaatagtcaaaatgtgcaactgtatgtaatgtaaaagcttctccctccaccgtctggcacctgctatgagctgacagcagtgtcaagaagagacagtgtgcttgacttccttcttcctctgccatcctctccctccgaaccctaaacctaccagctgcagtttctgacctttgcagaattggagttggggaaaggtcaagagggaagagagaagaaaagttctttctgaactggccccaatcctgggctagttttctctgatctcgggggtgtttaaaattggctttgtcaggtggtgtcccaggttctgattcagagagacgctttgttactggggatgtctcaactgtagcttctgttacagattatatgctctcaggctggctacctacaactctctaacccccagttctccccaggtcatcgccacacagactatctgttagggcctcatcgtgtgttcaaattgccaccttgggcaaagttcccttacgctggtgtcagactggctctcttccacagggccttctggtccacatgaaatatagatcttgtattgtcaacagtgggagaaatgctgccagtgcagccaccatccctcgaaggcagtcccagtcacggccttacaagcaccagttgctgtgctctgtagaccccaaacatgaaggtctcgctcagagtggtctccttgaagcccctcacacctggctccatgtcaacatgacagaaaaaaatgccacaattcctgtcaatttccaactcctagccacttcaacctcaaccattttagactgtcaaagtgagtgtgaggctaagtcagaatcacaaaactggcctcacacacacagtttctgcaaattcagcatagttggtttagcacctcacttggactgcgggaactattgtttactgtccagctttgggggcctcagtaggcaaagaatcctgttaaaacattttgttatacaatctacttcttgcccaggatgttcagcgtagtgtataagatgtttcttattatttgtgagtttgatttcctgaagcaactgctttaaaaaagaacactgatatgcactataagatctcttatgtttttaacaaggcaggttgtagctattcaataaatgttaccaagtgaatgaatgaatcaatgactgaataggaggaaaataatatattctagaagagaatttaatctttgtatattgacacttcaaaggaacttgaagccttggagtgagaggcagtctagtcctcaaaactgctgggcttctctttcagattctttgtcaatgcttcatctcatctgtgattctggccatcactggcctcatcacaattgtttcctctgtcacctcccacaatttccattgttgctgctgctgctgtaaacaccctgtttccactattcttaccattcttagtttatgtgaatccatggttcatgtctattctcatgctgctaataaagacacacccaagactgggtaattcataaaggaaagaagtttaattgactcccagttccacatggctcaggaggcctcacaatcttggcagaagcgaaggaagagcaaagtcacgtcttacagggtggcaggcaagagagagagcatgcccaggggaactcccattcctaaaaccatcatatctcgtgagacttattcactatcaggagaacagcatgggaaagacctgcccccatgattcagttacctcccactgggtccctcccatgacacgtgagaattagaggagctacaattcaagatttgggtggggacacagccaaaccacatcagtcttttatgtctgccaaggagataatcaccaaaaatgaatcaaaagaagaaatatttgtagtcttccttacatatgtaaatatcattatagctgtgcttctatggacagagtattaggagcttcatgaaagatcaatcagaaacaagagtaaataacataagaataaaacacaaataagcatactgcataataacacatcaataataaagcataaagtacaagtaacatgaacttaaatcactagaataattacttcatttacgaaagaacttaccacagaatctcccctgtggagaattttaattgaatcaaaatttaatatgtaaacatattatatatacaaatcacattctgatagaatatatctattgggcaaagtaacatgcatcaacaacctactgtttttatttgtttgttcaagatctttattcagtatccaaaagaagatgtcaagtaggtatttagatacaagtgtaatggtcctgggagaagccacagttggatataatacttaatgtagatgaactagaaacaatctactttttgcccaggatattcagcatagtatataagatgtctcattatttgtgagtttgatttcctgaagcaactgctttaaaagggcacattcatatggaattcaagatttcctatgtttttaacaaggcagtttgtactaaatccacatctgggctcacagcatcccagggagagggaggttatatgctttttctacttcctgccacaagcagcataagcaaaggactgccatagttgtgggacttccctttttccacagaccctatccctgcgtagtgagaaattataactttagacatttcagactttctgatccttcactcctctcaggaattcataagtttaaaggtcagatcctgcatagtcaagagtacaagatcccagaaggctttcagggcaaacgcgtcttggtgattggtcttgggaacactggaggagacattgctgtggaactcagtcgaacggcagctcaggtacatcatctctgaattaatgcccctaatcccatcatcagttatgatggctggaaagagatattcaaaactatgaagtacattggccaattgctaaattatgcagacacacagtaagtgggaaaaaaaaaaaacattgaaaatctttaaagccactcacggttctttctgaactatttaaaaagccatgctttacagaactgaactatctccaagaagggtctaggaaaattgtgtggatgccagacctctaagcatttttcaggagtgcttccttcagaaacaagaccatataggcaaattgcttcacccagttcaattatcttttttttacaccctccctttgtcattctggtaaaatccctatgtaagaatagaaaggtcattttcttgaatgtttctaagttctctactaaaggtgatatctgtaccttgttttgagatgaaagcaactcttgcacaacaagtatacataatggttttagaaagtctaagcccagattcacaaattagaaatctattgcactttagcataaattaaaggaaaatgattagatctggaaagaatatatttttatttaaaaataaggtaaaattgcttttccataccttcactttaagttctattttgcttacatgtaaaaaattgccagatcaattccatgtatctacaaatattatacttctatatttataattctataaacatagtaaaatatttaagagacatacagatctagtaaagtgattttgagaacaatgacagcaataggaacagataatcgtatgtagacctatgtacaaattcaccaatcctctgttgttaaaagaccagactggaataagatcatttgaaacacactgatgaaaaatactacaaaatgatgaacatttatttatccttcttgccttactttactttttaggtacttctcagtactagaactggtacctgggttcttgggcgctcttcagattggggctatccttataatatgatggttacaagaagatgctgtagttttattgcacaagttctgccttcacgttttctaaactggattcaagaaaggaagttgaataagagatttaatcatgaggattatggattaagtattaccaaagggtacttacattttttatttagtagaaaaaatattaaatcaatatttatcattacattttattcagaattcaaaatgttcaataattgtaatattgcctttgtttattctactctaaatccatttccctaaaacactgttcatcaggtaccacagcagtttttaaaatatatgtattctctttctggtggcaaaagtagtgattcatgaggctggaagaaaataaaagatgaaaacttccatttcctgctgttacaaatatcacatatttttgttgttgttgttgttgttgttggggtttttttgtgttgttgatgttgtttttgttcttgttgagacagggttttactcctgtcacccaggctggagttcaatggtccgatttctattcactgcaatctctgcctcctgggctcaagctattcttctgccttaccctcccaagtagctaggactacaggcacaggccacctcgcccagctaatttttgtatttttagtagagacagtgtttcaccatgttggccaggctggttttgaactcctggtctcaagtgatctacctgcctcggcctcccaaagtgctgggattataggaatgagccactccactcagccaaaatgatatattttaatatacatctgtatagagttgcacattggcaagtaaaagaaagcctttgaaaagcacgtaaggtcattaaatatgatttttattatacacttgacccaaatatttttctttggtaagatatctttttttgttttgtttctttttttgtctgtgtttttatccttgagatgtccttcaacttatgaggaaaactactggcaaaggatgatttgatatgtaaattttacaaagaaaatatgtttgatgtgattaggtagaatgatggtcacactgaaaatatgtatcagtataaattttttttaatggagtctcactctgttgcccaagctggagtgcagtgggtgtgatcttggctcactgccacctctgccctccccgggctcaagtgattctcctgcctcagcctcccagataggtgggactacaggtgcaggccaccatgcccagctaattttttgtattaaatttttatttaaagagttccttgctaatttcctgtctgcctgatgtcattccctagaggcctaagtaatttgagacccaaaattgatcatcaaatggattgttgtaccctctatgctgacactctgagaaaagcattgctccagaaattagttctaagagatagagagttttaaaccccaagcaagaaagagtaggtttagtcattttccatataccttctactgagaacagaaacacaaaaccatgttataaacatactaagtcaagtagatgactttgaattagacattggttaattctcttccttagcttggcaggtaatttccctgaattggctaagtaaatcatttgctgaagtttctcataaaaataactacagtgaataattttctcctgtgtgtcaaaggaaaaaagcaaaattcattgtgaatgatgagctgccaaactgtatcctctgtggggcaatcactatgaaaaccagcgtgattgaatttacagaaacctctgctgtctttgaagatgggacagtggaagaaaacattgatgttgtgatcttcactacaggatatacattttcttttccattttttgaagaacctcttaaaagcctctgtacaaagaagatatttctatacaagcaagtctttcccttaaacctagagagagcgacattagccatcatcggccttatcggccttaaaggatccatcttatcaggcacagagctccaagcacgatgggtcacaagagtattcaaaggtaccatgactctactgaaagtcctctctttggatcgtaaaattggtgccctgccatttagctaaaatcaaacagatgtgaactaaagtaacaaaatatttttaacattagtgtacaattaattgtatatgtttgtaatatgagggtgtgctgtgtcacttaatgtgactgaataggaaaagagattttggctctgtggatgagataaatttggacaacagaatataatcaaatttgtcaggttagctgaaattattgaaggcttcatgatcctgttctagcctagtctaatctatctactcctaaatcttttcatttagtactagaagtataattttatattgcttccaaagaaagatattggaataatatacactatgaatgaagttgagattagagacccataaaaaatattttagacactggaaactactttctgtcaattatgcaataagagcatagatactggagtcagagctacggaggtccaatcccaacttcaaaattctttagctttgcaagaacccctctaaatctcagccccttcatctgtaaaatggggataataaatcccgtatgacaagaattttgtaaaaaggataatgtctgcaaagcaattagcacagtacttgacatataactaacgcgtattaagtgacagggtttctctgaccattgctattgctatcatacctctctaaagcagggcaaattttagattagcaagcattttagttttaaagaactgcagttttctgtttttaaatataaacagccatagcaattgggcccatcagctatgctgtagaaaaattctgttcttaatgaataaaaacaattaccaataacttataaatagcatacaacatggtattaaatagtgttgacttctatcaaactgtagaaatataataggcatcaatcacacttaaaaccgtacgttctcctaagttggcacaaaaaaaaatgttatttgaatggggggaggggaaagaaggcagttagaaaatctcattttatttacattacagaaaaaaatcctacaaccctgcagtaaattaccacaaatttctgttttttaaggtcagttaaagagctttcacagcattatccaattacattaaaaccacagaagacttaattaactactggttttaaaaagtattttatggtgagctccaaaatggttattagaatgataaagctgacaaaacaaaactcttttagctcacaccataggagtaatggcatgcttctcctgagaacttccaaaaagcaatctaggaacaaccaattaaatcttgctagttttttagaggataaggtgaccctagtggaaagcagtccacagagcttagttggacctatctcgtgtggaaagtaaacacacaccctgggccagcacttggtacctgacaaaggcaggactggccagaatgggatggcaaacagggcagactaacaagggtcacaagtggcctgaggtggatagggacagtgaaggggcagggggtggggacagagtttacattataagagggagtatgggtgttctaggaacccagaagacaaacttggattttagtctctggggaagctggacaactgcagagaattatcagggtgcaagctgttaagggagaataaggtttagaattcagaaaaacaagaagagcagagtccaagtgctaagactgtctagatgggagattgggaatgagcaggtcctcacaacaaaagcagacagagcctgggtgagactgactgcgaaactgccaggccccttccacacatgaggctccttgtgtaacaaaaatgaaaatgttctaagacagggttataaagtgggttttttttagagaccagtcctcactccattgcccaggctggagtgcagtggcgtgatcatggctcactgcagcctccatctcctgggctcaagggattctcccacctcagcctcctgagtagctggaactataagcccatgccaccacacctggctaaatttttattttttgtagaaagaatatcttgctatgttgccaggctggtcttgaactcttggacttaagctgtcctcctaccttgccctcccaacgtgctggggttataggcatgagccactatgaccagcctaaaatggggtcattttaagtgtttacatctaaccaactaatagctttaacacaaacatgcacacacacacacacacacacacacgtacaatgtggagggtatacatacaatataatataaattatattatttatacagcaaaagcagatgaagagagacagggcaggccaactggcacaggtgcaggtgtctggtgagtgtggcgcaggctgacagctgggccatagaggcatctctcctcacaattctggcagtagagtaccctggttaagtgaactgggcggggaattttacctccagaaaattattttctgtgctgcatttccattctgagctttgactatcatgtgctctgaagttagagcagtgggaggctagaaatgagtgggtggagaatttaaataaaggaaaagccacatgtgactttagtgttgtttgtgatttttcccacaggactctgtaagatacctccatcccaaaaattgatgatggaggctactgaaaaggaacagctcattaaaaggtatgaaatgtagcttgctctagggcaaacttacagtatattctgttacaaaaaaaggattcagagtataaaagccattcctagagaagcagtatggcaggttggaaataactctgcattaggaatcagaaggatacatttttagtcctaactctgccaccaatcagacgtggccttagacaagtcatctggggacaccaggtcttttcagtggaacacacagcctggccccctaccagtggcaatcctgtcttcacttagtccaggaaatctattctgacttcactctcttcctacctctcaggctgctctttctctgtatttgctggtatcgcctcttcctcactcccaaaatttagtgagctccaaacttagtcctcaggcctcttctcattcctatttacacccactcccaggtggcctcatccaggcctgtggctttaaatatcatcatatactcagggctcccaaactgtgtctctgactcaaatctttctccagaacttcagactcctaattcccctccctctagatagctccacttagatatttaataggcgtctcaaatttaatatgtctaaaaatgaactcttgaccccctccgccccccatctgccctgtaaatgggctgatctgaaacttttccccatctcagttcatagctactcattccagttggtcaaaaccaagttcagtcaaaaaccttggattaatccttttctcttctttttttctcacatcccatatcggcaaatattgtcagctcctacctaccaaataaatccagaattcagacacttctcactgcccctactgctaccatcccagaccagaccaccaacatctctcatcaggacacttgctgccacctcttacctggtctccctccttccactctgttctacaatctaggcttgtcacagcatcaagagtgagccacatcacattgcccttctactcaaaaacctccagttgcttccttttcactcccaggaggctccctacagcctctgtggcccacagcacacccaaatattgatatgccctcactgcctactgctctccatctcatccatgctgctttaggcattccagcctcctacctgttcctcaaacataccaaacataaccccctcagaacctttacgctctactcttctgtcagcctggaatgttccatcagacacctaaaagactcactctgttcaaatgtcacttaataagagagaagccttctctgacaacactatatgtgacagcaacccaccctgactcaccattgcctctccccttaccctcctttctatttctcagagtgcccattattaccacctgatatattacatatctacttagttgaggttttttaataatgtattcatttcccccattaaaatacaggctttttgacagcaaggactttgttttgttcactattggatctccagcacctacaatggtgcctggaatgtgatagacacttaatgttcatttatttatttactcactgaatgaatgaatgattgacattgggacatcatgaaagtttactgacagaaataagtaaacttcatgaaaagtagaacatcgtggaagtttactgacaggaataagtaaataagtaagtttactgacagaaataggtatgaataatgccttcatattaatatataatatgctcatatctgtggaaagttcagtccacgtacaccaagtatggccttctcaactcacaattcacaccaataaaaaaatttaggtacatatgatgctttctggtcatgttcattcattcaacagctgttctatttggactgatcagacgttgttctcacatcaaatccaagaactgaaaacattatttaaagtttctctcgagtttttaagaacctacaactatttatggagaaaaagcagcccaaggatgatctttttgatagactcaatactggtattctgaataagcatctccaggatctcatggagagcttgacagccaaggtattccatacatacaatgcctccatcacgctacagcagcagctagaagaactcacagccccggatgagaacatcccagcgaagatcctttcttataaccgtgccaatcgagctgttgcaattctttgtaaccatcagagggcaccaccaaaaacttttgagaagtctatgatgaacttgcaaactaagattgatgccaagaaggaacagctagcagatgcccggagaaacctgaaaagtgctaaggctgatgccaaggtcatgaaagatgcaaagatgaagaaggtagtagagtcaaagaagaaggctgttcagagactggaggaacagttgatgaagctggaagttcaagccacagaccgagaggaaaataaacagatggccttgggaacctccaaactcaattatctggatgctaggatcactgtgccttggtgcaagaagtggggtgtcccaattgagaagatttacaacaaaacccagcgagaaaagtttgcctgggccattgaaatcgctgatgaagactacgagttttagccagtctcaagaggcagggttctgtgaaaaggaacagtgtggtttgggaaagatggataaactgagcctcgcttgccctcgtgcctgggtgagagaggcagcaagtcttaacaaaccaacatctttgcaaaaagctaaacctggagatattataagggacagctgagccagttgtcctacggacaacttatttaaaaatatttcagctatcaaaattctagctgtatgatttgttttgaattttgtttttattttcaagagggcaagtggatgggaatttgtcagcgttctaccaggcaaattcactgtttcactgaaatgtttggattctcttagctactgtatgcaaagtccgattatattggtgtgtttttacagttagggttttgcaataacttctatattttaatagaaataaattcctaaactccctcccctctcccccatttcaggaatttaaaattaagtagaacaaaaaacccagcgcacctgttagagtcgtcactctctattgtcatggggatcaattttcattaaacttgaagcagtcgtggctttggcagtgttttggttcagacacctgttcacagaaaagcatgatgggaaaatatttcctgacttgagtgttcctttttaaatgtgaatttttatttctttttaattattttaaaatatttaaacctttttcttgatcttaaagatcgtgtagattggggttggggagggatgaagggcgagtgagtctaaggataatgaaataatcagtgactgaaaccattttcccatcatcctttgttctgagcattcgctgtaccctttaagatatccatctttttctttttaaccctaatctttcacttgaaagattttattgtataaaaagttccacaggtcaataaatttagaggaaaatgagtatttggtccaaaaaaattaaaaataattaagattttagggcttttattttttcttttgtaattgtgtaaaaaatggaaaaaaacataaaaagcagaactttaatgtgaagacttttttgctataatcattagttttagaggcattgttagtttagtgtgtgtgcagagtccatttcccacatctttcctcaagtatcttctatttttatcatgaattcccttttaatcaactgtaggttatttaaaataaattcctacaacttaacggaaaaaaaaaagtttctcttccatctctagtaaaattaattgcctccttttaccatctctagtaaaattaattagcttcacagataccctctgtagataaactcctttaatttctttcttcctaacatacaaaaacattcccaaatatggtttgatttcccccaaaaaatgtaacaaaatggtgggaggatgggtgggtctgataacttgagaaatgcagggcaggtgtgattaatgaaaggtcctccctcttttttcctctcaggggagtgtttaaagacaccagcaaagacaaatttgactacattgcctacatggatgatatcgctgcctgcataggcacaaagcccagcatcccacttctgttcctcaaggatcccagactagcttgggaagttttctttggaccatgtactccttatcagtaccgcctcatgggccctggaaaatgggatggagccagaaatgccatcctgacccagtgggacagaacattgaaacctttaaaaactcgaattgtccctgattcctccaagcctgcctccatgtcacattatttaaaagcctggggggcacctgtcctacttgcctctcttctacttatctgtaaatcttcacttttcttgaaattggtgagagataaactacaggacagaatgtccccttacctagtaagtctttggcgaggatgaacctgattgttacaagggttacaccaagtcatgctaattctatctccaagtatcttgtgcatccctcctctgctctccatcataactgctattagccaaattcaggcccagtcatctcctatctgaattattgtattatcttcttctttgttttcagtaccctctttcttgccaccctttccaatgcatcttctaccctgctacctcagtgattattctaaaataaatatatatgatatggtttagctgtgtccccacccaaatctcatcttgaattgtagctcccataattcccacatgccgtgggaggtaggtaattgaatcatgggggcaggtcttctcccatactgttctcatggtagtgaataagtctcactatatctgatggttttataaatgacagttcccctgcacaagctctctcgtgtctaccaccatgtaagacgtgtctttgctccttcttcaccttccaccatgattgtgaggcctccccagccatgtggaactgtgagtctgttaaacctcccttcctttataaattacccagtcttgggtatgtctttattagcagcaatagaacagactaatacaatatggtttattactctaaagtaaatatatggtttataaatatataggaacctctgattcccaggaaggtctcagtaggaacaaaatggcattcaaattaagttgagaaaattttttccatcacccaaactggaacacagtgatgcaaacatagatcactgcagcctcgaactcctgggctcaagctatcctcccacctcagccttctgagtagctgggaccatgactggctaatgtttttaaaggttttcatagggacagtgtgttactttttctttctttttttttctttcttttaaaaaaaatacggccagggtctcgctatgttgcccaggctggtttcaagctcctgagctcaaacaatcattctgcctcagccttccaaagtgctgggattacaggcatgagttatcatgtccagcctcactattttttttagatctcagatcttgaactcttgggttcaaacaaacctccctcctccacctcccaagttgctgggattacagacatgtgccaccatgcctgcctggaaattttaatatagagattattttaaaagatatgggcagagtgtaggaagatcatagagataatgaaacactcccagacttgtaacctttactatccatagacctaatgaggcgagagaataaagcaattactaaagagaaaaagcaagcactgcgtagagggccacctaacaagagcaatgaccttcagctgagtgacaaaggcaggtgcacgatgactacaaaagtagagatctgggggaataaattatctaatcttactctcttcccactctctgatcccttgctagtgctccccaagggccaaaccaaatgaaagtcagaaggcaaggttgccaacagattttatccacagaggtcaggctcctagggcacagagcagagcaaagatgatggagaggatatatggtgaggcacacaaaagggatccagtttgatcatgtcaccctcccatataaaatccttcattctctatcttgattagagataatagtccttggctgggcacagtggcttatgcctgtaatcccaacactttgggaagttgaggcgggcagatcacttgaagtcaggagttcaagaccagcctggccaacatggtgaaacctcatctctactaaaaatacaaaaatcagctgggcgtggtggtgcgtgactgtaatctcagctatttaggaggctgaggcaggagaatcacttgaacccaggagacagaggttgcagtgaggcaagatcacaccactgcactccagcctgggtgacagaaagagactctctcaaaaaaaaaaaaaaaagaagacataatagtcccatattccttagcataacatagaaggcccttcatggtctgagtccctttgcctgggtcagcaggatgcctgttatttcaaaccctcccatccagcactaccaaactatgaactttcataactcctccctttggcatcagctcttgcctctgccaggcacacaaatctataccgtgcctgactgatgagatcctatttatctttcaagagagctcagtgctctcattctgtgcagccttccctaaatccccaaagcagaaatggtcacccctgtgtagcagctgcaccttgtgtatgctctggtgctgctctt

SEQ ID NO: 16227 - DNA, 78649 bp, Human; identical to SEQ ID NO: 14619

SEQ ID NO: 16228 - DNA, 78649 bp, Human; identical to SEQ ID NO: 14619

SEQ ID NO: 16229 - DNA, 17013 bp, Human
aggctggtctcgaactcctgtgctcaagcgatacgcccctccttggcctcccaaagtgttgggattacaggcgtgagccaccgagctgggccaggccccaggtattgtcatgatgtaaaaatctctctctagaaaagagaacaccagcttcccagctggtcttctgtagctaggagatgcaagagcagcagttgaatttgaggtttgctttggagaaagaaccaaaagcagatatggatggtttggatgtgagggagggaaagagaatcctaagtgtattagtagtggtgggaggaggttcggtacagtggtgtcatttggaagacaaatcgttggtgtttaacctctatgacccgaaagtctcccacaagcctgatacattaggcaaaatgtttgactgcactaagccttagtttatcgtcataaaataggccatgaaaattgcgtgagaaaatgtatataacagttcaacaaataatattggctgggtgtggtggctcatgcctgtaatcccagcactttgggaggccaaggtgggcagatcgcctgaggtcaggagttcgagaccagactggccaacatggtgagatcccccatctctactaaaaaaatacaaaacacacttgggcaaacatggtgaaaccccatttctactaaaaatagaaaaattagccaggcgtggtggcgcgcgcctataatcctagctgaggcacgagaatcgcttgaatccgggaggcggaggttgcagtgggctgagatcacaccactgcattccagcctgggcgacagagcaagactctgtctcaaaaacaaaatacacacacaaaatataatagtatttgtttgtttgtttgtttttgagatgcctcggattacagtgcggggattacagacgtgagccatcaagcccggacaatattattatattgttcattgcactcccacaacacccctaaggggcaggaacttttcttcccagccccctccccccgaccccaccgagagacagggtctcgctctgtcgcccaggcctggagtgcattggcgcgatcaaagctcactacagctcagaccctctggcctcaagcgatcctccagcctgggcctcccaaagcgctaggattacaggcgtgggccaccgcgcctgaccagtcttctcttcttgcagctgagccttaagagcctgtccaaagagcagaggtgggctgaaggcacaaagcgaatgaaagaataggcccccgggcaccgttgcacgccccacctcctcccaggggcgttgcactccagcccctcccgcacatgcgcactgggccttccaccgccccccgcccccagcaaagccccccgctcggagcatgcgcgggccgcttggcgccaattgctgaccgccacagccacagccagggctagcctcgccggttcccgggtggcgcgcgttcgctgcctcctcagctccaggatgatcggccagaagacgctctactcctttttctcccccagccccgccaggaagcgacacgcccccagccccgagccggccgtccaggggaccggcgtggctggggtgcctgaggaaagcggagatgcggcggtgaggcgcggcttgggccggggctagggggtgaagggggaggaaggcggtgggccccgcctgacggagggcgtgcaggatcgcgcctctgactcggtaaacccgggctccgctttccaaatagcctccacgtgttcaaaatagccgccgctgtcccccatgggccgccatgctaaagggccagccaatgggaacgcgtctcggggcccatggcgccaatccgcgcgccgcaggccctcctggctcggtgcgctgtccaatcagaggggagagggggcgggacccagagggaggttttttgccgcgaaaagaccacgtggggacgcggtggggcgggtctggcgggggcggggcacctctgtgcagggttcccagtcaccgcgacgctcctcgggaagccatagggcgcctcccagcccgtctccccgctccagtttagaacctaattcccaattcccggaccgggcccagccctgggctcttactgtccgcttttgctgggacctgttccacaaatgggcgtcttctgccttgggccgtgggggttgggccggaagctgcggacgcctgggaaggggccgctgcagctcttgagccgcctctgcggggaccacttgcaggccatcccagccaagaaggccccggctgggcaggaggagcctgggacgccgccctcctcgccgctgagtgccgagcagttggaccggatccagaggaacaaggccgcggccctgctcagactcgcggcccgcaacgtgcccgtgggctttggagagagctggaagaagcacctcagcggggagttcgggaaaccgtattttatcaaggtaaatatggaaatgcaccttccataagggtaaatgtggaggctgccggcccttttgtcttgttagtgtagccggccaagttcatgtttccgtaggcttaggttgtacccccttcaacctcctttactcacaaagggggtaaaagaaagccatgatgtttcactctgcagctttatattggttaaagttgttaacgacccgcgagatgatatcatggattcatttaagtcacatagtctattgtccaggaaaggctggcgtagtaaaatcaccaaccatcctgaatgaaacctggcttgagctttaaaaagccgagaggagtggcactgtcaggacccagcccagagaaagaggcaaggaattgacctgattgaaccacttaggtgggggggcaggcactgtttttgtttgttgttttttaaaagaatttggacataacatgacaaagaactaatgatgttccaaataacttgcactagaagctttcttattgaattcttatggtttccaatgagaatctgattttaagtctagtttatctttaaatcagctaatgggatttgttgcagaagaaagaaagcattacactgtttatccacccccacaccaagtcttcacctggacccagatgtgtgacataaaagatgtaagtacaacttgttgataatttttattggggagaaggagtcaaatagtatttttaaattagggacactggagttaagccacagtccatcattcagtagtaaataaaacactgaaatcccgaggtttggctgactgtatttcagcctgtatttactctttttaatgtttaccacgtggtatttatgtggcaaaaaggaaaactatgtacatcctgtgctcttatttcttgtattttttttaaatcctgaaactaacctcccgcggtgtcagatgttatggtggtggtgaagttcaaactgacacacaaagcagttaaatcttttgcagcttgttatagtcaaccccaccttgacctgaccacactgccttatagttagcactttcaagctcttgacttctggcctgaacagttttgtggttctgttatcagatccctttgctttagtttgtcttatataacagttgctggttggcggctctcatccatcttgtgttcagaagttcgtggggctgggcacggtggctcatgcctgtaatcccagcactttcggaggccaaagtgggaggatcatttgaggtcaggagttcaagaccaatgaaacctggtctctcctaaaatacaaaaattagccgggcatggtggcgcacgcctgtaattccagctacttgggaggctgaggtgggagaatcgcatgagcccaggaggcggaggttgcagtgagctgagatcacaccacttcactccagcgtgggcgacagagccagaccctgtctcaaaacaaaaaaaaaaccgtggcttctcactgttgaactatgaaagcagagcaaccctctttaaatagggccacgtcctacctctcagccttacctccacctcccactctcccactccagagttggacagtgtggcaaacccctccccacttctgtctcttaaaaatcaagtagatgcctctgtggcacctccttgaattgaagtccgttgcctgccacctctgtgatccagttttcctctgagctgctacgatgcatttagcacctgctgacactggacttttaggtttcttacccgttttcctcccccgttttgtaaactggggcaagaatcttgtgatttaatgaatatctgtgaaatgacatagaagtgaaataggtgaataaatcatcttgataaggcagccacacctaatacttagaaaatctcgtaagcttaattttagagtaagaatttagaatctagctctttggttttgaagctaaattaaatcctattaagatcaatactaatttgcttcttgtttgaatgccctattctgaataccagtaatcagtataaacagggaatattaaaaggaatattttgagggaatgctcaaaaaccagtttcaaacctatgaggatcagatgggccagcagggcttcttgacagaccagcattgggagagttgtttcacaagagaatatgttggcatggtgtgaacaccaaggggagggacaagaggtccccaaaagcctcctggtcatggaacatctggagctggattctgaaagatagagtatgtcagctgtggaggaagattctaagaacgcaatggcagaagcttgagaatgaagactaggtgggtgggccctggatgggaaggacgaggcggcctatgtttcaacacctcccgtgacaggaacttcatttcatttcattgtctcttgccacctactcccatggcccttttgatctgacctcattctcttctggctccacctgttagaggatataggggagcagacaccctcatatgctgctggtgggaaatctgaattgcttttttttttttttttttttttttgagatggagtgcagtggtgcaatctcggcttactgcaacctccaccccctgggttcaagcgattctcctgcctcagcctcccgagtagctgggactacaggtgtgcgccaccacacccagctaatttttgtatttttagtagagatggggtttcaccatgttggccagatggtttcgatatcttgacctcgtgatctgcctacctcgccctcccaaagtgctgggattacaggcgtgagccaccatgccaggccctaaattgctttaattcatcgaaaagtaactgggggctaggcacagtggctcatgcctgtaatcccagcattttgggaggccgaggagggaggatcccttgatctcaggaatttgagaccagcctcagcaacataagggaggccgtgtgtctacaaaaagtaaaaaaaaaattaggtgggcatagtggtgcactcctgtgggcccagctactctggaggctcaggtgggaggaccacttgagcccaggagggcgaggctgccatgagctgtgatggcaccactgcacatcagcctgagcaacacagcaaaaccgtgtctcaaaaaattaaaaaagcagctaggtacatatctttacaagtttaaaatacgcttagcctttgaccagcaactctgctattagcaatctatgccatagaagtgttttatttgttttgtttatgtttgtttgaggcagggtctgtgctgcttacattacagtattgtttaattcctgacccctggtggttcacaggtgaaggttgtcatcctgggacaggatccatatcatggacctaatcaagctcacgggctctgctttagtgttcaaaggcctgttccgcctccgcccaggtacagttgctttacaggtgactgcagtccagacatgattcctttcagatgtgtacttagcttattacaagtgggactatctggggcactgttcactagccttggaggaggatttctcggcctcagcaccattgacatttggggctgagtcattctttgttgtggaggaggagaggagtcctgtgctattgcaggatcttgtgccacatccctggcctctaccactggaaaccaggagcaacccccagctcgtgataatgaaaaatgtgcagacattgccaaaagtcccttgggggcgtaaaatcacccctggttaagaaccactgctttgggccgggcgcggtgactcacgcctgtaatcccagcactttgggaggctgaggcaggagaatcgctggatcccgggaggcggaggtggcagtgagccgagatcctgctactgcactctagcctgggtgacacagcaagactggaaaaaaaaaaaaaagaaccactgcttttggaggatttggtgtatgatatacataaatatgctaaggacagaaaactgtccctgagcaacagtgggggtctgggttgtaactgctgggttgatttacttaggttttccagagtgctgttaaatccaagtacagactaaagtaaaggtctttggcagagtcacctgttagaaggaggactggcagtgttgatctcattaatcggcgccatatgtgccagtgtcccttccaagggctggctgtaacttctaaccttttcacatatgtcttagacgttactgagctttcaaaattatgcttaagattctgttttttgtttttcttgtggcttgctttcagtttggagaacatttataaagagttgtctacagacatagaggattttgttcatcctggccatggagatttatctgggtgggccaagcaaggtaagccagcgactgctagattttttttttttttttttttttgagaccgagtctcactctgttgcccaggctagagtgcagtggtgcaatctcagcttactgcaacctctgcctcccaggttcaggcgattctcatgcctcagcctcctgagtagctgggaccacaggcatgagccaccatagctggctaattttttaatgtatttttagtagagacagggtttcaccatgttggccaggctggtctcgaactcctgacctcaggtgatccgcccgactcggcttcccaaagtgctgggattacaggcataagccaccacgcccagccccgactccattgttgatggtagtggctgctgccattatgccggctgcagcagggaagcacagcttgctacactggatcccatcaagcattggtttcatcatggatttagctcctgttgctgggtattgggctgatttgcctgagcctacatttaacctgtttctctcatgtgtataggtgttctccttctcaacgctgtcctcacggttcgtgcccatcaagccaactctcataaggagcgaggctgggagcagttcactgatgcagttgtgtcctggctaaatcagaactcgaatggccttgttttcttgctctggggctcttatgctcagaagaagggcagtgccattgatagggtatgttttgttttctttcttttttttcttttttttttaacactataaaaacaatgtaaagaattctaggagtccctgctgtgtttggtcctggaaaatccatgttataaaataacttttattttcccttaggcctgttataagggtttcccattgaaaactgagaagaatttggacaaattataggggtgatgagttgtgtatgaggaaagcaaagcaactggccaacttgtgactgaatgcagttggtgctgtaggcatgaacttggtgtctacaagatacaagtccctgggtaccattcacttaacaagtgatggatgaggcatgtttctggcttccaagaaatttgggaacatatagaaaacacaaagaattccactcaatcacaaatttaacttgcccatgaaaatactatcagtgatcattattgttttgtttctgggttttttgttttttgatggagtctcgctctgttgcccaggctgtagtgcagtggtatgattttggctcactgcaacctccgcctgctgggtttaagtgattctgcctcagcctcccgagtagctgggactacaggcgcccgccaccacacccggctgatttttttttattttttagtagagacagggtttcaccatgttggccaggctggttttgaactcctgacctcaagcgatctgtcctcctcaacctccaaagtgctaggattacaggcatgagccaccacacccggcctatcggtgatcattattaaccccaaggtctaattgcagatacccaacacgaccaaaccagtggctcccctccctacatcttccccctatctgctacctccctctttcccttcactcactgaagcacttctacacctggttgtggaaatcagagacctaaaagtcatccttgaatcctccatcccatcagtaaatcccatcaactctgcctcccaaaacaccccagtctactgcttctcattcgccactgctgcccttcaggcatgagtcaccatcatctttctccaggagaaccgtgatggactagagatggaggcttgatggagagccgcagagtggaggagggagagatagggggtgggaaggagacgagccaggggtgtgttcatccctggcaaatgggagagacattgggtgggggagaaattatagagtaaatgcttcaatgatcgaaggcaagggcttagcagaggtaacctgacaatagtttttggtgtatcagcaggaggtaacgggggtatcagaaatgtgcacgtatatttaacccctaccttgtgtgggtactaggttgagcacttttgttttttgagatggagtctttctgtcacccaggctggagtgcagtggcatgatctcggctcactgcaacttcgcctcctgggttcaagcacttctcctgcctcagcctcctgagtagctaggattacagttgcctgccaccacacccagctaatattttttatttttagtagagactgggtttcaccatgttgacaaggctggtcttgaactcctgacctcaagcgatcctcccatcttggtctcccaaagtgctaggattacagatgtaagccaccgcacccgaccaggttgagtactttgcatgcagaatcttacttaactctcagaaaggctttgaggtaggcatacacttgtatgagtgacctaagatctgactggtatgaactgctaagatgtgatcatctaggtatgtaagaagtgtgcgtgagagtaattgctaatctctatcccttagggaggtttacggccagtgttgctcttccgcagtatattggtaatctttaatcatggtttggtctgaaagtaaacagttgttaaagtagcttggtcattaaagccaaattgcatatctccagcccagtgtctcttctgatctatagagtgccttgttactactgccccatgaacatgccaaattcaacattttccaaacgaagtttctccttttctcatccatgcttcactaaacttcctcctctgcactccctagcagcaaaaagcaccatcatctgcccagttgtccagccagatctattactgacacctgcctacctctctttctcccctcttctgtcctttttttccaccttcccagtcagtcagtcattcatatctgtgttctttcttccccctccaaatctacccctgcctgaccacctttgccttcattcaggccctcacctgatcttgcctggagggttctgatgctttctccctggaaggccttgccttaggctgaagatctgatttcaggggggtaggggggtggcccccaatcggcctcccagacttaactctatccctctttgcactccgatccctaggctgacccattcccctttactttttcacggtgccccacttccctgcctttgcatatcctgctttctctgcctacagtgtagaggtcattttcttctgggattctttagagctctgcagggctgacatttacaggggcctgtgctgcttgcgtgtgtgttcagcatttggtgtgcatgacttcttatcacactcagcccctgtgatcctcatttgattggtcacagtaacttcataagctgggcggtattgttattcccagtctacagatgaaaactgaagcagcttagagttgcagcaacttctctgtggtacagctactgagggtagaggtaggcctcgaccccgggcagtctggctccaggctctgtactcttaaccacactggattgcctggctttagtcctcacccctcatcgcccctcctggactgagccccttgaaggcaagagtgttttgagaaacagtgatttgttcgttagtttttatatacagaaaagaagaggaaaacaaaaatggtctatatctccctgttaaaataactatagttgatattttaaaaaaatcaaagtagtcatttgccacataatgatgtttcagtcataaactgtatatatgacgatggtcccataagattataatattctggccgggtgtggtggctcatacctgttatcccagcactttgggtggccgaggcgagtggattgtctgagctcaggagtttgagaccagcctgggcaacatagtgaaaccctgtctctactaaaatacaaaaaattagccaggtgtggcggcgtgtgcctgtagtcccagctacttgggaggcagaggttgcagttagctgagatcatgccactgcactccagcctggcaacagagtgagactctatctcaaaaaaaaaacatatatatatatacacatatatatatacgtatatatatatacacatatatatatacgtatatatatatatatgtgtatatatatatatacgtatatatatatgtgtatatatatatacgtatatatatgtgtatatatatatgttttttttttgagatagatatatgtatatatatatatacgtatatatatatgtgtatatatatatacgtatatatatgtatatatatgtgtatatatatatgtatatatatgtgtatatatatatatacgtatatatatatgtgtatatatatatatataaaaaatatttttactgcatcttttctatgtttagatacacaaatgcctaccattgtgtcacagttgcctatagtatttagtacagtaacatgctacacaggtttgtagaccaggagcaataagctacactatatagcctaggtgtgtagtggtaggttatcccatttgggtttgtgtaaagatgccctgtggtgtacggatagcagtgaaattgcctaacaacacacttctcagaatgcatccctgtcattaggtgatgtatgactattgctttttttcttttgaaacagggtctagctctgtcacccaggctggaatgcactggcttgatctcaactcactgcggcctcaacctcccaggctcaagcaatcctcccaccttagtcacctgagtagcagggaccacaggcgtgcgccaccacacctggctaatttttgtatttttttttgtggagacagggtttcaccacgttgcccaggctggctcttgaactcctggacttaaacgatcctcctgcctcggcctcccaaagtgctgggattacaggcgtgagctaccacacctggccactgactattcctcttttttttttttttttttttttttctgagacagtttcactcttgttgcccaggctggagtgcaatggcgtgatctcagttcactgcagcctccccctcctgggttcaagtgattctcctgcctcagcctcctgagtagctgggattacaggcatgtaccaccacatccagctaattttgtatttttagtagagacggagtttcttcatgttggtcaggctggtcttgaactcctgacctcaggtgatccacctacctcagcctcccaaagtgctgggattacaggtgtgagccaccacgcccggccaactattccatttttgtggcgagatttttttgtttttgtttttgttttttaattcttccttcttaggagctgtaagactattcagagagttcagaaaggcacaaaatggaaagtaaatggcttccactctttctcttaaaggaactactaaatacagtgtcttgggtatttttctaaagtttttaaaaaatgaaattattttgcattttgttcacttggtaaattttggaggtcatctcatcagtatatttatctttcgcatgtttttctaggagttatgtggttttacattgtaagaactttagaaaaatacatttagccagttctgtaacactgaattgtatactaggttttagctgacataagcagtgtgtcagtccctttatatgtacctatttgtgtaggtacaactggtccctggcttatgaagtttgacctgatttttttcgactttacaatggtgtataaccatactttgagcactcacacgttgtttttttttctttctttaagagacagggtctcttggctgggagcagtggctcacgcctgtaatcccaacactttgagaggccagggtggcggatcacttgagctcaggggtttgagaacagcctgggcaacatagtgagaccttgtctctaaaaaacacaaaaaattagcctggtgtagtggcacgcacctgtggtcccaggtactcaggaggctgaggtgggagagtaacttgagcctaggaggtggaggctacagtgggccacagtcatgccactacactctagcctgggtgacagagtaagaccccatctcaaaaaataaaaaattaaaaaaaaagatcttgctctgtcacccaggctggagtgcagtggcacaattatagctttttgcagcctcgaactcctgggctcaagtgatcctgccacctcagtcttctgtgtagctaggactgcaggtgcatgccatcacacttggctaactttttaatttttttgtagagatggggtctcgctatgttgcctcagttggttgtaaactcttggtcccatgcagttgtcctaccttggcctcccaaagcactgggattacaggtgtaagccaccgtgactggccccgttctatttttcactttcagtacagtgttcaatgagttacatgaggtactaaacacttcattgtaaaagaagctttgttttgcccagctgtaggctaatgtaggtgttctgagcatgtttaaggtagggtaggttaagctatgatgttcagcaggttatatgtcataaatatatcttcaacttaggatattttctacttaggatgggttttccaagatgttaaccccatccattgtgttaataagttgaggagtttatctgtgtgtgtatgcatcatggtgtcctttagcaaatacagtcttagcagtggaaattgctggcggtatgatagggacacttgaaaattgcatagataattgccaacttgaaggcagagggtggtgctctttgcatctcagagcctagcaaaggtaggtagttgctcaacaaacggactaatgttctaatgcaaatgctgaatgctccactttggaagggggagaatttagagggcaaaggggaatcgcacagggtcttaaagtgcaacagccacagtccttcctttttgggaaaaaaaaaaaaaagtcccggccgggcatggtggttcacgcctgtaatcccagcactttggggaggccaaggcgagcggatcacgaggtcaagagatcgagaccatcctggccaatatgatgaaaccccatctctactaaaaatacaaaaattagctgggtgtggtggcacgcgcctgtagtcccagctacttgggaagctgaggcaggagaatcgcttgaacccgggaggcggaggttgcagtgagtcgagatcacgccactgcagcaagactctgtctcaaaaaaaaaaaaaaaaaatttaaaaagtcccaaatctgccaccatttattcttgatctttttcagaagcggcaccatgtactacagacggctcatccctcccctttgtcagtgtatagagggttctttggatgtagacacttttcaaagaccaatgagctgctgcagaagtctggcaagaagcccattgactggaaggagctgtgatcatcagctgaggggtggcctttgagaagctgctgttaacgtatttgccagttacgaagttccactgaaaattttcctattaattcttaagtactctgcataagggggaaaagcttccagaaagcagccatgaaccaggctgtccaggaatggcagctgtatccaaccacaaacaacaaaggctaccctttgaccaaatgtctttctctgcaacatggcttcggcctaaaatatgcagaagacagatgaggtcaaatactcagttggctctctttatctcccttgcctttatggtgaaacaggggagatgtgcacctttcaggcacagccctagtttggcgcctgctgctccttggttttgcctggttagactttcagtgacagatgttggggtgtttttgcttagaaaggtccccttgtctcagccttgcagggcaggcatgccagtctctgccagttccactgcccccttgatctttgaaggagtcctcaggcccctcgcagcataaggatgttttgcaactttccagaatctggcccagaaattagggctcaatttcctgattgtagtagaggttaagattgctgtgagctttatcagataagagaccgagagaagtaagctgggtcttgttattccttgggtgttggtggaataagcagtggaatttgaacaaggaagaggagaaaagggaattttgtctttatggggtggggtgattttctcctagggttatgtccagttggggtttttaaggcagcacagactgccaagtactgttttttttaaccgactgaaatcactttgggatattttttcctgcaacactggaaagttttagttttttaagaagtactcatgcagatatatatatatatatttttcccagtcctttttttaagagacggtctttattgggtctgcacctccatccttgatcttgttagcaatgctgtttttgctgttagtcgggttagagttggctctacgcgaggtttgttaataaaagtttgttaaaagtttgttttgtgcaagtgtcctttgtgcgtccaggccagggcatccatggacgtccttgggctgccctttcccttggcgcctcccagggttcccatagcaaccaccgtctgcaggaggggccgcccttgcccctcctccccgccctgccgctcagtggaacggcccaaccctcccctggctgcggtgagcgctgggcccaacccccggcctggagcagcgccccaactccgagcaccgtggagcaccggctgccagctgagaccccagaggggtaactaacggcctgaggaaggcatttcttcggggaacatggcgtgcccgtcgtggctacgttctgccaagccctgtgacgttggaggggagccgcctgcatcccccgctcagccagtgtttctagactccgagacatctggaactcggaagtgaggccagggctccaggaagactccctgatgacgcactggcccgcagcccaggctcaggtagtgggggctgtcaggatgatctgtgggatcccccagtgtccgaagaaagaagccacaattgtgtttttttttctttctttctttttctttttttttttttgagcgagtctcactctgtcgctcaggctgaagtacagtggcgcgatctcggctcactgcaacctctgcctccaggggtcaagcaatcctcccacctcagcctcccaagtagctgggattacgagcatgcactaccacgcccggctaatttttgtacttttagtagagaaacttttaactaaatgggcaagaaagaatgcatccagccagaacctcgagactagcaaatgcatttcttaaaagggcagggagggagaccagagtttgcttgaaaatactgcttcctttccttatctatgtagggaagggtttatcattctacattttgtggtcagcaagctggctttcacgggaggaggatgcatggtcgatttgccctctggtaactttgggatcttcctctaaacaacagtggactcccttagccaaggaagaagtgaagggataattgtgcttacaccagttagcttttcacacttctctctctcccggtgcagcactgccggtagggggagcagtgagctccaagtttccaggaataattcaaaacacaattattttatattttaaaatataaaatgtatattttaaatatatatacatacatttctatataatatatacaaaagttcaatatacgtatattgaatatatatgtatataagttcaatatatatgtatgtatattcaatatatatgtatgtatatatgtatatatattcaatatatatgtgtatatattgaactttagtcatgtggtgacactttaaacagtacacagagcagcttctgggtccatgaccctccaaaaatttaattactgattctttagaaactaggcaactcagccaggtgtgggggctcacgcctgtaatcccagcactttgggtggccgaggtgggtggatcacctgaggtcgggagttcaagaccagcctgaccagcatggagaaaccctgtctccactaaaaatacaaaattagccaggcgtggtggcacatgcctgtaatcccagctacttgggaggctgaggcaggagaatcacttgaacccgggcgatcgcaccattgcactccagactgggcaacaagagcataagagcaaaactccgtctcaaaaaaaaaaaaaaaaaaaaccaaccaggcaactcattttgatgaactcttagctatgtggtagttgcttttttcatgtgtcaagtctgctatattcctgcactcagtgtgcaaagatgcataaaaggcagtcttagccttttaggtcagcggttggcaaactttctgtgaagggtcaggtggtaaatatttgagggtttgcagttacccgttctccgtgggaactgctcaacaactcactgcagagaaagcagccgtgggcaaaacgtacaggaacgggcgaggctgtgttccaataaaacttta

SEQ ID NO: 16230 - DNA, 27045 bp, Human
gagtctccctccgtcgcccaggccggagtgcagtggtgcgatctcggctcactgcaagctcggcctcccgggttcacgccattctcctgcctcagccttgcgagtagctgggactacaggctcccgacaccacgcccagctaatttttttttttttttgtatttttagtagagatggggttttaccctgttagccaggatggtctcgatttcctgaccccgtgatccgcccgcctcggcctcccaatgtgctgggattacaggcgtgagccacgcgcccggccagaagagtttaattcttttctcatttttaggttaaaaaatgagtagaggccgggcacggtggctcacgccagtaatcccagcactttgggaggcagaggctggcggatcacctgaggtcgggagttcgagattagcctgaccaatatggagaaaccccgtctctactaaaaatacaaaattagccaggcgtggtggctcatgcctgtaatcccagctactcgggaggctgaggcaagagaatcgcttgaatccgggaggcagaggttggtgtgagccaagatcatgccattgcactccagcctgggcaacaagcgccaaactctatctcaaaaaaagaaaaaacaaaattagccaggtgtggtggtgcgtgcctgtaatccaagccactcgggaggctgaggcaggagaattgcttgaaaccgggaggtggaggttgcagcgagcctagatggtgccactgcactccagtgtgggcgacagagtgagactccataaaaaaaaaaaaaaattcaggggaaaaaaagcaattaaaaaaacataactataaaaataatacaaattacaaaacaaccatttacatagcatttacattatattagttataagtaatctagagatgattaaagtgtacggaggaatgtgcataggttatatgccaatactgcctcattttatatgagggacttgaacatagaagggttttggagtccacagaggtcctgaaaccaatttccccttcccatgcctgggatgactgaattatacagcagcaaaaatgaatatactcaagctatatgcatgagtctcataaatataatgctcacagaaaaaagcaagttgcagaagggtaaatacggttgatatataaaggtgctaaacacagaactatttaatgatatacggatgcagtaaaagtataagaaatgtatgcaaacttacttaaattcagggtgttggttacttggagtaaggcgaatgtttgggatgtcagtaggtacctgacaaatggcaacttaactttgttttggtttttttgagatagggtcttgccctttcgcccaggctcaagtgctgtggtgggatgatagctcactgcagcctcgatctccaggctcaaaagatcctccctcccgcctccgcgtcccaagtagctgggaccacaagcgcgcgccaccacgcccggctaatttttaatttttttttgtagagttcaggtctcactgtgttgcccaggatggtcttgaactcctgggctcaagcgatcctcccgccttggcctcccaaagtgctgggattacaggtgtgagccaccgcgcctggcctgcaactttacttataataatctgtgtggcagatgtcatttggcccattttacagatgaggaaattgaggcacagggaagtgaactggcggaatttcagttccgctgggttttgacactgaatcaactggctgaaccagcgagaggacggcccggctggctctcaggcctctcccggcgctcccttccggaccggtgagtgagactcctggggccacgccttgtgaaattctgaggcttcttttcagggatcgaaatcccctccggctccgccctgcgcgttgggccccgccccagcgggtcatgaatatgcaagtgagaggaagatatttaaaggcgtcggcgccacgcgcatatccctgctcggcgctgcccgcccagttcctgttcccagactgaggcccagcccccttcgcccgtttccatcacgagtgccgccagcatgtctgacaaactgccctacaaagtcggtgagtcccaggacctgcagccggttgcggccgcccggcacccgcccggggcttgttcgtggcgggggctgcagggccgactcggggctctctggaccccctggaatcgcagcctcggcgcgtttctggccgcgcgaagccagctggaagttggagttctcgcgcggccatgagcgggccgttccgggtggccgtggactacaagtcccagcatgccccgcgacgccggggccgccgcgcggtctgcgagccgcaaactggcggcgtgctccgcgggagagcacacctggccacggcctgggacggctggcacctgccggaccctgctcggggggcctgcgcccggcctcctaggcctggaccggaccctgtccagctgggcggccccgacgagcgtccacccctctctgggcctcctacagggacggcgagggcaccccggagggtgtatgaggagaggcctggaaagcgagccccaggccggctccgatcctcctctcccctgggactttgggccagttacccaacctgtggggtcccccacccctccagcaggggcagccttgcagaaatctcgaagaaaatttggagtggtttgaaaaatcctgctgtcccaccgattgaagtgtaatacagggatagttaacgtttacttagtgtttcctgtgggatcggcactgccttctagctttattctagtctcatggctctgtagggaaactgttctcattttatgatgagaatcctgaggcagaggtaacttgccctcagtcttacagctggtggtgatggagcaagattggaacgcaggccatctagatctctgagcgcaccctttcaccactgtgtgcaagcgaatacacgcggaacaatcctagtgaattttcagcaaaaaccagttcagtttggctggtagcttttcaagtaactttgacactattggaccgggtgtggtggctcacccctgtagtcccagcactttgagaggccgaggtgggcgaatcacttgaggtcaagagttcgagaccagcctggccaacgtggtgaaacgctatctctaccaaaaatacaaaaactagctgggcgtggtggcgggcgccttcattcccagctactcgggaggctgaggcaggaggactgtttgagccggggagacggaggttgcagtgagccgagattgcaccaccacgctccaacctgggcaacagagcaagaccctgtctcaaaaaaaaaaaacaaacaaaaaaagacactattaagtctggagaatgccatccacatttatggaaacacttgctgtatatctggtgatttacgtgtgtttacacaataatcttcatagaggtggacgtaatcccgttatatagagcatgaaactgaggcccttgggaggtgacttgcaaagattctgttgaagtagttcatcaagttgctaccagagtagactgtctccattgtgtggatgctgaaactgaacccagaaaggttatgtgaaggtcacatcaatagtagagctggaatgggggcttgtcatactgtggagagattagtgggtcaggattggggccattgggttgtgtgggtggagataaagctggatttggggatggggagcttagctgggtggggctggaggaaggaggccctgctgtatgccagatcttgatcatatggcattatctttacttaaggcgcatagcaagctagggatgattatccacactttacagatgaagaaactgatgtttacaggggctcttgctgttcctcttggcttgtcctggggacaggtgttcctgtgacttttgcaagtccttagctccagagattgcagcatctagcctctcctgtgcctttggagttgagggtcccagggaaaactgtggggctggcacagtgtcctcgagggcactgaaggagttatttttagctggagggacatgtggtggtggaggggtggagcttagcagcacagggcataacccattgtcccatacagccgggcccctcccaggaggggccttgagaggggcctctgctctagccctgcctggctgccagttctggttctgcggttaattggctatggaacctgcagcaaactcctctctgggtcctctctgggtcattagtaaatgctgggactcagactaggttcagatttgtgttgtttttctttgccacccttgtcacgtgccagcccctctcatggatctttcattcagttctgaggacagatatggtcggtaaacagttgctgaccccttctctgagccaggtcatgctggagacacaaaggtgacccagagacaggggtggcacagacatgcatacagataaagtagtattgtctccattttatgtgagcagatctgccacttgtctgtctccacggtcaccaccccagtctggtctctctccttgcaggtctccctggatctcttgctccgcagatccacacagcagccaatggggtcttttcaaaagacaaatctggtctctgaatgctggtccctgaaaactgtaggttccccacttcactgggactgaagtcccaactcatcttatgcctctatttgagtcaccctggtgcactcttggttcctctagcagggatatactaggttctttcctgtttccaggtttttttcagcacctactgtgtgccaggtactgtattaggtgcttgagaggagccttccaggccgagaactgcttgggttaaagccctgaggtggaaatgagtggagcttgcctgaagtcagtcaggaagcctgtgtgttgaacagctagtgagtggggaaagtggagagatggaggaggggcaggcagtcatgcagatagggcccgaagattgagggaagccattggagggtttgcttgtttagttttgtttactttagtagaatgatggaggtgatgtaacttaaatttttaagagcctccctcttctggctgctgtggggagaatggcatgttagagcatgggaccagtgaagagagtgtggcagtgtccaactgagaagtggcagtgtatttatttctttattgttttttttggagacagagtctccctctcacccaggttggagtgcagtggtgctattttagctcactgccacctccgcctcccaggttcaagcaattctcctgcctcagcctcctgagtagctgggattataagtgcccaccaccacgcccaactaatttttgtatttttagtagagatgggatttcaccatgttggccaggctgctctcgaacttctgacctcgggtgatccgcccaccttggcctctcaaagtgctgggattacaggctgtgagccactgcgcccagcctgagaagtgacagtttagatgaaggtggtgagatgcagttggattgcttatatatttcacttgttgagccaaaaacgtgctgattgaggtgaaagaggaaaagaggaatcaaatcttaagtttttgggcagagtagctggttgaatggtggtttcatttcctaaaatgggaagattgggagagtaaccggtagtgggggcaaaggagccatgaggactccaacatgacacataatagatccaactggacatccaagtggaggtgctgtggaggcagttggatcacatcgagtctcaagttcaggggagtagtttgggctggatataaatacgtgggagtcatccccgtagagaaggtatgtaaagccataagactggatgagcttaattggtaaacataagagaactgggagatgatggagccctgagggcccccaaaccctaaagtctgttagctaaagaggaaccaggaaggtaggtggaaaagcacaggacagtcacagaagccaagtaaagaaagggtttcaggaaggagggcaagtcattcatgcaatctgtgctgctggtagaaacatggtcttaggtaattttgcatcaggtatggagatcaggctggtctttggacggaagagcagttttagtggagtatggaagtccttaaggaggagaggggatatggaatcaggccccatggagcagggatagtgtagtgaccagccccatagggtcggtgggtctctccctgtgtgcggcgacgagagagtgtagaaataaagatacaagacaaagagacaagagaaaaggcagctgggcccgggggaccactaccatcaatgcgcggagaccggtagtggccccgaatgttgggctgcgctgttatttattgcatataaggcagaaggggcagggtaaagaatgtgagtcacctccaacgataggtaaggtcatgtgggtcacgtgtccactggacagggggcccttccctgcctggcagccgaggcagggagggagaggagacagagagaaagacagcttacgccattatttctgcatatcagggactattagtatttttactaatttactactgctatctagaaggcatagccaggtgtacaggatggaacatgaaggcagactaggagtgtgaccactgaagcacagcatcacagggagatggttaggcctctggataactgtgggcgagcctggctgatgtcaggccctctacaagaggtggaggagcagagtcttttctaaactcccctggggaaagggagacaccccccccccccccgccgccgccacttcccagtctgctaagtagcgggtgttgttccttgacaccttttgctaccgctggaccacgatccgcctggtaacgggcgtcttcccagacgctggcgtcaccgctagaccaaggagccctctggtggccctgtccgggcataacagaaggctcgcactcttgtcttctggtcacacctcactatgtcccctcagctcctatctctgtatggcctggtttttcctaggctatgattatagagcaaggattatcataatattggaataaaaagtaattgctacaaactaatgattaatgatattcatatataatcatatataagatctatatctagtataactattcttgttttatattttattatactggaacagctcgtgtcctctgtctcttgcctcggtgcctgggtggcttgccgcccacaggacagctcatctattttattttatttttttgagaccgagtctcactctgtcacccaggctggagtgcagtggcatgatctcagctcattgcagcctctgcctcccaggttcaagtgattctcctgcctcagcctcctgagtagctgggattacaggcacccaccaccacacccggctaatttttgtatttttagtagagacggggtttcaccatgttggtcaggctggtcttgaactcctgacctcaagtgatctgcccaccttggcctcccaaagtgttgggattacaggtgtgagccaccgcgcccattcaactcatctgtggtaacaggaaagagtgcctggtctgaagctgtagatgactgctataggtgactagtggattccataggggaaaagtggcctggttctgaattcatctcagtgaattgggaagtgagattgtcattcaatggggaaaggtgttggagggttgaggagagtagaaaatgggagtaaatttactaggaaaatgtcataggattgctgcaatgtgctatgtgtcttttatggtcttaataaatatgatatcttggccaggtgtggtggctcacacctgtaatcccagcactttgggaggctgaagcaggtggatcacgaggccaggagttcaagatcagcctggccaacatggtgaaaccccgtctcctctaaaaatacaaaaattagctgggcatggtggcgagttcctgtaatcccagctattggggaggctgaggcaggagaattgcttgaaccgggacctgagaggtggaggttgcagtgggccgagatcgcgccactgcaccccagcctggtctacagagccagactatgtctctaaaataattaattaattaattaattaaatatgatgtcttggtggggttgtgattgtcctcctgctgggttcagtgggtccggtgcagtggagggtcgggtttaattgggctgagagttttgccaagtgagttctcaaagggaaagggggtagaagggacactagaaattggtaggatgaattgaatagaggttctcacctgacaggccacagccttgttggagcttggcctctggaaggagaaaaccagaaagatgaggcgtggctagagttgggtgcttgaagtccagatttccaaggagagctatcactggtgatggcctactagggtaggagggctggggtgggtggcttgagttgaggcacagccggagtggtctctcatgcgggaggcgtgtttcatctctgaaattgttaaaatgcactgtaggaagctgactgacagacaattttattgattattaaattcttagattattaaattctctacagagtcctttgcctcccaccgcctacctctttgggtgtttggcaggatctcagcttccctaaagataaaaatcaccaggagtcttagacctgctgaatcatattttccaggggagatttacaagcatgccagaggaacatcccttaccggggaagtctgcaaactttgacctagggactgacctagggtatgaccttggaagtggaccagtgtggtaggggagagtattgagatagtgagttagctcataataatatccttctttcctgcctgagaatttgaacaaattcgagacattttaggtggcagatagcacctgaaatactttttgttactagtaaccatgaagccagaggatgtagattagtattttaggtggcaacacctgaaatattaccttttattactaataacctcaaagccagaggatatagattaatatgaaatccaaatgatcctgcttattgaacccccagattcagcagttacccaatcagttgcaggcaaggtgggccagggtaggttggtctctggaaaagcagagaacaccagcttcctgcaagtgggcaggtgagtgcttgcttgcaaaaagaagggagagctaagctgagcacaccattttttcctctcagttttactggtcagacaagctcaccccacctcccctggggcagagaggccaagagcattcgttatacggatgagttcctccaggtggaaagaaacatcaggagtggggaagcatttttacatctaaaaggagatcaaggaactgtcaaatccaaaatgttagatagtatttataagtgttgaatcaccgagagtgatgactgagagaggaagatggagaaccagcagctaacatctttagggagtctttagggagtgaggagtggcctggaggttggtaggtgtcagcagaaaggcagggtagtgggaagtatcatgtgagctatttttcaaagggacgcttctttatgttgtaatttttgtgtccctgtgtgattaaatgtgttctcccacaagtcagaaaggtgcaggtaggcagggaccgtgtctttcttgagtactctggcttcataaatacttgttgcatgagtgagagaatgcggtgacagagtgctaagccctagtgtgttgagtccacacgtggatcggggtccatgcagtgaccgcccctcttggttggtgggatgaggggactcacggaactcccacctgtttcctcccgtagccgacatcggcctggctgcctggggacgcaaggccctggacattgctgagaacgagatgccgggcctgatgcgtatgcgggagcggtactcggcctccaagccactgaagggcgcccgcatcgctggctgcctgcacatgaccgtggagacggccgtcctcattgagaccctcgtcaccctgggtgctgaggtgaggcccacagctgtatcaccccagagtccttgccctccctgggttcagccagggaagaagacgactgtgccagggtggggaccttccaggtgtggagctgaccgcgggcctggaggggttcctccctctcactcggtttcctccgtttcccagtgctgccaccccttgtggtgagtgttctgcagattttctccctggctgggaaggtcactgttggctaccctcaaggcatcctcctgatggatgctctggcaggaaaaattcaacacccatgtcctacttagtctcttaagggccagcttgccttggcccttcgggggtcacaggcctaccctggacccatcatggctgctggatgatggcagctctgattggttcagcctgggtcatgtgtgccaatgattaacagctctcctaaggtctcagagagtcaagaagcaagctggtttcccaaagcagggtagggcaatggagccaaaatccacagaggggctcagggctgagtccttggacctcttctttcttttcagcattcactcttggcggtctgattttatagctttagacactatctggtgatgactgtcacatttttgtactagcctggacttctcctggaactcaagactggcatatccaggagcgggggcgttgacgctccctggaggtctagtactcatctcaggcagaacgcgttcaaacagactcaggattttctgccccctcttcttcccaaagccttccccacctgagtaaatggaacctctgttccagccttctgggttctctcaattcacgaatctgggagtcatctcctcccctccctttcctccccactcccaactccctttactccaacaactcatccctctgcaaatcctgtcagtgcagccttcagagtagacccaggatgtgacaacttctcatcatctccactgctactgtcatatttcttgtctggagtcttctccaacagtctctgcagttgtccccttgcttccaccctttcccttccacacagcactggagtgaggttttaaaacctgagttggatctcgcccctgctctggctcccatctgcccacccagcatccccagcctgtgatcctagagcttgctgtgcctagatcccaagcctctccccactacccgaagctctcccttttcctcgcccagcgtccctggtgcttttgagccatcagtgaccaacagccttgttttgatggctcttctaggtgcagtggtccagctgcaacatcttctccacccaggaccatgcggcggctgccattgccaaggctggcattccgggtaagtcctgcttgcttctgagacgtggaatttgtgaagggattctgccctctttgcttcactgactgctagagcaacagacttccttacatatcagaaagggagaggagtcaccgccacaaaatcctagcccagcgaccccacaggaaagagctgctttgtcccatcatcatctaaaatcctgtggaagttgtttattgacccaggtcaagccgtgtaaccaggaagagcaagatcttatgattgggaactacatgatgaagcggaggggaagttcattaaaggaaggatgtggatctctttccaaagaactggggagggctacggggcagaaaaagaggttcactgcctagggtatggcggtctaaaggactgaggaaggaccaagtctaacgagaatggagttttcacaggctgggcacatgtctgcttggacttggggaggggagtggttagatctgacccagtgattaggacattcaagattgcttctaaccaaccacaggtggacaggagggggtggcacagcactccttcacagactgaccagggctgaatgggcatgatccccattcctcagccttggcaccgtggctttcttcttttttttttttctttttgagacagagtcttgccccgttgcccatactggagtgcagtggtgcgatcttggctcactgcaattcttaagactattgtctgctccagttgtgggtagaagcagctggctctgcttggccagcgtcctttgctcacaagaggctcctgggaaccccacacctgtgccctagtcatgccacatgggaggagtgtgggctggtggtcagtagcccttagttctggtgtctattctggaatttcatgtagagtggcccaagtgcgtcttagctcctctctgggcatctgtaagtgatgataatggtcatggctgcctcacagggtttctatgaggaagaatgagatggggtatggaggatttagagtcatgtctggcagaaagcaagtaccccacacatggtagctgctcgtagtcattttttggccagactttgcctgagattcccccacacagaggctgctagtgctccagtcctttcagtgcagagcaaaccctggatcctgccatgtggatcctgctgagggggaggtgttgtggggtatcaagccctggtcactcagggttgatgcctcagtccttggcgcccaggcagaaggggatgggaaaggaaagaatgatttcctgatatctatatctggggcggggggctgtacatggcttctgtctcacttaatccatactattgtgagccctatttacagaggagaagactgaggctcagagaggtgaagtgatttgcccaaggtcacacagctggcaagtggcagagccagggtttgaactcagatctatctggctccaagttgtgtcctgaccactgctgagttttcagaggggccggaggtggctggggatgggagttgggaaggaggtagttttggctctgccagagttgttccctggagcaggtaccagttgggaagtccaggccctgatgtgccactcaccctccagtgtatgcctggaagggcgaaacggacgaggagtacctgtggtgcattgagcagaccctgtacttcaaggacgggcccctcaacatgattctggacgacgggggcgacctcaccaacctcatccacaccaagtacccgcagcttctgccaggtgagcagggcggggcaggtgggctgggtgctggtggcctgggtggggcctgtttgcccacatgatggccgcaggcctggcaggactcccatcacctcaagcagcaggatctggaagatgggaggatggcaggctctggcattcatgctggggcctcctgacttctgagggtgcgaggctagggcagctgagctgatggcccaagggcaggcacagacagggccatggttgggaatagctgggagggagccagctttgttcaaagcaggtacgcagagtgcagaggccctgaggcaggaatggctggagtgttcaggaaacagaaaagaggcccacaggatagcagtgagcaaagggagccttcactgcgggtatggtgtgaacttcgtgaagaccagatgtgtcagggcctaataggccaatagaaaagtgtttgacctgatatgcagagcaaggggaaataactggagggcgttgagaagatttctctgagaagatacatgttagaaatggctgctgcatggaggatgggttgtggtagggagactgggaagaagcgacagggtcacggactagagcagcggcagtgagaatagagaagctgggagttgttcggaggcagagtcactaggcctggtggtggcttccctgtaggagggcgttggggactcctccctcacgcgggtctgggtgattggggggcctgtgggatcagtcacagagatgggaacccagaaagaggaatggctttagggggtaaagatgaggaatttgcatgagcacaggtgtggcatctctgaggcttgtcctgtcccctcttgtttaggcatccgaggcatctctgaggagaccacgactggggtccacaacctctacaagatgatggccaatgggatcctcaaggtgcctgccatcaatgtcaatgactccgtcaccaaggtgagccgaggggcagtgacagctcccgctacagtggctgcagctcaggacgaggcctctgaagaagagtgcccaggaaggctgagattagggacatgaagccctcatttgagggggcaaaagcggttatagacaggctaatgagtgcgtttaaaaggggtgtcagagctgggtgttaggagctttatggctttgggaagaagagctttcaagttaagcaaggtctttgaccgggcaatctctcctagtaactgatgcctaggaaggctccacactggcagagaaagattagagagaagctctttgagccgatcggggtgaagggcttgtgggggcattgggtgctggaggggttcagcccaggccgggatgcttggtgggcccatgatgcctgggctcttcagaatactctgaggccaagttgtcctggccccagggccttgcctgcccctattgtctccttaccccctttcctttcagagcaagtttgacaacctctatggctgccgggagtccctcatagatggcatcaagcgggccacagatgtgatgattgccggcaaggtagcggtggtagcaggctatggtgatgtgggcaagggctgtgcccaggccctgcggggtttcggagcccgcgtcatcatcaccgagattgaccccatcaacgcactgcaggctgccatggagggtaggatagggcaagggttggttgtcagccactggggccagagggaggggcaaggccaccgtagatgacccacagccactgtctctgcacaggctatgaggtgaccaccatggatgaggcctgtcaggagggcaacatctttgtcaccaccacaggctgtattgacatcatccttggccggtaggtgccagatggggggtcccggggagtgagggaggagggcagagttgggacagctttctgtccctgacaatctcccacggtcttgggctgcctgacaggcactttgagcagatgaaggatgatgccattgtgtgtaacattggacactttgacgtggagatcgatgtcaagtggctcaacgagaacgccgtggagaaggtgaacatcaagccgcaggtgagaagctcccgccttgccagtgggctgggcagatgggagtgcagaggagtgctggctgccagggaggagagctgaggagatggtggcaacctgtgcagggggatggggagaagagggcctagcatcagagccagccagacgtggcaaccttatcctgtgggcagccggcatccctgaaggtatcaggcaggtgagctgtatgtggtgaggctgtagttttagaaagatcactctagctactgtgtgcagaataaaagcaacaatggcgggtggtggggagagaggcttttagaggaggctcgtagaatccctgcaggggatgatggcagcctcagcttagggagtgctggggtggatggacggcatgtagggtcaggatggaggcagagtaacaaaggacacagctttggccgggcatggtggctcacacctgtaatcccagcactttggaaggccgagatgggcggatcacctgaggccaggagttcgagactagcctggccaacatggttgaaaccccgtctctactaaaaatacaaaaaaattagctgggccgggtgcggtagctcatgcctgtaatcccagcagtttgggaggtcgaggcgggcggatcacatgaggtcaggggttcgagaccagcctgaccaatatgatgaaaccccatctctactaaaaatagaaaaattagccgggtgtggtggcgggcacctgtaatcccagctatttgggaggctgaggcaggagagaattgcttgaagctgggaggcggaggttgcagtgagccgagatcgcaccctcgcactcctgcctggttaataagagcgagactccatctcaaaaaaaaaaaaaaaaaaaaggccaggtacagtggctcatgcctgtaatcccagcactttgggaggcctaggtgggcagatcacgaggtcaggagtttgagaccagtctggccagcatagtgaaaccccgtctctactaaaaatacaagaagttagccgggtgtggtgatgtgcacctgcaatcccagctacttgggaggctgaggcaggagaatcacatgaacccgggagatggaggttgtagtgagccgagattgttccactgcactccagcctgggtgacagtgcgagactctgtctcaaaaacaaacaaacaaaaaaatcagctgggcatggtggtgggtgcctgtaatcccagctactcgggaggctgaggcatgagaatcgcttaaacgtggtaggcagaggttgcagtgagccgagattgcgccattgctctccagcctgggcaacagagcgagactccatctcaaaaacaaaactaaaaacaaaaaacaaaaagggacacagcttgaatcactgtgtgaggagcaggcccatgcactgagctgggaaagaacaggtttgcattgggcattggggcactgaaactggaagatgagttcttatagggggtgtgaagttttacttgagttgcaattattatgagtttatttttttctctgattataaaagtagtatgtttctggaagacattttggctttggatatcaagagctttaaagttaagcaacctctttgactgggcaatctctcctataattggtccttaggataattaaatatgtatgtagagatgttcatcattttttttttctttttttgagatgggctcactctgttacccaagctagagggcagtggcatgatcatggcacactgcagccttgacctcctgggctgaaggagctgatcctcctgcctcagccttccaagtacctgggactacagatgtgcactactacacctggctaactttttattttttgtagagacgaggccttgctgtgttccccaggctggtctcaaactcctgagcttaagttatctcccaaagtgctgggattataggcgtgagctgccacaccaggtccaccacattttttaaagggagaaaagcccacctatgtgaggttctttgagttggtgctgtgccgtgtttgagatatgataaggaagatacagacacagagttggccaaagccctgacacccacccagtcacagccacaccagaagcccaagtcccagagaggcagacaggcagctctatgaacccacatcccctacactgtcctcttgggtgctctgctcctgcgtgggagttctccttggctaggtcctgcactagtctagggtgtcagttcccggctaggcagagggcacctccatctctgcctagaaggcctggcactcatcacagtgtgggggtggccagggcgtgcttctgtggcagccacacccctgacagccatctgtctagacctcctttttgcaaaggcatcacaggtgaaacctgctacattggggtgatgggcacctttctgccaagctgccctccaaagctggactctatgcccaccctcaacatccttgacagtcttgccaaccttctgcccaacattatctcttgtccgtcctctcaagggcctctgtactcaggccataattgaccactccctgaatacccactgcagctcctacttctgctcatctgtccagacagctgcatttgtctggaacagaacacatgcccttctccttgttcatcttctcagcccagctcaagagacccccttccggccaggcacggtggcacacacctgtaattccagcactttgggaggccgaggcaggcggatcacttgaggtcaggagtttgagaccagcctggccaacatggtcaaaccctgtctctactaaaaatacaaaaaattagctgggcatggtggctcatgcgtatagtcccagctactctggaggctgaggcaggagaatcgcttgaacccaggaggtggaggttgcagtgagctgagatcacaccactgtactccagcctggatgacagagtaagactccgtctcagaaaaaaaaaaaaaaaaaaattaataaaataaaaaagagacccccttcctggccagctcctctggcagaggcaatgcccacactcttagtacagacccctagtgcagcatccatcactggctttggtctctgaccccactgttgtaccaggagggtagagtccaggttgacgtgtccctgcaaggggcttagatgggtatcagtgagtgcttattgattgaagcatcaatcaatgcctgatgggcatcagagacctttccttggatcggtactaggcctctggagcagcttggaaacctgggcttttggggaaatgtttgggaggctgcctgagggtggagggatggcaagggaagagctgggagtggggagaaagcaagtttgtgtgttcagacagctgggacagacggaggactggggcactgaggctggggatttccatgtcacgttcactcactaaaccgggagttctcaaccttggcagtcacctgggagccacactgtgggccacaggaataggagtctctgggaatgaggccaaggtatcttttttttttttttttttttttttgagacggagtttcgctcttgttgcccaggctggagtgcaatggcgcgatcttggctcaccacaacctccgcttcccaggttcaagcgattcgcctggctcagccttcctgagtagctgggattacaggcatgtgctaccatgcctggctaattttgtgtttttagtagagacagggtttctccatgttgttcaggctggtcccgaactcccgacctcaggtgattccccccgccttggcctcccaaagtgctgggattacaggcatgagccaccgcgtctggcctgggtatcctcattttttaaagcttctgaggtgattccaatgtgagtgccacggcattcagcttttgctaagctgcattcaaaactatttcatggttattgagaacatgggatctgtcctcagaccgtccagactcaaattgcagcctcctcttagtgtgtggctctggacaagtgacctaacccttgtaaacttcagtttctgaatctgaaatggggatgacagcagtactgaaatcacagggttgtttctgggatgaaatgtggtagttacctgtaaaggacttagtacagggcacatgacagtgatcataacgataacattagctgctgcttactgagtgcctcatatgcgccaagcaagtgtgagcacgtgaagttctcacagcagaactgtgcagtctgcagctcagcatttctttgttgtttttttgttttttgttttttgagacagagtctcgctccgtcgcccaggctgcagtgcagtggtgcgatctcggctcgctgcaaactccacctcccaggttcacgccattctcctgcctcagcctcccgagtggctgggaccacaggcgcctgctaccacgcccggctaattttttgtattttttttttagtagagacgggctttcactgtgttggccaagataatctcgatctcctgacctcatgatccgcctgcctcggccttccaaagtgctgggattacaggcgtgagccaccgtgccccggccagcttaacatttcttaataaatattggctgttatttttgtgctaagccatgtgctggaggttgttttggagcagttcggactcctcatgggcactgttggaggcagagaggcctgccagatcagagggtgggctgtgggagcggggccctgcctgccttcactgttgccctgcctgcgtgtaggtggaccggtatcggttgaagaatgggcgccgcatcatcctgctggccgagggtcggctggtcaacctgggttgtgccatgggccaccccagcttcgtgatgagtaactccttcaccaaccaggtgatggcgcagatcgagctgtggacccatccagacaagtaccccgttggggttcatttcctgcccaagaaggtgggtttattcttctacctcaagccaagggtcacgtgtctaatcctgggatccccacacagggcttgccagagtttataaagtgcttgcctgtctgccctcttagaggccctcatggggtcctctacagtgcagaagtcattctccccattgacagaagaagaaactgagacccacagtagggagtggctccctggagcacagcagagcggcaggaccaggtggtgaggagagcctgggccttggagcgggacacaccccagtttgaatctcagccccaccacttacaggctgtgtaatccaggcaaattctttctctgtcttcattttctcatctgtgaaatgaaggtaatagcaacccccttcaggattgtgaggatttcctgagatcatgaacccacacacccacaggggctaggcaggtaaatgagtgatgccagctgaacaaggactggaagagctgaaggggtaaagggctggttgccacctaggaacccaggtccgtctgaccagggcttctaacctttcaggagagccagagataccaagatctctatacaaaatgattttcaaatacaggcaactcattaaaattttattttgattttgatttttttgagatagagtctcactctgttgcccaggctagagtgcagtgacgtgatctcggcttactgcaacctccacctgccgggttcaagcaatcctcccacctcagcctcttgagtagctaggattacaggcagatgccaccacacttggctaatttttttgtatttttagtagagacggggttttgccatattggccagactggtctcgaactcctgatttcaagtgatccacccgcctcggccactgcacctggcctcattataatttaaaaaataactgggtgggttaacttggacatgtgtataagctgagtgcagtctgcaggctgcacgttgtggccttgtaataagatgatacatccctggccaggcgcggtggctcacacctgtaatcccagcactttgggaggccgaggtgggcagatcatttgaggtcagaagttggagaccagcctggccaacatggtgaaaccccatctctactaaaaatacaaaaaaatgagctgggcatggtggcgcatgcctgtagtcccaggtacttgggaagctgaggcaggagaattgcttgaacccaggaggtggaggttgcagtgagacgagattgtgccactgcactccagcctggtgacagagtgagaccctgtctcaaaaaaaaaagatacatccctaagcatggcatctcactatggttgtatggtctgcatactcatgaagatgaagtcctctgacatgaaatccagtgctcaccctaacaccccatgcagtccacccttccctggggtcaggacagatgttttagtcctggcttttcttggcagttttacaggtgaactttgctttgtcccttaccctgtccaatcctcagtctccttatgagctaaatggtaagagtagctcttgctcttccagccttttgctgctggagaagctgtgatggggtctacataccatcccttcatcttttgaaaggctggttctaccaattgaggaagacgcaggaagaggcctggggcatctgcctccagggccagccaacaactaatctccctggagcaatgtcttgctggaccaaacattttacccataaggacctcaaggcataccttgttctgtgcagctggttgtggggttgaaagattctcacttgatccccatctaatcccagttgggagaaatatggctatgagtttggtgagaaattggtcaggctttgaaatgagggcagggttggaagtgaaagaggcaaagctcccgcctcagcacctgaccctgtccttaccacttttcttcatcattgctaacatgtggcttggggacaggacactcttggcatcatgcctcacatgctgtatgcaggcaagggactaggtaccttggtcaacaatgacagagaaggcagccaccatttattaagtcacctactgcacgaatgactctgagtagcactgatctttgtaacagccttgagagatgagtgatccatccatcctgcgaatggggaaagtcaggtgtagagaccgacttgctctcacagatgttaagtatcaggccaggaatagaacctagctctgtctgtccaaggtgttgaccttaggacgtgacacacaccttctggttcagggtgctgggagaaggaaaagttctgggctagtccgggccaagcagaaggttgatttcaatgtgtactgtgggggttggaggccatcgttctacctctggaactgacgtggactcagttctaggctgggccctggtcctactgttgcccgcctctctgctgagcacatcaccttctgcaggctctttgcttcatctgaagatacaaggataaaccgcacccatcctacttcttaagggtgtttgggaggctctaatgaaacagtagatgtgaaaccacttgggaatgtaaaagctgtgggctgagctgtggtcagaggccgccatgccatcatgggacaggatggggtcccttaggggtagggagaggcctacctcatgagagagttagaggcttgcttgtatttaactcttgcctctgtcctcctcggtttctgcataatctcttcaaagctgctctagaggccataagctgggatgcttgagacacattttggggctttgaagccagatagacctgggttcaaatcctagctctgtcattcactagcttggtgaccgtggacacgtcatttcacgtttctgaaccttgatttcctcattttataaaaggaggatggcagtggattagaatccttttggtcacaagtgatagaaacactattcaaaccagtgtatcagttatcttgctgcataacactctaacccccagacttactggcttcaaataataaatatttattatttcagtttctgtgggtcaagaatttgagatcagcttagctggctgcttctgactcaggctctttcatgaggttgcggtcaagatttctgccagggctgcaatcatctgaaggtttgactgggtctggaagatcctcttcacatcgctgttgacaggaggtctcaattcctcatgcatgggcctctccagagggctgcttatgcatcctcaggagatggcatctggcttcccccagagtaagtcatccagaggagagcaaggaggaagccacagggtctctatgaacttgtgtccaaagtcacacaccatcacttctgctttcttctattcattagaaaggaatcactcggtggggtggggggaggcggtggggattaggctctaattcttaaaggagtatcaaagaatttatagatacattttaatcaaaaaaagcaaccagtttaatccaaaaaagaactttattctcgaatctgccaggcacggtggctcacgcctgtaatcccagcactttgggaggctgaggcaggcagatcacctgaggtcaggagttcgacacctgaggtcaggagttcaagaacagccttaccaacatggtgaaaccccatctctactaaaaacagaaagttagctggacgtggtggtgcacgcctgtaatcccagctcctcgggaggctgaggcaggagaatcacttgaacctgggatgtagaagttgcagtgagccgagatcgcgccactgcactccagcgtgggcgtccgaatgagactctgtcacaaaaaaaagaactttattctcggatccaaacactggaaacctaggattccgtgtcatcatggctctgtccttctgtctctcggatctatcttcatttcacttgtaaaatagacttggaactggtgagctgagattgatagatacccttccctgtttaggaatcccagtggggttggagcaccttgtctctgcctgtcatggaaaatatgtcctgtgcatagatcaattccagagaagcattttggttagctgcttgagttgaagaatgaggaaggagatgtgattgatggtcctgtcaagccacatgtaggggagggtgtggcatggttcccttttgaggggggctgggcagccaaaacaacacattaactgaggctgggtgtgaggatagaaagagttaacatgagtaccacacatggcagaaaccctaacagaacacttctgcctctattggcagccagacgcgtgtaggggtcccagaaaatggcactgattcccggtcttcctttgtttctccccagctggatgaggcagtggctgaagcccacctgggcaagctgaatgtgaagttgaccaagctaactgagaagcaagcccagtacctgggcatgtcctgtgatggccccttcaagccggatcactaccgctactgagagccaggtctgcgtttcaccctccagctgctgtccttgcccaggccccacctctcctccctaagagctaatggcaccaactttgtgattggtttgtcagtgtcccccatcgactctctggggctgatcacttagtttttggcctctgctgcagccgtcatactgttccaaatgtggcagcgggaacagagtaccctcttcaagccccggtcatgatggaggtcccagccacagggaaccatgagctcagtggtcttggaacagctcactaagtcagtccttccttagcctggaagtcagtagtggagtcacaaagcccatgtgttttgccatctaggccttcacctggtctgtggacttatacctgtgtgcttggtttacaggtccagtggttcttcagcccatgacagatgagaaggggctatattgaagggcaaagaggaactgttgtttgaattttcctgagagcctggcttagtgctgggccttctcttaaacctcattacaatgaggttagtacttttagtccctgttttacaggggttagaatagactgttaaggggcaactgagaaagaacagagaagtgacagctaggggttgagaggggccagaaaaacatgaatgcaggcagatttcgtgaaatctgccaccactttataaccagatggttcctttcacaaccctgggtcaaaaagagaataatttggcctataatgttaaaagaaagcaggaaggtgggtaaataaaaatcttggtgcctggaagaattttgagcctttattttatagataatcctctgctaacaatgtatgccatgaatagggggttatagtcgtgctgatgaagcattcacagggtactctgcagtggaacggctgtctgtggtccttaggcttgaaagaatgggtaaagtgaagagggaactctttcgtttttttttgagacagagtctcgctccgtcacccaggctggagtgcagtgatgcaatctcagctcaatgcaaccttcgcctcctgggttcaagcgatcctcctgcctcagcctcctgagtagttgagatcacacccagctaatttttttttggtatttttagtagagacggggttttaccatgttagccaggctgatcttgaactcctgacctcaagtgatctgcctgggattataggcgtgagccactgtgcccggctgtttgcagtatttttaaaagtgcactaagtggggactcacattaagttctaaagatacaatgtcaagtaaaacccttaagtcacactcaatggcccatgatcagtgaggcatgaggggctgaaaactgctcactctggcttggatgctcatcagtgtgtcctgcctgacaattaattcttaccttttctttttccctgagtgcacatagtttaagttgcataagttacgtgtgtatgtgatgtgactctgctgtaaatagtgtacagactttggtacttcaactattattagtaccaaatgacagggcacccactcccaactgaccacaacacaagtggtcaaaacaggctgagatcttgcacacttgggtgacaggcatggtgcaagcatcttttagagttgttgttttttttttttttctagacagtctcgctctgttgcccaggcaacagagtgcagtggtgctatctcagctcactgcaagctccacctcccaggttcatgccattcttctgcctcagcctcccgagtagctgggactacaggcacccgccaccacgcccggcaaatttttttttgtatttttttttagtagagatggggtttcaccatgttagccaggatggtctcgatctcctgacctcgtgatccacccgcctcggccacccaaagtgctgggattagaagcgtgagccaccgtgcctggcctttttttttttttttttttttgagacggagtctcactctcgtcgcccaggctagagtgcagtggcacaatctcagctcactgcaacctctgcctcctgagttcaagcaattctcctgcctcagcctcccaagtagctgggattacagatgctcatcaccacacctggctaatttttgtatttgtagtagagacagggtttcaccatgttggccaggctggtcttgaactcctaacctcaggtgatctgcccacctcagcttcccaaagtgctgggattacaggcatgagccaccatgcctggccttagtgcactaagtggggactcacattaagttctaaagatatgatgtatctttacatcatatgtaaaaagatatggtcttatttattcctcatagagacttgaattcccctgtctgaggctgtgagaggagccataagcatgagctgacttttgtatgtggtaggacttagaccaaaatccaagccccttccacaccagcaaggtcaggtttaggaagggagcctggattcagatttcccaacattagatcaggaactctggaactgtaaaccagagggctacccagagccctgcctcagttcttctactggggtggctgctgggacgataacttcacagtagaaaaaaggagaggctgctgttcttctaagccagagaggttgaacgccttctgctgcacagccgctgcctgtgtgtgcgcatgctcccttccctctagcgtgtctcctcgtggatgtgggaaatgctgtcagaatgcttcctcctgccagatcccatgtagccccccacctcccttcttccaggagttctggtttctgttatgccagcctcttccttt

SEQ ID NO: 16231 - DNA, 30053 bp, Human
gctctctattatagaaaacatagcaaacatatagaatcagaattgagataattacttgaagtgtattctttaaagccatcttctcccagttccagaatcatccgctgtttccacctctccaacaagaaaacctgttgttttgtcatggtctgctgaaggactcgggtcacacttggtatcacattcctttgcaaggggattttcaaaggaactgaaggatcacttgcatttggtttatcacttctctctggattgaagataggaaaccagttttgtggcactcgtctgtcctcaccttggtttggcagcttatgcttgctcacgggtccacagagcaaagcatcttcctccaccgatcccggggtctgggcgacgcctctggatgacaagacagactgaactaaattagagtatttttcttggtccacttcttcatatgggttcacttttttcttccggccacatgagtaagaggaagtagagaaagccacaagggcagctgattccacagaaaactttgaactcctgagctgcctgcaaatggtctgaaataacttcatcttcattcagatttgttttcactttagtctatttgcaacggtcgaaggcctttatgtttgtattcctattggagagaaaacaaccatcaaagcgaaagctgcatcagaatgatattgcacatcaaaattgtgaactttttcgacatgtttggacagagccctttcttaagaaagtcgacagagcgagaccctgcctccaaaaaaaatttataaataaatcaagactcaatacccgaaggaccgacacatactaaatgcgaattagtagacagcttgaggcaagacgtcccagtttctaatctgcaggaatgtgacgcccaggaagggaggcgtgtgcgagacacggaaaaacacaaagatggagcccgtcccatggcggccacacagtcctaggtgacagacgacgactaattcctagacaccaggctctctgctaagtattctgtgtggatacttctcatttggtcctcacaccctctaccgtgggtctagaatgaacccgttgcacagacgtggaaatcgggttggagggtcccgtcgctcgccggtcagagctggtggcggcgctgaggtcccattactgtgaccgcaaaaagtcgcctcccgctccgccgtgggtgcggacccctggcggggccaggacggcggtggcccctgtggcaggagtctggattagagaaaagacgacttaaataaaagcccagcctacggcaagtgtcggtaccttggaagccaccacacttcgcttaactctcaaggcgcgaacaacctctcgcgacccgtactttcatccgtcccgcgctttggtttcgaattaggcacagcctaaggcaaagcaggtccagaatgccccgcggcgctcacgccccacccgaggctttcgtcggcctccgccaacgcgccaccagttagaggcagggagtacctctccgagcggaagggccggcgtctccgaagcgcgggagcctccaaatcgcgcccttctgctctcacgagatctggtgacgtcagcgctcgctgccatcttggactcgggctgagtaataaattccccccgcaccgaaacgcggtctttctctagacgcgtcttgctgggagagtgtccgttgcttcccgtccgtgtcgcggccctgcggttggcggcctcctcgtggagcggagcaagggtaggccccacgtggcgtctttgcccggctccaagatggacggcagcggggactgggaggctgctctgggggagcacgtggcgccctgctcgcctgctcccggggcagctgggatggtggcggagtccggaggcctcctgccgccgtcgggcagggaggccggcggaggcggggccgtggccgcccccgagaggcgcccaggcggcggcggcggcggcccagcttcttctttcctcgcacagccaggcggcccctgctcgagtcccgcgtcgccatggccgcggttcccgagttgctgcagcagcaggaggaggaccgcagcaaggtgaggtcctcccagcctcagactcctgggcgggcggccctgcgagctccggggtcgctgcattctttcccttgcgcgtccataggccgtggctgctcgccgccatccccagcgcgggaagcacccgtgagacccgggcggcccctctccctggtcttcactgaaggctgccccggggaatccctgtggatgtcccggattctattaggacagaaccagagacgcgggaccttagccccagctcaggcgccggtgccgagcggacttggagagatgatctctggagaccccggaatgttctttttaaaactttcctcggcttcgtggtgaccagtaggtgaacgtgaaattgacttaacatgcgacagaccagtttggtttgttgcccccaaaataccctccttccccccaccttttactgagaagacttttttggggggggggcccaaacaacttgggaaattgcatcaagcgtccgaacatgctgcttacaactttagaaacgcaaaatgcgttgttgtgggagttgtgtaatttttagtaggtgctcaaatacttgctgaacttggtgtctatttttaagtcttgcccattgatgtaaactgtccctaggtcacgtgtatcttgaggtctaaaagattatttatgcaataaattgaaattcccatagccaattaaagattcagacgagcctccactctttttcattggttctttaaatttgcctcggtagctttgcgatgcatggtttgcgagcaacctttcttgcagaatcgtcaacgtaagtttttctgaccgatgaaaaagaacctctaaaaatacaaggctctcttaaaatgtaatttggagccgtcttaacttacacatttcttgagaagttaaaggcacctccatagagaaacttgttcatctagtaagtaaataccagagtttcaaagcggctggattgttccaacaagggtatcattgcattaattattaaaatagagctttctatacaggagggtgttgtttagagtggttttttttttgaaagttctttattactaaaacaaagtggaaacttgagaccacgattctttgtaaaacattataaaggtacttttctccataaagggtagataatggattgggattttggtagcattttattttttctttctttctggtacattcttttagctgtcttgattcggagtcagctaggtaaaaggactcaattgcttcaccccactctctggtagtacagtatattgcagctggtttttaaaatgacttccaccaccctgatcctccagcaaaattggagaatggttatgaaggccatttcctgcctgttttagaggctacagaaactgtccgtatctgtagcgaagagagttacatgacattgttttcctttttacattacaggaataaagagacaataaaaataaataattaccctgacgcgtggctttatttttgttttctgatctctgctgatgctgataacctgctgtggtctggcctagatggtgttatggttaactgaaagggagtttggggcaagtatgaaataatgggaaactaagtcttgggcaactttttgccataatacaatttcggtagtcaactgaaatgttttgtgtgttacctgaaatgtgtgttacttaaattgtttaaatgccctcctgataatttactttggtttggaattctccctaaggatggagttaattaagactcactaaggtagggggacatacttgattcttcaggattttgaattctagcccaatactcattttggccaattcagcaaaactgaaagggaatactgtgtcagtcgtgtctggtagccagacactggcattttgttacattctttagccgagggtgttggggtttgccttcttcctcagaaaatagttcaggggaagagatgcatggttaatttggttcctaactggtcctctatttactggtttttgattttttttttttttttgagacggagtctcgctctgtcgtccaggctggagcgcaatggctcgatctcagctcactgcaacttccgctttctgggttcaagcgattctcctgcctcagcctctcaagtagctgggattacagtcgctcaccgccatgcccggctaatttttgtatttttgtggagaccgggtttcaccatgttggccaggctggtatttgaactcgaccttcgcagcctagtgctatttttaactagggggttctccttccttgacagtaacaacttggccttaacttactgcttggttacagggactttggtgaatgatatctgtcctcttacctactcaggagtgtttgtagactaagtactgctgctctggtttcgtgtttaactggtgtggaagctgcctctaggggtatttttgttctccattagctagaatggagtgcagttggttagtataggaacaatcctgaactttgaccaataccatagcaagtccaaacttacaaactttgtggactgaagctttatgctacccttgcaactattttctaagttgaggaagtatgacgtatcaagcttcccacgccttagttctagttcagtaacttgtactcggtgtcttaagatccccatttgtgaatactctaaaaggtcattatctgttcacattattttggccataggtagaaatggccaagaggcttttttttttttttttttgagacagggtctggctctgtcacccaggcgggagtgcagtgtcacgatcacaactcactgcagcctcgacctggggagctcaggtgatcacccccacctcagcctcctgagtagctggggctacaggcacacaccagcatgcccacctaatttttgtattttttggtagagatggggtttcaccatccagttcaacatgccgggattacaggcatgagccattgtgcttggccaaggctgttaagttttctagatttgtttctgagctgtaaactcctcattcggtgagacctagtggtcatctaaactagaggttgagtttaaaattcagtttctcaacctggggagcactgttgacattttagcctgatcacttttgttgaggagtgccctctgggttgtaggatgtgaagcaactgtttttggcctctgctaggacgcggcctcctcccctcccatggtgataagaagtcaaaattgcctgtttgagaatcactggtttaaacggacttccttctaaaatggtgtgatatgggtggggtcaggttgtgttacagaagctagtctttgtgtgcttgttgcgaatttttcaggttttctattaatcttgcctaaggaaataacatgccatgtaaaaattagcattgttggatatctttgtgagaataaagcttttccactaatactgaggaaccttaacaaaaggtggtgaaagatggttttcttcagcaggttctgggtacttgagggttgcaaagggagggcttcgtgtttgtgtttgtgagtgtaggctttggacactggaaacttacctgagtttcttgtgctgcagaggggaacttggtttaaaattctgctgtttcagcatttttctgtctttattatcagggtcttgatgctcgagcaaattaggtgagaacagatctataggttagtaccctgaatgtcttaaatagcccgtggtcacaacagtgtgtagtgaagttaaatagtatttaaggaaacagtctaacttttaatgatcccaatagtgagaaacggctattaaagtgtaaattaagtttctctgcatgatctaactttccaaaaagtggcttcttcacccttaatacctgttttctgattggccattgaggtactctgacaagatctcctaaaagagatcttcacaccttcacatgctgcctaaaggcaaaccatagtaccccaggaggagtaagttgcagtttgaggggcagccaacacttaagtttaaaaatgggggtccttggcttgactcttctttttacattttggcataacttttttaggcattcctatatggtctggagagaaaactaattttctgcctgaaaagctcagtttctgaagggcacactcctaagcattctagtcatggtaaatggtgaggaatacaaatccagatggctcccttggcagggttttcactttttctttcaagagcaccgcagagctaggacattgtgctgttagatacttggtagctggtgggtgataaaatgttggacttcttccctcacccttcctatatctttcatgaattttgttttgaattcttgtatttattttgtttagaattctttttctcaagacagtcttgctgtgttgcccaagctggtatcgaactcctgagctcaggccatcttcctgcactcagcctcctgaatgggcccctggtctgagtattggaatatttacatctgaatgatttgggaaatttgctgtacctcaaactcagagtgaaagaaatgtccaaccaaaaagcgggcagcctgctctccatgctgccatttgtatttcaaactgcgatgaccaaggttaagttcaaacaggcagctctaccactgttgctgaatcgtctttcttggtaaaggtaaattgtcaaacctatttcctgtgcatcttggtttgatcatgaagtgagaccatgaaggaaggcagtaaatgtccttcaacaccctcatccacatgagtaatatggaccatcttagctttgttgaagagggcttgttccagccttggcaacagagtgagaccctgctacaaaaaagggggcttgctgacttgatatggtatgccagtgaacttttgggagggagccatgatgggattgggtagtaggtgaaggcttttagctctgagtaaaggaaactggcatttctgttttttactttttgagacagggtctcagggtctcggcctgctcccaggctcgagttcagtggtctgatcgtagttcactgcagactcaaaatcctgagctcaagtgatcttcccacctcagcctcccagagtgttaggagtaaaggcataggccaccgagcctaggtgattttttttaaggctttgctgtgttgcccaggcttgtctcaaactcctggccgcgggcgatcctcctgcctcagcctcccaaagtgctgggattacagacaagaacctctctgcctggctgggtttcttttattcatttgttggacctgctttcttggtagcagtggtgtattgattcccagtaggatttatctgccaggagatccttacagatcattagttcagctgttttgctttgtgaattcatttgaaagtattataatttcggtacttagtaattagatggatttcttgacatgcattagatatttaaggcagtaatttaactctggttccatgttgattccattagtacatgggcttgcagccttgtgaaatgatgattcagtttatccattcgctgagtgcgctgcactgaccttcttccaagcctcagttcctgttctaggaacttgaggctatgtagccagaaaatgccctgcagtctgcagtgttctactgtgaactgcttgtgtgttggcaggctaccggtaagaatggttggtgtcagcagggacggggccctctgagacccatctcacaaagatgagtggtgaaaatctgatcacttgctgcagccctttagttttttattaagccgatgcctgagtagctttaatagctattagctatgttagtagactgagatcttctgttagaagtctttagttctgttttccttgggggactaagaaattatattgcaggcctgaattacaggaaggggagaaccaatggctagggaatgagagccaatacctgtaaaagcagagttgggctgggtgcggtggctcacgcctataatcccaggactttgggaggctgaggcgggcagatcacgaggtcaggagttagagaccagcctgaccaacatggtgaaaccctgtctctactaaaaatacaaaaattagctgggtggggtggtgggcgcctgtaatcccagctactcaggaggctgaggcaggagtatctgggagaattgaaccccgggggtggaggtcgcggtgagctgagactgtgccactgcactccagcctgggcaacagagtgagactccgtctcaaaaaaaaaaaaaaaagcagagttaatatattgcttatagttagttgaaccagttgtttctcacaaaccagtgccataatctaaagctgagattgaacacagataggtacgtattagttatcttcaggatggcagagaatagtaacaattcggagcaccaatgggaacattgtttcctgagagttcaaacagtaacaaagtagcatatgtttcctaaatatgtatcatgtgaatctttaatgtttgtggacattaatacaaatctagagtgtgacagaacatctttgaattttatattctcacttaacaaatattggactaggcaaggtgtggatatctttccagctgaaaatctgatcaaggaggcaggcttcttggctccatgctaagaatcatcgatgatttgtcatattggccctcttgctggcaaaatcttagtttcttaggcagtggaatgaagcataacaaaacaaaatccctagaggctaggaacagatagtttgaaagagaagacactgtagcatgtgctgcttaagtacatatcttctgcttttggaatggaaactaggaagtcatttaaatagatatgtgtcttttttatcctatctgtagtaatttatgtgggatattcaaataggaaaatacaggctagcactgcatattgtatccatgtcttacattgtatacaaatgactattagatttaaatgactgttcaactagccccaatctaacagatcagagattgtggagtttcacttctttggactgtgtctttttcattttggcactgagtctgcagtcaccataaccacttagaaaaaactgtattttttctgttctcctggtgggttctgagttttagaatcttgccttttgtgttgttcagtcatccaggtgccctttgccctctgtaagccattaaaccttttgaagaggcagctttgctggtagagtcgtaagtgaaatttggaccaaaagtgagtttatgaagactggtgggcaggagctcaacagctgcagggttgtcctgcagccagtgtctgatgtgccccagctgggaagctgatgaataggtgaggaaatgcacagggattccgtaactacttttctccttttagggaagtgccttggctctcttaccaaaagcactgcgattttttaaaacagttgaaaatgtgctttccaaatgaagccgtgcttgtttaccgtgaaggctgattataatccgtattgtaaggattgacctggtagggaagtacatcatgaactgaaactttacctaaaactttggatacgtgatccagtagtttcaagggaaatctacaaaagtcaggtttttaaaaattttttaaaaattctgaaatagagatgaggtctcaccgttttgctcaggctgggttgttgggtttgttttttatgtgtagtttttttttttttttttggagactcgctctgttgcccaggctgaagtgcagtggtgcgatcttggctcactgcaacctcctcctcccgagttcaagcagttcttctgcctcagcctcctgagtagctgggattacaggcgcacgccaccatgccaggctaatttgtgtgtgtttttttgtttgtttgtttttttaagacggagtttcgctctcatcgcccaggctggagtgcagtcgcgtgatgtcggctcactgcaacctctgcctcctgggttcaagcgattctcctacctcagcctcctgagtagctgggattacagatgtgcgccaccatgcccagctaatttttgtatttttggtagagacggggtttcaccgtgttggccaagatgttctcgatctcctgaccttgtgatctagctgcctccacctcccaaagtgctgggattacaggcgtgagccaccgtgcctggccactttttgtatttttagtagagacggggtttcaccatgttggtcaggctggtctcgatctcctgacctcaagtgatctgcctaccttggcatcccaaattgctgggattgcaggcgtgagccaccacacccagccagaagtcagttttaaaacttaaattatttgagagtaggtatattttcaatttgattcttacaagtgacctaagggatctggaaaagaggtaaaactttgcatggtaaaggtccggcatgcccaaggctggacttggttctaaagcctgctttgttaactgttgtaaacggccactgtaagcattgtaacatctgtggcctaagtcagagactcaagtgttggccagcagggctaaggagtactctgagcccttcaagcttaaggggggatggaggcagaggcaagtgagaggggaagagtggagcctggcaattatttagcaagttctgtagcactgtggagtgggtttgttgactaagcagaaggaatgctgaacttttggtcacacttgatgcttcccgagtgagagtacaaatgctgacttagaagctctagtcatttcacaagtttctacccatgtttgtctcatctggagggttatatgctataatatgagaaagttcatttaacttgcgcctgggggacattgagttaatgatggcctggatgctgaggggttttgccaatactctcttttagacagttctttaaggcccaaatacaacattgcattatttgcttatttggtggttaggactgtcatgtcaagtgattggagttttgcttgaatcccttcctagggcgaaatgtctgggcaaaaatggctgctagtgaacctcggatgtttgatatgctgtggttgcagtcactcataacctagtggttttcttctttttgtcttcatcacattctgaaacaaaaaatatgtttctatactaaccagaaaggaagacaggtatagtcgggggtattacctctacatggggaaagggacgaaaagagaagataattattcagaggaacgaaaagcagctaaagcagctggtagcatccattgcagctttaactgtggtgcacaaatgagctccatttacttgattacatcccccttgggtcctcctattcgaattccaagggtatcccatgtggagttcacaggctcactgagtttgctgggcttgtgagcgaaaatggaactgtcagcatattcatttgagcagtgctagaagtcagggtttgtgactttaggaaatggaatcttaggaaatgtggcagtttttgagctctgggaaaggcaccttagacctgtcctgtgagctgtcctatgtctcctccagagaccatggctacttcttaggcctggctctgtttattcctgttcttgggcctgcctgaccttgacagataagcctaagatcagtagagtcgttggtatagcctctgcaatcacatctcagttaatgatttgaggtatttttaaaggctgtatttgccagtgttaacttagcagaaggaaggaagctcttatcagaaaatacgccaaagctggagtcagttatgatcaaatgaagtcgcagaccttgaagctttatctttgtttgcagagatctcacaaatggacatgtgaaaattaagccagacaagcagatatttcataggagttatcaagaattcatgtggaagaaaaatacttaggttgagatgtgaggactcaaaagtatctgttttgatcttactaatagttgatgttaaaatcaacttctggtgactacttgagcttaattttttggaggaaagccattgtaataggctccctctggctttcagaattataaatatacagtgcttaaggaaaaagggagtacttgaaacttaagtaatccatgtgcttttagtgaatatatttagtctttttatagctgattgaccagattttcaagttttagaggttaagtacataagtttttagtcttgaactttttattttgaagaaagggacccaaagggaaatttggagtgaaatacctcatcttcttaattgtaatcttcacttggcattccgtgctttgggtaatccagtgttatgacaactttactttagcactccttacagtaaaaggaatggggcaatgagatgcttacgctatgagttcctcgtgccttgtgtgtcaggttttcagattgaccaccaccttgtctgctttaatgtacttttatttaagtcacttttccctaatagcccagttcctattagtgctgccactgttctctcctctcttttttttttttttttttttgacgggcagaaatggagttaggtagtttttttcctctcaatttccagctcagaaaatcagttaattgagtattcagagtgatgctcacacttgttgctcatgtgtaaccacagtgggattgtgctaattaagtaaggccttggttggtttttctaattcacccctcctgtctagattccttggctatttgaaacagtcccaggtttactctgaactctccacccaggatcctattccacatgactgttctctgtgccatctccccaggttttcctttcagatatttgtgtggcctggttaatgcctcttgaatgttcattgtactttggcatttatgtaagaattcaagattttgttctatttagttcaggccttagtgtacagtcaggtatttggccaaatgtattgtacatgacattattgtagctgttgtttacattacaggaatacttcggatataccaatgcatgtgaagaatgggtttcccctcagtttcacataaacttagaaatgtctcaactgacatttctttttcttttttttaatttttaattctttttttttttttttgagacagtttcgctctgtcgcccaggctagagtgcagtggtgtgatctcagctcactgcaagctccgcctccagtgttcaggccattctcctgcctcagcctcccaagtagctgggactacaggtgcccgccaccacgcttagctaattttttgtatttttagtagagacggggtttcaccatgttagccaggatggtctccatctcctgaccctgtgaaccacccgccttggcctcccaaagtgctgggattacaggggtgagccgccgcgcccagctcaactgacatttctaaatgatctatgtataaactgctttttagtaactactcatttttggaataattttttagggccaaatgagtttgaaactaatacgcaaaaaatgtatttcagctgagatctgtatctgtggacctgaatgttgatccctcgcttcagattgacatacctgatgcgctcagtgagagagacaaagtcaaatttacagtgcacacaaaggtaagtaacatgcagtggtaatacatacagtgctaggttgcagccttgttattcacagtggatgtgagaagagattccctgagcttgaaacagttgctattcgtagggtagcactattaagtgagaacctccctaatctatctcacagtaagcatcaggtgagtgccattgtggcggcagcagcattctgctgtggcagagccctgggctgtgggcattgtttttttgttttttttttttttttttttggagacagtctcattgtgttgcccaggctggaatgaagtggcaccatcttggctcactgcagcccctgcctcccgggttcaagcaattctcctgcctcagccaccagagtagctgggattacaggcctgagccaccacactcggctcaaactcctgacctcaggtgatgcacgtgcctcagcttcccaaagtgctgggattcaaggcgtgagccagagccaccacaccgggccccagctttgtttttaatttgcatccaagggaagtttgtctctgtagcttgctttttttcagcatttactaaattgggaaagacctttcccatgtggttttttcttaacgcctgggcggcttgaatagcacacttcagttattccggaggtagtgtaaaaagactggtgacataattctctgcctgagcttaccagatcaaaggaggtaaaatcagcattcactggagtgaaaaggaaggaagccagggacaatttttagaaccatagtaagttacagctaagaggtttttttaaaatttatttttcttctttgtcataagttgggggtggggggtaaattcagacttacaaaaatagaatttggggctgggttgggtggctcacacctgtaatcctagcacttcgggaggacaagatgggcagatcgtttgagcctgggcaacatggcaaaaacctgtctcttccaaaaatataaaaattagccggatgtggtagcacacacctgtagttccagctactcaggaggctgaggtgggaggatggcttaagagcctggaaggcagaggttgcagtgagccaagaagccaagatcattccactgcactccagcctgggtgacagccagaccctgtcccaaaaatgtatataaacaaaaaaaagtacacagaaacaaaaaaatagaattagggttgtggcttatttcttagaactgaacttctaccagtagattctgatgggatattcattacaagcttcagaaaggtggagtttggggagaaatcgttagagttcaggttgaatcttagctatgactttcatgacaggagatcatgtataactgctttgttctttactggatcatattatgatgtattatgcagaattttcccactgtgtagcctaggaaacccagatcacttatctaaaagtcgtggttaccagttaacttctttctttctttacagaccacactgcccacgtttcagagcccagagttttctgttacaaggcaacatgaagactttgtgtggctacatgacactcttattgaaacaacagactatgctgggcttattgtgagtcttttagaaaatcaaataagctagttctttctgccttgctatgcattagtttaaaagagacttatatccactttttttaatggattgtgaaaagttagatttcatctacctactggagtatttgctgactgtcaagtggaaagtatgtgaaggaatagtgttacagctttgaggtggtgcatacaggcttacattatttacattgtaaaggggtgtgaacagtgtaatgactttagtcttacctacctttaggtttggtttttctctggtatgttttttcctatgtcagtagaattgatttctaggaaacactgctattggtaatagtttgtgataagatttctcaaaagttgctgaaggaggccatgcctttaatcctagcactttgggaggccaaggtgggtggatcacctgagctcagaattttaagacgtgcctgggcaacatgatgagaccctgtctctactaaaaatacaaaaaatttgctgggcgtggtggtgcgtacctgtagtcccagccactggggaggctgaggcatgagaatcgcttgaacttgagaggcagaggttgcagtaagccgaggccgtgccacgtcactccagcctgggtgacagagcgagactctttctcccaaaaacaaaaaaagtgctcaaggaggcagttttcagcccttgattgttatttcttggcggcaggaacagacttaactgattttaaaggagatttccacgcgttttgtcctgccaggcagactgaagaagctctccaaatgatgattgcttaatcattaaacaaaattaataccgaagcttatatttagatatgtctttcattcaaaattagagtccttgattatcctttgggattaggaaaaaattcctttggaatactgaacactttataatcttgatggctcatctttggtgcttagcattcgttgtactagttttaggcgaacactgaagcagtatagacactgttgtgctctgaacaattgtctataatggataaactgaacaaatgattgccatcaaagtgaatatgcaactctcaggaagacacctcattttaaatgtccagaagagttaaggaaggttaagaaaaaacaggagttgacttttaaatagccccacaggagtggagtggttgtctcctgtggaccagcaagagtagaatgaggcaccaactagaaaacatcgctgctgggacaagaggctcatgagttcctgcctctgctgcagattccacctgctcctacgaagcccgactttgatggtcctcgagagaagatgcagaaactgggagaaggtgaagggtctatgaccaaagaagaatttgccaagatgaaacaagaactggaagcgtaagtggattttcctggtgggctctgtcttttgagaagtagaaaagtggtgctgtgtacaaaaataagtagaagaacctgacttaattttgttttaagtgcagctgtttaattaggtccctagcgtcgttttctaaaactagtaatacatcttgcatagtgtgggacatggtctttgtacttcacacattgattcattggaggccattgacactaatacccgatagagtagttgtcttttcccatatgtagggcatacttattaaggatgctggtctggcacagtgaggaaataaacttttgtgcctttataaattgctcataatgtacaaagcttttctttcggaagcttggttactagacgttgagaagaaactagagagttgggggtttcgtcatgtgttgccccggctggtctcgaactcctgagttcaagtgatcagcttgcctttgcctcccatagtgctgagattatagtgagctgcccctgggccaggccaaatagtgctgttatagagtagcattctcagtaaccatcacatagataatttgaaagaggaagtccaggtctacaggcagcaagtatattttaatctggttgtcatttaattttttcaaacaaaaatagatttttggaaagtttcttatgaatccatccttgcatttcctcatcttagctgaaaagtactcattcctcccctcttcaaccatcagctccccctctccaaacccctgtgtcatctagggcagcactcaaacctccaggccctgaaagcatttagcacacacttgagtggctctcgggaccagctctggggaatgaggcactgaacacaacagatccaagtttctaccgttaggaattttaaggtgacttttaatgtctaggttgagataaagctgctttgtaatttttgttaacttttagcttcattagactcatgctgtatacttaggctgcagttaaagggttctcattgctttaaagaaacaaatgttctgtggctactaagtaacagtaattgcatgtagatttaggagctcatggacttgacccatcaaatccagttacaacattgctttcctccatagtcttattccacagattcaaaaatggcaactgccttagtatctaactagacaccagtttatactgaaatactgtttggtccagttgcagtgttttatgtggtggcatgagcagggccatagaattaatcaggagtggtattggtcaggtagttgagctgtgtcaactgaatgccatgtgcacatctcttttcagtgagtatctcgctgtgtttaagaagactgtgtcctcccatgaagtctttcttcagcggctttcttctcaccctgttctcagtaaagatcgcaactttcatgttttcctggaatatgatcaggatgtaaggcatttttattccattttgataatccacttcaaatgtttatactttcaaaatgtacttgatagtttctactgctttaaagttttgaatttcttacacaatggaaacctttttagatgctgcttttccttcattgtaagtcattttttgtaaaactctgcttaaagaaaattttgacttctttccccttccaaaacctaggtttctttttaagaaattaacagtcccaaacatcccttagttaatttcttaacaattccaaacttaactaagttcattttaaggaaattaaaatttgtgtaatttattttcttcccacctacgctttttgttgaattatgacttttttcttttcttttttgaggcagaatctcgctctgtcatccaggctggagtgcagtggcgcgatctcggcttactgcaagctccaccttctgggttcacgccattctcctgcctcagcctcccgagtagctaggattacaggtgcccaccaccacacccggcttattttttgtatttttagtagagatggggtttcaccgcgttagccaagatggtctcgatctcctgacctcgtgatccgcccgccttggcctcccaaagtgctgggattacaggcgtgagccactgcgcccggccgcgaattatgacttttatgctatttttctttttaacatgttttggtttttgctacttaatatggatagaagagaacagtaattttcccaaggatttcagagccactaagacttagcttctagtcagtctttcaaaatctgtcaagccttttagaatgagatgacctacctatgtttgggtttagccattaggtgttttaagcttggaggttaaggcagaattaaagatactttatgcatttgcctgtactgataaagaggattacttaaaatgttactcagaacttctttaagagaatctagaaaaatccataccatataaactctttggaattttcttcttttagctaagtgttaggcggaaaaatactaaagagatgtttggtggcttcttcaaaagtgtggtgaaaagtgctgatgaagtcctttttactggagttaaggtaagtgacctttggctgttggagaaaattttttacttcatcgggaataggtgaccttttgtttctttgaaagagatacttgtgaaacaaatggttaacttttaagacatgtaagtgttcttcagattttggtaattttcatctacttattcaattttcacttatttcccagagcaccttgttctgtcccaggagaagcaacttgaacctttccacacttggcttcattttctccttttctgtaaggagggagattactcagttaatttctaaaataaagtacaagatcagtattttatcccactctcagaactacactgtccagtttggtcaccaactacaggtgatagagaagcacttgacatgcaacctagctggcacaactaaggaaccaaactttagattttatttacatactggatttcaaggcgttagcacaaagacaagaatacaaaataacgtttccgttaccgttagaggtatgatttactttactacttctcgggccttctcattcctttgtaactgagttacccttacaattactgtctggtatctggctttgccactccagggagcccagaatacaggtgctaagtagagagggcatcatcagaaattaggaaactcggacttggtccagtttaaggtgtatgggactgtcctgtatccatgcattatgggatatttggcattggcatccttggccaatgcctaccagataccaggatttcctcccagtctgaaaccaatcgagaaaaaaaaacctcattcacacacagataggtatccaaggctaagtggccatgttccacctggtagaaccattgtactagcgtaaaattgctgtgtcttagggtgccagttttactggtggttgttaagtgattcttctgtagacattttctgccagcccttgatttttcccagccttggttaagaaatagtatcgtaaatttgtaattccctgatctgtagaggttaaactttactcacgtttatatgccatgttctaagcaatatatttttatattgataaatgtaaaaggctgcagggatagtatatttcatgaaatgtctggttctttttttcttccttctaggaggtagatgacttctttgagcaagagaagaacttccttattaactattacaataggatcaaagattcttgtgtgaaagctgacaaaatgaccagatctcataaaagtaaatatcatttaccgctagtcagagctttgctgatgagcctggctgtgtttggataaaaagacttgtccttgtttctgcagatgttgccgatgactatatccacaccgcagcctgcttacatagcctggctttagaagagcccacagtcatcaaaaagtaagtttttttggaaaagcatttcccctaacccaattgaagagtgccgagtggtgtaattaaaagcataaatgagtagtgactacatggtcctgctctggagttacaagctcagtaagacaagtctctagcactcatcttacatgttctctggacataagacacttgtaagacaattgtaggggacttgggctcttctatatgtaaacaaatacagtaaatgttgtcaaagcagtagtttctgtcacacttaaaagcctgttttctttagttttggagtttgtaagagtttatcttgcatcttcccctggcaattggtgcttgcaattttgcctggtaatgccctagaccttctttttttttggcctgtgatgcagcctcaggagatcctgagaacatgtgcccctgccctggaccttgaagagatttggttatagtggtcatgagaataatttaatgaccccagtctaacacacagctgttttgatgtacaattttctgaaattaccttcattcattaattaaaaacccttccattttcactctgcacttatgtatgtgtttcagtttctccatcctgggcatttctggtgtaagacaatattttacttaacatccaggcttggcaaaacaggtgatactacttctgactcgaaattgaaaggctaatggcagaaccatgacgaattaaatagcatatttactgctttgtgatgcccatagcatagctcattagaaaccaaccttggtttacacagcattggcatttaataagaatatttgggcgcatggcaggatgaccgaagggtcaccaagaggctgagtgtggtgctgtacatgtgtgtaattttgtgaccattttctctactatttggggtcagttgaagtgagagcactacttttaaattaatgctaaagtaccaaaggctaggactcctgagttgacccattcctgtcttgcacactggtaagatcatgttttatagatgatttaagaccttaaaccaaaattatatgtacatttccaggtacctattgaaggttgctgagctatttgaaaaactaagggtaaggatttctgtgttggtcttcataatatatattttataatctatagctttctgccttgatggtgacctttccttttctatatagaaagtagagggtcgagtttcatcagatgaagatttgaagctaacagagctcctccgatactacatgctcaacattgaagctgctaaggtaggaagagagttgctcagcttctcagagcagtgcaggaccagaagtctgtttaaaaagtttctttatacaaaggagcagaataagaatttatcagacttgtttttataaatgacatgcctttctggcattgtatccataaagcttgtgtatctgacagcactgtatgggttgtgtgaagtagacaggtaatagtttgggggattataggtcattgatgtgggacataacatgcagaaagggctgtttctggggcaaagaagatttgggagtttttattgaattgcaagtatccctgcagcctttgagccgtgaagcgttatatgtatatgtggacaaaatggtaagcagaataacctttgggaatgaaacatgctttgtctgcattgccctgaacaaatatgttttaattttatgtgaaatgtattaaatcaggcaaaataaaattagataggattgtatgccctctaaggctgaaatgtcatcagaaagtaaaagagtaaaaaaaatttttccccccatcatgcaattttattttagttaatttgccctttggcatgttttctgaatcttgggagtttttaaaaacatacttttttaatagcctattttctactttcatggaattaagagctcacttacgattatttgagtatatacaaaaataggcctagtagtttcacccatcagttattatttcacctagttttaaatgtgtaatctatacatcataattgctcatttcagatactaaagtaacttctactctgttgtaagattgcaaagaatctttatatctgactaagtggatctccaaggtagattaccagaagcaggatttgcagggtagggttatgtttcttactacttcattgcccagttgtattttagcagcgctcaacttgacttacccagcagtgactgtatatttcaagttatctctgatacacaatatttaatttttaaagttaactttatttactgaattactggaaaacaaaagtccttctgttttcactcttgagtaatcacttgattcatataaggaattctaaaaaaagctctcaacaaagctatcagcattgctcatccctgcgaagctggagatttaaaaatactctgggagagggaaggtgtagaggtagattattgccactaacatctcaggtggtacattggcacttgggctattttttagactggtttagatacttagtatgtatacctgttaatttttttcccaggatctcttatacagacgcaccaaagccctcattgactatgagaactcaaacaaagctctggataaggcccggttaaagagcaaagacgtcaagttggctgaggcacaccagcaggagtgctgccagaaatttgaacaactttccgaatctgcaaaagaaggttgagcaggacattcttctttctgtactgtaatttgaaaataatttcaaacttagaaaagttctacaaatagtgcaaaaaacacccatgtatccttcacccagtgtcagcacttcacccctctgccttatcacttgcacatgcacagtcatcctcatggctttgcgtgcttacaaacgttacacacctggtttttctgtaccattggagattaagttgcatatgtcatgcttcttttagccctaaaaacgttgtggtttatttcctaagactgaagacattctcttgtatggttacagtatggttgtttgctgtgataaacttaactttgggtctacaatctgctctctgtattttcatgtttgtcttgatgtcctctacaagatccagtctaggattgcatctggttgtcttagctattagtctcctttactctggaatagttcttagtttttaacagtatcagtctttttagagaatctctttacaaatcctgtatttctgacttttggtaggtttcctcatgtttagatctggttatgggctcctggcagaatagaagtaatatgcccttattggggtgtcacttctgattggacagtgtgtctctccttcattcgtggtggtaattttgattactcaattagatagtatccaaatccagtttctccactgtgtagttactattttaacccccatcaatctgtggtgaggcaatttaagaccatgcaaataccttggtcttcatcaaacttcctccctaggtttagcatgtattaatgattcttgcctaaaccagctgttactctgacgattgcagaaagacgatttccctcatctctagctctagctttcctacccaagttggcacttgtcatcctactacaaaaaagccttcccttttctcagaaatttcctttatctttattagagtcatggactcccagtttttaaaatggtttagaattcattattgtattaccaagttatttttgatgcctgtccagactttgccaataggagcacctttaagctggcatgtggttgtaacagcctaacccgtcttttttagagtgataggccatgctaatcttactctctgctccagccttgaaactggccattttttcaaggagccagggttctttttctttgggaacagttaccagcatctgagtatgctcatcgtttcggggtatctctgcttctgtgcccttcagtggactgagctaggaaatgtatgtgtgtgtgcacacatatgccgttgcacacacatgcaggtttcagggatcacaagtccggtccatgtccacatccatagggttctttcttgccttatccatttcacctcttagagcagaggactttcaccatttctattgaacatgagtataatatgtagtccttacctaagaggattctgtggatcttctctggggttctcaggggccatggaacatgtcagagcaaatgttggaatggattacccagaatgtgagtagttgtagtggggcactgttggactcaatcccaaccccctaacgcgtgtttccatgaaaaattcatatcttacttagttttttcctaactttcttgtttcccagtggtagggtaatctagacatagggaaatgatgtgttcatcaacatgtttgaagctacctgggggaaacctagactttatagatttctaatcatttgtctgtctattcaggattataatacaatgccttaactgtaaggcacaaaggcacagagcttcctggcaaatgtcatgtagacaggctctgaggctgtgttgggttcttccaaagtaaccttcatgctaccctgtttctgaaacaattacagctttttttttttttttaaaactaaaattttcaaggaaacgtacacacttcaaaactactgagttgaaatcttataggccagtttcatggctctggaaattttagaggagattgaagaaaaaacataaaactttaaaaaatgatgccaattcaggtctacctttactgcctaaagttttcgcccacattgattatatcctatattcaaaatgccagataggtacactatctaaaaatacagtattctgtggaatgctgagattggtgggtcttaacctgtttgcctttggtataagtgctttctgagacttgcagctgagctgacgactagagttgagtcagtgggtaagggctggtttcacaggaggtgaatagttaagtgtatggagccctggtactgtgtgtaggtctagaggaaggcagggagcttatcttcacccaggatatccaagggactgataaacatcaccttgtagtgcaagcactatagacttgacatatcactatgaaatttgtgactttttaacttggatgtggctgcttgtattgtagttcttttgcacagcactgtagagacaggaaggagggtgagtctgctctgaacacttgagcaccagcagaaggttgggtgatggtcaaagttttagtcaagtaaaactgcaagacagaacttgatgtcacaaattcaatgaaggaattagggcggacatgcatattcttggtttgttccaatttccaatgggtcattaatgccgaattctgatggcaataggagtagatgaaatgaaaaagggctgggtgcagtggctcacgcctgtaatcccagcactttgggaggctgaggcgggcggatcacgaggtcaggagatcgagaccatcctggctaacacagggaaaccccgtctctactaaaaatacaaaaaattagccgggtgtggtggcgggcgcctgtagtcccagctactcgggaggctgaggcaggagaatggcgtgaacccaggagtcagagcttgcagtgagccgagatcccgccactgcactccagcctgggcaacagagcaagattccgtctcaagaaaaaaaaagaaaaaggagtagatgaaaaggaagcatgccctaaagatcatcaagtaaacctgtcttgaatacgtgtagcagtttttcactgttttggatttaaaaatgttttaagttttatttttaatcgacaagtcattgtattgcatttgtggaatacagtgtgatgctttgcaggtacataatgtgaaattattagatcaagctaattaacatctttcatttttttcagtggtaatacatttgaaatttgctgtttcaatatatattattgactgtagtcaccctgttgtgcagtagatctcaaaatttattccttgagtttagctgcagccttctacccattctctttcccaccttccccagcaccccaccctcatcctctgataaccatcattctgttctctacttctaggagttcaacttaagattttacctgtaagtgagatcatgtaatgtttgtctttctgtgcctggtttattttatttggcataatgtcctctaagatccatccacattgtcccatatgagagaattttgttattttaaaaggccggatagtataatgtgtctatactacattgtcttcatccactgatggataattctcagttgattttgtattttggctattgtaaataatgctgcagtgaacatggaagtacggatatcccattgagatactgatttcagttccttttatattcccagaagtgggtttgctggatcatatggtaattctatttttagttttttgaggaacctctataccattttccatggtggctgtactaatttacattcccagcaacggtgtagaagagttcacttttctctgcattgttgctaacactgatctttcatctatttgagaaaatgcattctagcaggtgtgaggtaatctcattgtggttttaatttgcatttccctaatggctagtgctgctgaacgttgtttgcatgaacctggtatgtcttcttttgagaagcattttcacaagccattggtgaagtatgtggctcaccaccacccatactccagccctgttcccagtcactggtacctagagggtgagagtgaggctgctcatcaacgtgttctccaagtcataagctgctgctctcccactcacgatgcttggtgattcagtgatgttttccacttaaagacagtgatagctgtatcaccacagttaatagatgtctgatgtgtcccagtcacagagataatacaaatgtgaggaaataatgctggtgcctgaaagcattggagaccatttgtaagaatgccatttggtagttaaagtgaacatgaaaattgtttagtttttcttggtttcataaacattttttcttcctgtagaactgataaatttcaaacggaagagagtggcagcatttagaaagaatctaattgaaatgtctgaactggaaataaaacatgccagggtaagtgttttctacagatgaagccaacatcttttatggttttttccaagttatttcccagtttactaacccattgtcatcaggcagttggggtggccttgtggtattaatcgtctgtagtacttagttgatgggagccactcattgtttatttgtagtcttgtttataatgtcacccatgactaatttttagcaacttttttttttttttttaatagagatggggtttcaccattttggccaggctggacttgaacccctgacctcaggtgatccacctgccttggcctcccaaagtgctgggattacaggtgtgagctaaagctcccagccctaatttctagcaacttttattcaatctttccaaggccctcgccttcatggaacaacgcactgatagtgtcttaagaagttacagtaagcaggatcacatttaggagcaagcaggtgagggcagaggtgctggagtgaacgtcggctctttggctggtagccttacccactgagggagaggagctgaaacatgaaatggggatgcgtggtacgttgcagttcacctgggatttgatgaagagaagggccagcttgctctggctgactttaaacctcccgtgaaaagccgtgttggtgtacttgagtcattccaggtatatggcaagttttaataattcactggtctgccttgccttttttccccacagaacaatgtctcccttttgcagagctgtattgacttgttcaagaataactgatatgccttcactcagaagaaaagaaatgaatgtgaaagaaagccaagcatcacttgcacttaaatcattaccacggaagatatattagcttcaactttagtttaaaattatgtgaataaatattttgatttctacaaatcttaacatttaaccatgttggtttaaaaatattattgcttgctacttggacataactaatttttccttgtgcatttaatacctctgggcagaatccaaatactgggttctcccgtagttcgtctttagttactaagaaagggtgtaggacacattagccttctggaaacaagtagaagccatcacctggcccatgtccctacaaacccatgattgtcagggaggtgccagttacagcaggtgattcagctacttgaggtcggtaacagaccttccattcctcactgaaggtggggtttgtgtttttgttttgccctgttactccactggtagtcatctggtgtttgtactataacaacagcaagaaaatctcatttatctttatatactctttgcacctcctttttttagtcgagatataaatatttgaggggagagaaatatctacaggtatatatggaaacaaataatgtggtctgctttataagatggccagatctacattaggaaaagtataagccccctccctaatggccgctggggggtgagggcggtgtgttgtatgtctttgggtgtttgtttttttataaagcatataataaaataatcgtgctactaatgtacggcctgttttcgtggaaactacaaccagagtgtgtcccaggagtgcaggtggtgctagggtttggctgtggttacagggttttcaggttctgcccagagtcctgggggcggtcaggggaaatttgtcctagtcttgacattcttaagtactccaggccttttttagatggtctctaaatgtgggtttgtctgtttgctcctgacctgatggaggtttgcattttggccagggcctttaccatagggcagtggtccccagtctcaggtccatggcttgttaggaagaggtgagccagcattgccgcctgaggttcgcctcctgtcagattagcagcagcattagattctcataggagtgcaaacccagtattgtgaactgggcatgcaacaggtctaggttgtgcgctccttaggagaatcaaatgcctgatgatctgatgtggaatggtttcatctggaagccatccctttccacaccccaccttgtccatggaaaaattgtcttccacgaaaccactccctggtgccaatgacatgtcttcaggagttgtgtgtctattcctttgttgatgactgagcacttagggtggtaatctcctttacctttctaataagtaattcatggtaagaccatgagactaaaaacattttacccaccacatttagcatctgttacagccaactggtatgagggttgcagaactgatttcaatacatacagggagcatgtttcttaacatttatctggtcttcgtgtcttgcctccccagctatttacaggcggccacagtgccttctaccttcacagtacatacttgggaaacggtgcacaaaatgagtgaatttaaacttggcagttgtaacttcagtctgggctcctaaccaaatctgtccttcctacccatctcccccataatgtccacagcagccacccacacacgcccagcattctgttagtgtagagccagcactcctgcagtcaggttcctgggccgcagtgcttgagcaccagtgtgatcagccctgattggtggagctctggctgttggcctcggggccttggtgcattttcttgagactaaaccttgtcaaatggacagcagaggcatgaatcttgagtgctgggtctgctgctcaccaagtgatctaggctgcctctctcagctgactgatctgtgagctggagtcagcacttcagaggcccctcaaattagttttatgccagcaatctctaat

SEQ ID NO: 16232 - DNA, 24204 bp, Human
gaacgttgcatccccacggccaagattgcaccccctcttctacagacaacatccaagctgctgggacccgacccagcgccaccttgcgagcccagcatttcgaggggcaggcttccaaacagggtaataatcgtcccattaaaattaatgtccatgaagtgagccgttaaaagcgtgcagattaaaaatggggggagggaattgttcaatttaaatccaaagggctttttaaatagacactgtgtcttcattcttggaacgctacacccgggcaatggatcaggtcccctctgtaaagactagggggattaaggaggtgagtcccaggagaatgggaagtggttctggcgagaagcaaagggaaccaaggtctatccagggcccactgcgtgccaggtgcttggcacacatttctctcatttaatctctgccccaatcctgggatggaggtattattattcccagattacagggggcagtataaaaccgtggttaagagcttagagcctgcggcatactgccctagttcagatgacggtttcattcttagctactctgtgagctagggcaagaacccttacctacctgtgcctcagcttcctcatctttgaaatattatagtaattgcatgtagaattgttgggagatttacctttaggcagcagaggcaagggcgcccaaagcccacaggtgccagacatagaagatgcgcagtaggtcttggccattatgaagcctagaataattggagctgggtgagggaaaaggccaccagaatcacacagtgttgtgggctttgagccctgactttgttgtcatttcaccacgctgtgggccaaaagggacatttctcctcctgatcaattcagaccaaaactaagttcacagactcgaagaatcttggttatactctgcggtgggaaggcaagaacggaagctccctcagcaggttccagactcccaacttggagccatctctggactcatcccgatggtctgaatcccaaagttgtctgaatcccagtcgatttaagatcacaggtttcattctcccccacagaatcctgacagccgcccagcccatctgaaccttcaccgtttgtgacaactgcagacgctccagtctggaggtgcacaggagtggctgtcggattggaaaagggggaattaaagtcccccgcgcccctcctctcgccgaccccttagggtctccactgcgcattaaatcggggtcatcgcagaaaactgtaacgccatcaggaaaataatgttcacaaagaaagcagacaagaagtttccctttagaaagccccttgcgagggtcttttgggtgcgggtgccgggcagcgagaatgcctccgtccgcgccccacgcgagctcaggtgggcccatccagcctcccaccgggcgctgggggcactttagggtcaggtttctagccaggcgctgggggcacgttagggtcaggctgaaagcctacaggtgccaagtcagacctgaaacgaggcaagttgggtgtaatctgacccttccataagattttgaatccacccacctcccccaaacaaaacaacagcctcggaatatttttgaataatgcagccgaattcagcatcagcttcatccaaaacggcaaacaagcctttttccctcgccaaatcggaactcgagctgaattcaggaaaaggggaaggagaacaaccttccctcgcgctccgcgcctccgcgggggtcccccgagacccccaaagcccaggacctccgctgcggggagccttctcgcgccgccccgcgccgcgctccccgtctcccaaacctcgcgctccctagctgccggcgccgctagggttaaaagttacctctcggtttcttctgcctgcagccccccccccaacccccgggggccggatgatgtaacccccctccccgcccccctccaccatgtgacactttaattaataatagcgccgtcagcacaacaaacgcacaacacaagggagaaacttggtgtccaggggaaggcccccggcggctggagcgcggcggcagcgggcgcagaggccggagggagaggaggcgaggggcggcccgagcgcggggcgggagcgaggccagcggtcatgtgcccgtgccccctgctccgcgtgtcgctgccccccggccgtgtgcgcctgcagcgcgggtcgcctggggctgcgctcgtccgccgcgcagctcaccgccgcccggctcaaggcgctaggcgacgagctgcaccagcgcaccatgtggcggcgccgcgcgcggagccggagggcgccggcgcccggcgcgctccccacctactggccttggctgtgcgcggccgcgcaggtggcggcgctggcggcctggctgctcggcaggcggaacttgtaggaacgcggggcttcttggtggggccggagccgagacccagccggagcgagcaacaggtacgcgagcgagcgagcgagagccggggcgcggcagctgggcactggagacgctgggctggcccgggagcgggagagtggcaagtttggctttcttcttttcccttctccttcttcctccgttctcttctcttgcaagcatctccacctctcctcttctacccagtccccagtcttcccttccaagtgtaaggtccaccgtttctgcccccatctctgcgagtccttaagcgcatcttgctactcacttatagctcagtggcttgcggaggacttcagcctccataatccccaccagccccacaaataaacacacaatgcaagtaaaaagtgtgcttgctatgggaatgtagttgtaagccacgccaaatacttaaaatctatcgcacttccaagaaaggtccccggtcccgttccaatcctcttgccgttcctgagtcgcccccgtctccatcacctttgctcccaacctcttgtccctaagtgtcacttctccaatctctgatccccattatctggcaccccaagcgcatctcgagacttcctccccctccaggtttctggctggcccaatctttcttcccaagctccgcgcatttgcaattttcctctgccctgccaacttcgctccttctcgagtgaggtgtcctgtttaaggagtttggcttccttctccccagacggttgtagctgctacgggaaggagacgccctcggagtgggctggaatagggggctttcagggaaactccaatgggaagccttaaggaaggaacatttattgagctccttcggggtgctgggcactgtttagggaggtcatgtgttgagaacttaggacaggaagtgggtactgagcacctagtgtggttggtatcagtgggaggaaggtactaggctcttggggtggggggatcattgtgccctagctgtgcgcctggcactgtgctaggcgctttgaggaagcacacagcgtaagcatcgtcttactactctggatcctggagtagcgaggagcgctgcagagaatgagggagagagaatcaggctgagcccaccatagatgggtctagggccggaaggtgaagctcgaaggtgacatagccagccgcccttaggtccccgcccccgagccccgccgcgcgccgcagacaccctgggaagttggagcggcgcctgaaggcgaggcccgagcgtctgcgcccgcggggaaaggcggcagccggagcgtggggggtggcagcgcccagggagctgcgggggtgcgcggggtgtgagccgggaccgcaggcgacagatgtcgcgtgggcccgcgcagcccgggcgctggcgaagagaaatgcgcgcttcggggcgctctctgcccggctcccgggcgccgggggtcccatccacttctccctaccttctctctctcctgttggagaggccaggggctcccgcgactgaaaggggccaggctgaggctgcccaatcccagggacaggaagaacattttggatggatcgcggggtgcagaaaaaggaagttgagcgacagacgcgaagcccaaagcgtggaatttgggaagaggcagaaaaaaagtgggcgaagaggaagagaaaaaacaagcgacgagatggggagggacaagaagtttggggaggatagagaaaaagagaaactgcctggaaaacaagttgcaagacaattgaaaagtgaatgagaaggaaagagaggaaggtagtaaaatcaaatagaactgtggagagagggctgggacacggctttctctggttctgtcgtccaggagattggaaacgctctccccttccggcaccaggcgtgcgggatgtcgggtgcccctcccgggaggccgaggactccgggccggagcctgactgtgtgttcctgtttgccggtgtgtgagtgtcggggtgggaatgctcccggggcctggaaggggaggctgcgggcggggcgggcagattgcgccgctctgcgccggagcgcaggggaggagttgggtaactggggcctgcgctgcaggggagggcggcggccaggagtttcgctgttttgagtcggtgttggggggcagcagcaggttattgtctctgtggagtttatttcccccgccccgccctcgccttctaccccagagttacttccgtgctgcgccctgactcggagacaccctcttcccacacctctgggttcttctcctacctgccttgtcccgcccgggcgtcccctgcagccacaccctccagggttctgcagcctctggcgccctgacctcaggatgccccgctcggcttcccagcagcaccgcccctcataccctcgggacacccgtagaattgctcaccacccgccttcctgcgctcccaggccgggttctcagtgctcgggctccctgcactggccctgatcaagttctctccctgcagcctacatctgacctcagaataccagccgctccggcctttcttgtgcttttgatttaatttggggaaactcattttttcccagctctggtaagttaagtaaaggggaaagaaaaatcaccggaggaagacagtctgttgcgttctatgctggatatggggtgctctccaccttccctaccctaaaagaaaaaggggaatgttcacagctgtaccttaggtgtttgagggaggcctgtgccagccatatagggtgggaactaccactttcaattcccataggtttaaagggtgtgctccgctatatgcagaatcaatattttcaacatacaggccaggcaggttggctcacgcctgtaattccagcactttgggaggccaaggcaggtggatcacctgaggtcaggagtttgagaccagcatggccaacatggtgaaaccccatctctactaaaaatacaaaaattagctgagcgtggtggtgcacacctgtaatcccagctactcgggaggctgaggcaggagaatcgcttgaacctgggaggcggaggttacagtcagccaagaagagctgagatcacaccactgcactccagcctgggcgacagagcgagactccatctcaataataatttaaaacatatatgtgtatatacacatacatatatccagcatacttgttttgagtctctactgcgaaccagcaatacttttctcagaagtcatcctttaaaaaaataacaaacagaaacaaaaacccaagactaagttttcccatatgtaaaatgggggcaaaaaatgggggcccaccagccagacttagtgcataggcacgttattaagggggttaaatgaattcatacacggaaagctctagaacagtggatatacatgtgagccatcatgattattattgtgcatttactatcattctttcccaaggtagtcaacattttaccattattattgctggccattccacaccactcctacctgccctcccgggaagtcagtgccagaagggtcaggagagaataatggttaagagactcttaagtgtccagccatttgctgacagcgtgaccttgagaaagaaccattacctctgcacctttatctgtaaactggagctgtatccttccagggttattgggagaatgataagagaacattcatttaaagtgtccagtgcaggccgggccagtggttcagtcctgtaatcccagttctttgggaggccaaggtgggcggatcacttgagcccaggagttcaagaccagcctgggcaacatggtgaaaccttgtctgtaccaaaaaaaaaaaaaaaattagctgggcatggtggtgtgcacctgtagtctcaggtactcaggaggctgaggtgggaggatcacttgagtcccagaggcagaggttgcagtaagctgagatcgcactattgcactccagcctaggcgacaaagtgagactcttgtctcaaaaaagtccagtgcagtgtctgtctcttaacttcactcaacagaggatgtcatgaaatggtcagtgtcattccttttaattcaaaggggaagccgaggcagagagcatccacctaagtgatccccagtggaactgcagcttctgtctttgagggcacacagcgccccccaccccatgacttgcgggggaagaggagataggggcagtaagcagaccgggttggtgcacagtgaattcctgtacaagtgaaattccctttcttccagagccccaggggaggctcctctgaggctggggaggcctggaggaggatgggtatgatttaaccagtcaatactcaaagatacaggagagagggaacaaaagacgctttatggtgagtgctggctggcggaggcgtgggagggagggagggagaagcgtgcctggggagggggcagggagggagagagaatggagccgaggaatctgcctgggagtcggggccagggctgggtagaatcctgccttgggagcaggggaaggggagagagggggactccgcaggcccataaggcgacgtggtcagtggcaaggaagataatgggccagcgggagcctgctttaatgaattaatgacagcctggcccaccagccagacatgctaactggttcttggcaggtactttggggattaagtggttaaacctggaggcgcatcccgcaggcctccctcccagctcgcagcacccctgccagaattacttttagagcttgaaagcttggccttctgtttggcgagggagcccgaggaggacagctgttggggaggaaccccccgggaaggggccagatgtgcagaaccaggcagccttcctgccacatggtctctgtctggagtcatccgctcgcatagtgagaggccagagtacaagtgactgagctgtggatggaaaagagccacacccggggataattaaatatacccccagatgtgggctggctggatttggcaatcataactctagagtttttgaaaagtcagccttttagacaggcagataacgagaggtggggagggggcttccgtttcttggtagtcctcactagtgtccctgtgataggatttcacgggaatagaaagctaacccacagtgtccctagtccctggcaacttgcttgtctcatagtaggtgtacaataactatgtgctgtgttaaatgaatcagaaactatgcaacatcagccgggtatgctggctcacacctgtaatcccagcattttgagaggctgaggcgggtggatcacttgaggtcaggagttcgagacctgcctggccaatgtggtgaaaccccatctccactaaaaatacaaaaattagccaggcatgatggtgtgtgcctgtagtcccagctacttgggaggctgaggcaggagaattgcatgaacccaggaggcggaggttgcagtgagccgagatcgcgccactgtactctagcctgggcgacagaatgagtgagactctgttacaaaaaaataaaaaataaaaaaagaaactatgcaacatagtcactattgtttcccaaattcaggttcttccacttatacaactgctaattattgagtaccttctgtgtatagggcactgtggatacaggaaggaccaagacataagagttccctgctttcatggagcccacattttagtgggaagagacagacaataagtaaatattgttcttgttactacttctgtgtaacaaattactccaaaactactaagttttgcttcaaacaactagagccatccctctgtctctgggcgggagtggttccaggatcccactttggatcccaaaatccaaggatgccaagtccttgatataaaatggtgtagtgtttgcatataacccacacactgtaggctttaaatcatctttagattacttataatacccaatacaatgtaagtgctatgtaactaattatactgtattgtttttatgtgtgttttttatacttgtgttatttttaaatttttttttccaatagttttgatctgaggttggttgaatccatggatgtggaactcacctatatggaaggctgacatatttgaccatgctcacacattctgtgggttaggaatttggtcagggcatagtgggggtgacttgtctctgctccaggatggctggggactggagtcatgggtggggaggcaaccttatttacatgtctggctgttaatactgggagtcagctggggctgtcaattggagcagctatactcagcctcttcgtgtggcttgggcttcctcacagcatggcagccggattctgacacagtgactgagagctccaaaagcaagtaccccagggaactaggtggaagctgctttgctttttctgtcccagcttccaaagtcacttgggtcagaagcaagtcacaagctgatacagattcaaggtggggcggaattagactccacctcatgggggagtggtgaggttctagaatagcatgtggaatgggagatattttagtggccacctttggattatgcaatctaacacagagataattttagaaactcctcagggctttgaaggtaatacacaaaggtaacacaatagagagtgccccagggactcctcacctgtggtgatgagggaaggcaggacactttgaagaggaaccaggggaatagtggacttgaatgacagaaaggagccagctatatgaagacatgcgagaaaggtgttttgggaagagagagagctaagtccagtggcccggaggtaagactgcatagtacgtttcaggaaagaaaaacaagcagtgtagcttggtgccagggctgggtgcccagatgcagggatgcagagatgaatgagtcccaaccacagccctcaggtgaccccagactctttcagagacaggagacccaggctttgcccctgccctcacctcttagtagaaataaaccagttcacctcctgccaaggtctgagaggtcctgatccctgaaccaactcactcatgcccactcccctcagtgccaggggaacattgtggacatcgattgggtttccatcacccttagaactctcaccattcaactcagcactggctcccctctcctttcctgctctaaactggtgcccctgctgttgggtgggggatttctgatttagcccacatcaataagttgcatccttttacgacttctggttggccaggcaaggagaaagctccttccttttcctgtggggaggcaactggcttatccaagatggctgctttccacagagctttcccacactgaacctttgctccatgggccagagacttgggcagggtggaatttaattgctctgggaaacttgatataatattacttttttaaaaagtagctggatgtggtggctcatgcctgtaatcccagcacttggggaggctgaggtgggaagattgcttgagccctggaacttgagactaacctgggcaatatagtgagaccccatctctacaaaaaataagaaattagtgaggtatggtggtctgcacctgtgttaccaactactcgggagctgagtgaggtaggaggattgcttgagcccaggagactgaggctatagtgagctataatcgtaccactgtactacaggctgggcaagagaatgagaccctgtctcagaaaaataaataactttttcttgatgacaaaaaatatgacaagttcattggcaactatttggaaaatgctgaataaaagaaaattgtagtcaggcgtggtggcatgtgcctgtaatcccagctactggggaggctgaggcaggatgattgcttgagccaggactttgtggctgcagtgagctatgattgtgccactgcactctgtcctgggtgacataatgagactctgtctcaaaacaaaacaaaacaaaacaaaacaaaaaaatgaaaaagaaaattgtagtcttgcctctggagaaaggaggttcagctttgagcagaaggtctgagtagcagaagattgcagtcctttcccatgtaaagaccagacagattctaagcctttctacctttccattgcattagatttgaccctttagtgatgtgattttctttccttctttctgccatttctctttcctttctttcttcctttctctttttctctctttctttccctccctccctccctgcctgcctccctccctccctctcttccttccttccttccgtccctccttcttcctgtctctctctgtttctgtctctgtctctctctctctttgtttttttgagacggggtcttactctgtcacccaggctggagtgcagtagcaggatcgtagctcactgcagccttaacctcctgggctcaagcgactctcccacctcagccttctgagtagctgagactacaggtgcacgccaccacacctggctaatttttgtattttttgtagagacagggttttgctatgttgcccaggctggtcttgaactcctgagctcaagacctcctgccttggttttccaaagtgttgggattataggtgtgcaccaccattcctggctggataggtactttaagacttggaatcactataaatatattatctgtaacctgaccttttccatatatcacaggcatttgttcaacagcttaatatttttctatgagacacttctttttgtttgtttgttttgagatgaagtctcacactgtcgcctgagctggagtgcaatggcgcaatctctctgcaacctccacctcccaggttcaagagattctcctgccttagcctcccgagtagctgggattacaggtgcctgccaccacacctggcttaatttttgtatttttagtagagacagagtttcactacattggccatcctggtctcgaactcctgaccttgtgatccacctgccttggcctcccaaagtgctgggattacaggcgtgagccaccatgcttagaagttggttggtattgctttatttggttagtccatcatttacattccccatccatcattgtgaagtcacttgagcccaggagttcgaagttgtagtgagctacaattacaccactgtactccaacctgggcagacaacagagtgagacccccatctcaaagaaaaaaaaaaaagaactaattaaaacaaatttttttaatgctcacaggtgagaggattgcttgaagccaggagttcaatactagccagggcaacaaagtgagacccaatctttactaaaaaaagaaaaaagaaaaattagccaagcatggtggcttgcatctgtagtcctgctactcgggaggctgagatgggaggatcgcttgagcccagggaggttgaggctgcagtgagctgtgatcacgccactgtactccaacctgggcgacagagcaagaccctgtctcaaaaaaaaaaaaataataataatactttttttttttttggctgggcacggtggctcacacctataatcccagcactttgggaggccgaggtgggtggatcatttgaggtcaggagttcaagaccagcctgaccaacatggtgaaacccatctctactaaaaatagaaacaaattagcctggtgtggtggcacatgcctatagtcccagctacttgggaggctgaggcaagagaatcgcttgaatctgggaggtggaggttgcagtgagccgagatcgtgccactgaacttcagcctgggtgacagagagaaactccatctaaaaaaaaatgtttttaatgctctcaaatgtaactttgatatcaaaacatatttagcgttcttttggctgggtgtggtggctcacacctgtaatcccagcactttagggggccaaggtgggtagagctcctgaggtcaggagtttaagaccagcctggccaacatggtgaaacctcgcttctactaaaacaaaacaaaacaaaacaaaacaaaacaaaacaaaacaaaaacaaaaattagctgggcgtggtggcgcgtgcctgtaatcccagctacctgggaggctgaggcaagagaatcgcttgaacccaggaggcagaggttgcagtgagccgagatcatgccattgcactccagcttgagcgacagagcgagactctgtctcaaatacaaacaaacaaaaaacatagttagcattcttgtattataaaggctgtctagagcataaaatcatgtcaagatctggaaacactgccgttggctcccatatctcattcatgtcattggcctttatttatttatttgagacagggtctctctgttgcccaggctgcggtgcaatggcacaatcagggctcactgcagcctcgacctgggctcaagtgattctcctacctttgcctctccggtagctgagactactggtgtgtgccactaattttttacttttttttagagatggggtctcgctatgttgcccagtctggtctggaactcctgggctcaagcagtctttctgccttagccttccaaagtgctgagattccaagtgtgagccactgtgcccagcccatgtcactggcctttatatgtcaggtgtctgttggcttttgagctggctgtgactggcctcagctgaatctctgttgccttgctgtggactggtcttcatggaccacacctctagccagtgtgggagtgtggatgacgcctagcgtgcctctccccacttcagggaaaggttccaagtctcagtaatgtcactaatctggaaagcttctctgcctgactgtacctatcatcctgggggcaggaatcatgttcatctaatattcttggagctagcacatggtacttaataagtcctgtaaaatgctaacacactgatgctggagaaactaagacaaaatggcttgcctgggtggagagggaggtcttccaggagtggggatgtgtctgagttactggaatggattcaagaagaggtaccattttctgttttgtgtgtgtgtgtgtgtgttttagatggagtctcactctgttgcccaggctggagtgcagtggcacgatcttggctcactgcaacctctgcctcccgggttcaagcgattcttccgcctcagcctccagagtagctgggattacaggtgcccaccaccacgcccagctaatttttgtatttttagtagagaaggggtttaccatgttggccagtttggtgctctaactcctgacctcaagtgatccagatatgcctgccttggcctcccagagtgctgagattacaggtgtgagccaccacgcgtggccaaggtccatttttcaaagatagctcagacttagaatatgtgagactgttggcagaccaaaaagcctaaggcttgattcagaaaatttaactctggtaactgtgtatcttcctcaccaatactttatgctgaggcagggaagcttcatggaaagggacatgaattttggagtcaggccgactttcacatcactttctccatctcgcatttgccagttgtgtgaccttaggccgatcccattaccttctgagccttggtttcctcatctgtaaaatgggaagaataatagcatctgcgctggaggagcactatgtataaagcagctggcgcagattcagccccctctacatgtgagtggcttggagaataaattctgttttatctctgtagtgagctcctagcatgctataatctactccagtgcagtacaaggatgtactggtgttcagaacatggtgagtgacagcctatgatatgtgttgttcttatttggtgtaaaattgagtccataggctgggtgtggtggctcacacctgtaatcccagcactttgggggaccgaggtgggtagagcacttgagatcaggagttcaagaccagcctggccaacatggcgaaatctcgcctctattttaaaaaaatatgtacaaaaattagccaggcattgtggcacacacctgtagtcccagctactcgggaggctgaggtgggaggatcgcttgagcccaggaggtcaagtctgcagtgagctatgattgtgccactgcactccagcccagacaacaggctgtttttaaaaaccctgtctttaaaaaaaaaaaaaacgaagaagaagtttagtccatgggcccatctttatagtatggcccatctttatggtaagccttttgcttaaggcagttgctaatctgctttaatcctgccttccccaatctgggactcaccaagggcctacttaggccactctgacagggctgggagaaccactagatcagggcttcccagcccgggcaacactggccttcaggtcccagaaagatgcaaaccgccatgcctattttgcccattactgtatcccagcacctggccatggtgacattcactaactggtgaatgaatgaatgaatgtaggggaggcctcaggaaatttgtgaacacccagtaatcaagctaataacatggctgatttcatcctcctcttctactttcccctacttgggacagaaaacatagtttggatccaattctcaaaagatctgtgagccaaaagggtctgtgttctggaaacatagccagagccagacacgacattagagacatctaacccatctccgtcattgtacagatggagaacctggggcccagagatagctgctgagggttaagatgaggcgagcttaaatgccaggggatagtaggagtgtctgagtatctcaggcagggtgaaaatgggtggtcttctagctgaatttggcttgcagttgagttctgtttgacctgcgtggttttctcccaacacttaaaagtcaggcattttagccaggcgtggtggcatgttcctgtagtgcccattactcaggaagctggggcaggaggatcacttgagcccagcagttcgagaccagcctgggcaacaaagtgagatcccataaaaaaaaaaaatcagtcattttcaggtagaagcctgtatttccaatttttcttgaaaaatgaaaagatctaacaatgtattctaacacatgtattcccatgtggcagaaacaggctggagatgaatgtcagaaacccctttagaaagcacaaaaacactacagtgtccccagcccctcctgggtacctttagtgggtccagtgcatttcagttcatgacccctgatttcagggagccccctatgctcttcccttgatgcatagacacccacacacgcatcctattttaaatacatgagctcatactgttcatgctgttttgtaacctgctttttcctcactaaaaataggtggttgagatcttcccatgtcaacacgcaaaggttttcctcatcctttttaatggctgcatgatgttctgttgcttggatgaaccaggatttccttatatggtcacttccttgggaacatttgcattgtttcctgttttctggtagggtaaacaaggttgttaggcactttttttgttgttttagaaacagggtctttctgtgtcacccaggctgatgtgcagtggcatgatcatagcccactataacttaaactcctgagcttatgtgatcttcctacctcagcctcctgagtagctgggactatagacatgcaccaccacaattggctaattaaaaattttttgtggccgggcgcagtggctcaggcctgtaatcccagcactttgggaggccaaggcaggtggatcacctgaggtcaggagttcgagaccagcctggccaacatagtgaaaccccatctctactaaaaatacaaaaaaaatagcggggcatggtggtgcatgcctgtaatcccagctacttgggaggctgaggccggagaatagcttgaaccagggtggcggaggttgcagtgagccaagattacgctattgcactccagcctgggcaataattgcgaaactccatctcaaaaaaaaaaaaaaaagtttttttttgtatatgtgtagatggagtctcattatgtggcccaggctggtctggaactcctgggctcaagtgatcctcccattttggcctcccaaagtgctgggattacaggtgtgagccactgtgcccggcaggggacattcatatttggacaactttgcaaacaaaaagtgaagttcctgaaagtgaaattgttaggtcaaagaatgtgcatagtataacatgtgggacatgggacatgggcaacattatcttacaggccacagtttgccttaagaagagtctgtattttttgtttgtttgttttggcgttgattctgtgctgagctgagctactacccaactctcactgcttacccttctgaaagtcaagcgagttgggcttccaaggcccacctgccgtaagttcctagtgggtaggagctcaggtctctctccatagactttaagtaatcactatctagtagctgatagcattgataactgttcactgatagaagagagctgggccaaggagagcaaatacttcttccagaggctgccaaatggcctcttccttcctcacacatcacaacctagccatcttttcagcttcctttccacagtctcctgtgcactcagcttcctacctggccgacatgaactatacagatggagatttaagggataacatggaccggagcaatcttcttttcaagaggattctgcatggagagcttctcctccaagtctttttttttttttttttttgagacagggtcttgctatattgtccaggttggcctcaaactcctgggctcaagcaatcctcctgcctcagccacctgagtagcagggattagggacacatgccaccatgcccagtccttccttcaagtcttagggactaggatgattggtaccattgaaactccttggtcaaaatcaacctgctgaaaccaaagacagaagatgcgagaaactgctttttttttttttttttttttgagatggaatcttgctctctctcccaggctggagtgcaatggtaccacctcagttcactgcaacctctgcctcccgggtttaagtgattctcctgtctcagcctcctgactagctgggattacaggtgtgcgccaccgcacctggctaatttttgtatttttagtagagatggggttttaccatgttggccaggctggtctcaaactcctgacctcaagtgatccacctgcctcggccacccaaattgctgggattacaggcgtgagccaccacacccagcctgtcatctttattcgtttgccacttatttactctccctcagtagataatgaattgagcgcctagtatacgctgggcgttgtgctgggctctgggaacctaatggtaggaaaagaacaaaaaagagacatggcgtatacaaatgaccagaaaatactctgggaggctacacaaccagccggtaatactggctgcctctgggaaagggagtggggcttaagggttgggttgaaggggctttccttttatttttatattcttctttgctgtttgaatttgtaacttatcacttgtgcaaatagcaagggcaaaaaaggtattttttaaattttatttatttatttacttattgagacagggtctggctctgttgcccaggatggagtgcagaggcatgatctcagctcactgcaacctccacttcccgggttctagagattctcgtgcctcagcctcctgagtagcgaagattacaggtgtgcaccaccacacctggctaatttttgtatgtttagtagagatgaggttttgccatgttgcccaggctggtctcgaacttctggcctccttggcctcccaaagtgctggaattacaggcaagagccaccacacccggccaaggtttttttttaattaaaaattggggcctcttaggagggaatccaagagtcctaattctttgctgacatcagaaaaagggaataagcctcttgccccatctaatgctgcactggggtttacggttttcagctttcaccttccatacccaaagcggcacaacatcactgcagcccacggaggcaggaccttgtgggttcaagttctccctctctgcccgcctcccccctcacacggtggatgaaaaatggaaacagggacattttttcaaaggtatttcatgaatcacttcagccacgagttttggctgtgagttagcatctgagaaaattctttacgagccaagtttaagggaacacatcccaagggtggggcagtggctcacaggggttgatggacttgatgttttaaaaatagttttaaattgcacgattactactgctgcttggaaaaaagaaagaaagaaaccctatatatataaaatatagcccatagcagcctcaaactcctgggcttatgcaatcctctctcctcagtctcctgaagtgctgggattacaggcgtgagccatagcacctggcctcaattcctacaactttctgatacagttccctgctcatcacgcttccctgtttgtgccatgcttatcactgtccttggtcttgtttgggcccttcccccacctaagccacgcttcctttttccaaatatggaaaaaatatgtgtgtgtgttctaggtcctgatcaaatcctgggtccgcgctgaagcttccctggtaattgtaaccccattctgacttctaggctattggttcacctccagatattggtcatttacagtactggtctctggcatggcatatccttccagtaagcctggaggcaaatttaaagcaggcacctggccttatctggtgcggataaccatgcttagcacgatgtccacacactcaatagcataataggtacttaataagtgttcctgtctctccttccatcccacctgtgcttaaggcagcataattattttaggctaatgctgcagggttacactgactttcattctgtaggtttatggctagacaccaacagagatgtttaggggttacaaaagctggtttcataaactaaatttagaatgtatttatcaattgagttgattgatgactaattccatattctatgaaaatatatggtggctacataacaatgcagagttcctactgtgtttgtgccctcgtgagatagaaggggaattggcctggtgtggtggcgcacacctgtaatcctagcactttgggaggccaatgcgggacgattgcttgaggccaggagtttgagaccagcctaggcaacatagaaagaccctgtctctaaaagaaaaaataaaaataataaattagccagatgtggtggtgcatgccgatagtcccagctagaggctgaggtgggaggatcgcttgagctcaggaggtcgagggtgcagtgagctatgatggcgccactgcactcctgcctgggtggcagagcgagacccagtttctttaaaaaaaaaaaaaaaagcaaaaggtttgaagtcactgatttggatccttgtgactgtcagctgacattgactatggggtccatgtgtttatgactcatatctttcatgcagtcagatgtatccattagggcccgagtaagaggcagaaagtgtttccaaactcagtaatcagaggagaatttaggacagcttcaacagcaaaggcgtgggcagggtttgggaaaccagcgagagtgaatgcagtacccaggcttggccatagaggggagctattcccaccctggcctgaaggtgccagggtaaggaatgggacctggagtctccaggagggtgtcactgtaccagagtccagacagcggctgtggccaacctctgaccagtgggaggggagctggggaacaaacacctgatcttactttcccattagtgcctcctgttggccaaacccagaaggaagccagaagtcaagggtaccagctgctacagttcatgcaagtcaacatctcagactttttcaaacccagaagccataaagtgatctcccttccactttctctcctatatcacttggtgtgtattacccacatgctcgttcatatgccacctgctttagaataacgggtgatacgttcttatctcccccgctaacttatagccaccttatctgtccttttaagtctgggcacggtggctcatgcctgtaatcacagcactttgggaggctgaggtgggtggatcacttgaagataggagttcaagaccagtctggccaacatggcaaaactcagtctctactaaaaatacaaaaatttagccgggcatgatggcatgcacctgtagtcccagctacttgggaggctgaggcaggaggcagaggttgcttgaacccaggaggcagaggttgcagtgagctgagatcgtaccactgcactccagcctgggcaacagaacgagaccttgtctcaaaaacaaacaaacaaacaaacaaacaaacaaacaaacaaaaaaccctacctttttaaggtgtacaagtcaatgatgaggagtatacatagaattttgcagccatcttcacagtcaactttggaaaattttcgtttccctgaaagaaaccccatgcgcatgagtatcactccccaattcctcctatccgccccggccctaggcaaccaccattctcctttctgtcccagaagatctgcctgttgtggacatttcatataaatggaatcacacaatatgtgtccttttgtgtctggcttctttgacttagcatgatgccttcaaggttcatccatcttcacgtatcaatacttcattcctttttgatggctgactaatagtccattgtatggaaagaccacattttgtttattcatcagttgatggacatttgggttgtttccgtattttgctattatggataattctgccatgagcatttgtgcacacattttgtgcattctgtggtggatgctcctgggtatgggctgttttttctgccctgcctaggatgcctcattttcttatcctggttagtttcctggcactcttcaatagtcagcaggggcctgccactctctctgaggagtctgctttgtctcccttatgagctgcctcccctgggctcctatagaccacgtttccccagactgcatgtgctctttacatgggactgtcattatccacttcttcccatctccctgttggttctgagcccctcaaggggcaagaattacgtcattgaacctgtagcccctagtatggcacttggcatacttgggaataagtgaatggatgaatgaacgaacaaacaaacaaaagagaacagagactgccctacaactctctcttgaatctgggtctatgaaatgaatcgaggaaggtcctgttctgaatttggagaagcaaaaagttcatgtgtctctagattcttctttttaaaaacatctctgaagatgcctatgtaaatatctaggtctaaaagcagagaggggagtgtgtgtgcacgcacaaatgtctatttggggaaggctgctacatagacagagattctggtaaggggaagagtgccaagactagcttttgaggcatccttcctccaaaaccagagctttgcatccagtagctctcccctccctcctccccctcccgacatccggggctgagcgtgcagaggcccactgcactgacgtcacccccagcagctgtctgcactgaccaaaataccaatctttatttctgcaggttggtgaaaaccctgtgtccttggagaaagctggttcccgttttccagagggggagcccagagcttgaaaggccgcggttggcacttcgagaaggaagtggagagtaaagacagcgcctggagcgatcgtagaaacacagaatgggactggggaagccctttggaaatccagctgcagaaacagacaccccaatgctatttacatacagctctatatatataaaaaaagaaaatatgaatattacgtatcagtgcatgccttgttgaggacgtggttgccttccttttctgcaccttgcgatgtgaactttgatattctgtaatgtctggggcgccagaagagagatgcctgctgtgtacttagaaactatttgcaaagactggtgggaattagccccagcatcggccaactgcctggggatagatgctggtggaataagaggtaacagtgcaaaaggcatgatagaaaaaaaaagtgaggacttgggaccgattgtgtaggggcagtctgggatgcctccatttcttgactcgtcctagcctctccctctgtacttacctaggtcgatcgctagatcccactgtcacgtcaagagaaatgggatttttgtgtctctggtgcttcacttaaaattttgctggtgctaagtgcgttcctgctggtgctgctgtggtattctgttgacagacttggaaggccaggggacaagagagatttctattttgctgtttcagattctttttttttttttttaagggacaagttgcaaaagtgccacttgagagtctcttctcttcttctacctggggacgaatatccagaggtggtttggagcaaaccttggggtctaggagggaggatggcattgagaggcttgctggttatgaggcagaaagctgacctcatgcatgacttggttgctatctcccccacccccacaaaagtgtcctcggagttcagcccacagcctcctccactccccaaggggatttcagggtttaggttttatggattaaagagccaagaaatggctacattctgttcaaagatgatttataaccgggggatgttgtgggagggagtgggccatttaaatgaaatgcaccagcatctcactgattgacagaggtctgatttttttccccccaaggataagctactattttcagaagtttctagaagggctaaaaaaagatgtgtgctggacggagacttggctgcaaagactcttcagggagcagtgattattttttgctttcattttcgaaaaatccaacataagcaggtattcttcctctgtgcaggataccacacactgccattttcaaagccgaggtggcgaggtgtcaggctgcagattcggacggtcattctccaaggctggatttgcaggtcaccacccggtacctatagacagagggtccagcaggctggttagcagacaccgctccagttctaagacgccagcagtgggatccacgtttaaggtggatgcggctgaaatgggaattatccccccacaggctttgctgtacagttctaagaagccagcagtgggatccacatttgttaaggtggatgcggctgaaatgggaattatccctccataggctttgctgtaaatgaccaggtcctttagaatgtacaacctctcagtgctgctgcaagctgggagctggatttctttctgtcttctttttaaaatccgttccttgtgttttcctaaatagccctttaaagagaaatgcaaccccagggctgctgaatgccagggaagactcccccaccccgcagctttgaactcagcaaaccaaaaaaaaaaaaaaagaagaataatgcttattttgggagaacgtgtttctcctcattactcgtgccctccccctagctgatgtttgcaggggaccctcgcttagctggggactgcagagagcagtgggtaatattcccacaaagctacgaacttagagaaggcaaattcattagaataatatgaaatacagtcactgcttctatttaatcactttcttagccacagactagggtctttccagctccccccattttctggggaggggcgtccattactacacagctgtatccaatcacagttctctgcttctttaaggctgtaccttcaagatcgtagtgggggcatgctgaccacctgtagacacaggagaagatgaaaggtgagaggatccctttttcagccccgacttgcctactggcttttgatgtttc

SEQ ID NO: 16233 - DNA, 57150 bp, Human
ataataacagccagtattcttcccacatacttccggtcaaaagtggggaaaccagaaaccgaataaaacattgggaagagacatactgtgttcctggaaaaaatataacagagccagatttaactcggtgagagggaaagtgacccccttgagaaaccagggaatgtctcaccctcagaccaaccctttcttttgcaaattgaattggtcaaagtttagttttgtcatcatttctattgttataattcttattcattttcccagccccgtccacacttctatttttcactacccccacgccccacaagttgccaccgggtcaggtggggacatatccggagagaaatagaaagggatgcattttaaagcgagttctcttttgagaggaaaacaatgggtagttttggaagtgtctttcttaaaaacggaaggagaaggtgaagaaaaaaattatcaacagcaatgggcccctttggtttgggttttgactttttaaagaggaacctctgctgtcctgttgcagtattaaaatcagggcaggaattttgcaaaatgagaaaaataaacttcgggagaaaacccagctgggagcagcttcgggaaagcgacagttctccgaaaggaggaagggaggatgcgcgctgtagccggctccggagtttactgcccgaacgattggggaaaagaacgaggattctcaaatctagttgcgatctctcgtctctcctttattctgttcgtggtgcgggcttcggagcgtctgggaaagccagtctgtgaagctggacttgcagaatcctttgaatgccggtccaggtggctgcagggcccgcagtccgggatgccggagaaaggaaccacaaggaaaagacgctacgctcggagtttccccttttccttgcagccccggcggggcctaggcctcggtttccggcccacctcggctcagaggtcaagtaggaactcatctcgtcgacctagggtttgggagaaggatttcgggttgcgttcttggcatctgggagcaaacacgagcctcggatttggggacatatcgttattaacagcttgggaaacgaaagcgaagctcggggcagccactgcagcctggctgagagaaaggacgcgggttgtgctctctggaagcaaaggggtctgcggcccagctggcctgggagcttgtggccggcgctggaagctgcccgctctccccgcgggcctgaccttggctcccgccgcagctctgccggccgactgcctccctgcacattttgctgccgttccagtccttacaggaccgggcctggagccaggccatgcttcggaaagccctgggggttggggacgcgcaaaacccagaatcgaaccccgaagctgggggcaagtccagattcagacgtccagctccctcgggaccccttggcggagaacttacccttccggaaggcccgacgctctccggctctgtgctgggcaggcctagctcttctctcggcgccaccaggggcgtctacgcggtacgttttgcaactcaacctagtgggtttccagcggtgcgcaaaagtttgcgagcatccaccactgcgctgcttagaaattgtgcccattgatcagactaaaaataatagtcgtcgtgattacaaaacaaaatagagtgcctcgtgcctcggcgggccctggtacaataattattctctacagaaaccacctctctccactcccacccctactccaccacccactcgcaccccgcccctgccgggccactctgggacgaattgcattcttggacctttctctccgcaaggcacattacggagaactccctctgtctcgtgtcccctccacgacaacccagtaattatttctatgcaagtctgcaagagggcactgagttatcgcatcccaagcctaaccagctagagcggcgcctcggtattcatttgcccagagctcctccgcgggggatttaaaaataataataataataataaggatcccatgccttatgcaagagacctcagtcccccggaacaactcgatttccttccaatagaggtctgaggtggactcccacctcccttcgtgaagagttccctcctctcccccttcctaagaaagtcgatcttggctctatttgtgtcttatgttcatcaccctcattcctccggagaaagccgggttggtttatgtctttatttattcccggggccaagacgtccggaacctgtggctgcgcagacccggcactgataggcgaagacggagagaaatttacctcccgccgctgccccccagccaaacgtgacagcgcgcgggccggttgcgtgactcgtgacgtctccaagtcctataggtgcagcggctggtgagatagtcgctatcgcctggttgcctctttattttactggggtatgcctggtaataaacagtaatatttaatttgtcggagaccacaaaccaaccttgagctgggaggtacgtgctcttcttgacagacgttggaagaagacctggcctaaagaggtctcttttggtggtccttttcaaagtcttcacctgagccctgctctccagcgaggcgcactcctggcttttgcgctccaaagaagaggtgggatagttggaggtgagtttcaccctggaggactgaggggggaaataggtttctctttgcacttggccctccttggcttttcaccccgtcttagtcttgctgaatcttctcttgctgtgctgctgcttctcatgaacgaaataagaatggcttcgtgtgtcacctggcaagaatggattctctcgaaaggtttgaaaatccctattttgcttggtggcccagaccatctgtgctcaatgagctaagcaaatctggctgggctattacctgggagagtccagatttttcctctctggaggggcctgaagattatttatgggaattaattttatccccaaatctctgagaacttaaagggattgggaaggtctttctggatttccctttccctctactggagatgtagcggttcagccttcttccgatgccatgtttgtttttcgtgtcttcggcctagggtcgccttgccagcaagcctaaaggcctccaagctgacttggagggtgagggtgttttcacaaataaatacatcgcctgggcaaagggaaaatatctgtttgcaaacaaacctggaaggtggagtgagcaccatagcaaaggagggctggctttctccccggttgccccacattcagggttggagattctccactttggcattttgcagcaatggcctggcctgggattttagcagagcagtcacagagggttacacagctgctgacctcggggcatttctcctccctccatccctttctccagaccttgacttgcaggcccaagtctcttatcagaaccctagaaaaatcagtatgatgggggtacaggaggtaaggatgggaaacagaacaggactcctgacatttactccaagcaccaatattcggtgtcccaatctgggtctgctcagactgagacctactgactgtgtttgtgcttttattgacctcttcaactcaccctaaaaaaaaaaaatacatctcagagagggaaagggcaaggagaggagaccagtggagatgaaaaccctagccagtccccagtgactgtttgattattttaataaaactgggcactgccttgtgtacacctggagcaggggacgtctggtggccccactgggtggggggtgagggcccgcagcgatttcttagcatctttgatctcggcccccatcccaatgcaccttcaccctgccttcaccccagagtcgttgagagtaggggtgatgagtagggggtggaggggagatgtcaggaaggcgagcgccggccaggcggggtcaggcagctctccttctcgaggtcagcgttggagagaatgtctgcaaggctgcggaggcccgcggtgtgtttgtgtgtgtgcgtccagactcggttctctgcaccgccagcgtcactgagattacttcccgattagaagccgaccgcgtttgaaatgatttgtgcaggagtttttgcagccaccgcttgctcagagaagcagagatggatggaggttgggaaaggggtagagaggagggagttattgcaggtctgtgttgagagtcgtattgtgatttgagtgttcgggaaatctagtggaaatttggggtggggggaagggaggacgggagggtgggagggagagagaagggggagggcgacagagtgcagtgggagctagttggataggcgatttcagtactttgtgagcatcgaggcaacccaacgtcactgtgctcagctgagttggcttgtatttcagagagagagagagagggagagagagtgagagagactgactcttacctcgaatccgggaactttaatcctgaaagctgcgctcagaaaggacttcgaccattcactgggcttccaactttccctccctgggggtgtaaaggaggagcggggcactgagattatatggttgccggtgctcttggaggctattttgtgttctttggcgcttgccaactgggaagtatttagggagagcaagcgcacagcagaggaggtgtgtgttggaggtgggcagtcgccgcggaggctccagcggtaggtgcgccctagtaggcagcagtagccgctattctgggtaagcagtaaaccccgcataaaccccggagccaccatgcctgctcccccgcctcaccgccggcttccctgctaggagcagcagaggatgtggtgaatgcaccggcttcaccgaacgaggtaaccgtcccggcagatggcccgggaggctcaggagggagctcgtcggccgagtcggctggggcggcgggaatggcggattccagcccggctttgcattctgcagagcacagcttgcagagattttgcgcggctcggagctccccggcaaatggagtctgggaggccgccgcggctggcggagcggcattgaggtttgcagaagcacggcctggttctgtcaaaccgcatcttgttcgcctccgccagcccagagctccccgggaccctggcgagggcgcggggtaggattctccccgcggccggcagtgaatgggagcgcgtgtaggggcgccagccctgctttcttttgttgtgagtaggcagcggggctccagtcgccgcctccctgaagccccgagaacgaggcgaagaaagctgcttgcaagtcaggcctcagaagctgtccttctcctcggccccatttctagatctctggccacagcaggtcagggtgggatctggccgcttgcttaagcagctgctgaggttttgggggaccatcgcttgtgcccgcttcccaaagtcttcccgttctagggggaattcctacttgcgtatagaagagattggaaggagatcagagagcaggagacaggctcatcgggcttgaacagctctgcggcagttattttgtgtgttctaagctcatacgcctgcaaacccgggccgttctatgcattgcggggacccgggctgcagattcaatgtctccagcctaggacttatccgagaatgattttgtcctcgccaatcctgagcctgagcctgcagttttagcaggccaggcctggctgaagttcagagaaacccctttcggcctggtcactccacaaaatgcccgccatcccccgcccggcatcagagcgctggtggcgggcacccagtgacgagccttcctcggaacggctgcacggtgactttcttcatctagtcttctgtttggctactttttatcttttaacgaatcttacttaaggttgggataaagaaaaggatgtttaattttaaaggacttttaatgttaaggcctgtaactggtaaaaggtgtatatgaattctcttttgaacctagtctcaatctgcacaaccttccccttctgtgtttttctttttgcaagaggcgggttatttcacacatttctgcctgctgcagaaaactattcctcttgtgaggtttaataaaaagagtttcgacggcatcttgtaatttggcgaagaaagaaattctctaaaggacactgggtttttgttttgttttgtttttggttcctacccagtggcttccaaaaatacccacgccttatctttattggctcttccagaagtccagacaaatttgacgggcagcttgcttatcacggagagcctgcgcaggggagatgcgggcctcaccttctccgggtctgacgcgggtcttttgcaagaagttgtgcctgcttataaagtaatagtaatactactaggaatactagtaacagtaataattctagggccttctgcagtcaccttcggctgggaacggaggtgctggtagctggaaactgggggccaaactgctccctcctgtcactagaattgtgctctccaacctttctctcgttctctctctgtcctccccacccccatctccccctgcttcttgtcctcagagcagaaccttgcgcgggcacagggccctgggcgcaccatggccgacgcagacgagggctttggcctggcgcacacgcctctggagcctgacgcaaaagacctgccctgcgattcgaaacccgagagcgcgctcggggcccccagcaagtccccgtcgtccccgcaggccgccttcacccagcaggtaaggagacctcgcgcttcgggtccctttgcagagatcaaagtcagagtctggctttcctgctcggcttctcttgcggggacagaacaaaaacaaaataaaaaaaccccaaaacgaacccaacgactataatcatcccttttcctttttattcccactcagttccacctttctctgccctgtctccccaaatgctagcgtattgccatctactttattgtgacggttatctttacggccaaaggatttttgaaatctatttaaattgttcgagaaatctcaattatccggccgtttggggtcagctaacaatggcctagataattcctttccctctgcactatgtgtagaatcggcccccagcatcttaataagggccaggtcagcggccgattcaggccggcatgagcgatggcttgacccctcttctgatcttccgtagccttcgcctcctcccgcctcctcctgcctcctcctgcctcctccgcgccgccgactagacccgcgcgccgcaccatttgtcttgcggtcggggcctggctggctggcgcgccatcaccggccgctgggagcgcacagagctctgcccggagggcaccaggagcctcgggttcgccaggctacaacctgggcccaggcagagggaggagcctcaccttgcgctctgcgcccaaaacccaggacgcactgggcgctcaagtcggcccctcagtagatcctggtaatttttaaataaggtgtcacatggggtgaaacggggtgacgaccagaagagacacttacacatggctaaaatcctgccttgggatttcgatcccttcctggcttttcccggcttctctctttggcctttaagtttcaggaaaacgtgtgtatatttgtagagaagcagagagcgtgaacacagtttaggaaacttagggatttttttttttcttttaaggaaaagcaaacccactttttagactgttgtaaattattccaaaatgaagagtttgtgtgtgcatgtatgtgtgtgtgcacatatgtatatatatgtatatatatacatttgcatcggttctgtaaatttagttttagctgaaagccaaaatgttaaatggcatcaggcgtgtcctataatcaaaatagctggatgtgaatggaactacttgtagagagagcctggaaggtttgttaatatagatatttaggattaattatccttctggactgtaagaatatatgataatacaaacatttttaggtttcaaaattcatgtatgttcaggtttgcactcaccatggtcgagaataagcaagtatttgcacatctgtatgtttgatgtgtgggcatctgagtgtctacatgagaatattctgagtggttttctagattaggttcctagtttttctaaattaggttttttatctatcccccccacccatctcaggtgaagtggattgaaattggctctggttttttttttttggtttgtttgtttggttggttttttcttattccggtcctcctcagtgacattccggagcaccctgatggtgggtgatcactccatagccttgtgctgatggcattagaagcagacaatacagcactgtgggttcaagtggttgttgcaaccctcagggattcagcctacatagggatccctgggcagaggctgttgggtgctccagataattctgcagtgggctgaagccactttttactctctgagaccacaggctccagcgggaaggaggagcagtctctgtgttttgggggagtttggggaaggaatgcccactactgccagggcttgttagtgtgacttttttctccttcttgcagggcatggagggaatcaaagtgtttctccatgaaagagaactgtggctaaaattccacgaagtgggcacggaaatgatcataaccaaggctggaaggtgagatggtttgttgtgtagagagagggacgaggagaaattgtgggagaggtgaagaagaaaaggtggcttggaagagaagaaggaaggaaaggggcaaaaggagagggaatatagagaaagaagagaaaggagaggagaggagagagagagcgaaagatagatcctggttaaagaggcacaaggagattcctccattgatctctcctaggatggaggaaatactccagaagttcaagcccggaaactgggcatttctcccacctcacatatagaaagaataaagagcttgggaggccgtgctatctggattcgtaatgagggaaagagagaagagggaaaggagaaaacagaaaacagagacccagagaagacagagtctagaaggtttttgggtttcagggatcttggactttatctttactccaatcctcattcccaccctccctgaccttggagtggctccagggtcccacccgattgtcaaactctgaatcgttggatgtattcgctacctctttcattgtttatagaaagcaggcgaagcctttaaaactgaaccggggctcggccgggctctatatacagacaccaataaacacggcagcttcgccaagacactcgccccggagttccccttaaaagctcgcagagttttagctagaaatgctagacttctgggggaggaggaaggagagtggtgcagctctgtatgtcagtgtgagtgtgtgagcatgtgcacgcgcgcgcccaggcctggggacgtcctggccacatccctacccgtgctggacgggtcttccgcgtcccgcaaagcaaaaagccagaggatgccccgagcaggcgtgtggagcaggcgaacggtaggcccaagccaccgagtgtgtgaagggggagggtggagccgcctttccagacgccccccgcccccgttctccagccgaagcctccctcaataaactgacaacagtgacatttattattatttaaaattaaacaaagtctgctccccgctcggcccaaggcctgagtgaactaggaggcgcgttctgtttatatcaacgaactgcagtcctcttcctattcccccaggaaggaaagacacgtccgagtccctctttccccccgagcctgagccgtgaggatttaactataaaaggcctgcgaagtcttctgcgcctccgcctccgggcgcgctcgctcaggctgataaacactgcgaggctttggctccggggctcggagggagaggcctccattcgaccgttcccgccatcgctgagtgagccgagatctgccaacttgtcttttcgccccgggccagccttgagaatctttgctttctggggcatgttcctcagaaggtggagggaaatttggagtgcgccagggcgcagaaaggcagcagagacggcacagttccgggccatcggcttgataacgactgaatcttagttcaggcctcagctttttctgaaaccagatctggaagggtctggaatttctttgctgaaggccaaggaatttcgactctccgaggaagagtttcaggggccttggagaagttgtgggggcattcaggaataaactcctgctagagacccatgtcagaggtcattaaccgagttatactgggaaccgcggccttccccttcctccagcggcagaggaccaaagcaaggtcgggaagcctgggcgcacccacgcgtgtgcatctctggggcgcacacaccttgtgtacacgtgacaccttagcaacgcgaggatcggcggaagcacctggctagacagatcctctaggatcagcgcctagcattgtacctaataagcctcctctccccacaaatattaataataggtgtctggctccgaaaagggcggttagcaagagttgaaatggaggtccctttgaagcatcttcaaaacccgttctctagaggcgcatgcgtcctggtttgttttccgcttaggttacctacagttgcccgcctgctgttacctcctcccttcgcctttctcctccctataacttcaagggaaacccgggatggatcttgcggagagcggaacggggctagtttccgcttccacgtttctccaggaattgctttttcccttaaaatggatggaggctgccttaaaatactggcattaattcccgcccccctctctccctccgtccctctctcttaggcggatgtttcccagttacaaagtgaaggtgacgggccttaatcccaaaacgaagtacattcttctcatggacattgtacctgccgacgatcacagatacaaattcgcagataataaatggtaggcactggggtggcaggtggagcggggagagagaaaagtggaaccttctcccaaaaagttgaaaagttgtatcagtgaactttttttttttttttagttcctactgtgtgctaaaggcgtctgtccgcctatcccattgctttttactaaccattctcagacaaagaaactacaacaattagctccggttttccagatgagaaagcggaggctcagaggaagtgaggtgcctgtgtctattgctgcacccacaggttgtggatttttacaaagggtattgttaccaagtgctggaggtatttctgggggcataaaaccatttacagttattttttatgagttacctgctttgaacatgcatttttatgaaattgcaaaatcgactcgtggtattcgagttaaacagttaggagaggcccatttcttgggtagaatcgttcccatggctgccagcagtgcaggggcctgacgatgaaacccccgttgaaagccctcaaggaattttcaaggctttttgcacgtccagacctccagaacccgccacttttttgtgggatgcgagaggctgtaagaagaaagggctgggccaggggcttgcctgggcgcaggcacaaagtattctggggcagctgggattgcagatacctaagggagacgggagagcctccagattattcccagctactactcaacaaccctcacctggtgcgtgaactgaagcacgcttcggtgcagtgcgctacctccagactctgagccaggcctctagtacacctctccttcatctaggtctgtgacgggcaaagctgagcccgccatgcctggccgcctgtacgtgcacccagactcccccgccaccggggcgcattggatgaggcagctcgtctccttccagaaactcaagctcaccaacaaccacctggacccatttgggcatgtgagtaccgtggcctggattccccgccttgtctccctcttgtcctctctcccttcttctcactgggtttctctcccttcttggctctgtgtgcctacatttctccttttctttcctccattttcccccactttcgtcgctttctgcctctaccttcttgatctggacttccttcctcttccttttcctcccctccgtctcaattctctcattcctttctcttctttcaccttctcacttgctttccctttgctttctttttcttcctactatttcatcctctgtctccactactctcctacacagacatctgcccctctgcagtcctcccggtgatccacactccccagatctgggtctgtcgttccttggtggctggagatatggcccccggctcacctggtctggggctgcatccttgccgttagggcccaaaccctctccctttgcctagggatggaggaatgattgaagctgctcattccaggcctggagagtctgtgaattcgatctgtggttaggagtggagggctgtgtttcagtcttgcagaaaatatggacctcctagcccagtggatacccagtatagactgcacagaggctggaccacaatgaaagccatataccttccctccccacttctcaatcctgccttaattttgggatgttccaggggagagggagagcccagctcacctgccccctcttttccagatgggaaatgaactcataagagaactatggtgccagtgccactttttagcttgatactcccggggagatctgttttttttccaacaaccagctttctccctttccacactgtgcccagagcaggcgaatgtaaaccagggtcctaaacttggagtctggattggacccaagagaggggactggtgaatttcctgaaactgaatgcagggtattgaatgtgcagcctgctcaccacccaaaagaatgtgtaggttttagtggattcttagtagggtcatcacccctcttccccaaagaaaaacaaaacacaaaacactgatttttgaaaaaatgtccccaaatctcatcgtagaagataattaattactagaacagaacacggattctgtattcacgtttagaacttttagctggatgattctgccatacaagtgggtacattcgtcttgggcatttgattctcacggcagcctagggggcggacgggaggcatagcttttgcacaggagagtccaggggacgggggtgacttgccaaggtcctacagcttgtatttgggagcagagatttgcggctaggtctctctaattacaaaaggagttccctgtcctggaaggttgtagcttcaaagaggagcaacagataggcgcatggtcgccgatttcagggaaaggaggggactgggagggaatgaatttggtcaagggggcgggggaggatggtttatgaaggtccaaacgagaaatctgctcctttgaggccttggggctgaagcactgaagtccccaggatctgggatgggaagaggatctcaggggtccacactgatgggtaaatgcagctctcagcacgtgggtggagaggaaaaagaatcattcactctctgtgcagcctgcttggagcgctcggaaggcattcccaggcaaatgcagagccactctgttaaacccgggtgttttgcccacgagtccttcttgctgggcttcccaggaggtgctctgtaaattcagcttgtgtaggcattggctgacccgccctggctgtgtatctgccagtccccagcagatgccttaccagcaccagggaaaaccggagccatttctaaaggttccacatgcatctctgggctggctccttctggaggatgggacccttgggtggggtcctgcgtggtccttgacgctgggaagtgggacggttccccaggctcatttcagctcctagctttttctctgctcctctggagtgcctttggggtctctctagggcggatgcctgcggaaggtgcacaaccccaccaccaaattcctggcatccctgccagcttcaggacgttcccagctggggagaggggctcggagctgctcagaactgcctagaagccaggcattcccacccgagactccggacttttaattcagagccggcctaatgaaattaggagccattagatcgccctcgcgctgatgtctccacactgtccccagccgtcaaagcaatttggctaagccgggccgatggccccgccggccggggactgtggcggccagcggggccccgctgcgtctctctgtcgccacgccgccccggtcggcgtcgctatcggccggggaggcggccgggccacggcggccggagattagagacgcgcggcccggggtcgggcagccgcggggcccgcgagttcctcgtccctcccccgcccccggccgcggctcgcctcccccaactacctccactcgatcggggccggactccagggttggtccaagaatcttgccccagggtcatcaatgcaaataatcaaagtcacagagacaacctccgcagttcccgggaaaaagcaggccagattttcaggctgttaaacgcggcgattcgcacgttcggtggggatgtgtcagagcgttctggtaaatactagcgtcatcagaacaacaaacccagttttattggtgaggatgctcatctgtgactagccctggctccagcaagaacgtgcagcctggaagtcctcctcctcctcctcttcctaatgataatggtggttgtaaaaattacagcacaactacagcagttaggacccctcttgtccctgggaacacccctaaatatggggaagataggaagtagaaagagaatattcccgaaaaagcagatgtagccgttctgtctggggccaagcgtggagataattctggttgtggatcctgaaacgtgataaagctggagaaagggagtttccaaggcaaccagccccttctttgaggggtgtgggtggtgcttcctccccacaccttatgagccgacatccttggagggcagatcacccgtgacccccaaatatcttctcttttcacgaactctgctttgcttgttctccaaacaaaggccccagatttgaggtctgatcacccaccctaagcctcagaaaaaggctgtgcagagaactggtgatttttttttttacttatttcagttttccaaacacttgatatcttctcttgcatcccttagagatttggggagtgggggttatttctatgtttgttgtttgtttgtccccgtgcccctacaccacctgtcaatccaaaagtgcccttgaggcttccctccagacgcggattcctcgatccagacttgctcagctcccgttgggggtgggaagtgccctatgcagggagttaatttattaagcaaactttattaagaattctgatttactgctctgtgtgccttgggtagattcctggaatattaccctggctttttcggttggaaattgttatttttgaaatgtttctttttaatgaaatccctggccccttttcaaaacagaagaaaaatatctatttttcgagagccgatataacaaggcgaatttagagggcggggagcagggttttatctggagacaaagggagttttgattttcttacaatctcattttctttattatttttagattattctaaattccatgcacaaataccagcctagattacacatcgtgaaagcggatgaaaataatggatttggctcaaaaaatacagcgttctgcactcacgtctttcctgagactgcgtttatagcagtgacttcctaccagaaccacaaggtaagcctgaagcccaggaaccagtgcctggggccgtctgctctttcttttgcatgaatctgcaaggttttcctgctggaactttgctcctctgaatggcagcagtcaccaacttcgaccccagggtgctggggtggggacaaagctgcagcctaagagtttcagctgtttttactatatccacgagcttggcttgacagtcaccaccacacatatgcacccacaccagttagaaacaaacttgtcaaaccatagatgggccacacactcaaataccacaagaaggcatcccactgaccttatgaaatgcctagtgggaagaaaggttgcttaatggctctggtgctgccatttcatttctgggcaactgtttctgctggggtcagttttctcctctctgcctttttaatatttttcactccgagacagggtctcactctgtctgtcacccaggctggagtgcagtggcacaatcatggctcactgcagccttgacttcccaggctcaagagatcctcctgcctcagcctctggagtagctgggactataggcacacaccatcattatgctcagccaatttttaacttttgttttttgtaaagacggggtctctctatgttgccaggactggtcttgaactcctggcctcaagtgatcctcccacattggttttccaaagcgttggtattacaggcatgagccactgcacccaattttgccactcaactggcaacagcacaggtggcaaagttgccgggatccttaggattggactttcctgatgcttccctaattgtttcagaaatcactgactccagaccacattcttgggaaaggtttgccttgttaaaatgaaaacagagcaacctgcaccaccagcagcttgggataacactcccaagctggacttagacaaagagcctgcagaaccacagcttggtgaggggaggcagacctgcattgcttgggagaaggtggctgcagtttggtgtaggggcgggatgctgtcgcatggattgtgtgaaagtcagaccccatgaggttcaaaatccaggcactggttttggcatttcaaagcttgacaatgactttggagcaggctgcctatagcggcaggttggagggtgggggaggatcttctctttttcctcaggagaaagtttgtctcgacttgtcaggattcacctctgttccttagatacccgagtgcatgtggattcattttattgtgggtggcaggagggatttaatgttctaagccttggtatgaaaagttctagaatctggagaggcgagcaataggtgctgggggaggggcccctgccctcgtgcggttgtagactgttaggagtattaagcagtgatttgggcttagaaggctctggaagggcaaagtgggaggggggtccatatgggatctgtgagggcaggtcacctagatggatgtggagatggtgtgcccctcccttttcttagctacagtccccaccagcaaggctggggtggagggggaactgcaggagctggggactggacaggagaggccggagaaggatgagaggaaggcttagcaccccaaatcctcccctcacccctcgaaggtcattccagtgcaggctggcttggcagagaataccccaactgaggccgggactgttccaaaatgctgtggctaatctccaaatccagattgtctgtgaacaggccaagctgtgatagacagtcctttccaggccacaaagcctgtctgggaacccaggtcgagagagagcttcctgccctcggaaagaaaactcattcccctcaagacaccattcctttttaaatgggtaggaggatttttccgagtatccttccacctgttgaaccagcaagagcaaaaccgagggtcgaatgccctgaaagatgcaaaactatttcaggccaatttgagtctgtctccttgaaacctgtttccctcaatggctgctgtaaacctgtgtttagctttgcggtgacggtcacaggaaaaaaaaatagcaataaggaagctcaattcttcctatatatgtatatacttacatgctctcagaccagactggggtccaaaaatatatgagatcttttccccctctaccccaagaaagcccaggttcatacaggaggataggaaagggtagacatataaaagtgaccggcttaaaaaaccatctgaattctcaggtcctttggaagaaacaccctaaattctgtgtagttatgttcttaagactcatcaggtgtggatagatgtgggaaaactcactccctctctccctctttctgttgacagccttattgaggcataattgtcatctaataaactgccatatttgaaacagacaactagataagcttcatgtgtatatatatgtatacctgtgaaactgtcactgcagccatttgtgaatatgcccaacaccctttacattgctatttaaaaaatttcttccccaatacacgtatttagtgattgatgtgcatgaatgcctgcctgcccaatggggtgtgtatgtgtgattttttttttttttttttttttagcgcaatccagggaatcgtgtgtctgaatgctcacaggtctaagaatgtgtgtctccaaatacgcatttggatatatgcgtatttcacggccacactaagtgttcacacacaataattgcttttttttctgtattgattgagtcagggagcccagttgagctgtgcataatgttctgtttagccagcctgacagattccttgacatccgggagagaaatttcatgggagacaactttctgttaccctcccccacttcttcctttagagcaccaaagacacctattttctttttcaggagcaaatccaaaactgtgcactttcccagtcaagtgcagggcccctgcaaacatttcccacgtggatatatgatgtgtgatttaaataagcgggccagggttgcatgtgatttgtggactcagtcttgctactttattgtcccacctggactgggtgttgagacttctgacttcatgcgtagaagccagctgagctcaccatcgcatagggttaaggtggaggactgtggaagctgactgcttgggttcaaacctatctgactttgggcaaatgacttaactccatttccccacctgtaaaatggggataataagagaactcacctcatagtgttgttgtgaagattcaatgagataattcccggcaagtgtgtcatgtgggacctggcagagagctagcacagagcattagtaatgattgatggaccattgattgactacttagcagatcagtttattaacagggcgactccatccaaaacacagacttcggaaaactctttgtttactcattctaacttcctggctagtttagaatctgaaagactgggaatttaaataagttcttattcctgtggttgaaaaacaactgcaaatattagtctttgtggtttagttggctcattccctgatcatgttatcaattcaaggactatttgtctagcgttttgccttggataaatgagcagggaaaagaaaagcaatgcatgtgattaaattgccaagacaatttggaaaaataagggccaccgtttttatggtcaaagggcccagtgccttcagaatgatctgtctctatttggatgtaggtaccaggtggaggtaggtaggctacatggttcatttcttaggctgcaatcacatacccatataccactgggcccctaatgacgagacacatttcctcagcccagctgtgatctcgggctggatttgggacttatttccccagatggttgacagcttaaaaaagatatttaaaaactcaaatcttccccagcgacgttcattctgtgaaacacgtttttgtaaagttttcactgcagttgtcagcagctcccagtgcaatccctagaaatatttaggtgttaaaaaaaggtcacgtgggcatttcatttccctgttcttgcaacaatggctgtgtatgcaagcaatgtctatccccagatattaacttaactttgccattaaaaggcattttcctcctgcttaaatcattgtgtaaggagtctatatttatgaggtatgagctttctggttcagaccaggaaatgaacccttaatagagagacataattaagatttttggtcctcgtgagggttttaaaaaatttttttcaaaagcaagaattcacaacaattattctcattaatttttacaacctctgtctcagttggagctggtatttatgtttgtttttcccccactcccaaatctctcccggatatccggttttatgttgattttgaagggagtacatttgcatggtgaatagaagtcagtttcagtgaagccttttggtggaactgggaaatccaggtgtatcagtttgtgtgcccatgatctaacacacagcatattaggaagggaactttataaacatggttacagtatgtgagtggacagatattttgacctgcagacaatgtatgttgtatgttgacatttctcaagggtaattcttaggtcatataggcatctataatcagtttccaaaagaagttacgtgtaaagatcaacatacctaagtgaatatataagaaattgtgcttatcctgtgcaatcatatttttgcaagctatgatggtaagtgcaagattgggtaacagccaatctgtttgaggtgcaaggaatggatttgagcaaaaggtttttgctgataacataaaattcacccttttcttctttccttggggcaattttttgttctgagttcttggtggagcatggacatcatggactgagcactaattctcatgctgagatcctcactaaattctgtgtcacagcctcaccatcttcgacatttacttctgagactgcggaggggcaggctgggaggtgggaggaaaaggattccttcatccactttttttttttttttttttttttttttttttttttggaaacggagtctcgctctgtcgcccaggctggagtgcagtggcgggatctcggctcactgcaagctccgcctcccgggttcacgccattctcctgcctcagcctcccaagtagctgggactacaggtgcccgccactacgcccggctaattttttgtatttttagtagagacggggtttcaccgttttagccgggatggtctcgatctcctgacctcgtgatccgcccgcctctgcctcccaaagtgctgggattacaggcgtgagccaccgcgcccggcaataaaacacttttaaatgatctatttctccttaactttttgcaagtccattaagagatgatttatggtcaactgggtgaaatttcattgtgataaaagctgagtgagaaagaaaagtcccattagatgttgggtttttagactcttaaaatacaagtgaatacaggagtacacatcttaagatgactttccaaaaggattttatagatttttctactcattcagaagagtcaagaaaaaatctgaggccaagcgtggtggctcatgcctgtaatcctagcactttgggaggccgaggtgggtggatcatttgaggccaggagttcaagagcagcctggccaacatggtgaaaccctgtctgtactaaaatacaaaaattagccaggtgtgttggtgggcacctgtcatctcagctactcgggaggctgaggcaggagagtcacttgaacctgagaggcggagtttgcagtgagccaagatcgcgccactgcaccccagcctgggtgacagagtgagactctgtttcaaaaaataaaatataaataaaaaatctgaaagctacaggaatagacacagttaaacaaaaatgggctgggtgtggtggctcacaccttaatcctaacaatttgggaggccaagagctggaggattgcttgagcccaggagttcaagaccagcctgggcaacatagtgagactctgtcactccgaaaacctaaaaaaaaaaaaaaaaaggttgagggagggagaatgtgtacacacacacacacacacacacacacacacacacacacacacggatactttaaaaatattttaaaataaactttagggtaggaatagtggctcatgtgtataatctcagcactttggaaggccaaggtgggaggatcactccagcttgggaggtcaatgttgtagtgagctatggtcactccactgcactccagcctgggtaacagagtgagaccctgtctcaaaataagtaaataaataatttttaaaaatacttggctcagctgggcatggtggctcacgcctgtaatcccagcagtttgggaggctgaggcaggcagatcacctgagatcaggagtttgagaccagcctggccaacatgttaaaacccttctctgctaaaactacaaaaattactcaggcgtggtggcaggcacatgtaatcccaactacttgggaggctgagacacgagaattgcttgaacctgggaggtggaggttgcagtgagccgagatcgtgccagtgcactccagcctgagtgacagagtgagactccgtctcaaaaaaccataacaacaacaaaaaacctggctgggcacagtggctcagcctgtaatccctgtactttgggaggccaaggcaggaggattgcttgagctcaggagttccagaccagcctggacaacatggcaaaacctcatctgaactgaaactaaaaataaaaataaaaaaattagcccagcatggtggtgcatgcctgtggtcccagctgctcgggatgccgaggcaggaggattgcatgagcccaggagtttgaggctgcagtgagctatgttcgcactgcagcactccagcctgggtgatagattgagaccccatatccaaacaaaacaaaaaggcttcattttttagagcagttttagtttcacagcaaagttgtgcagaacataccaagatttcccctatagcttctccccaccacatgcacagccacccccaccatggacatcctgtaccagagtggaacattttttgcagttgatgagcctacactgacacatcatcatcacccagagtccatagttcaccttagggcccactcttggtgttgtacattccatgggtttggacaaatacataatgatgtgtacctgcctttatagtatcatagggagtagtttcacaaacccaaaaatcctctgggctctgcctattcatccctccctctttccaacctgtggccaccactgaccttttaactgactccgtagttttgctttttctagagtgttgtatagttggaatcatatatcttaaaatattaattgtatgtatattttttatggtgaatacacataggtgcacatacatataataattttattttcaataattttggggttagaggtaaacctcataggtcatctcttccagaaggcagaatagataagaattcctctcttcaaatgaagaaattagagggtacattcatttatcaagcacagtttctcaaatctgtaactatactactgggaaagactcgagatgatttttagggatacttgaatatgatgaaatcacagagaaagtgttttttgtttgtttgtttttttgttttttgttttttttttgagacggaattttgctctgttgcccaagctagagtacagtggtgtgatctcggctcactgcaatctctgccgcctgggttcaagtgattcacctgccttagcctctggagtagctgggattataggagcctgccatcatgccaggctatttttttttttaaattttgtattttttgtagagatggggttttaccatgttggccaggctggtcttgaacttctgatctcaagttatccacccaccttggcttcccaaagtgctgggattacaggcatgagccaccatggctggctgaaagttgttctttttaaaattatctttctagtcttctattagagagggagtctcagttcagtactggtttgtgttaactagttctctaaaagtgtctaatttccacttgcaacaaagagaaggcaagctttggatatgagtaaagacaattacatatatttattttcttcttattgagtagcaagtgattctagtttgtcatacaaagaagtgatatcatatttgtgtgaaataagtgcaaattaaaagtggtttgatttaaataaaaatattaagccagtgtacaggtgctgtatagatatggcaataatagtgaaagaaaaccttgaatgactgaagtttgagtcatgctgctctcatgtctataacatgattctctatgttctctatgaaaattcagttcacacgcaatttttaggaaatacttctggcaaactccgtatggttgccttctgtcacctgggtctgctactgtacattcacactaatataatgcgttgatggattaaattaaagttctgggcctggaaccaaaacgtgcaaaaagaccctgttctgtaactatgccttgtatgttgcaacacagatttccaagagagaaacctctcttctttgcttaggacattaaagaggtttggtgctgttcaatagctattatataagttatcattatgtatattggcgtttatttcattaggcaccattttccaccagaactaggaaacgctatctgcaaaactatgaaatgaacatgaaatgaggcataatagaatttttgaatgcaataatcaagacatgttttctgcagaaacacacgatggggtcaacccttccaatggagatgactacgctgcctgatgtgcaacgatcatgtcaacatgcacagctttccaaaggggagggagtactgagtattgaggcctagatggtgtttaaaacacaaaatgcaagattggaaaaaaaaaaaaaagaacccagctggaatgatgcagagtatgactccaattaatgggcaaaccaaacccaggtgtttttccccttttaaaagcagtccaatggaggacatttttcaaagcctccacttgaatgaagtggtgggtcccgttgacgtgactggcttaatttgcttcttttggttgccagaggctgcatttccatgatatttattattagctcatgtcctgaggtggtcttgcagcaatcaagtgaaaaccagcttgttctctcttcctctttccttcagatcacgcaattaaagattgagaataatccctttgccaaaggatttcggggcagtgatgacatggagctgcacagaatgtcaagaatgcaaaggtaggaaagtggattcctcaactttctcctccccacatacccctcaaattacccaggtaagccagcagcaacccagcacctccctccaccagcattcctgcccgtagaatgccaggcacatggaaatggggagaatgagccccctctgtcccattttctgataaccttcacatgtggttggcgccattgggcaacctggagaatacattttctagtggagagaaggtacgaagagttcggcattctccattctcccagggaacaaaaggcacagctttctcttctttctctgctgtctctctccctgtagggaaaccctttctctttttcttcccataagtcacagccgatgaatgctttttttttttttggcaacagctcttggtaaatgaaagagaagttaatgacttgatttcctgagggtgaaatacagacaaacttgacaccatgtggtgtccagggcactggaggattggaagctggtgctaaaaattgctcggtatttttacatatcctgtggtcatagttgctgatatgatgaatagaacgggctgtagcaaatgtacatagtgggaatttggtctgatttgaaaggattgtacaagcattgccaattttgtggaacattctctctacctcttgatgtgcttccaaaataacttaccatatggcaagcgaattagaaatacatcttgatccctctgaccaagaaggtttgtgtgtgtgtgttgtgtgtgtgtgtgtgtgtgtgtgtgtgtgttttctttttttctgtttggtgggtttagtgtttcaaaataaaatgagatccttttggatgttttccttatcctttctggaagatgtgaaaagggagagtcaggcagatagacagatatattcattcaaagaaagataagagacctaagaacataaagggagaaagaccttaaatctgtggttttaatattaggtttagaaatacatgcaatggaaaaattgtttttagatagcgggcttatcaggtcaaattttgcaagctttttaaaaaataatgctagcccaggtggcatgttcctgcagccccagctactcagaaggccgaggcaggaggatttcttgaacccaggaatttgaggctgcagtgagctatgatcacactactgcactgcagttgggacaacatagcaagaccctgtctccaaatattaaaaaaaaaaacaagagaatgaccctgtttccaaacattaaaaaaacaaggagtgtggtacatctgtgcacacattcctgttttcataaattggtttccttcaagattgtggactcacaaggtactttttgtggctaaaataggcaagttctgagtttgttatttaaaatttatttttggttttaagcatctacattttgaaattgattgggccatagggtcagtggaaaagatgacaacaaatatcatgttttagctgaaagaggttcaataattcacggccctgggctcagagtgccaactttctgttcctatcccattctgatggtgatttgccgttaaggtggcttagtcattgccacacaaagtcacctctcagtcctacaggcaaagttcctgctgtgcaggtgggagctgaagggagatcacccattcccacctgcaatcaaagggtttcatcatctcttacttcttccctcctttttacaaggtcaagggcagggggtgaataatagatttaaggtgtgttgaatcatcccttcaaactttaccagttaccacctcctactgattataccttccagcataactcggaattcagcccccttctgccagggtgctaattctagccaccaccagcctcctaactaatggagacccaaattcagttctggtctcctccagggactttctttaggcagccaccaaagagatctttgtaaaacacaaatcaggcaagttctctttgcagtggagaacatgtccaagtctcctgttgccatcactataaggtttggactcttttgcctggttagccatgaccttcccatctggcctggccacccccctaggtttgtccttcaccagtgtccccctaatatgtgtcaatcatgctaaaggaaaggcttcaaacctgtgttctttcctttatttttggcccttcgaacacacatttcgtctgtgtcaaactcttttccctccttctcaccaggccatctcccaaccatcactgagtctccttgtagcttttccttccttcaagaagctttccctggccatagactgtgtggtcagcccatgtctcccccaggacccctcctgggaatcagcccctcaaactttaccagttgccctccaggcttttctgtgtccgacccaggcctggaactttggaagatgattggacagatgacagccagctatgaaagtagagacaggtgggcatgtgcaggtgtgtgagagctcagatgtcagatgtcagtcatcaagggagtcttttctaaaagctctttttttttttttttttggagacagggtctcactctgtcgctcaggctggagtgcagtggcacgatctcaggtctctgcagccctgacatccacaggctcagatgatcctcccacctcccaagtacctgggactgcaggcatgcactgccatacccaactaaatttgtatgtttttattttattattattacttttttgaggcggaatctccctctgtcatccaggctggagtgcagtggcacgatctccgctcactgcaaccttggcctcccgggttcaagagagtctcctccctcagcctcctgagtagctggaattacaggcgttcaccaccacgcctggctaattttcgtgttttagtagagacggagttcaccatgttggccaggctggtctcaaactcctgacctcaggcaatccacccgcctcggcctcccaaagtgctgggattacaggcgtgagccaccacgcctagcctaaatttgtattttttgtagagacagggtttcaccatgctgcctaggctggcctagaacccctggactcaagtgatctacctgcctcaggctcccaaagtgctgggattacagacattacccacagcccctggccaactctcctaaagttctaaacacatgttcatttgtttgtgtacttacttattgattgattgattgattgagacagggcctcgctctgttgcccaggctggagggcagtggtgcgatcatgactcactgcagcctcaaccttccaggctcaggtggtcttctggcttcagcctcccaaggagctgggtgtccaggcacacagcaccgcatccagctaatttttgtatttttgtagaggcaggatctccccaggttgcccaggctggtcacacaactgtttatatatttaggcagatgactcttctttggcctgaattggctgtcctaaccatctgtcaaggtattgcagattgcttgaggcctggactaggtgtccttgatgggtaggaactttgcagatggaatggaggaaaagtgtggctagtcattggtagaaagtcagtaattgacatgttgagtcaaacctctcagcctaagagccatgtgtgtctttgtggccatgttagcagttgccctggaaaccagagggctgaactaaccactgatgaagttgggggagtagatgaggtcattggccaaggtctctggacatgtccttggggaaggagaaagagtgaagaagagtggttcccacagaaggctttggagtcagacaaacctggggtcaattcttgttctacatttatcagtatgagccctggggtaagtgatttaacctcatggaacctcagtattctcatctgcaggaggggcatagataagtatagcctctactttctagggttcctgtaaaaattatatgagcaaatgcctatagagtgcttgattcctagtctatatgttcagtaaaatttaactaatttggaggaaagctccccagtactcccaattttgcccttgttcagaatttattttgggtcattctcccaacccccaggttgcagtcagtagtgacaagtggggaatatggctctccagagtcagccttgataacagccaggcaggaacggcaggctcactgctaatcttgtaattctgtttcctgtcccctacacacccggtgacagctggctatgggagaaaagcaggagggatgaaatatcctctaattccaacaattggtagaagggagtgaggtgggattacagagagttaagcattaccttgcacttattccacagaaataacttttggatttgcttggcaaatgtctggctgttcccccatctacctcttggcccaactccctgtgtttggaaaacgcagatgatgtcttctttattttccaacattttttaatggtttctagttacaggagcaatcactgcttattataaaaatttgggagctatgggaaagcacaaagcataaagtcatttaaacatcctgtctcaagcagaccaattaaagggtgtgccaagtttatttagaaaggttaatcaatctgtgacttaaaaaaaatctaatcctaaaaactaatatttccccaaattgaagaacccttagattggtgacaaaggagttttttttttaataaaaactatttatttatttaggacagggtctttccctgccatccaggctggcatgaagtggcacaatcatagctcactgcagcctcgaactcctgagctccagcaatcctcctgccttagcgtctgaagtagctggactacaggtgcataccaccatgcccagctaattttttgtagcgacggaatctcactatgttgcccaggttggtttcaaactcctggtctcaagcaatcctcatgtcctggccttctaaatcatgggaattacaggttttagatggtgcacagacccatggacacatcagtcctgtgatttcatagatgttattgctcagaatgagactgagttctaagaaaggaagaaaagaaggaagcaaggaagggaggggagttaaggctgattaaagaggaaatattaactgaatagcagaacggctcgtatcaaggtttggggaacattgtcaagataatatgcaaagcacagaaatttgagaaacacacataaaagctcaaccacctacaaagaaaggcttgagagtgccattgctgtttgaaaccatctaggccctggttttttatagaacaactctttctttggactttgcttcagtcttcaagatgtattcaaacaagttctgaacttcctaggagccaaaggggctggagctgggactggggcagagtaggctttatggagagggtaaaagtagacctcgtagagagaatgggacctgaatctgttgggaagaagggttttctgggctgaagcaaggaagaagtgggcaagggtctaaaagtctagggggctggagtaggggtcagattctgaagatctctgaaagccagctggagtgactctatgacaggtatgaggagagctgctcctagaagtgtggaattgtagagatagaagggattccaggagacagcatctgatccacctgctctcttttgcagaatgggaaactgaggcccagagactcatttacttattcagcttttgatctgttgatttgtttatgcaactaaaacatttgttaagtgtttgctgtatgccaagcactaggcatacaaggatgaatcaacacacaggggaccagggtccatggatggaaacaggcccaggagctggggtccaggctgccgcgctgagcagctccagggcttttctactcgaccgaggagtgtctgtttcctcatctgtaaaaaggaagtcattacagagcctacctccaggcctgttgcaaggatgaaatgaggtaacgtgtgtgtactgattattattgctgcataacaaatgactcccaagcttaagctgggctggctgggacaccctggcttccaaactatcccatctgttctctgtgtgtgatgttaaatccaggccagccaaagtggctcacctgcgacaactttccccaacaacacattgggagtcttctagcagaggaaggaagtatacacttccacaaagagctcccagaccatcaaagtccccaagttccctacagttgcaatctgctagcccccagtaatgtcccataaatgctgcttgtggtgaaaagaccaggcctttgctggtcgccgttgtgtgcaaggggaagcaggaagcaccagggaggcacttttattttgtctgtgattggtgggtcatgctatttggaaggactcagctgtgcagttcttgctgaccatcagatggtggctgggctaccggtaacggaaggcaggtcaggcaggatgtccagcttggcacactcctgtgacccacagttgatgctgcttttggatgggacctcagctgttgtccactgaaaaatcagaatgtggcctctctagcttggcagactcagggtgttcagactttctcacggaagtggaagccacctggtccttgctgactgcaccttggatgtcaggtagtgtcacttctgctgcattcttttggttgaatgtgactcactcaggtgggttcagattcagggagtttgagaccagcctggacaacatggtgaaaccccgtctctactaaaaatacaaaaaattagctgggtgtggtggtgctcacctgtaatcccagctacttgggagtctgaggtgggagcattgcttgaaccccagaggtagaggttgcagtgagcccagatcgtgccactgcactccagcctgggcaacaagagtgaaactccgtctcgaaaaaaacaaaacaaaacaaacaaaacaaaacagaaaacaggttcaagaagggaggacaagttctctcttctacctagaaggagtgtcaaggaattcgtcgacgcattttaaaactgcctcagcaggcatggaagcacacagcacagtgtctggcccagagggacgctcgatcgctggtaggtgttaagacacggtccatgttctgttgaagccagatgccaggttgacttgcccaaggtcacacagtttggatgaaggggcctgcctggctgcaagcttgctttcttcaggatggagagaaccccctttccactaaactgggcttctgctcatcttcttgtaaccataaaccccagaatatgaacaagcaatagcaaagtccttcatctcggtatttcttagctcacctcacacagaatgaccatgagcaatgactggtcttttcaccataagaagtatttatggagcattatcaggggctaagtagatgatggattgggggacttggttggcctcagagttcttcatggaagaaatgaagctccctttacttccttgctctcttagtgtgctgcagacggcatcaggggcgtggtccctgaacctaaggggtaacttgaggctctacttttggtgactgggatctgagccacccaaccagagagtggatgggaaagtttggagtccaggatgtctcagccagactgaagcccacccatgactcagctccagtttgattattgaaaggactctacacagccacattgggaactgaccaacctcacccgcctctgtgggtgcttatttttaccctctctaccttgttcctgtagggtagggcttctgaaaatgggtgcaagactccttttgaaaatctagttaaagcaagagaccctctgaaagactcacaatatatgaatagagaaaaaaagtcgctaggtgtggtggctcatgtgtgtaatctcagcactttgggaggctgagacaggaggagaattgcttgagatcaggagtttgagaccagccagagcaacgtaggaagatcctgtctctaaaaaaaaagaaaaagaaaaagataaaaaaaaaaaaaaagattaactggacatgatagcctgtgtctatagttgcagttactcttttggctgagacaggaggattgcttgagcccaggagtttgaggcagcagtgagctgtgattatgccactgcattccagcctgagcaacagagcaaaatgctgtctcaattaaaaaaattcaatttcaagggatgtataaggcctaggtctcctaaaaggttaaaattcttctatttgaaccttccctcttctattacttccttcctgattttaaattaattttcagctcttaacctcaaatgatcatttttcaaactgaaggcttagcactcttgtgttctcatgcttgtggttaaaggtaatctgaatgcccaattaatgagaagtggttttcgagacaacattagacaaccttctggagatggcattaactcccctcttagggttgtaatttacctagccacatggcttcctccagggaagcagtgcatttatgtaaaacaagagcggggttgtgtctggggagctgagccagcctaagtgaagctgtaaaattgagatgtttttctgaaaggatctcatcttgggtcatggttatttgtcaaggcatggatgctcagaacccaaccccgccacattcccactttcccactcaggtacccccacccccacctaacccatccccagcatatctgctattcaggaacagggttgggagaaactcactcacccatctgtgtttttcctcatctttaatgaggtataattgacaaaaagtgtatatacttaggttatacaacttaatagtttaatatacgtaaatgtgagataattaccataatcaagctaattaacatattcagcacctcatatagttaccattttattttcttgtgtatatatatattttaatatatatatataaatatttaagatgtaccctcttagttaattttaagtacacaatactgtgctcttaactgtattcacattgctgtacgttagctctccaggaattatgcctcttgaataactgcctcttgaataacaaatgcctttgacctatatctccccattgcccttctccccagctactggcaaccaccattctcctctccactgctacaggtttgactattttagattacacctataagtgagtcatgtcatgttgatctttctgtgtccggcttgtttcacttaacaatgtcctccaggttcattcatgttgtctcaaacgagaggatttccttctttatttttaaggctgaatagtattctagtgtgtgtgtgtgtgtgtatatatatacacaccacattttctttatccattcatccactcatggatactcaggctgattccatatgttggctcttttgaatcgtgctgcaatgatcatgggagtgtagatatctctttaagatactgatttcatttcctttgggtgtatatctagaagagggatatacatatatccctgggtcatatgagagttctatttttctgttatttatatattgttttgttttgagataaggtcttactctgttgcccaggctggagtgcagtgtcatgatcagggctcattacagcttccacttcctgggttcaagcaatcctcccacctcagccatccaagtagctgggactacaggcacgtgccaccatgccttgttaatgtttttcaatttcagtagagacaagaccttgctatgttgctcaggctagtcttgaactcctgagctcaagtgatcctcctgccttggcctcccaaagtgctgggatgacagaacgtgggccactgcacctggctgatagttctatttttaatttttttgggaacctccatactgtgttccatggtggccgcaccaacttgcattcccaccagcagtgtgcaaggattcctttttctccacatccttgccaacatttgttatcttttgtctttttgagaatagccatcctaacaggtgtaaggtgatatatctcatgtggctttgatttgtatttcctcaatgagtaatgaagttgtacatttttattatacctcttatctatttgtatgtcttcttttgagaaatgtctattcaggtcttttgcccattttttaatgggatttttttcaccactattgagttgagttcatccacaattgagcagtgtttctcaaacttttggtagacatcacaattacctggggggcttgttaaaaaagatttctaggtctcactctcagaggtttgagtcagtggcttcagggatgggtcagaaactgcccttcaacagttttctccagtggctctgatggaggtgtcccctggtcacacttgggtaatcccttggttctagagaatgagtgagcactagagaatgcagatgaacacgtgattgtatttctgcaaacaaagcccatgtatgggccattttacacaaaaggcaacccttttctctacttagtactcaactcacactgaacattagaattacctgtagtcctcccctcagtgttctattatgaaaaatcgaaggcgtgtgagaaacatggaagaattgtacgatgagtgcccatgtactcactgcttagagtctacaattaaaattttgctatatatttgctctaccacatatccctccatccactcacctatccatccattcatctagccatccttccgtccctctctccctccctccttctttttattgatgcatttcaaattaaattgcagacatgagtacattttaccccaaacactacagtgtgcacatcattaactaggactcaatttttgttcacactcctgtattttaggttgaatttatatagggtgaaatgtacaaatgttaagtacacctctcactgtttggcacatgcacatacctgtgaaacccaagcccctatccaaatatagaacattcccatcaccccagaaaattctctcatttcctgcccccttgtcactccctgcctccttctcttcaccagaggcaatcaatgtcctgacttttttcactataggttagttttgtctgttatagaatttcatataaataggatcatccagtgtatactctttgtggaagacttctttctcctgggaagcttttaaaaactcccagtgtccatgctgttccccagaactataacatcaaattccctgggggtgagtttgggtgtcaacatatctatttttaatttcccaggtgattatggtatgcagccaagcttgaaaccaactcccctagaggaagttcctcgtctttgtccatccccaccctaagccgtgtcccccaatcacccaactccactaattaacatcctcacattaaaattttattttccaagagacctgctaccttgtagttgttctgaacagggaaggaggcagacttttatattagcacagaaaacatttatcattccttcagaaatagttgctttgggtgactttgccaaggtcatcctcagaagcgaaggtcaccaggaagtccttggcttacttctggatcatcagtggcctccacatgattttccccagaacaaaggatgccccaaggcaatccctttggtacagaaagcagtttgagaaagctgtagcattccagcttccagaaggattgaggccttggaggactccttctcaccaccctacccctgttccaaaatcatgtaaaagaaaagactaaacctaagtcatagttaagctggtttaaatggttaatttacaagactggactaaaatattggctgttcagttcagtactagactatttgatgaattattaccataaattcattaaaagtttagcttgaggctgggtgcggtggctcatgcctataatcctagcactttgggaggccgaggtgggcggatcacaaggtcaggagtttgagaccagcctggccaacatggtgaaaccccgcctcttctaaaaatacaaaaattagctgggcatgatggtgggtgcttgcagtcccagctacttgggaggctgaggcaggagaatcgcttgaacctgggaggcagaggttgcagtgagctgagattgcaccattgcactccagcctgggcgacagagcgagactgtctcaaaaacaaacacaaacaaacaaactttagcttgaattgtccttttatgtctgtagttttacaaagtttagcttgaattgtcctttgttgtctgtagttttacatctagcttttacccgcagaatccacacctgccctgtgagataggcctcttgttctccgttatgcaaacagggaaactgagacaaagggtaatgtcatgaattgcccaggacttttctccatgatttccgaaccatctccatagtttgagtcaaaaccgttttttgaatcacagaccctttttgagtagccaatgcaaatgtgaacctcttcctagaaaaagtgatcagctctaaatatttgacatttttgggtattcatacccatttgaagcccttgctgggtaagaacctctgctccaaaatataataatgtatatttacaaaatagtgtttattgagcaatgtgtccccagtgtgtgtgtgtgtgtgtgtgtgtgtgtgtgtgtgtgtgtgtatgtatatatattcgctaagcctttccatgcatcatttcattttataaccccaaagaggtggctattttattatccccattttatagacagaagactgaggcttgggtaaaggaagaaactagccagcaatggagtggtctagttcgtgcctggatactgaaggaaggcacattcacctggcctgacatcggagcctgagcttgatgctaccactctgatactatattatctacagatttaacaagtgggacccaaggccccaaaccaaaatttttacaagtggtgggtacttaaggccagggagagaagtgcctttgagtttcttggcacccctcaaatcatatagccctggttgagtcaacaatgggaaatttaggccttataaggtggctcatgtctattatcccagtgctttgggaggcagaggggaggatcacttgaggccagatcaaaaccaacctgggcaatatagcaagaccccatctctaaaaaaaaaaaaaatacaactattggctgggtgtggtggcacatgcctacagttccagctacctgggaggctgaagcaggaggaccccttgagcccaggagcttgaagtcaccgtgagctatgttcatgccacctcactccagcctggacaacagagtgagagtttgtcttaaaaacaaaagaaaaaaaccgacaatgggaaagttttataacctctttgtgccctcacccccattcttttttgaaatttgtataaatttagagagtacaagggtagcttttatacctggatctattgcatagtggtgaagtcgggcttttagtgtaagtatcactttaatagtgtacattgtatccattaagtaatttctcatccctcacccacctcccacccgtcggagcctccaatgtctgttattccatgctctatgtccacgcccaggttgtacacattctttagctccacttataagtgagaacattgtgtccccttattctcatcagcaacatggtacccagcgcccttctcctgctggtgtagtgtaaactgagtaagcactttgcagacttgaagaagccagtgattatttactatttgcactaggcgaaatccagccttgggtgtgccctctgcagtccctgccgtgtccgtgcatgttagatcagaacaacttcctcaagtgtattagaattagaatgttaagaaatcaagaaagctctcaaggggtgatgtggccccctttttaattttaatcacagattaaaatgctatcgagaagaggaatttgctccaagagaagagggatttcacagtccctcgccttgccccagtgcactgctttagttgtttgaaaaaggctgccagaaattgggtaaggatcaccaggaaaaaaaaaaaaaaaaaaacacaaaaatctgaacatgccagcgccccctgccacctgctcccatgaaaaggccaattcagtcggctgtagtggaaaacgttctcccgggtgttcattagctggagggaggctgaggatgcagtttggccgtggatttcaatattcccttgtaacgttttacaacccagacccagcgacaatggcgtcattcattgcactcgctcacgtggaacagaacatgagagaagggcagagctggggagaagctggtctgtgggcgctgatacccaaggccagctgaggtactcaggacccccagctcgtgttggggtcgggggtcccagactcttgtcagagcttgtccatgggatgcaggtgtagctgcttgatacagcagagagcagtgagatttgactgttgcaaactaaagtttctgcaaagagtaggatagatcagtagatcttgatattgcccgggtggagccaatatccaattctctcattaccagcatgctttataaagtgggatttgccaagtagttggtatggaggtaacaattgcttattattaagcattagttaggtggctgatataatgggcttatggggacttttatcactcatccccgttccaccattccccttgatatagggacttggaaggaagggcgggaggggtatgagggatagaaggctatatattgggtacagtgtacactgctcgggtgatgggttcatgaaaatctcagaagtcaccactaaagaactaatccatgtaaccaaacactacctattcccccaaaacaaaaaaatttttaaaatgtcatgtgaaaaaaataaacatgataactgataggaaaaaaaaaggttaaatgaggtcataagtgtggggctttaatctcacaggatggtggccatataaaaaagaggaagatagatagatagagagagagagagagagagagagagggagagatcatcccccactctaaccctccctgcctggcatgtgaggacactgagggaaggcggccatcagaagcgaggaagacaggcatcacccgaaactgaccatgctagcacccacatctccagaactatgagaaaatacatttctgtgtgtgtgctttttttaaagtattaggtggcgtgagttttggaataggattgaccctgggtgagactcagctttgcctcttagctgtgtggtctgggacaagtcacttgacctctctgtacctgccttttcttttctttcttttcttttttcttttctcttttcttttcttttctttcttttcttttcttttctttgctttcttttcttttcttttcttttcttttcttttcttttcttttcttttcttttcttttctgagacagagtttcactcttgtcatccaggctggagtgcaatggtgctatcttggctcattgcaacctccacctcccaggttcaagtgattgtcctacctcagcctcccaagtacatgcccagctaatttttgtatttttagtagagacaaggtttcgtcatgttgaccagactggtcttgaactcctgatctcaagtgatctgcctgcctcagcctcccaaagtgctggaattacaggtgtgagccaccgtgcctggcccatctgcattttcttatctctaatgtaaatgtaactgtacctgtgaaatgaggttcttgccaggatcaaatcaggataagcatataagtcaagcagtacggtggctggaacattaggaggcacttgaagaacaatgtagatgagaatgatgatgatgatgattaaaaaaagagcaggctccttttgctgcctgtatttctagagacagaagggcttttcaactttcactttaattctcttgtgtccttgcttcttcatggatgttcttaagctgtagaagaaaatagttttatcttctcatctggaggactttagagatttctgtcatactaaccacgtctctttggttgaccgttcctttgatccatggatgagctctgtgaaaattgccccgctgttgtttgattctaacattttctttcctttgcatgtgtaattctataatgattgagaagtcacttccccattccatgcccatattttgacacttgtcagaggggtttggggacatcgtatttcaggcattaacagagatgttcacgatcggtgttggggatgatgtttcaggctctttagagggaaacaagctgtgagggacaagtggttattgggatgatattgcttttcccacttctgtgttagtaatcaaaagcaggacttggcctttccagagagcaattttgcaatttggctgtactggaacggagaattccacggagtccattgatacattctcttgtaaactctctcagccaacattttttggaggttattttctttaattaaaaagaaaaactgttcctattaaaaatataaaaccaaaagagatttcccccttcctcttggagctctgacagcaaaatattggaactaaatagatctaaatagaattgtcggcaagttttgacaacttttataatgttttattgttattataatttttcttctttttctttttttcttttttttttccattacgtagcttgaaccacaaagcaagagctgtaaagctaattccattcccttcagcctcctggccccagggggagattctgactggtgcggctgctcggatggctccagctttggttctgagatggcacagggaagctgggctaggagacccctgggtgtcctgagggtgtctgtagactcatggaaacttggcagatgctctgtgttcctgcctggccactctggtgtgctttcacatgacaaacaaaggcagggacatagggtggagatgttcacacacttgagggggtagaagtagaaagagtcttgtaccccaaaaccctgctcccctaaaagcatattgtgttctaaaaattgaaagacatcattaggatacaatgcaaaagttatgaggaaatgattggattagaattctagttgtgtctctttctaactctgtgatcttgaacaagttgcttcatctccctgggcctcaacttcctcatctgtaaaatgggatcaaagataatacctatcacatagagtcatagaaaggatgaaatggacgaattcaagatccttcaaaatgcgttacgtgtagctctttgcgcatgatattatttcaggtatactctttaattttaatagttaagcattgattgattgattgattgattgattgattgagacagggtttcactctgtcacccaggctggagtgcaatggtgcagtcatagctcactgcagcctcaaactcctgggctcaagcaatcctcttgcctcagcctcctgagttgctatgaccataggcacataaacattcgtcttaattgcattaaaataactataattagcaccacaagcctgtaatttcacagatatgatcacttatagtgaagcttaacttatttagataaatgattaatttttaaaatgtcataagttaaagaatagatggctgtatgtcatggtgaaaattgtgtctgactgaagtttgggatttactgacacatgctccttctaggataggggttcttaaactgtttgatgccatgggcctctctggcagtgtgttgaagcctatgaatcatctctaagaataatatgattaaatgcatgaaatagaatacataggttacaagagaagccaattatatttgaaatatagttaccaaaatatgttttaaatggctgtttagcaatatatgcagtttgtaaatgccatgcccaagattccctatccccatcctaaatgctggatatgggatgttaggggtcaagctcttcttctctcacatacttggatatttctctctttgtcccttctatcttgaagcacccccacccccaccttctctctactcctctgcaaccttccacatcccatccattccccacctctctcatttcctttgagcctcctgctgctgcacagcacgactttccttcttcccaggagaggtttctactgagtccttctgaggaaaaaaaatgggaacacctggtatgaaatctgaaggtaagggaatgtggaggaccagtcctaagagtgtgaggggccagattttgagcacactgagggatgctatacctatgatgtcatggaatttttattatgcttactttgcctgtgtgagccctgaagctcaggggagggttgtgtgtcagatggacacacagcctgtaagggatagggatggggcctgaattgggagctgcgtaatcttagatcccatgctgattttttcttttcttttctttctttctttctcttttctttctttccttttttgtttcttttttctttctttctttttaaatcttctatgtccttgttcctccttctttctcattttctttccctctcttttttccctccctctattctctctgcccaaaacaataacagtaatgacgatggttgccatttgttgagcatttactgtgtgccatgtacctttctgagtcttttcatggttaactcattaacccgtttcttctatcaacagccctttgaactggggacattcattatccctactttacagatgggaaaactaaggtatggagaagttaagtatatcagtggccacaaggacagaagctcaggaggaaattctgacactagcagcaatctatccagatgagagtaacttaggattatacctgaccttcctaggttgtcagctaccagtttttactaactttgggcaatgacctgagccccaccttaaagatggacacccacaggttaagtctaaataaatactcagattaactagctttcaaattagggaatttaaagacatacatagactaaattgacatatttcaaaataccatgtgtgtttattgattgttaaaaggggttcttaactgggggtgtttatttacttttctgctgaggtatagaactgttggtaaatctacttgcctaatgtataaggcatgaaaaattagtacccaaatatacatttgtgaaatatgatggacatgaatataactggatcattttattcatcaaagacctcttttttttccttattctgtgacttttctggtggattctctcacacctggttcagccactcaggaaatctgtatcagggcactgataggcgttatctcccatcttttctctttcagtaaagaatatcccgtggtccccaggagcaccgtgaggcaaaaagtggcctccaaccacagtcctttcagcagcgagtctcgagctctctccacctcatccaatttggggtcccaataccagtgtgagaatggtgtttccggcccctcccaggacctcctgcctccacccaacccatacccactgccccaggagcatagccaaatttaccattgtaccaagaggaaaggtgagtgtgatcacccctggtcaatttgctttctttcttaccttttcctttccttgggttgggggtgagggggtgaggagtattcatttatttactttatttatttaaaaatgtaaacaacacaaaaatatatggagataagaaatttaaaccaaacagctaaaacaaaaagttcccttgacatgttcctacccccagttccagcccctcctttggagaaagcttatttgaaatgttcagacctattgtattcatttatgcacacatacacgtggcgagtgcagagaaagaactagatttatttttacttttttttttcttttttttttttttttgagacaggatcttgctctatcacccaggctggagtgcagtggtgtagtcatggctcactgcagcctcaaccacctgggcttaagtgatcctttcacatcagcctccctagtagctgggactataggcatgcgttcacacactgtactaaatttttgttgttgttgtagagacagggtctcactgtgttgcccaggcttgtctaaacctcctgggctcaagtgacccacctgccttggcttcccaaagtgctgggattacatgcctgagccaccacacccaaaattttttttaaaaacttttaatatagatgaaatcacactgtatgtattttgcaacttgctgttttttttcttttaaactttagaatgtgttttgggtatctttttatgaacctagactgccttattttatttttaactgctaaggaggaagaattgactggaaaggataaaatggagtttattttgtcactccctctggtaggcagggaggttgcttgagtggtccctgatggtattacaagccgtgatgcaggaaaaccccttgtgactatcaatgcttctctggcatatgtgtcagtgtttctcccaggtggattttgaactctttttttttttttcctgatcaaaaccaacacacacacacacacacacatcacaaatgattttccccgtctcatcccccatttaaatctactaagctgaggcattccgcagttttctttgccacatgagaaataaatggcttttttttttttctaagtcatccaagtccaaaggggctaagctaaagaaagaattttctggtggcccttcttgtgagccagaatagaagtgtttggcacaggtggtgtggtggagttcagctcgatagaaccattgcttggtgtgagctgtagatggtatggtggggagactgcagcctttggggacagagagatgcgggtttgaatctcatctctgctccctgcttcttgtgtgacctcactcaggtgttctagcctctcctagcctcagtttctcactttgtaaatgatatgtttcctaaagcatctgatagttagcaagtacgcagtaggtggcagccatgattgggtatgtggcagatatcgctccagaaggtgattcccaggaggaatctgcctcttgtctttggactggcattaatttaatcagtcttcccagagaagactgcctctctaggtgagagcttgagaagacagatacagaagggatggggtaggctaaagtttacatctgtggtctgtagaatcaatcaggatgaagttcacctttgcaatttaaaaattttcataagtagtgacaagttgcttaacctttccaagcctcatttttaaaaatctgtaaatatgggctcagggtacgacttgtctcataggcttggtgcagagatgtcaaaaaatcatacacatcatatgttatctcagggttgactcagaaagtagtagctgttttgctctaaaagacactaattttaatctacaaagtggcctgttgaacctcacagcctcagtggtcaacacaagcctttgtgaatccagtgcccagtgcctagccctttaggaaaaaataactcgctaacaaccaatgggaatggatgctttggtagctttttctggagctggggttacatgaggaaagtaacatagtttgactatttgacatttaccaatcttgcgttttaaaggagggaagagctgtcattggtatttacatggggctaggagctgacctggatgaggcctgacttccagacttacctgaagccaatccaaactccttgaatctcaaaggcctgaacaatatcactccaacaggccccctggcgtgactcccggcacgtctgctgccggatggactggagaccagatgcctgcaaatatgtctgcctctttaggcatgagcaggaggttaagaatgtcctatgggacacaggtccctgaatagagattctgttttatattatatttaagggtgcccttcctaagtcccagatcgagctttttcgacaacactatggagtagatgctattattaacccactttatcaatggggaaactgaggctcagaaaggttccaaacaaaaactgccagtggttcttgaaccccagcctggtctgcagattctatacgtgtgcatttcaccactactctataccgtcttggttacctttgctcatctgctacaatctcaaaatttcattttccactgaagatctgtctttgagactgggtcaaacatgctgattaagagctcaccaggtttgaattcgggagctctaatcgattaaattaatgccagaccaaaagacaggcaggaagaagttaaaaaggatcatggtgctttttaggttcaatatttacagcagcatccttataaatgcatccctgaaggatgcggcagggaggctttgaatgcacggttcacaaacctcttaggttatgacttgactttcatggactgtttgttggatccttggatgagcttaaaatcaacttggagtggccactggggaagctggagttgggggctgatccactgtagtaatactcacagttgacgacacttggcagctgtgtgcccaggggcaagttgttttacctttctgggcctcaactatcttttgtgcaaaatgaggataacaatagcacctgcttgatacggttgtgatgaggggaaatgagatcatccacagaaagcacctagaacagtgtctggcacctacaagtgctcaatgaacatgtgcttgccacaggcctgcccttgtgaagctcatacggttgcaagcaggtcggacattacacaagtaattataaattgcttaattgaaattgtgaagcctggcactgtggctcacacctgtaatctcagcattttgggaggctgaggctggaggattgcttgagtccaagagttgggactagcctgggcaacatagtaagactccatctctacaaaaaataaaaaattagtctggcatgttggcacatgccagtggtcctagccaacccaggaggctgagatgggaggattgcttgagcccaggagttcgaggctgcagtgagctgtgattgcaccactgcactccagcctgtgtgacagagagagaccctgtctcaaaaaataaataaataaaataaaataaatgattgaatgctataaaggagatatgcaaagtgttaaggaatatcaaactggagtgtcagtctagggtaggcaatcagggaagcattgaggctgagatcagaggagactgagtgctggataggagaagggggaggtgtgagggtatccacacatagaggaaagcatgcatgaagccccttggctgagggagagcctgccccctggggagtgaacagaaggctgagatgttggcactcaaggcaagggcaaagtggtgggggatgagggctagaggggaaggcagggaccagtgagatgccagcctgtataagccattttaatgaaagatgtcagattttatcctaccaccagtgcacgtccattggagggatttaaatttgtgagtaacatgcctaagttctttatttggaagcagtcactgtgctatgatagcacaggactatttagttggcaccagagacccattgaaaggctgtcatggggtttgaaacaggagatggtggctccgaccagggtgtggggagaagctggagatgtgggtggaatcaggccttagtggctggttggcgataacaaggtgaagaattaccccactactttgtggatttggaaaccaacactgaggaacttacccaaagtcactcagctcgtgagtggcccagcttgagatgtatactgaggcctgtgggctcagggtgaatggggtatgcaccctggagaaatcctttcacctttccagaaactctgcccttctcacctccctccacccccaaaagggagctcccagtgacagggaacattccaaccgagggctctctgtcctgcctaggagacaacaaatagcaattcatcatcagcctccacactgtaaagtgataaggaatcagccgaggtttccttccagttgggattctcattaagtgataactccatgggtggttttccccctggcccctgcctgccccactatctgacttcccctcattgtctgtctcctttccaatgagcccaggagtcaggcccaatgaaatgtcacagggccaggcaggccggagggctccttgtgtttggaaccggctgtctccaaactatctctcccgatggactgagccaaaaaagctgggaaggtcttttatcaatgccactcaatcaaatccaggaccccagggcctgggagagcacttgtctgtctttctccctctcacccctgactctcacccccactcgcattagaaactaaaagcaacccaaataaagattctagcaaagccatgagctgaatcagatattcaaaggaaagttagagattgagaggggaaggggaattcgatatggaaaagggctttgcagggtgcattttctgagtgctatgttttaaaatgcgatttcacatccattcctttgctgattctccagttccctgcagcagtctttggactaggggagatgccacccatctctattttgcagggatctaatggaggaccaagagacagggttagattttaagcttatgtggctgatgattggcagatctgggatggatgcatcagattaatctttatttattgagcacttaatgtataatggacactgtgctaggtgcttgggataagtggaggacatggtggaaaaggctcccgctctcaagaaacttgaattcttactggatgagacatataataagccagtaagtaaatttattggtttcaggtagtgactaggtgatgtttcaaactgagtcttttgatttctcgttgagaatcttcgcacaataccattccaacccttcctactttatgctaagagcatggggacaccaaaaacaaataacaacaacaacaaaaacaacaacaacaaaaagtcatccacccactcatccacccacccaccaatccatccacccaccattcacccatccacccacccatccacccactcactcattcatccatccacccatccatcactcatctatctatccactcactcatccatccacccactcatccatctacccactcatccatccagccatcaccccacctatccacttatccatccacccacttatccatccccccacccatctatcaacccatccatccacctacccaaccactcactcatccatcaacccacccatccattcacccatctacccacccacccatccatgcatccatccacccatccaaccacccatccatccacccactcatccaccaatcctcccactcattcattcatccatccatccacccacccacccacccatacatctatcctcccatccatccatctactcatccacccactcatccataagagtcaaggtttgctaccttttcatgttggctgagcatgtagggttgcatgaaatggaaagcctggggccatctgtcagaatgagcactgctttgtgagtcagaagacctgaattatagccaccttcccaacttgctgaaggtcactcagctagaaagattactactctgagtttcagggtctctgtctgggaagactcgccaatggttcttcatctgaatgaactgaattggcaagagaaatgacccatttgggaatagtgaaaatatttgctcaataggattagtatttaaaagcactctgtgagctttccagctctgtaatctacccaaatactattaagtatgggacaactttcagaaagctatctatccagtcttccaaaagagaaagagggaaaagagaatggacccaggtcatttggacagacaagatttgaatgctttatgtgcaaggaagataaaaactcaactgccctcattattacctcaattaaatctcataaaaagttcaggtattatctccatttacaatcaagaactgagattggaatgacctggtgattcatccagtcacatggcgagcgagcattggagctgtaactctgtgccttaatatctgtgccttggatgcattactaaattcactttatccggaatcaaaaatatctagaaaaatccaaagtactagggttttctacagtgccatgccataatgagtggtcagaatcaggaagaatttactgttacctaagagactcatttcggtttaggatagttgcaatataactgaccactcttaatatgcaactttctgaagccgagttgtggactcatctcatcagaagacttgatacttaagtatagcccatttaccaaccctgaaagttaatcatgacttggctggagataggtctttgctgttgaacagttattgggctctcaaagaagagaaaaaagaaagaaactgagccataaccaaaataaacacagagattacatccagagcatttatcatgactgacctgaaatttggatccttgagttggaatttctttacaatgtgatgaggcctgagaggaatttgagaatgttcaggacctgctttcatcaataagccaagattgagtttttcttagtgctctgcattagatctttggggtattaaagactggaatgtataattttacgattttccaaaatgtgttccggccgttttcttattattcttccttttttacttgtaacaaatctggaaggggatcagaaacttgaaaatagttagtttgccttgtttttttttcctcttgctaagggtgccctgcagctgtactttctattattgaaaagggtaacaccctggttaattggaaaacccaaaggttatgattccagcaacaatggaaacactcaggtttatgaatctgggggaaggaaggaagagttgaaggaaaggaatcaagggaggaggtggtgaggacaaaaagaagctgagtatagcaatgtcttcaagcctccaaacaaacaaacaaacaaacaaacaaacaaaaaaaaccccgcacagttaaaaggtgaaaaatgtggccgttcattcatctggatgttttcaaacatctgcatggttggcatgatgtagatagaacacctggaagagtgtgtttttcttttttttttatttttggtacaaatttttttggtatcctataagtcccatatgtggcccagaaagagtctagtggaaataagtttacttgctgttaagtgggcacaaccctaagagatatgttttgtttgtggatacttttggcttatctgtgggtgtcacttggacattgatacaaatggagctgattggtggaatccaaacccaagctactctacctgggtttgggagctattttacaaaccagtccaaagccaaaggatttagtcttgagtcaatggcttacttgtgtctttatatctgaggaccacctctcagtcacagagtgtcagcctccctcacttactgctcatggtaggatagactgggattgaggacatgcaccaaaaacgggatcatgttcaccactctatctccagcacctggcacaatacctagcactttggagcagctcagtaattatctgctgtatgattgcatgagtggcactgggtattagaaatctagagagttggaagcaaggtgtgtaggcaaagtcaatccaatctggcttagattccagcctctgttccttctcagccatgtgaccttgggcaagtcacttctctgagctttagtttctgcctttatgagacaggcattacagcagacaccttgaggaattactgtgagatgaagagtaaggtcatgtagtaggtactcaataaataatagctctgatcatttcctctcgttatttagttcagcattctgttttcatggccatgagccatcacagtgagttgcatggatgccccagtgtttcatttttcttcacttctccaaagacagacataatttcttaacatttattgactagaaagagacagaaagatgaggaaagagaattttcagtttggaaggtaaaatttcagataagtaatgagtctgtgttgaggtttatactttggtagatatccccaagtattgcttcccctgaagggaatactttgagggtattattgtgaattatgtctgccatgagcctgactggtggtgttagccctgcaacaagagctgttcatgttgacggaaatcaggagactttacatgctcaatcttagttcttagctacccagtaaggtaagtattactcactttgattcagagatgatgatgagtctctgagcgtagatgccctgctggtatcacgcagatattaagtaaaggagcctgattcaaatccagacatgtctaggcttcttaacctggggtctgggttttagggagtctttgaaccccctgaaattgtatgcaaagccttgtatgcacatgcagttttcaaaacattgtgtttcaatgcagttttctaggaaagagcccagcactttttcttgttttcaaaggggccagtggccccgaagtggtgaaaggagaccccctttcagagacaaaactatctccacttccctacactaggaaatgactagtacacagggaagggaagggacttgctcagcaggaaacagcaacacattaacttgtaccaacttaacaaatactaactaggcacatgcttacataaggaatcaggaaagaatttgaacattcattcaagctccctcccactcatccatgcatccatgcatccatgcatccatccatccatccatccatccatccatccatccatcgtacaaatatttattgcatgctttctctatgtatcaagacagtgaaaaacaagggctttgtggtcagactacttggattctaatcctggctctactgtttatcagccatgtgaaaccttgggcaagtttcttaacctccgtgagtcctttttctctcatctgtaagatgaggataatagtaaaacccacctggtagggttgttgtgattaaatgtgttacttcctggagagtgcttagaatcgtgctacgcagagtacacactgtatatgtttgttttgacttattgttgatgctgttgttaatagtaggtgtttactaggttctgggaatatagtcatggataaggcagaaaatgtcctgcttttatgaaatttacatgctggagaagaggaaagataataataattgctatttatttatttttgagatggggggtctcactatgttgcccaggctggtctcaaactcctgggctcaagtgatcctttttccttggcctcccgagcagctggaactataggcgtgcacaactgcacctggttagttgctatttattgagtgtttctgggctctggactaagtgcttcatgtattttcccatttaattctcaacactgccctttgtaggaagtgctatttcctaccctttccatcttacagatgaagaagctgaacccagaaaggtcaaactgtttgcatagaactccatagcccaaggtcttaaccattacaatccaaccccctttttttgtattcagaatggcggttagggctaacagtctctcaggacttattcttcagtactttggccaaataactgtctccacttttagctgcctggtgcctgctcctggcctcactgctgtctctcctgtcttcacagaggaagaatgttccaccacagaccatccctataagaagccctacatggagacatcacccagtgaagaagattccttctaccgctctagctatccacagcagcagggcctgggtgcctcctacaggacagagtcggcacagcggcaagcttgcatgtatgccagctctgcgccccccagcgagcctgtgcccagcctagaggacatcagctgcaacacgtggccaagcatgccttcctacagcagctgcaccgtcaccaccgtgcagcccatggacaggctaccctaccagcacttctccgctcacttcacctcggggcccctggtccctcggctggctggcatggccaaccatggctccccacagctgggagagggaatgttccagcaccagacctccgtggcccaccagcctgtggtcaggcagtgtgggcctcagactggcctgcagtcccctggcacccttcagccccctgagttcctctactctcatggcgtgccaaggactctatcccctcatcagtaccactctgtgcacggagttggcatggtgccagagtggagcgacaatagctaaagtgaggcctgcttcacaacagacatttcctagagaaagagagagagagaggagaaagagagagaaggagagagacagtagccaagagaaccccacggacaagatttttcatttcacccaatgttcacatctgcactcaaggtcgctggatgctgatctaatcagtagcttgaaaccacaattttaaaaatgtgactttcttgttttgtctcaaaacttaaaaaaacaaacacaaaaagatgagtcccaccccccactaccaccacacccatcaaccagccacattcacgctactccccagatctcttcccccattccttcttttgggctctagaaagtcttgcctcattgagtgtttttccctagtgcgtagttggagtctgtccctgtcttggtgttaatgttgacattgttatataataaatgataatatatttttttctttcaattttcttaatgggacccagtcccttatttggggggaggtctgaggcaagtatatttcaaaatatgtacttgcgggattcccttcaagtaaaccatccctgaaacctaaattcacgtttccccttgactaagaaaagcacctacctctgccatgtgatgtttctgaaaagcctctgtatgtccccatttgctttggttttgtcctgccttctccaatatcacgtgctcagttttgcctctacttacccatggagtcaggataacactgacgctccctggcatcctatcttattcagccctaccatcttgccagctctgtctttccagctgtctgtcgctaaaacgtggcctatagcttcccttccggaaagcttgctttgaaaaacttaaaaagcccccgtttacatgtaggcaggactgtgataacagtgcaagctctgtgttgacaagagttgtggacaaaaagccaaaataaatattcttcctgattaaaaaaattttttttgaaaaaaacaaggccagccccaaccttccaaacctccatcaccaacaacccaaactggatgtcaagcaaaatgcacaattcctacagaagaggcaagacacagtcaccaatgatatctcgccaaagaaaccacgcccacaccaatgccgacacaaaactgtgtttactgaaagccgaaaacagtattaaaaaaagtgtgtaagtaaagtgttatggtagggttcttcagatgtaatattttactggtactatttatttataaataggaattctaattaagtaataacatgaaatgaaacccagcataggagctggccaagagcttttaattttattgatactcaaaaccaagtttgtgtttttttgtttttttttgtttttttcctctttcgaatgtgctttgctttttttgattaaaaagaatttttttttccttttttataaacagaccctaataaagagaacagggtaagatgtgaggctgagtgtgtttaagtacgtgagagagtgtgagtgtgtttgtaagtgagtgtccctatgcgattatgtctctttacgttgctaaggggggagggtgaggattaagtactcgtgccttatatttgtgtgccaattaatgcctaataaataccatgtgcttaaacaagtacaaggaagttgaacacccattttttttttttcctgttctttctaccgactgaatagaggggataggaattggaggaaacaggaagaggttgtcttgcatgtgaatttctcacctcacgtgatttctcatgcccatcgcaggagaatttgggatccattgtccttgagtgtgatgaagctgaatatatgatccactggtttatatccttggaatgaggttacttgttttaatggaatttgtgtaggcactggagaagaaaagtctttaggaattccaacctatttaaaatggtatcggtcatattatatgtaacacctaatgtttgggtttttcaagaatctctttctctgaattaattgttggagccaggcgttttgggggttctactgcaaataactttatgaaccatcagtgaatcagatattgattttaaatccatggatctaggatttgtgaacttgagctctaaaacacatatgggacagaagagagcagcaaattggtgagtacatttgtgcagcagatttgttctgtttttgtaattttgatgcccgcatccctcaaattatcaagagctatcaaatatgccacatccccttgaaaaagaaacaattggcttgttgattaca

SEQ ID NO: 16234 - DNA, 11689 bp, Human
ttggtagaaccagattgtggtctgaaatcttttttcagaaatgctgccatcgtgtggcactgcggagctatgaccagaagagtcctgtaaagggtcgtatggttcatctcaagatggctgggctccagcataatctattcctataattaattctagcttcatattgaatcattcccgtgggcacagagtaaactacagtaaatcctgtggaaattttgttgtttttagaattttcggacttccctccactaaattgacaacatgacacgcttatgcgggtatgtttaaaggaaaaaaatagtttttagaagcagaaaaaagaagtctattttgcaactttataatctgtgtgctttctattttatagagatagtcgtcatcttacttattaaaatgggtgcttattacctacaaaccaatcatatcaattcatctggaatacatccaatttaagggagacatatttccccctaccaaatgttcatgaaacctatgaattagctatacactatcactgcaagacattatttaatctatatttatattaaaagtaatatttggcaaaaggaagctgacactttaggactaataaaaaccacaattacttttgcagcaacctaataataaataggaccatttatttttcatctcaattacacacaagtcttaacaataaaggtgtaaggtaaataaatagtgcaatctgcatttcacaactgagaaagcaaatgaagataagtaatctcaaggcaatattaaatattttaaaaggacccagagctctgctatccctgaattctgctctaatattcggactttccctgtaattttctttcattcagacaccttttaaatacctagtaaagtgttttttaatacagaaatttttaaaaatgtttttctttttaagtggcctactttacataccttgggagaaaaactagaaaaaaagatgattccaaaatcgaatctgttcctttagaaatgtgcaaaatttccttattgatgcatacaatttaaagatcttacgtctactctcattttaataacctgttcttttaaaggacattacaattcgtgactgcctgcccctcttaaaaatttcataatagttaacacacatatagtccttaagatacgcagagcatttgcatctaatatgtgctaagcattgctagtttaacatactaattcatttaaacccctcaaaaaccccatgacctaggtaatagtattgcatttcatggatgagggaacaaggataggtaggctgggcgatttgcccaaggttgcacaggtcagcagtgacacagcggaattcagaaccacggtctggctcctgaagcagccctctcaagcagtcatcctgctctcagtcagaaactgctttacttctgcaacatctagaataaattaccattcttctatttcatatagaattttatattttaatgtcactagtgccatttgtctaagtaacaagctactgcatactcgaaatcacaaagctaagcttgagtagtaaaggacagaggcaagttttctgaactccttgcaggcttgaacaatagccttctggctcttcaataagtacaatcatacaggcaagagtggttgcagatattacctttatgttacttaaaccgaaagaaacaaaaatccattctatttaattttacattaatgtttttccctactttctccctttttcatgggatccctaagtgctcttcctggatgctgaatgcccatcccgtaaatgaaaaagctagttaatgatattgtacataagtaatgttttaactgtagattgtgtgtgtgcgtttttgtttttttttgttttaaccacaaaaccagagggggaagtgtgggagcaggtgggctgggcagtggcagaaaacctcatgacacaatctctccgcctccctgtgttggtggaggatgtctgcagcagcatttaaattctgggagggcttggttgtcagcagcagcaggaggaggcagagcacagcatcgtcgggaccagactcgtctcaggccagttgcagccttctcagccaaacgccgaccaaggtacagcttcagtttgctactgggttgtgcattcagctgaatttcatggggaagtccaaattctaaggaaaaatatttttaattgtaatgctgttaaacagacttaaattttctagcctttttaataagcagattagatacattgcaggtctcctggaacaaaggtgtctagatattttgaatgccaatcaaatttaaaacttaaaaatacttccactgggtcctcaaaagaacggaaaccaccgatgctaatcagaaaatagtaaaattaaattcccctttggaataattatacctatataattttcagtgggtgactgtgcaggaatttaaaagaaaagggatcttttatgctaattaaaccaattacaatgctattttttaaatgatgtatctcacttttaaggggaagaaaaccctttctgaatatgccactgctaaatttagctgttaaaatattcaccaagatacctgtatgacactgtgtaggcttattattacaaatagaaaagctgttggctattttcaatgttttcctttgaatttcaaatttttagaacatcttacttaaataacaaatttcagagatagtttgatttcacctaagtagcacctacttgataattaagctaaaagtcacatttaaagtacatgttggaaaaatggataaagcaaatttttttcatttttttctgtgagttttttcttctctaaaaaatattcccatactagcttattaatataattaagttactgttgatctgtttgtaggtttagagagctagatatataaggtagtaatggtataatttctggaactctaaattttaaagttgaataaatacagacttgcaaaatttccctttcccttgcctaatagtgaaagatggataataggtggcaatataaatattaacttgaaagactataatactaaaaagaaaaggcatctctaagaagtagaaaagattctatagaaaatatattttatttgtgatcattttgtaatgtggtagtataaaaaggtatcactgttgtaacctatgaagatgtcagctattccttatgaaatattttgcaggaaaactcactaccatgagaattgcagtgatttgcttttgcctcctaggcatcacctgtgccataccagtgagtacagttgcatcttaaagaaaattcctgaaaataactgaattgtgtgcttccatgtgctaggaggacattcttgtaatctttcttcatcttttctgtttctaaggttaaacaggctgattctggaagttctgaggaaaagcaggtaagcatcttttatgtttttatatagttaaatcatttactcaattatggcgagaggtgcaagaaacgtatttgctgcgatattacttatcttctcagtcaaatccattggtttacaagtattgattgactgcctgctatgaatctaggccagtaccaagcacagtatagtttttaataaatataagtttataaaaccaacccagatattttaaatataataatatctaggcatgtatgatgagttatcgcatgtaagataagttatatgaagttgtgtgactttttttccattagtccacatactgatctaaaagcagaaaattccagcttttgctttgtttagtggattgctaagtttaaaattcacattggatattagtcagaactgtttgtatgaccataatattcacaatattgtctgagatattagctgagaagcccattgtgaaaagaaagtctatgtgtgctgtttgtatctattgtgattgtcagctgatgttagatcacattttctaaccaaacataagaccaaccaaactctttattataattatttgaccagcactaaagatgtacctacccctccacaacagatgaaactgtgccagccaaacaacaaatgggcattgtccccagaagcttggacaaaaaggcacacagagttcaattccagttgaacagaataaaggccaaaatagagctgccttgggggtcactgcaattagactgcttaatgaagacattaaaagaagtattctgtgttcgtttgtgtgtggaggggtgtgtgtgtctgtttttcaactgatttgaaaatacaggtgttgaatcctaataataaaccagaaaaattaacatctccagagaagatagaggtcatactatttgaggcaagaattagcgtctttttaataaacgaaaatatggcaaagatgcattttagaaggcacgtggagctataacaatttaagaaatacgtgaagagctcaaggctcagccttctagaatcccagaaacttaaagctagtaaaaaattggggaagtctctaaggatatatgcctgaaaatacacactggttatctgtgagtgttaggattactgggtggtttttagtctattcattttgcttacctttattttcttcatattagtttttaaaaattataaatgtaacttatacatccattctctctgagcctgtattacatgtgtcatgagaatagatagatagatatgaaaaagtgaagagaaaaactctgaactcatctggtctcactgtttttccgccttctttttttttttttttttttttttttgagacggagtctcgctccgtcgcccaggctggagtgcagtggtgtgatctcggctcactgcaagctccgcctcccaggttcaccccattctcctgagtagctgggactacaggcgcccgccaccacgcccggataattttttgtatttttagtagagacggggtttcaccgtgttagccaggatggtctccatctcctgacctcgtgatccaccctccttggcctcccaaagtgctgggattacaggcgtgagccactgcgcccggctgttttttcatcttcttaaagcaaggaaccccttctttcagcaaaacctttcggagaagcccaatactaagctcctctggttagagccagccatgagagaaactccaagtacttctgactggttctctctctactcatccaccccttaggtggctgcagaaggaactctgtgcaacccccagagttctcattctcagtgacagggaaatgtaatgattggccctggatgattcagcagatcagatgatacttactcagagcaatttccactcctttgcagtagcatattatcagtattttccagataaataacttggctaaagaaaaatccatttcatttacatctttggcaccttacagcaatagaacttttgtgcaatgattttaatattatatttctacattggctgataagatacatatggctattgagcactcaaaatgtgggctagtgcaactgaggaactgaatttttatcttctttttttttttttttttttttgagatggagtcttgctctgtcacccaggctggagtgcagtggcgcaatcttggctcactgcaagctctgcctcctgggttcacgccattctcttgcctcagcctccccagtagctgggggtacaggtgcctgccaccacgcccggctatttttttttatttttattttttttagtagaaacggggtttcactgtgttagccaggatgttctcgatctcctgacctcgtgatccgcctgcctcggcctcccaaagtgctgggattacaggggtgagccaccgtgcctagccatttcattttaattaacttaaatttaaatagctccatgtggttagaggatactgaattagcacagtcttagagagttccttcttgttccatggactggacacaatgaagattaacagtaattaaggtcacttctggtttagatgtgctttatctgagaggaaaattcagccagcaaacatacaaaaagaaagcacagtgtgaagttcggtgttaagagctagtttgcctgcgtttgaaccctgcctggctctgccatttcctaccacttaactgcactgtggctgagttttctgatctgtaaggtgggaataataatgatacctatctcataggggaatgaaaggatcaaatgagttcatatttgtaaagcaatttgaaagagtgcctagcccacagtaagtgctacataagagtttgttaaatgaatctgcaaaaaaaaaaaaattacaaaaaggtacctaagggtccgggtgactatatgcttccatcaagactagtgaagaatggttgttttttccattcatccctacatttctttttttaataatgataaacatgcaacttttttgtagctttacaacaaatacccagatgctgtggccacatggctaaaccctgacccatctcagaagcagaatctcctagccccacaggtatttttaaacttctcataattaaactacagtgatgaaagatagccacactcaggccatttgggctgctcagatgaatcctgcctgcctgctggcaaacatgtgcttaggacattgactgatctgccatgttggcttctctctgtgttaagccatccacagatgaggctgaaaaataaaaactgctttggattaaaaaggttaacttttgaataaaaaagctaggcatgtgtgatgcgcactaacacgtgccattccttcttcagaatgctgtgtcctctgaagaaaccaatgactttaaacaagaggtaagttctcattttcaatcagaggcccatcatgccttgaagagatgaaagaaggcattgcctggattctcttctgatgaaatttcattagcaagttttccagctaattggcagtctaaaacttgctcataaataaaacatgtatttactaaatatcagaaatactaggtttcctcggataagtttagcattacagaagatgtttattaatgcctgttatttgaaacattaatctgcttgcaatttatttaaggtattttgtagatatctaatatctaataagcatctaattaatgcatatcaaagctaagattttgcctttaggaaagttttctttcctaataaaatagtttatttgacaactattctttttattaggatcattcatatatttgctaagcaaagagtaaatttattttccttaagattcaatttgaatatactaagaatattaaagcaagttagataaattacccaatatatttgtcaatttgaaatttgatagacattagttgtttaattcaatgggcagttttgagctgcagtttatacacacatgcataacagagtcacctttcaattatccatgttaataggaaagtggttatagattttagtacacacattaaaatatggatactcttctcttttgataaatctcatttcaaataaaaaaaccagtctcataattatgtatctgtatctattacatcattgaatttagtaaataatgtttaatatgtataaggaaaaacaatgttattgacatgaagattatactcacatatttggcttgaaaatatctataaaaataatttctgttgcaaagtaagaaatgttcttcagaatgttattaatccctgtgttaaaagagaaattggaagatgctcactttagctcctaaaagccatggtatgtactgtgaatgcaaagattctgaaactaaataaaaagaaagatagtaaaagactaatgtgctataaaggctaagggaaaataaaaacccatatattaattttcccggccatcttaattttcagacccttccaagtaagtccaacgaaagccatgaccacatggatgatatggatgatgaagatgatgatgaccatgtggacagccaggactccattgactcgaacgactctgatgatgtagatgacactgatgattctcaccagtctgatgagtctcaccattctgatgaatctgatgaactggtcactgattttcccacggacctgccagcaaccgaagttttcactccagttgtccccacagtagacacatatgatggccgaggtgatagtgtggtttatggactgaggtcaaaatctaagaagtttcgcagacctgacatccaggtaaatcctttaacagacacacctgatggttctgactagcgctcaagtctaggaaaccacagtttgcatattcattcattcattcatccattcattcatccattcagcaagaattcattcatattctactttatgaccattgaatacaaatctttttctgcttggcggtttttgtaagtctacataatttctctctagatttgattctcaaacacaattctactttttgaaatcctggatcacttattttcagattaaaataaatggaaaacaccaattatttaaaaaaaataatggtcatgttttgaagttaaatacctaagaggaattgtagttgcaaattacactgaatccttagtcacagaatctggatttgacatagccttgccgtttactattctctttactttttaactaacaattcacttcctctttatgtaggtttcaatataatgaaacctacctcataggtttcattacatatgtaagtgatgtagttattaaactaaatgagatgacatatgtgaaaggccttggtaaagtactatacaaagtaacatgctagtattatttcagccagatttagacaatttttagtataagatgacctaaaagctagagagtggaaaaggattaccatattcccatccctagccgttcatataattattcttcatttgtgccgtgattcagtaccctgatgctacagacgaggacatcacctcacacatggaaagcgaggagttgaatggtgcatacaaggccatccccgttgcccaggacctgaacgcgccttctgattgggacagccgtgggaaggacagttatgaaacgagtcagctggatgaccagagtgctgaaacccacagccacaagcagtccagattatataagcggaaagccaatgatgagagcaatgagcattccgatgtgattgatagtcaggaactttccaaagtcagccgtgaattccacagccatgaatttcacagccatgaagatatgctggttgtagaccccaaaagtaaggaagaagataaacacctgaaatttcgtatttctcatgaattagatagtgcatcttctgaggtcaattaaaaggagaaaaaatacaatttctcactttgcatttagtcaaaagaaaaaatgctttatagcaaaatgaaagagaacatgaaatgcttctttctcagtttattggttgaatgtgtatctatttgagtctggaaataactaatgtgtttgataattagtttagtttgtggcttcatggaaactccctgtaaactaaaagcttcagggttatgtctatgttcattctatagaagaaatgcaaactatcactgtattttaatatttgttattctctcatgaatagaaatttatgtagaagcaaacaaaatacttttacccacttaaaaagagaatataacattttatgtcactataatcttttgttttttaagttagtgtatattttgttgtgattatctttttgtggtgtgaataaatcttttatcttgaatgtaataagaatttggtggtgtcaattgcttatttgttttcccacggttgtccagcaattaataaaacataaccttttttactgcctatataatgtttttaaaggtttattttggtttcaattgatacataataagtgtacatatttatggggtacggtgtgatgttttgttacatatatacattgtataattatcaaagggtaattatcatatccatcacctgaaacacttgtcatttatttgtgctgagaacattcaatcctcttttctagctattttgaagtatacaatacattattattgactatagccaagctactttgcaatagaatactagaatttattcctcctagctaactgtaactttgtacccattgactaacctcccctcatccaccttcccactctcccagccgctggtaatcactattctactctctacttctatgaggtcaacttttctagattccacatatgagtgagatcatgcagtactcttccttctgtgcttggcttatttaacttaacatcctctaggttcgcctatgttgtcaaaaataccaagagaaaacatgcacaaactatacatctaagaaggaattaaaatccagaatacataaggaactcaaacaacttaatatcaaaaaaaaaagaaaaaaaaagacaactcaaataatccaatttaaaatgggcacaaatctgaatagacatttctcaaaagaagacatgcaaatggccaacaggtatacagaaaaatgctcaacatcactaatcaccaggaaaatgcaaatcacaaccacaatgagatatcatcccacccaagctaaaatggcttttatcaaagagacaaaaaataacagacacaggccaggattcggggaaagaaggacactcgtacactggtgagaactgtaaattagtacagccactatgaaaaactgtatggagacttctcaaaaaaacaaaaatagaactaccatattatttagcaatcccactgctgagcatataaccaaaagaaagcaaatcaatatgtggaagagatatctgaacttcaatgtttatggcagcactattcacaatagccaagatgtgcaataaatgtaaatgtccctcatgatgaatagataaagaaaatgtggtatatacacacaatggagtactatttgaccataaaaagaaattaaatcctgtcatttgcagcaacatggatggaactggaggtcattatattaagtgaaataagacaggcacaaaaagacaaatatcgcatgttctcacccatatgtggtagctagaaaagtggatcacatagagatagactgtaaattggtggttctacaagaggctggggagggtgagggtaaggggcagatgaagaaaagttgattaatgggtacaaatatacagttaggtagaagaaataggatctagcatttgacagtacagtagggtaactatcaataatttactgtatatacatttgttaaaaaccctaaaagacaagaattcaagtgttcccaacataaagcaaagataaatgtttgaggaaatggatatctcagttatgctcattggatcattacacactatatgcacacacaaaaacatcatatgtgcccccaaaatacagacaactattgcatatcaattttttaaataatcaataaatttaaaaggaaactataaagatattagataaatacatgagtgagtaacttcacagtctgggtgtggagaaacctcttctaatgatgagaagacaatgccatgccatagtccttgtagatatcattagtcaggtgcagcagccccttaggctcccagcatacttgctgcagtgggcacttcctcacactcacctgcaggtgatggctggattgatggtgttgttcccacatgcttggcaaggggcttggcactgtgctcaaatccaagggcatgaccaagttactcctggaatcacttatttgaatagtggtactatttaacaactattccctgcatcacttctctattagtcagggttcattcagaagacagaaaagagaccagtcatttgaacagggaaaatttaatttaaagaattatt

SEQ ID NO: 16235 - DNA, 18049 bp, Human
ttgtcataaggggtggtaactaatcaaaaactgcctcaacgtttcctctgctccctatacatgtgcatcctgatctgacaccaaaaggtagagagtatttctccttatgaatctgagatctccttgtgattgattgaccaacagaatatggaaaaatgatattctaggaactcttggcccccagccttcaggttgtgagaaggccaagccaaggagaggccatgtaaagaactaaagtgctcagaattacagctccagctgagctctcaggtaacaactatgaaagtggcatctgaaatgttctgccccaactgagtcttcagatgactacaatgctagctgtgagagataagaaaatggtagttgttttaaaatgcaaagtattgaagtggtttttgatatagcaatagataacaaaaatgcctagttttattgtaaatgttatccacagttttcaattttgttatctaattgctcctctgtttttatgtagggatttgaagagagtctaaaataatgtcttgtaatgcaatctgcccaaatctgcccagaatccaattctgtcataagattataaggttcttctagcatagatctcagttaagacccatgaaaccatcagagagtgtaattcagaaccagagcaaatcacagggaatttatagcttccccatatggactttggctttctaatcaaccctaaatgaaaatagacatctctttcctcattgtctgcaccaccctcccccgcatattatagttcacactaaatatgttgataatccatatatctgacattagttgcctgaataaattgggcactctaattttctagatccatgttaggagcatcagctcaattttttttttaacaattaaagcatttttttaaaagttacagtgagttatgcagatactgtaatcaagttaatagtttggctaattttcaagccaatccactcagtcattcaaagagtactgagtgattattaagaactgttctaggtatccaggcactgattatagatcagtagacaagcaaacatccctactcttaaggaaattaaggtccagcagctgatattctctaaattcttgttcagtggccatcctgccgtcacttgaacacgctcctgggaaattgccaaacccatttccagctccctacaacttttagtacgcttcctcgaaaatgttttggtaaatatcattttatccatttcattacattttcagtggtggcacagagtcccttcaagattagtttccttggatgctacccagctagtattccccttaatccaattctgatttcaaagaatcattaaaatgtggcaaacagggaatgattaagtgttaagtgttagatctaaatttcttgaataacacaatagctacttaaggggggtactttagtggacgctttattagattagtaggagtttgggaactttgtgtgtatatgggggtggggagatgagaggaaaaggaggtgagtagtagaggttgttaaaagaggaaaaaggaagaaataaaagcccatattctcaaaaccaacaatttaaggaactctagtattttagtagctttctccatgtacaacctggaaatgtacattaacaggaaactttctacccacccctgcctccgcctttcccatccttgggtctgctgggatctgtcggtgggtagaagacattgtcattgttcataagactgcctgaatgtgaatgacatatatttagaaatcaaaataaagttttgggaagatcttcaatttaatggaaactagtctagtcatttgggaaccacaagagctttttagggaaaatgtgcctctgccagctggaggaagtgtgggtgtaccggggtcccggtgacaccttgtgatgtcagtcacccccagcctgaggttgattggctatgaagagctgcagcagagtttaaattcctgcaccatcagagaagtgtccagaatatcaacacaagagtggcttcattgggcatagatttcctctttgagaacatcaacctgatttttgagactttttgaaaaaattctttgtgaactacggagggtaagtcattttcatcatttaattttttaaaatgacttttgctggttgtttggaaaatattaaatatgtatacatgtttgaggcattataccatgtagagagagatgggagagctgcgctttgggtaaaaacagttcctatttttgtgcctgttgtttatgccacagtaaataatgatatgaaaatgacatgttaagacaatacagccaggtgtttttcttggtaatgctttaattagatctctgcatgacacttctaaaagggatagtttatagaacaggaggcagatggaaggtcattttgaaatttagttttaattagcaaaacgtataaaacttttacagtgtgtttcatgaataagggaatgtttgcaacctacaagattgtgaaaaaaaagctaaacttattgaatggcaggactttaaaaagaattttttttaaattaaaatgttattcatctagagagcatctagtaacatttattatgaactgcataagtaactaaaagatgattaaactactgaaataactgagggtgtgataattatgttttttgtattcatgttagcatgatgccttgaatacagttagaattcaataaatgttgaatataattatattttaaaatattgcattttaaaacatatattttaaaatgtccatatgtatttttatttactgtatttagtgcacttcttcatctgtgtgacgtttagaagagtccatgtgttttagcaacttgtcttccttaagagcagtaacttgtggttaaccatactttctgtttaactgaggcttgactatcttattttaactttgttgtttaaaaatgcgaacaaactattttctaaagggtattagtccacttacctacctgaaaatggtgatgtaaaacaatgtgcctcagatgcttagaggccttccaaatctatatttaattttgggggcacctcagaggtatattcctgtgattaaaagcatataatattggattcatcgtaattgacctgaagacacatacaataggaagaattggatttttttttggtttgtttgtttctctggattcctggtagagttcatatcctggccaagtttgattctattttcaaagagtaataagaaaacaaattctagcaggttctagttagttggattctggttaattttattattataaaaccaacttattttattattattgtttattattattaaagtttcctgctaatgtacatttacaggttgtacatggagaaagctaccaaaatattagagtttcttaaattgttggttttgagaatatgggctagaaaagtgcctaacacattgcatgttcataaatatttactgactgctaatgaatgaatgtattgttcagttgtgttcttgaagataacaatactaagacaaataaagcaaattaatatgatgaattgttttccaaaagaaaaaagagtctatgacttttcaaacctttattttcttcttttggcctatttccttcattttggtttacataaaagaagatatatattttacaaatgtatcttaaccttgagaaaatgctagaacaaatttccttacttaagagccgaaagaagttttggctacacacctgaaatcttgactttagtttccctctccacattctaaacatttggctcttttcaactctatgaaaacaattcacaggggcagaaattctctaatacaccgccttccaaatggatggaactcaagttgtttatttccttttgttacgtcatctcactgtagaatgacagcatgtagaatgtagaaataacattaaccaatcactgaagaagaactcaaagttctggacttttaattgcaggcttgtagctgtggttcacatttattattcagaatacggctactgcctatctgcttctactcttttttgaatagtagccaaaatgtttataaaagtttggagctcttgtttggaaatgcacttcacaaaattataattatttttatcagaaataccaaatgcaaacctaacaaggggtttaagatctgattttctttaatgcttacagttggactatattttttgggtggcaacatcagctctctcagaactctagagtgtcttttattttagtttactagacttgcatctgggaaattattgctttaggtcaggatgctaacgagtatttctagaatcctgagcaagttagggcatctttcttgtgttttagaatcttccatccctaagaaacttgagcacttggggcatgcacttctttgtgagaaaacacaacgttcattggtttagaataaatgcacaatggcatccccagttttctaattatttagattagagaagctaaagaaaatacaagagaattcaatagtcattgaccttctgtcaaggctctaacatttgctagctttcagagaatcatgaaattataaccctattcaaatttcactttgaaaattaaaatgatgaggtaactttcatttgatctgtgaaactgaaagcattgaaagggttattttgagaatatcatatttgagaaaattttgctttcctgaagaaataaacctaacacattttttaaaaagttttgattgtggtatctaaagagaagtaacatctattaaattaagcttgattttggtatagttaagcattttcatatgtttttctctgttgatattaattgaaggatttttaaaagaaattaagatagtatcaaacataaggactgatatacactatgcgaattagaataaagaaagtagcacaaattaagaataactatgctgaggagagataatgcccataacatacatgagaggttgtttgaccatttgagttgtgtgaaagcagaaatgagaagcctgttcaggctccttatcttaggatttctattattttattgaatacattaaaaataagattagatgacttcttgagcccaatgtttcagacaatattcagcatattcaggcattatcgagtgatatatatatatatatatatatatatatatatatatatatatatatactttttttttgagatagggtcttgctctgtcacccaaacaggtgtggagtggcacgatcatggctcagtgcagcttcaacctccctggctcaaagaattctccccactcagcctcctgagtagctgggactacaggcacgtgccaccaagcctggttaattatgatatttttaattcttagatcaagtgttaaaatctcttgtggaactttaaaaacaaacctattcctgtgcccacccaagtgaatggatttattgccctgggatgggatttgtgcattggcatttttaaaactcttcccagttgatagtaatatatatttagggttgagaatctttggcttttaactcctatcattattttaggggccaagggaaaacttccccctcaccctctgaaggtttgctgaaaatcaactgacaaaatatagattaataggagaaaaggaatacaaaattatttttatgtgacacaggagccttcagaacgaagacctaaagatacaggagaaactgtccatctttatgcttatgtccaacaaaacatgggcagccatgtagaaatatgattggacaaaaaggttttgaccttatactagtagaccaagtggggtggcccagcaaagcctgtccagattcttcttggcctctccgtgcagcatttcttccttcttgatatgggacaggaccttctctgcaatgcgggtcttatgacatacaattaaactaggggggtcagagaatttctttaaggccagttgttacacagaaagacagggggacttagggtaatattttcaggttttattgctggctttggggaaaagaggttctggtttctataacctgcctttgggaaagagggattctagtttctatggttagtctcaggggagaatgaggggccagagataggagggcaggggaaggtcagagagaagcttttgcttctgaggctgcttctgaggccttcattatggagtattgttttctgagttcctataccagtaaactattgcaaatcaaagaaaatgactgaggtgagtctcaattatttttggagacttatcttgccaaaattgaggatgcacctgggaaaaatgaacacaaaactaccagaaacatctatggtccatgtttgtttacaaagagtccgaggacttcagtatttaaaggggaaagaacaggcaataggagaaaggaaggacagataaaagaggcaagtggttgcattcctttgagtctttgtttagtgctcactgagcccacattttatatgtgaaaggagagggtagaggaatagtcaattatgcatttgtctcatgctcagtgaatctgcatttctacataagataaagtaaacatagactagaggaagctgtcagacatgcatctgtctcaggtgagaagaggaatgacttttagttctgtcctttgtcctgaacttatgaaggtaagctgttaatttacattgtgagggtgaaattcaaccagactgttttggggtaaagatctcagggcccacaggaatttccctgtgagaaaattgtgagggaggtatgtagccttttatccttgtagctatctttttaagaacaaaatgggaggcaggtttgagtgacccagttcctaggttgactttccctttgacttagtgagtttggggtcccaagattttattttcctttcacagtatacatttaacatttaaagaaatgaaacaaatcgacaaacgtgaaataaacttgcaggattatttgtgaaatgtatggaagttcatcagacaagtatgctagggcagctaccagggcttactagtgcagggtaaattgcgttccttaaaccatttcaataaatttttactttagcatctagtacttctatttttaaatacaaaacaaagtgttttccaaagcaacagctcttgaagtgtgaaatgaagttaccctccagaaaaatagtttgatttggcgtgtttctctcagcatgatttacaagtgtatcccaaacctgtaatcttccccaaatccttcagtactgtgaatgacagcaaaaataatttagcataattatgtataatgtatgactaaacgtgtcacagtagatattaagagctttctgaagttgtaatatgaagcctactctagcgcatctcttgcagatcacaaaaaaagcaaaaaaaaatctattttgtgtagacattattatgcagtcataaatgtgacttagaagccattgtgtgtgtgtgtgtgtatgtgtatgtgtgtgtttgtgtgtgtgtgaaaacaaatgcccaccacctatcactggtgtcaataagtgtagttttttagggagaatacatttgctagggtgctctgccataccaagctgcataattattgtaaaagggaatggatagaaatttctatattcctctttctttactttttcgtcaatttatcatactttatgtgttagcgtttgtacatctcctcattgaaacattttcaatttatttcttaggagtgaggtttttaaaaaccactttgttgagttataatctatacaccacatacttcactaatttgaagtgtatagctcagtggttttcagtatgttcacagagttgtgcaaccttcactacaatacatggaacagtttcatcacctccaaaagaaatcctgtacccattagctgtcacccctcaacctcccatctgcacaagctctgggcaaccactagtctactttttgtctctgtagatttgcctattgtggacatttcatgtaaatagaatcattccaatgtggcctttttatctggcttctttcacttagcatagtgttctcaagtttcctctactctgcagcacatgtcagtacttcattcctctttatggttgaataatattctgttttatagatacagtaaattttatttatccattcatcagttcatggacatttggatgaatttttagtaggaagaaactgttaaaaagttgaagctactttattcctttaacatggagagaaacatctatgtccttcattccaggtagaggtatcacacccaactatgaagatcagcatcctgctcatgttcctttggggattatcctgtgctctcccagtaagtattagggtagggatatatgaaaaaaccctttcatacttaaaactccacaattttgattggctatgaaccaagatggctgtgtatgttccagtccagtaaaaatagtagtttcttagcatgctgttttcttaagaaatatcattcaaggtgttttttattctgttcagttgccattcacatagatatcattcatacttttcttccctataagcagtgcttcttaaagtgtcatcctggaaccaccagcatcagcatcaactaggaccttgttagaaatccaaattcttggaccctacctcagagctgctaagccagactctttagggataggaaacagaaatcagtgttttaacaaggcctcccagtgattctgatgcagcctaaaatttgactatccctactcctatgtatgaaatgtgttaataactattgctttagaaatttctctttggatttaccatgtgtactaaattttctaggtaaccaggtatcaaaataatgaatctgaggattctgaagaatggaaggtgagtagaaatatgactttttgaaatattttaattttaatttattatgagtataaccaaattgatttcattgcaaatgttgaaactgctaatgacttcatcagcatattaataagctaagctatagagttcatagaagaaaatactgctgtgattccaacttagtagtatactctggcaaggaagcatattttctgttagctttcttcttataatggatgtgtataatagtaccaggggatgcatgacaatgaatcaagagtcttcaggagagattatgacttgaaatctgttttaacaagagttatctggtgggcaagaggtcaagtcctggaaggtgaaaaaagaaagaagaatgagaggacactagagtctctggaatgagagctaatgttgctagcatgttattatattgagagttactaactctcaataactcaagaatcattgccaggcacagttctgagtgttttacatatattaactttcttaattttcacacctctgtgaattaggtattatgttttattctcactttacagatgagaaaactgatcacagagagtaattcaatcgtctaggttacatggtcaattagtgttagagccagactttgatattacgtcactctagctccagaatccacattcttaaccagtgtgtcatatccctctcaggaaggagccaggtctaagaggtcagaaaattctcaagattggcactaagggttaaaatcttatgcgaaatcagagcattttgttcactactgtgtttcctactggcttttacatatgataaagcttggccccaatgcttttggtggtggccagataatgtcagtgacctgaggtggggtcctgtccatgcctgagtctggaatagactttgcagtatttattatgaactttcttcagagaaatccataggctggttaatttaaaagcagacactctagatcctctctctcatttaaccagagacgcacaaacatgccctgttctcaagtctagccttggcatgagaaaaataacaatgtcttgctcccttccacccattaattccaaatgataattgactggagcacagcctgccattgtgcctgcctgcagtgttgcaggccaaagacagcgtgattatagctcctttccctaaggagatacccccagtccagcacctctgaaacgcacgttgaagacatgtcaatagcagctcctccctgctctactttgcgccttgggtgttccacacaggactttgccctcctcaaggggaaggggaagaagtgatggggaggggtaccagaagttgctaaggcattcttatagtgcttatgagactaaagatagtgaaataaattagaggtatgactagttaaatttctgatttagcatttgtttttaataccagggcttttacatgactcgagaagggtttcatggctttctcaattcagttttgtttactattaaattttataaggtggatgttatcaaatggattttttctttagtttatatcatgttgaataaatagttttcgagatacttccataggcattagctggtttcatcttcataactaccttgtggggtaagcacagtgggtgttaatttccttaatttatgaataagaaactggtggtcagacacgtgaagtgaattgcccaccttcacctagagtaaccaaccatctcggtttacctggaacttaggggtttcctggaacacatgactttcagtgctaacaccaagatgattggttttcagggctaaaaccaaaaccagtgagttaattgagacttaaatctggattctgagtttcaatgctgcttttcctgtgttacgtttcctctaggttgtatgaacggccaggttcaaaaaagcatatttatttctgtaaatgaaatatcagaaatataaacattgtctaggtctcttatatcccaagatcttttcaagccattagtcattttactttccttttggaaccatttcatcataaaatttcactattactcatgtaaatgtaagatctctaccaagaaactaaaaataataacctaaaattattgtaaataattacaataatgaaatccatctgtgagggagtaatttgttttccttcctttccttttttgcagggtcatttggctcaggcaccaacaccacccttggtaactatctcatttacttttgtcataaacatctcatgaagtaactttaacactcttccagttgccttttacaattttgaaagtagtaaatccagactggaagcaattgatgtgtatcatgtttttttctttcctaaggaattactaaaaagaaaagtaaacatttttcccctttcaggagagcagtgagtcatcagaaggcagtaaagttagctcagaggaacaggtaattaaacagacctttcttaacttttcaggctacttaggaatggaaggaaatgatgttagattaaattacctggcgacagttctaaatataatattttctaactatgagttatgctggctaaagagtcctataaagtaagaagagaaaaatgagtaaggagaattcacatgcagacatgctattcatcttattttcatcactgagcctagattgctggcactgtggccccaaatgtctctcctagttaaaacataaacacatgcgcagaaacacacacacacactcacaaatggtcattgaccatgtcaaacttgctcatcaacttaaaatgttgcttttacaattggagcagttcagctcaggtgaagaagtgcctgggagcttctatgtgtcaaggatcctgctcgaagacagaacaggacagccctgaggaaactttaatgaaaagaactgcttcagtgatgactttctcttcgaaaatagtcccatctgtgggactgggctctgggagtgagaaaggcagactcagtttatatcccttaaagctggcattctttttcatttttctaagactaagtgttgttactttcttagctatgctattgttttgaccaaactcaatcctgtggggctccagagagtccaggagccaggtttctccctaaggctttgatccatgttgcattctacacttagccagagttggaagatgaattattagcctgtttatccctatttacttaaggttatcaaaggaacattctagaaatttaaaagcatagaactggagaaatgccgtttgctggggactttgtgatttgttgtctcaagggtctgtaagctttcaagttacggtagcaattcctgcttgagaaagggtaatgaggtatggtgattcctgcagttcctgcttgtgagttgggttaacgaggtatggcaggttaaacccatgctcagttccaccatactagcataaaactccagtgctaggaagagaggtcaacagcatatacacaagtactcccaatcacccaattacagactcagacattgatcagtagggatgtgtaaaaacaaaacaaaacaaaacaaaaactagcaggtatgctctgttgtagggtatggtaaagagagcagatattttgggagcataatgtatgaagactcactgtccttccttactggtacagagcatccaattgttttacttacagggctcacctctctgacttcccacgtagcactaagttgccttgttggtcacactagttggtgtcttctagctgaatcatctataggcaactttctggttgtactaacgaggtagaaacatggtttgggtgaagtatataccttactataatatttaattttcattttagctaaagattttatcctctggtcctagtacatttttccctccagaagaaaaaaaattggggtcattttaagatcactcaatatttttaaaaactctgtttcacaccaaacactttaatgcatgagcattataaaccaactctaattcacaaacaattacctaagaggtttttttgtgtgtgtgtttgtttgtttgagacggagtctcgctctgtcgccaggctggagtgcagtggctcgatctcggctcactgcaacctctgccccccaggttcaagtgattctcctgcctcagcctcccaagtaactgggactacaggtttgtggcaccacagccagctaatttttttttttttttttttttttttttttttttttgagacggagtctcgctgtcgcccaggctggagtgcagtggcgcaatctcggctcactgcaggctccgccccctggggttcacgccattctcctgcctcagcctccggagtagctgggactacaggcgcccgccacctcgcccggctaattttttgtattttttagtaaagacggggtttcaccgtgttagccaggatggtctcgatctcctgacctcgtgatccgcccgcctcggcctcccaaagtgctgggattacaggcgtgagccaccgcgcccggcctgctaatttttgtatttttagtagagacgaggtttcaccatgttggccaagatggtctcgatctcttgacctcggcctcctaaagtgctgggttatgggtgtgagccaccttgcccagcccaagagtttttttttttttttttaaggaattatatatacagtatgatttgaatttcataaatgtgatttccagaaagctttttgagaaaatgttggcagcattgagtgaagtgtgcctatataaaatggaaccacttgagtttcaattcctcttccttcctatttaagctctggtagagaggttattgagtagtaaaactgaccgtagattagaggaggggatgtagggcgaaggaagcagaaagactagaaaggctctagataactccttctctatcggttcctggaatactgaccatatctgttaaccccaaattctaggcaaatgaagaccccagtgacagcactcagtcagaggagggcctgggctctgatgatcatcaatacatttataggctagctggtggcttctccaggagcacaggaaaaggaggagatgataaagatgacgatgaagatgacagtggagatgacacctttggtgacgatgacagtggcccagggcccaaagacagacaagaaggaggaaactccagactgggaagtgatgaggactctgatgacaccatacaagccagtgaagagagtgccccacaagggcaagacagtgcccaagataccaccagtgagagcagggaacttgacaatgaggaccgggtggacagcaagcctgagggaggtgactccactcaagagagtgagagtgaagagcactgggtgggaggtggcagtgatggggagagcagccatggagacggctccgagttggacgatgagggaatgcagagtgatgacccagagagcatcaggagtgaaaggggaaactccagaatgaacagtgcaggcatgaaatcaaaagaatctggagaaaacagtgagcaagcaaacactcaagattcaggtggcagccaattgctggagcatcccagtaggaaaatttttaggaagtctcgcatctcagaggaagatgacagaagcgagcttgatgacaacaacacaatggaagaagtcaagagtgactctacagaaaacagcaactccagagacactggcctcagccaacccaggagagacagcaagggtgactctcaagaagacagcaaggagaatctgtcccaggaagagagccaaaacgtagatggtcccagcagtgagtccagccaagaggccaacctgtcatctcaagagaacagcagtgagtctcaggaagaggtggtgagtgagtccaggggagataaccccgaccccacaactagttatgtagaagaccaggaagacagtgactccagcgaggaggacagctcgcacacactctcccactcaaaaagtgaatccagagaggagcaagcagacagcgaatccagtgagagcctcaacttctcagaggaaagcccggagtcccctgaggatgagaacagctccagccaggagggcctccagtctcacagcagctcagcagagagtcagagcgaggaaagccattctgaggaagacgacagtgactctcaagacagcagcagatccaaagaagatagcaactccacggagagcaaatcaagcagtgaggaagatggccagttgaaaaacattgagatagagagccggaaattaacagttgatgcctatcacaacaaacccattggggaccaagatgacaatgactgccaagacggctattagcatcagctgtcctaagaagcagttgtcacataaaggagtcttagggacttgaaaatgtatcatgataactataatttattgatgttttgatcaaaagaataaccagatgccatatttttcctgaaaggaattgctggacattacacttgtttttagggtgtcatcatttcacagaggtttaaatactgtggagtgacaccagaacacagccaaagaggctagaagcaagaaaggatctgcatgataactttgcagctgagatagttcctaattcatcaacgtaacaaacaaagctattgggtgtccatgatataccaggcactatgctaggtgttgagaatgtaaagcaggttaagacttgtttcttgctcctgaggagcgtatagaaggacccacaaagctacagagttaaagagggatatgtataagagaaacaagaattgttacaacccagtatggtgagtgccaagacagagagctatgaacacgatatctatctgggaacactgagaagggtgaccaatgcgttggagaacgagggagggcttcatagcagaagacattggagttggaaggttgcatagggtttcctcattggagaccggggaattctattcttgggataaataatagtaaattctataggattcaatacttagtttgcaaaagcactttgaaattatggcacagtgagttgttttggataagaaaatctttttctcccaattaatttaccaattcatcattttttttttttgtagaactcccataaacatcaccttactaatcactggtgatgataagaaggattgggtcaggaagagtgggagaaagaaattcctctttacgtagatactttttagctttattttttctaaaatcagtttgcgtgcaatgctagaaaaaaactgttctctgagtcctttacagagcaaaattctgtatgtaagattcaattgatttttgacaaataccatttgaaatattacctcaacataaaatacttgttttgtaataaagattataatacccagaagaaatatgtgtttatttgtaatcgtggtgctgattattaggatatatttgtgttaagcaactctttctttaaagcattcccaaatagttcagtaccttcctcctattaaaatgaaagattttcttaaattatttcctgaaaattttatttgtaattcaggtagcatttgataaaaatactatgtgttgcttatgatatttcactaactatacctgttacagaacagggagaaaaaaatgaagtaaactctgaatttttgtttgatgccacagtaaaagtttatgatgtttaggcttaacattatttcctgctggtctctcagactcatttgtgtaagttctggaagctacagagtaccatattccttatatttttatttctttgaaagaaacgacttcacgtcagcacttctactttacaaatgtgtttttactcccacttccactgcagtacctcagaattccccacaaaattattagtagaatccagaagacttcctggccgggtgcagtggctcatgcctgtcatcccagcactttgggaggccaaggtgagcagatcacttgaggtcaggagttcgagaccagcctggccaacacggtctccactaaaaataccaaatgagccaggtgtggtggcacgtctctgtagtctcagctactcaggaggctgaggcacaagaatcacttgaacccaggaggcggaggttgtagtgagccaagatcgtgccattgcactccagcctggtaaacaagagtgagaccctgtctcaaaaaaagaaaaaaaaaaaaaaagaatcaagaagacttcctaactttcagtctcacctttcccatccttcacatttctctgttccctcacaaggtcaaaggtgtgtttacctggggagatttaaaaattgtgtgtgtgtgtgtgtgtgtgtgtgtgtgtgtgtgtgtgtgtgtgtgtattctctaatgcttccccttgaaattttagagcttttaatttagtaggtctggagtgagacccagagttctgcatctctaaaaggattccaggaaattctggtggagcctatccactatcgctatttggggtctccatttggattaattatctgactccattaacctacaggttcctgccaacccattgctccttctgagaagaactgccccatgctcagacctcctgggtgcctgaggcacaggtggccaggttctaaccactcacatgccccacctcaccataggggattggaagaattagcacctgatgtgaggggagcctggctggcagcttccaaggaggcatgttgcaaaggcctcatctgcctgaacgcggatgatgggggcttgaggtctaatcttattttccttctctgaaaatatgtatatttagggaaagagatgtcagaaagtggttagaacaaaaacagaagggaatacacagagaggcagaaacggagagtgggctaacccccattaatgtggcacacaaaatggaaaattatggagctcctgatgctgaggggcaaaataatcatcttccggcctgcaagttggatttgactcttctattgcccccaagccttcctggattctgggatgttttgtcttctcgaatgccgcctgcatgagggcacccacctttcttcaggcaacttgagtgagtctttgttcccggcaaccaaaatgcttaatgaacagagacttagaaacttatgttatgttagctagcgttcctagcttctgtaacccagtggtccccaaactttctgctgtcagggaccagtttcatggaagacaatttttccagggatgaggggtgagggggatggtttcagggttattcaagtgcattacatttattgtgcacttattttctattattattacattggaatatataatgaaataattatacaactccccatagtgtagaatcagccctgagcttgttgtcctgtaactagatggttccatctgggggtgatgggagacagtgacagatcatc

SEQ ID NO: 16236 - DNA, 16542 bp, Human
ctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcaaaggacttgaacagacccttctcaaaagaagacatttatgcagccaaaaaacacatgaaaaaatgctcaccatcactggccatcagagaaatgcaaatcaaaaccactatgagataccatctcacaccagttagaatggcaatcattaaaaagtcaggaaacaacaggtgctggagaggatgtggagaaataggaacacttttacgctgttggtgggactgtaaactagttcaaccattgtggaagtcagtgtggcaattcctcagggatctagaactagaaataccatttgacccagcaatcccattactgggtatatacccaaaggactataaatcatgctgctataaagacacatgcacacgtatgtttattgcggcattattcacaatagcaaagacttggaaccaacccaaatgtccaacaatgatagattggattaagaaaatgtggcacatatacaccatggaatactatgcagccataaaaaatgatgagttcatgtcctttgtggggacatgtatgaaattggaaaccatcattctcagtaaactatcacaagaacaaaaaaccaaacaccacatattctcactcataggtgggaattgaacaatgagatcacatggacacaggaaggggaacatcacactctggggactgttgtggggtggggggagtggggagggatagcattgggagatatacctaatgctagatgatgagttagtgggtgcagcacaccagcatggcacatgtatacgtatgtaactaacctgcacaatgtgcacatgtaccctaaaacttaaagtataataataaaaaaaattaagagaaaaaaagaaaaaaaatgatattcattaatttttgatttctcaagcagacttcgcaactggaggaagaataaaatgactagactaggagaatatgcaaactattaagctagatttccctttgtaaattaaaaaattagtactttagtttatcaatccattctttgtggtgttggtttcatgaatcatttcaaaaacaatggatcactcctgctagctctagtcattttgttattctcataggaaaaaaattaaatatgaaaatgaatagaaaagatatatatagaagcccaagaaaaaaatgagctgacctcacatgcacgacaggaagggccacataaatggacaatatacagagatttaatttacaaaacaaaatataaaatctgcctctcagtggtatgattctcaaaagttctaacttttatactcagcatcatgttttagcaactatatcttacaaagtctgaccgacttaatcatatcaactttaatttatgagtcaatgaagtatatttcaggaggaaacatcaaatgatattaaaatattgatggttcatctgctcctttcccttattatttagtttttctttctttttttagctaaactaatgtaaaattatatctaatgacagcaagctttcctttctttcgacatagtgaaaacttgtataattatgaaatttttaaaaggttaaagcctttgttatttattttaattcaaatccagtatattattatacatattcggagcccaaactattcatcttcatctaaaccttcaattaaattccacaatgcaaacctcttggctctagaatcacgtttcttgtttattcaactgagcctgtgtcttgaaaaagtgttgaagtttgggggttttctggtgagaatccacgttctgacatcaccttggtcgtgacagtgattggctgttggaaggcaaagaagagtttatagccagcaagagcaagtgaatgagtgagtgagagggcagaggaaatactcaatctgtgccactcactgccttgagcctgcttcctcactccaggactgccagagggtaagatttaatagaacaacttcattatcataaaattagacactccatagtttacatctctgaacttggctttgaatttttcatttaaatgatgttattgcattgtacatggtttaataattatttatcattaaactggcacttcagattttaaattctttccaaaaggctaaacttattaacctaagcatgtaaataagttcttaatactatgcacataaactacattatgcttcttactttcattctctgcaaatcatagcttaactgtttgttttctcattctgatgcattcaagataacctgattgaaatactattttgcatttgcaaatctggctagatatatgcatatttctctacaaattatacctagtctgtacttcaagtacatatgttgtcttttcaacatattaaacattaggttttgatgtttcctatagctctaaagtcagaacagaaaatatattgtactaactagagaaataaatactcttggtagtttatcatacccttcccaataaaacttgaaattaaatcctcaaaattctcctttaagaatgtttgaattgttgtctgggttagtagtggtcactatagaggtcttggctttttgttgactcacaaagtaaataaaattagatttatataggcagccaatcctgactacaagaactacttggttctttgtattgttattattattatttatgccatcttttcatctggttatttttattgttatgagaaatttgtgtaatcaaaactatttctataattctatgtatctaagcttttagctctttaaaatattataaatattccgacccttctcacaaagtggcaaagcaataatctttctgttttgctgatgggcttggtcacggctggcaaagttcaaagcattatttagaccaccccgatagaaatcagtgctgcttaaaaagatgggctccttcaggagcaaagcctgtttattcccaaggggccatcaagaacttttactaagataggactgtgagaaactgtctgggcaccaaaacccaaagactcactctgacacacaaaaagagtgtgacttaggacccaagacagtatctccaggacttagtgtcagatactcagtaaggatgcaataaatcttggctgatgatgacacaatacacaatttaccagcaggtttcaatatatgacattggtttgcacattttaagtattattttcaaaatgtattcatgggaaattgccatcaccactacattttgcttccaaaatattgccaaagctgtgactgtgtatgagaaggtgctaacagttaaatgtgtatgtaaatgtaaatggctgagtgttagtaggctttcagctaagcttgcccaacttctattatgatataattttaaatacaattttattaaatagaataaaattaagataggatagcatttcactatctccttttactcatgaggaatttatgtggaactgaggctctttttatggctgcaatccccaagattattcaggccctattcccactttgagagctgcatcttcgattgttccatagaattgaaattttcatccatgtctgtcaccctaaccctggagagcccctaatccatcccagtacagtctcatacactagcagatggaaagcttaaatggagctggagagcaaattaatttgaggaaatctgcccccgatatctcaaggcgaaactctgaagaactcctcatggaagcatccttagcggagttgctgttgcgtgctacatgatgtcagtgtgatatttcatatattatggatcctctctgtctctctgtctctgtctctcatccacccacccatacacacacacacacacacacacacacacacacgcatatacacacacacacacaccaattattccaagatgttcagaggaaaattgctcctactttccattttacaaataaatttttagcccaaaacctatatagaagctggaaaccgcctatagggtatcagtgatttttgcttttttgttttatttttgagacaggatctcactctgttgcccagggtggagtacagtggtatgaacacggctcactgcaaccttggcctcccaggctcagcctctcgagtaactaggcctactggtgtgcaccaccatgccaagctaatttctgcactgtttgtagaggacaagtttcaccatgttgcccaggctcatctcaaactcttggactcaagcgatctgcccaccttggcctcccaaagtactggttttagaggcatgagccaccatacctggtcgagtttttaattgtaaacaaacaaacagggcacacaactacactaacaattcaattcacttagctgacactccatgtcaatattaagagggccattacgccagtgtgaagtaccctaagtattcaaaatctcttgcagtaatgaaaaggtcttccattgagaaatcacaaaaaataggttaaaaccaagtatggaactcaagattatttaaacggatgggttaagtcagtcttatattacttaaatggaaggaataatttgaaaataaaaggaataatttagttttaattagtcaaagtgataattacacagaaatgaaaacaaattaaatacttcatctttgaatatgagtaaaaaagttatgctcttagttttaatattttattaaccttaccacttcattaattccagaagcaatcaccaaaatgaagactgctttaattttgctcagcattttgggaatggcctgtgctttctcagtaagttctttatcaaaacccacagttattttcagttttgtctttttatgtaaaagaaaaattatgcaataattaaatgttctttaaaacagatgaaaaatttgcatcgaagagtcaaaatagaggattctgaagaaaatggggtaattaattttagcatacttccttggcctgattatacttgctgtatatttattgcatattaaacatgaatatatcatttattttgtttttgcaggtctttaagtacaggccacgatattatctttacaagcatgcctacttttatcctcatttaaaacgatttccagttcaggtaaatatagaaattcatttttcttcagtttaatttctattataatttaaaggagatcaaattttaactataaaacacctaaattcaactctcactgaaattcagtcaaaaagactgcttactataagaagtttgtttttagggaaataaggtttatttctaagttctcttttaaggcagacatatacacagagtaaaatcatttggatcatttgggtacagtctagaatgatataataaaaacaaacactgtagcacattgagctctggtatttttgctaactcacagacaaaagtggacagttttatcacttgttgaccaattccatcagtgataaggtcactggctgtcctattacagctgattcaatactgtcagatagctgtttacatgtggcactgcagagtcctttaattggtaggggaaaatttgacttcataaacatcagaggccattgtttttaaaaaaccttgataatcaatggtaatttctgaagattttctgcaccttaacctgtgtgggtcactagagcaatatgtcatacactggagcataatcataatggtaaaactgcagaggaaaaagagaaattcatgacgtgcaccaaaaaagcttgtgagaaaaacaaaccatcccttaaatttgtaaacaaaaaggaaaataactaaaaaaaaaataagagtttccaattttgccgggttacctgtgaagagtgactttgaaaaccagagggtgtggtgttgattttaaatatacaacaaaccaggattgcactatttttagtaccatacagtttgggttcaggacaccaattatgcaccacttgacccaggacttttgagacactaaaagcagtcaggatgctgaaaacgatgcctcagcacagtggcttggcattgcatcttaccatatgttgggctaatccatctctaacccctacaatgataggaaatgatcattttaaagtatttctagcaccagcataattatggggaatttgtgtggccacaaaaatatgagcatgaatgaaacaagagttgtgggttttcagaattgtattcccttctttggttcacctcagacccataaataaacagtgctcatttgaaagtttgctttgttctcttttttaaactaaatggaaatgataataaattcaagtctctgactagctcctaaacttttctgaaatattaggtacatagagatattcattcccatctggatatttttatagatatgtatgtatgggcccattaaaatgtccatagtgaagcaatattaggaggcattacatttctcaatattgatagacctgaggtttgtagatcaaggagatctttaatatacaagttttttcacaaattatatgcagataggcccatctcaactaatgtagaacttgtaagataattgtttttaaataaaattatatacaatatatctcccaatcctactgtctgacctagtattcatgacccattcttctactttacaaaatttgattttctttaagtgtattgttaggtgtttagtgcccatgttgtcaccccaaaacacattaatctgtattggctttgaaattcatgtttccatcaaacaaatctgcatttatatacaatcatttctaaattaccaagttacaatgacatatgttatttggattgcaaagtgatcagcaagctatctattgtggcttatatatctgctagactatagaaatgaaagtttaagtaaacttaacatcctaagcttctttattgagaaaattgtcattttgtgattcaaatgatattttattagttgaactcatagaaggtaagaatttaatcttatatttcctttatcggactcatctcagctatgacaagagttgtgggttttcagaattgtcttcaatttcagaactctttcatctatctgtgtagacaaatgaaagacttcttggagaatcaattggacttagcaacaaattggtaataatgcataaatgaaagataggaaaatgccaaagcttcaaggcatttcatacagcttttaaagtgttctcactgcagacactaatcgaagagtgatgtggttgagctagggagaaagccagaggtgaaggagcatgtgaagtgattgaaatacccccactgagagaaacagttctgattgcataaatatactgtcctctataattaagttaactaacaaatagaaatcgtccaaatataatactctattcaccctctgggctagggaaggcacaaccattaaggtcatggcagtggaagaacaggtttaattattctcttttccacctgaggttattcctggctcgaggtgacaagcattccctttccttgggtggatgatgtggccatctgaagaatgagccagcagggacagtcccacaggacctggacatgaatgttgtctcacatttgatttctaacccagaagttagagatccttctgcagctatattttctaaatgcaagacattaactgggtcatcagaatcaaagctaaatattgcagggaaggaaatgacagaatcttagattggaatttacatttcctttcaaaaagtagcaaaactctttagcttataattatatttttatatacaaaatcttaatttattctcattcaacactgaacttgttagagggatattactctacacaacctcccaaataattaaatgaataagtcataagacttttacttcacatgtataaattaacctcattttaggaactggctttaatcaaatttaaagatactaaaaattatatgcaaattaaatgctattaaattaagtgctaatttaaattcaacaggagagctcactatgtaagagaatcatctataacaacttttatagtaagctgaatgatttctttcatgttttctaaataaaattttaaaatgtgaactatatcttagcccaaggtctgccttgaacctgctggagaagtcacaacttttttaggccgctgattcattctccataaaatttaaaaattggaccagttaattcacttgttctctcaaagttaaacaattctgtgattcattgccctagtttttacatacaaaatgtttcaatatattgtcaatgctttggaagttgacaaatgggacatccaattcatatcttgatcatagtaaaatgcctatttttctctaacttcattttgcatgtctaatctcctatctttctcacatcagtatgcaatctgttcttagtaaacaagtcagtcaagatggtaatactaattagattgagtaaatatttgtgtgtattttattgtgattcaattagcaggaaatttaaattgctgttgaatatatttgtacacagataagagtatacatacatgtgtatatatttttagggcagtagtgactcatccgaagaaaatggagatgacagttcagaagaggaggaggaagaagaggtaaggaattttgcaatcttttcgtaataaagcagacagcacaagaaacaaataggaaactagtctattgcattctggactcagcaaatagccattgtcactttactaactgcccataatatcctattttggataagcagaattttatttaaattaggatccactaacatgacctgtttaaaacactattgcagtttggggttgaaattacttacaaatggtgctcaaaaccaaaaatctctcccttttaagtagaagtagtataaaatctgataaaaagcaacagaagtagtataaaatctgataaaaagtaacagatagcattacttctatttaggtggatagaacatgatgttagaagacaagtgaatagtaatcctaaactcagtgcaagacttgttttaaggactgaactttacaatttaatttaccaagagggtaatatgtaaaaacccgtatatctcctctacaatattattgtgattcatcagcctttcataacccacaaagtagggttattctttttaaaaaaatttcaggcttgttgtggtggctcatgcctgtaattccaacactctgagaggccaaggcggccagatcacttgaggtcaggagtttgagaccagcctagccaacatggtgaaaccctgtctctactaaacatacaaaaattagccaggtgtggtggcatacacctgtaattcctgtcactcgggaagctgagacatgagaatcacttgaacccggaaggtggaggttgcagtgagccaagatcctgtcactgcactccagtctgcgcaacagagcaagactctgtcacagaaaaaaaaaacaaaaacaacaaaaaaaaatcatatgtctttttgggtagtaataaaattcataggtatataaatatcttcccatatagttttacagattagtgtagtcctgggctaagaatcatctacatgtcttggaaattgtgctaccatgtttataactgatactcttgcctaaggaaacataccaattaggatgcatctttcccgcatagtcaattatagctaccactggtttaggaaccttttaaattcagcttttctcaggtgctatttatgaatggacaatgatattcaaaaatggatcatgtattaacagctgtcttgaaaacaaaatggtgtgggaacttgaaaggtgacgaatcattagtttggtatatttttaactataaaagtaacatttcccgtatcataatttatactaacatcttgaaggaaggccttacaagaatgttaagccagtaccaggaaaaatgccacccactaaatcccacaacatttctgctggagttccacatagcaatcttacacaagaactaggctaaggttatccatttagttatagctatttgctgtacagtgattgtaaaattgccttgtcaactacatttcccaactagattgcataacttttgggagtggctcttcgtttgttgttgtggtggttgaggactgaggaagactaggacttctttggggactctgatgaaatcaagtacacacaaaattttgccaaggatctctgaacatttaaggtcttcccagaacgtgtctgcagacacctcatgaccataggttaaaatccctgctttggggaagagccatgctactcagttttatatctcttcatgctgcctagcataatttcttatacatatatggtgcccagtacatatctggtggtttggttttgaaacttcagaggaataaatgcaacaaacttcattcattaaaagtagtaatggaaaagcgggtaaacaaaaccagaagtctttcatcctgaagagattctgaaacatcttttttcctcattctctaaaatgttattagcaatttaggttaaatatagagtccccagggattgtatttgtatgaggagaatacttaggcatattttctatttggtgatcacacatttcctttttccactcctaaactatttagtctcataaaataaactttttttttttttttgagacggagtctcgctctgtttcccaggctggagttcagtggcttaatctcagctcactacaagctgcacctcccaggttcacgccattctcctgcctcagcctcccaagtagctgggactacaggcaccggccaccatgcctggctaattttttgtatttttagtagagatggggtttcaccatgttagccaggatggtcttgatctcctgacctcgtgatccgcccgcctcggcctcccaaagtgctgggattacaggagtgagccaccgcgcccagacataaaagaaacttttattgaaatatacataataaaattatcctaattatacatctcattgaaatttcagaaattgaacacgtaagtgaaactagcactcatatcaaaaagcagtgcgtgccttgtgttccattccactcattaacaaacccctaccaaaggcaagcagtattttgactcttaatagattgactttggcctgtttttgtatattatgaatgtaggatcatacatgatttactctttgtgtgtcacttcttcactctcaaatttagagattcatccatgttgttctgtagttgtagatcatttattctcattgttagtatttcattacgtgaatgtaccaaaatgtgttattcttctgttgatgggcacttaagtagtttccaagtttgggtgattacaaagtgctgctatgaactttctagaacttattctggtgaacatatacatattcatttctcgaggccatttcacctaaaagtgaaatttcggagtcgaaatctactgaggcatatatattcaaccttagtagatggcaaccagctttccaaaacagacgtactcaggtaaactctcaccatccgtgtatgagggttccggttgctccacattctcaccaacacttgcttctttcagtcttgttagccaatctagtgagttgataatatctttgtaagcgcaaattagtgctatttttctatccaataaaatttgtgaagcctcatacccatcaacagtaacctattttcctatgtaactcatgtgcagcggaacatccttaaataaagtatctgggaaaagaaaaggtgtaagagaaaatataaaagttgggatattgggcctttagttgtgaccctaccaccaataaactgctatctatttgacctcatatgagtcatataagccaatcagatttttcaactgcaaatagtatattcttctactctggggatctttctaaggatggtagaataaatttctccttctacctctgaaacatctgttggaataaagcataaacataaaacaataaacaaacagcatggtgttttggggatatttgacacaattagcttggagactgtttggggtatactctggtggtattgcaacccttcactgaaatagtgaaatttacaaatttgatgaaacaaacatgtggtgctttagtcactttgttttaataataggctaaatatttgtttgtttgttttaaactttaaaagttatcacaatctcttaaaatgtattgaagtgaattcaattttccagtatttgtttaaaataaataaattgtatatataggaaaccttgactttttatattagctacaaattacactgagatcaactcaattaaaaaacaattgcctcacgatatgatataaaggctaaaagattaaatattaaagattataatagacattcatttgaagagtattaattttttaaaacaccttcatgcagactgggcgcggtggctcatgcctgtaatcccagcactttgggaggttgaggcgggcagatcacaacgtcaagatcacatcctggccaacacggtgaaacgccgtttctactaaaaatacaaaaattagctgggtgtggtggcatgtgcctgtagtctcagttgctggggaggctgagacaggagaatcgcttgaacccaggaggcagaggttgcagtgagccaagatcacaccactgcactccagcctggcaacagagcatgactctgtgcaaaaacaaaacaaaacaaaaacaaaaaaccttcatgcaataatatatcactaagaatttcttagagtgtttagtttcttctttgtgcagaaaaaaaatgatgtgtcaaatgcctgaaacacaagtattttttaattgataaaatacaaagcagaaatatctaaaacatatagtgtggagtaaggaggattcaataacttggagttgagctcttggaagtgagaagtgcaaatggcataggggaaggcaggctttgagtgatcagccagctgagggatgcaaagtttttccaaataataaaccttcaataaatgattcacagctccagtaaatcttgaactatcttccaggtaaaataatttttcttactatgaatatttttaacaggagacttcaaatgaaggagaaaacaatgaagaatcgaatgaagatgaagactctgaggctgagaataccacactttctgctacaacactgggctatggagaggacgccacgcctggcacagggtatacagggttagctgcaatccagcttcccaagaaggtaacaatggaattattcctccaaaatgaaattattaccattaataataatggtaatgttcaatcttttttaaactttttaactggagtctaagggtatcctaacactacacacatagtattttatactatcttcattaactcgctgaagtgagagcagatacaattttcctatttacaaataagaaaatatcttctcccaggcaagttctcctaccatgttattacactgacttttacattataacagaagactaagaacacaccactaggcatggataaaaggtcctgagagataccatgacattccagggaagagaattccaagacagagaaagtgagtagcaaaacgataggaagactctcccccaggaaaggcattatctttaaataatggcacactttccccatcaaaacccatgacaaaggggtttatcctgaagttttaaagcccccaatcattttgtaaattaaagtggccttaattcaaataagacgcctagaataaggctgtcagtattgtgttgcatgaaatgatggccttaaattttacatttttcacagctagatttgggttctttcaaacgtttccttacaggctggggatataacaaacaaagctacaaaagagaaggaaagtgatgaagaagaagaggaggaagaggaaggaaatgaaaacgaagaaagcgaagcagaagtggatgaaaacgaacaaggcataaacggcaccagtaccaacagcacagaggcagaaaacggcaacggcagcagcggagaagacaatggagaagaaggggaagaagaaagtgtcactggagccaatgcagaaggcaccacagagaccggaaggcagggcaagggcacctcgaagacaacaacctctccaaatggtgggtttgaacctacaaccccaccacaagtctatagaaccacttccccaccttttgggaaaaccaccaccgttgaatacgagggggagtacgaatacacgggcgccaatgattacgacaatggatatgaaatctatgaaagtgagaacggggaacctcgtggggacaattaccgagcctatgaagatgagtacagctactttaaaggacaaggctacgatggctatgatggtcagaattactaccaccaccagtgaagctccagcctgggatgaattcatccattctggctttgcatccggctaccattttcgaagttcaactcaggaaggtgcaatataacaaatgtgcatattataatgaggaatggtactaccgttccagattttctgtaattgcttctgcaaagtaataggcttcttgtcccttttttttctggcatgttatggaatgatcattgtaaatcaggaccatttatcaagcagtacaccaactcataagatcaaatttcattgaatggtttgaggttgtagctctataaatagtagtttttaacatgcctgtagtattgctaactgcaaaaacatactctttgtacaagaagtgcttctaagaatttcattgacattaatgacactgtatacaataaatgtgtagtttcttaatcgcactacctatgcaacactgtgtattaggtttatcatcctcatgtatttttatgtgacctgtatgtatattctaatctacgagttttatcacaaataaaaatgcaatccttcaaatgtgttataattaagaagagaagtgagagattcataatggaaaaggtgaaacaaatggaagacaatttcactaaaggagaaaagcttatttccactatagtttaaaactaagaggcactgtaaacattttcttttggctaaatcaacataactaagactttgccatgcttgtgggcagggttagccatacacgtcaggggaatgaatggctcttactagagttaccagatataacaaatatataggatgcctattaaatttgaatttcagataaacaatgaataatttttagtataagtataccccatgcaatatttggcctttgtgaaatattttggacatacttatactaaataaatgattcactacctatctaatactcaactttattatatatttatgttttgagacagagtctcactctatcacccaggctggagtgcagtggcgccatcttggctcactacaacctctgcctcctgggttcaagccattctcctacctaagcctcccgagtacctaggattacaggcacacaccaccacacctggctaaatttttgtattttgagtagagacagggtttcaccatgttggccaggcggctggtcttgaactcctgacctcaagtaatccatccacctcggcctcccaaagtgctaggattacaggtgtgaggcaccactcccggccctgatactcaactttaactgagtgcttcgtttatctggcaatcctacttctacttggcttaattttagctggacaaggggtggaatgaggtagaaaaaaactcttacacaacacatacgcacaaaggagggctgatatacaaagacttaacagcaagtcacaccttaatataaacctgaaagccatttaaaatgggagtaaagaaggaaagtagatagaaagagcaaaaagaacaaaaatgcattcatcttttattaattgataagatgtactgaacatctacagagccagacaatgttcacacattgagcatatgaaaatgaagaatactgtgtttggggtaattttagtctgttagttaccagttatgagactgtccatgcatcataacattcattttttcaaactttttgtcttattatatctttattccaaaattcgtttctcaaatattcaaaccacaaatttaaaaaatttggttttaaataaatatatattttttcccataagttattagggtacaggtggtattcggttacatgagtaagttctttagtggtgatttgtgagattttggtgtacccatcacccgagcactatacactgcacctcgtttgtagtctttccctcaccccttctcactcttccccccaagtccccaaagtccactgtatcattcttatgcctttgcatcctcatagcttagctcccacatatcagtgagaacatacgatatttggttttccaatcctgagttattccacttagaataatagtctccagtctcatccaggtcactgcaaatgctgttaattcattcctttttatggctgcatagtattccatcatatatatatatatatatccacagtttctttatccactcattgattgatggacacttgggttggttccacgattttgcaattgtgaattgtgctgctataaatatacatgtgttcaaatatgcaataaatatacatgtgttcaa

SEQ ID NO: 16237 - DNA, 12191 bp, Human
tgtctataaaatctgtagaattgtcatttctctcattcctgatattgctcatttgtgtcttctcctttatttccctcattagtctggaaagaatctcctaaattttattgaacttctcaaagaatcagctttggtttcactgactgtctctattgtttttctgttttctatttaattaatttcagttctgatctttattatttccttttctctacatactttgaacttaatttttccttctttggtggaaaatgaggtcattgtttcaaaacttcttctcttcatatatggttatttagtgctataatttcatcctaaataactgctttagtgacatcccacagattttgatatgctatgctttcattttcagtcatcccatatattttgaatttcccttttggtttcttctttcacccattgactatttatgagtgttccacttagccttaaaatacttgcggttttccagaattcttttgttattgatttctgattgccttccattgtggtcagtaaacataatttgtacgacttgaattcttttaaatttattgagattcattttggggctcagaatacgttctatcttggtaaatggtgcaggtacacttgaaaagaatgtttattcttctgttgttggatgaagtcgtctgtaaatgtcaattagatcaagttggatgatacttctgtttaaaggttgtatatccattatatttttctttcaattattaatagatggctattgaaatctctaaccataattcatgttaattcaaattaaggaaaagaaaggcaggtttagttcaccaacctccactgatgaatgtgtgtgtgggtaagggtgtcactcccataagtgactcgagccttgttaaaagttcttaggccctttaatctgcccaagtaaacatgctatatgaataaaaacaaagcattcactatgaaaacagcttcaaggcaaatttccttcccattcaattcacttccttttaaccttactttttccctacatataaagctttatttgtatataaataccatatatttttgtatatatagtttctggagataccactgttgcatagtgatatagcattagtggtcttatgtgtttcaccttctttaatattgtaacacaaaaattggcatattcctgaaaattctaaacaagtatatagagaaagacggtcaagtttttgaatgcatgaattgaagaaatagtttagggattacctgcattatagtacatctagggttcaagagaatggtgcactcatgttgcaaaacttgttagacataaagtctagttttctactttgcattctgcagctaacacagataattgagagataatggacagctaaatctgttgtctttatgcacctttggacatcttgctacttttgacattttcaatgtctgtttttgaaatgtagtttgaatactcaattgatagatttttaagcttttatgtcactgcttatttcagttaaatcagagagatttcaggggagttactgtttatagattgttaaagatccctcaggcaacgtcaaggctgctgcatgtggacagtttcttgaattatagcacagaaactttaatacctacctcaagaatgataggggtcttaaataggcagtcatatttactaaagaaacctagagttttcttagattgccaaccttggtaagacaagaaatgtcagggtgacagagtttaagtggctcttttcaggtatcttacactgattctctatatttaagatgtgaaacagcctcataggagctgtttaattaagtgaaagtaagtctagtccttttggaaccgaacggttcagtgagcaaatacatatcaccaagtgaaggaagtggggaagttattatgtgcttcatagactcgatgacactttataaccccatatcagggatcctaaacagtgattggttgagaaaattatcaaactgagtttaaatttcggcaagtacaaaattgtcatgcaaaagtccaggacagtgggccactttcagtcttcaaagagaaagataagaaattctggattttcaaaatccttttgaagccttttaaggtaagatgaaatatcctttttactcagaaccaactgattcatttagaaagaactttgaatttcaaagatgaagccagtttgattttaagaagcgagtaccccttaatgattagattgtatgcttcctttttgacttgtcatattgatagtatgtataaaagataacggacaattacgacctaaggaagagatagattgggaagaagaaagacctcgtactgaaaaattggccaactgaggtggaaatttgacaattaactatctgggcactttgattagttttgataaaaaatgagataactcagatttcaaaaatccaccttgggctttcaaacaaggcttcaattaggctttgctttttagtattttattacttactattacttattatttattgtcccacatgaaatgaaatttagcaatcactaatgatgccaaatctaattgctaaatgaaatgaagctaaatctcatttcattagtaacaataaatgaaataatctgatggagcttcacaaattctgaagtctttgtttcatgctgagatcacctgggccatttttattgtagtcttcgaagtcattcacctgccttggaaacggtgataaccatcatggaattgttcaggagtggagctgaaagagagatgtagtggtcagatttctgaactgtagctcagaaactggacacgtatcactctggccttggctgcaggtacctttccagtatgctgaggctcttccaaatcacagtgcagacgggccttctgcagagctatgtaatgattaggcttgggactgcaaagtacaggataactgtggcttagtaaacagctggccttcaacatctgtgccccagagctctgcatgatacttgtcctggtgtcacctcagcctcacttgaatctatggcatttcagaaggagctctagctgttcttggctttctgttgaacagctataagaatgagcacttttttccccctcagtagctctggaactgtgtcatctctcctgtgagaaaacgccagtaattctcatgacagttgatattcagtgaagttttattatattttcactaccaccattaaattcaatcaaagccattttatgacatgcagcattataatctatacatctggtgggagttcatgaaataggagtaaaactctcctttctatcattacttcaagaaatccaacttgcaatataaattaatttttttactcacacagattataaaatgtctattccaacttatcagaaacatgttttagaccatttctgaatttgaattctaacagggatgaagaatcatgattttagaagtcccataaaataattgctatcatttattcaaaaattgcaaagtgcctgaagcaatgctagatattgctgatagtcataaatatttatcaacaacattcagaaaacgtttttttctgtgctttgcattggaatacaataatcaccaagacactctcctgggcctcaggagcttacaggaaatcagggcaacacataagtaactaggcaattttaaacagtgcaatgcgttaccagtgagacgtgcaaacttccttggtataaaaaggaaagagataccaaataccctttgaagtggcgtcagagagggcgtctcagagataattctaccaaacttcaggataatcctgaggtgcaggtgttgttattattccaggtggagggataataaacctacttaaatttctcaagcttacacagcaagtagcaggggtaacatttgaacccaggtctctgaatacaaaccccgtattctttccactagcgtaggctccctcatgttagtaatttctttctcttaaagtctggtatagctcaattctatagatttggagtaaggatgacaagtgttttacctttgaagcacaatttcagcagaattagttagtacttgattaaagctattcagaagagaaatagatgtttttacacccaagaattgcagaagaacaaagttacagctatgccctttgtacctattatggcgttttccttcattggcacaggcagaaaaaaatctaggaagctacattagtgctgagcctggtgatgcccccataaccacaccaggtatgttctggaccatcgtatgtcttctcgtgttagatacatgcttcttgtccaggaaaagggcaaatgcttacacatcaaaataatatagtactatgattttccctttactttataagtaattttgtgctgttccttttttatacagccattgattattattattcctaaagaaaatgaagataattacatatttttgcatttgggcagtagcatgggccattccagtaagtatgcctttcttagaaaacctcttcactttgttatcttttttaacctaacattaatacaaaatgtagtgtgtgtgtgtgtgtgtgtgtgtgtgtgtgtgcatgtacatgtgtgtatatatgtgtgtgtgtatatatgtttccttaattttttttaacaggctgagtctaaacatttagatttgcactaagggctttatgtgatatctgtgaggtttcaacaaaaccactccaattcatcgtctcattcctctatagaaactcatatctcgtctgaaggattattattatttaaaacatttattcagattaatttacacttaatgcccagaagtcatggagactttgtccatctttgcttcatactctgtgaatttcattctaatacgaacaaagtctgtgctgtttaggaagtttccaagaaagaataataagaaaaagtagattttttttcaacatataggagactaatttttcactcagagttattatttatgtgctcactgtggaaaatttggaatatatgatgaaaaccaataaaaaattgagaaaattcaaccatttataattttactagccagccatcatgtttaacattttcatatgctttcataataccaaacatttggtatttatgtagttgaaaatgttctcaagtatttcaaatgtgctcttgcagagcacagaagtatactagcgtaatacttgattttgcctctgtgcaggctctggtcacgcctcctgttctcttaagagttttcatcaggattacacttagagcgggtttgtgctagtgcaagaggctttttgtagagaaacaccagaggtctatcccctcgtctttctacaagactctttccttctacagttgagataagtgggctgatctaacacgtccataaaattggtaataccacagtgaaaaatatccatgtacccagtttaaattctacacaagccctgtaagaagccacttctcttttctatctgattagatcatactttggcctttgtgttaaacctttcttcttcatggagggaagaatatttgtgtgtgtgtgtgtgtgtgtgcacgctcacacacatattcacaaataagaaccttttcaatagccagtattttctacttggcaggttcctcaaagcaaaccactggagagacatgtcgaaaaatccatgaatttgcatctcctagcaagatcaaatgtgtcagtacaggtataggatgtaatatatttcattttatttcctatttctgagttgctacattccattaacttctccaagattgcaatttgctttccttcaagatcattgacactcataattgattgaattgtttctttttcaggatgagttaaatgccagtggaaccatcaaagaaagtggtgtcctggtgcatgaaggtgatagaggaaggcaagagaatacccaagatggtcacaagggagaagggaatggctctaagtgggcagaagtaggagggaagagtttttctacatattccacattagcaaacgaagaggggaatattgagggctggaatggggacacaggaaaagcagaaacatatggtcatgatggaatacatgggaaagaagaaaacatcacagcaaatggcatccagggacaagtaagcatcattgacaatgctggagccacaaacagaagcaacactaatggaaatactgataagaatacccaaaatggggatgttggcgatgcaggtcacaatgaggatgtcgctgttgtccaagaagatggacctcaagtagctggaagcaataacagtacagacaatgaggatgaaataattgagaattcctgtagaaacgagggtaatacaagtgaaataacacctcagatcaacagcaagagaaatgggactaaggaagctgaggtaacaccaggcactggagaagatgctggcctggataattccgatgggagtcctagtgggaatggagcagatgaggatgaagacgagggttctggtgatgatgaagatgaagaagcagggaatggaaaagacagtagtaataacagcaagggccaggagggccaggaccatgggaaagaagatgatcatgatagtagcataggtcaaaattcggatagtaaagaatattatgaccctgaaggcaaagaagatccccataatgaagttgatggagacaagacctccaagagtgaggagaattctgctggtattccagaagacaatggcagccaaagaatagaggacacccagaagctcaaccatagagaaagcaaacgcgtagaaaatagaatcaccaaagaatcagagacacatgctgttgggaagagccaagataaggttagtttgtaaagctgatttctttcaatggcagtttaaattcttcccctccatctattgatgctagcacaaaaataaaccatgacaagcatccatgtatttttgtatccatattacttgactatttaaggaaatctagagtccttactagacttcgagatagaacaactttaaacatcttacatttctgataacttagttataattctagaaaagtcttatgtgaaatcatggatccccatgtaattgtttacaaaagttcctactgggtaggaatgtggatgaatttttaaggaatctaagcaccaggatgctttcaattacagaataaagcacattttcacaaataactgtgaagtactagaaatgtaactcctatccctatggcaacttttcccagttattcttcctcagatcaatgcaattttgcagcaaatattcactagttaatcattctttcctccatccttccatagggaatagaaatcaagggtcccagcagtggcaacagaaatattaccaaagaagttgggaaaggcaacgaaggtaaagaggataaaggacaacatggaatgatcttgggcaaaggcaatgtcaagacacaaggagaggttgtcaacatagaaggacctggccaaaaatcagaaccaggaaataaagttggacacagcaatacaggtagtgacagcaatagtgatggatatgacagttatgattttgatgataagtccatgcaaggagatgatcccaatagcagtgatgaatctaatggcaatgatgatgctaattcagaaagtgacaataacagcagtagccgaggagatgcttcttataactctgatgaatcaaaagataatggcaatggcagtgactcaaaaggagcagaagatgatgacagtgatagcacatcagacactaataatagtgacagtaatggcaatggtaacaatgggaatgatgacaatgacaaatcagacagtggcaaaggtaaatcagatagcagtgacagtgatagtagtgatagcagcaatagcagtgatagtagtgacagcagtgacagtgacagcagtgatagcaacagtagcagtgatagtgacagcagtgacagtgacagcagtgatagcagtgacagtgatagtagtgatagcagcaatagcagtgacagtagtgacagcagtgatagcagtgacagtagtgatagtagtgacagcagtgacagcaagtcagacagcagcaaatcagagagcgacagcagtgatagtgacagtaagtcagacagcagtgacagcaacagcagtgacagtagtgacaacagtgatagcagcgacagcagcaatagcagtaacagcagtgatagtagtgacagcagtgatagcagtgacagcagcagtagcagtgacagcagcagtagcagtgacagcagcaacagcagtgatagtagtgacagtagtgacagcagcaatagcagtgagagcagtgatagtagtgacagcagtgatagtgacagcagtgatagtagtgacagcagtaatagtaacagcagcgatagtgacagcagcaacagcagcgatagcagtgacagcagtgatagcagtgacagcagcaacagcagtgacagtagcgatagcagtgacagcagcaacagcagtgacagcagtgatagcagtgacagcagtgatagtagtgacagcagcaacagcagtgatagcaacgacagcagcaatagcagtgacagcagtgatagcagcaacagcagtgatagcagcaacagcagtgatagcagtgatagcagtgacagcagtgatagcgacagcagcaatagcagtgacagcagtaatagtagtgacagcagcgatagcaacagcagtgatagcagcgacagcagcgatagcagtgacagcagtgatagcgacagcagcaatagaagtgacagtagtaatagtagtgacagcagcgatagcagtgacagcagcaacagcagtgacagcagtgatagtagtgacagcagtgacagcaacgaaagcagcaatagcagtgacagcagtgatagcagcaacagcagtgatagtgacagcagtgatagcagcaacagcagtgacagcagtgatagcagcaacagcagtgatagcagtgaaagcagtaatagtagtgacaacagcaatagcagtgacagcagcaacagcagtgacagcagtgatagcagtgacagcagtaatagtagtgacagcagcaatagcggtgacagcagcaacagcagtgacagcagtgatagcaatagcagcgacagcagtgacagcagcaacagcagcgatagcagtgacagcagtgatagcagtgacagcagtgacagcagtgatagcagcaacagcagtgatagcagtgacagcagtgacagcagtgatagcagtaatagtagtgacagcagcaacagcagtgacagcagcgatagcagtgacagcagcgatagcagtgacagcagtgacagcagcaatagcagtgacagcagtgacagcagcgacagcagtgatagcagtgacagcagtggcagcagcgacagcagtgatagcagtgacagcagtgatagcagcgatagcagtgacagcagcgacagcagtgacagcagtgacagcagtgaaagcagcgacagcagcgatagcagcgacagcagtgacagcagcgacagcagtgacagcagcgatagcagcgacagcagcgacagcagcgatagcagtgacagcagcaatagcagtgatagcagcgacagcagtgatagcagtgacagcagcgacagcagcgatagcagcgacagcagtgatagtagtgatagcagtgacagcagtgacagcagcgacagcagtgacagcagcgacagcagtgacagcagcgacagcagtgacagcaatgaaagcagcgacagcagtgacagcagcgatagcagtgacagcagcaacagcagtgacagcagcgacagcagtgatagcagtgacagcacatctgacagcaatgatgagagtgacagccagagcaagtctggtaacggtaacaacaatggaagtgacagtgacagtgacagtgaaggcagtgacagtaaccactcaaccagtgatgattagaacaaaagaaaaacccataagattccttttgtgaaaagtttggtaatgggataggaaaaaaagatttccaagaaagtaaagaaaggggagaaataaacataagacgtatgtaaacaaaaacaactgggggaatcaaatcaaacagttggattcagaaccaagacctaactcctgcagagacagactctgaatgcatgacctttggtacatgcctgttaatattcatgttctgaaaatattttgttaaaagtgtaaatctaaacataaaagaacaattaaaatattctttaatacttcacacagaaacctcaagtaatcactacatgataacttcaatttaagtgccatgtgctgcagagaatgtagcaggcagacacatcttaaaagcaacctgtggcattgccttaagtctccatagttatatattctggagaggtggtctgcttaccgctgagtaaaagatgctgtactgtgatagccaacttggctttggattcagttgcttgttctatggaagaaatacatttatttgttacatgaaaaaaaattgcagctactattcaacctacctgggctatgggaataatctttctaatgatcaaatagagtagttataagtcacagaaattctaaagagtgctagtcagaaagagctcagagacaggttgatgtataaaatctgatctgtaatctgatgtatagcatctgatgttaaaatctgatgtaaaaaaatacatctcaacaaaccactggaaatttagtacaaagtccctaaaactattgacaaagctgatgcagtgcttagaacagtgtcttactcccaggagccactctccaaatgttaaccagtaaatgacacatgaatgactctggaggagcatcacttagaagcgcggtggctcacgcctgtatcccaacactttggcaggtcgaggtgggcggatcacgaggtcaagagatcgagaccatcttggccaacatggtgaaaccccgtctctactaaaaatacaaatatcagctgggagtggtggcgcgcgtctctagtcccagctacttgggaggctgaggcaggagaatcgcttgaacccaggagcggaagttgcagtaagctgagatcgtgccactgcactctagcctagcgacagaacgagagtccgtctcaaaaaaacaaacaaacaaaaaaactgtgttatgtggtatcaattatttatctttacatcagtctcaccaagtcattcttagttcacatttcccttgaaaacctcaacacgccaaaacttctaaaccagaccctgagtctcccttcccactattaatctctttaataaagctaaagctgctggtgggtaatggtttggaaaacttctctttcttatttgagagtcatatatgcagttacgatctgagtatatatcactcagctttggcatgaatgaaggtaattcttagccccaagatgaagcccaatttctagaaaatgacaatcttaaaggtgtatagagaatagagattgatatttaatagtgtggagatatagtttatcatctaaattagggcactttggagaatgaaaggggtgttatgagtaattatacggagacaggagatataaattggggttgtcccagggaaactgggagatactataaccctaacccataaaccttaagggtatttttcaagatttagtagtgacgctttgaaatctccatctttttccattgaggtaattattttagctttgttctaaagcaaagctgaaaatctatagagtgagattatgaatgcaacttctttaatgttaattttcaaccagttgttagttgaccatttaccttctaatattaggcatattttatgaagagtttcaggaggtttatttttctgccttcttcctcctctatgcaagtgtccttaggtaagagatcaacattgtgaggagtattgttgaagactttaaaaatactattcataaacttcttggtaactcttaagagtgcaaaatgtccaggtttgtactacatcacagtcatgtcatgactctaaacttctttccatataatatgttctaggtttttaatttctttagattttagggttttttctttcgttttgttttgttttaatttgtaaagcattgcttctagtatgtgtcacaactatttcaaaaggttgctatgaacactaagtcaggcaatggacatggaactctgtaaactacacaagatacataaatgaaggagataaatctcggtgttataataaatatccatttattaaagtaaatatccttttatacaattgct

SEQ ID NO: 16238 - DNA, 59828 bp, Human
  misc_feature (1)...(59828): n = A,T,C or G
ccccttgggagacttggaaaaatggtctgtgtcttccacacttctcagagcagatgtgcacagaggatgtgcacaccagggagaagcatggtcaaacactgcccacccctttatccttcctccgaggagattgctcaacccctagaccttggctaaggaaaaacatcctattgtctgaggcaaaaagacatcaagtcctttcatgctgtcctgggaaaggcggtttggaacaagttatcctgattctagagacgtgagtgttcccagctgcaccgtgacttgtttttggctcctaggcaaagtgcccagtttcctctgctcccaaatttctccaactgcaaagtagagataatccttgttacctttttcttgcagtgttctgaaaataaatagggcaaataattctaaagtgttttgagagatttggctgagggcatatttgcctagaaatgtaggtgggggtttttggtttattttggttttattttgtttttgtcagtgtttttgcttttggccagacgttggcatgcatttagaaaatctaaattaaattaaattaaattataattattcatctgatgataatggaacatttacaggatgcaaagcactgtgctaggcaccaggagaatgcagaaagggcacatccccttccttcaaggagtttacagctttctcagaagcaggtatgatatatatatgtgtctatatcacataatagagggattatagataagttacacaagtgtggctgtcagccatggtagctgatttggaatcccatcctgtaagttacagttggataccctagaaaaaacacccttactaagctttggtttcctcttatgtaaatgataatagctaacatttattgagtgtctgctacgtggcaggggtgttctatgcagtttatcatgttaactaacttaaaactcagaacaattgcagagatagatattatcatcatttccatatgtatatccctgtcttatagataaaagcactgatgctttagagaggttatataacttgtcccgggtcatagttaggaagtggtgaagataggatgcaaatccaagctggctggcctcaaattctgccaatccaaccactgtatgacactacccctcaaatgggaacacagtaaaacttaccatgcgtagtgaggatcaactgataataacgcataaaaagctgttagcacagtgtctgacacataataaatgtgtgataaatgtagaagtagcagtagaagagattagacacatacaaacaaccagaatcccgggccaaaaataagtgcacacctccattctttttatgggaaacctccttcttagataccaaccattataaccatggagttacagtggagagctgtgttgaggggagaactgcaacatttctgaatcagcatacaagtgatctataatataaggagcaatcatttttatatatgtccatttccaaatctcattcaaagaaggttaaggtatctgaagtacccttctattaaaattcagactgtatttgctagaacaatttccaattgagcaacgtaaaaatgcatctgctgccatttctcttcttccctcctttaatccctactccccaatttcctttagaaagaaacaacagcatggagtttcttttcaaggtcttaaaataaaaatctccaaaaaagggatgctgcttataaaacctttcagagttgtttgaaaaagaaaaaaaatgcataaagagccaagtgcttatattctggccaagttatgaggctctgagaacaagagcttgaggggaagactgttaaccccatccacgccaccagaattagctctttcccttttggtttgcaagcactgcctgtaaagccctcgcatgagaggccagcctgctagggaaatccaggaatctgcaacaaaaacgatgacagtctgaaatactctctggtgccaacctccaaattctcgtctgtcacttcagacccccactagttgacagagcagcagaatttcaactccagtagacttgaatatgcctctgggcaaagaagcagagctaacgaggaaagggatttaaagagtttttcttgggtgtttgtcaaacttttattccctgtctgtgtgcagaggggattcaacttcaatttttctgcagtggctctgggtccagccccttacttaaaggtaagttgtaataaatttacggcattatctaattgcatttgttaagctgatttgcgtgatctgataaagctgtcaaatatttttgcctaaataatacaaagccatttatttaccaaaaaaagttttgtgtgatttacagaaaagatacttcatagagaattttaccatttgtattcatgttttcttgtttcctgcgaaattaaatagcaagtactaataaatgatggtgattttagtgaagaccaagaatagaaatgtggaactgttgatcgcctcagtagcattcagatcttagtgaagcctgaatcctgaaatgtgttttgtagaagtactttattacatatatgaaataaactataaagaaggtagtttttaaaaaaaatttcaaatcaaataatttgtatgttttccatgtttaaattatctaaagttattcaatctcctgagcctaacagcaatgtagaaacggaactttttgcttttccaaaaggtaggaaaatttctccttttatactatattcttgtttgattatttttaagttattgcgattattttccctttcttggttcccttttacagctttataactaattattttttgcctcctactatcatttgttaagatgctcacacatagacctaaaatttctctaattcttgataatgtcttatttacaaaagcaaaaatgggagaagagaattaaagagctaaagagattatggtaactcatattataatgtactaccatttctggctctcttttctaaaataaagcaataatgtaggttgtgcttattcatccttcccaggtattaaaggtcactctgcaagagaaaaaaagaaaagaaaggaaaagaaaagaaaaaaaaacatgcttttaactgcagatcaatactgttgaaacagtacaccaagaggtactgcagaaagagtatctcttttgcactgcctttaatctgcaaagaggttaaatatgtcaccttggcattgtatctgagctctcctctggcccagggcctaagcacattgaatagaaatgttcactcagtccaagtcagcagaaatcttttttttttttattctcccctttctcgtagacaccagcttttttcagttcacagcttactcagtcaaacctgatggttgtgactattgttaactatgattttttttttattcaaaacaccctctttggaaagatttaagttaatatttctgttcatttaataagatctagcaaagcagagcagtttatttcatctacttatcgtccaatcaactagtgccactttccacattttggagaagaatattcacatgttatttatgaaccttgcctttttctttcagagaatttttcacacagccattgagcaattagagtgctggcatttccttcctaggtcttttgagatttaatccccagtagctcctcatggcacagattcacatatcaactaagtaaaaataatagtgatgacagaaataaaatgaatagtgatgcatctggacaacttgaaaacattatttatttcatttcctcttgactgttctttttactcagttgacttaaacactgctattttacttaagtttagcaccatatccagaactggttgggaacatttttctaccgagaagggcataaacaacttgttagaagatctgaagtgcacatagtcctcacttatccctctagaatgatcttcagtggagaaggagacccccataaataaatccagtagaacttcccagtaggcctggcttcctgagagatgtccaaccaggccagggtctgtttcttacggggctcacagggcatcttctgccaaaggctgagttagcgatgatagcattacctagggctagcctggcttttgtcttagtcatcaaaagatggatagaactttgaaaaacagagtgcatggtcttgatgattgttccaaaggtggggaggcaatctaataaagtgaataaggccatgacctgtggtttatatctgaccatatggaccctgtttatataagaccgtggtttatatccaagctttaccacaaaatagctctgtgactttgggcaaacaacttcatctctttgtgcctcagtctcttcattcatggaaatgggattataaaatcagtagctacctcagagatttgttgtaagaattaagtgaagaaaagagccatgtttggtacattaaagcaatcaatcaatcgtagataatatgaaagtactggactaactatatgtccctattgaaactccgtagaacgggaactgactctagatattttctcagggtttcttccttgtacttatacgttttgctctataataaaatatgaatgccaggtgtatgcctctgaggcagcacagcagagtggacagagcatgggcttcagagtccaatgcatctgggctagaatcctgactctgcttcttacaatcagtgtaagctttggcagttacttcccacctgcatgactcagtttactcatctgtttagcaaaatggggataataatacacacaaatgaggtcgttgtaggaatgaaatgtgatgtttattaaatgccaagtatagcacctggcagagaagtaaacacataggaaagttgactggttgctcataaggaatctcgtatatcagtgaggcctctgttacatacttgcaatgatttctctggtagtaacaatggagatcaagaaggaaatattctttgaattgccttttttatccaaagaaatgtaaaagtaaatcggacactactattttcccctggtggggggcctcaacacgaggtatttattactatgagacttcactgctgcatcagttagtagcttcttaatggccaagtcaaaggaaaccaaagaaagtgttctatgccagcttgccattacacagagtgagaagaaatgctgctttgctgtcaattctgttttattggcccacttggacaagagggaaagcccccaacatttcttctttcttatctcttctaaaggcaagaatagggcttttgacttgctccaggggatattttttcctctctaactgaaattcaagtgaaagagtcttttttttgtttttttgtctttgtttggtgtttttgtaaacctctcccctatgttcctagcattgaaatgtaagctgctttttctggctgcatgtagcaggagcaggctgtcgtcatagcaatgaaagggtgtagagagactcctgcttcatgacctgctctgggaaataactcttagtctgctttaaaatccttctttagaaatgaagtctccagtcctggcttgtttccttcctattacacaaccaacttatgtacacccattgcagtagctaaatgtttcctttaaagatttagtgaataggtattttaaaaatcaacaagagagctgctaaaacagtggctagtttactgtggcatacaggggaaaaacaactgggaaggcaaagaaagagaaatagaaatggcctcacatgatacacatactgcagcaaaccctgcaataaatccatttttcaagttcccactgcttcctcccatcttcacgatgtgctatggtgtagtggttatagaggggaattctggggcagactgcctggacttgaatcctggcactcataccttctagttgttttaatctaatccattctgtgcctctgtcttctcatctgtgaaatagatataataacagtcataaaattgtcatgggaattgaatgagattgagcatgtaaggcatttattacagtatctaacccatggtaaaggttggctgctaagctcaggagcctcagtttcccccacttgtgaaatgtggataacagctaattcataagatcattgtattttttttttttttgagacagagtcttgctctattgcccaggctagagtgcagtgacatgacctcagctcactgcaacctccaccacctgagttcaagtgattcttgtgcctcagcctcctgagtagctgggactacaggcatgtactaccatgcctggctgatttttgttgttttagtagagatggggttttgtcatgttggccaggctggtctcaaactccaggcctcaagtgatctgcttgcctcaggctcccaaggtgctgggattacaggtgtgagccaccatgccaagatgatcattgtatgattaactaaaataatgaatgtacatgctcaataagtagtagttattacaattctttttcatggttttgttattgaaacagcaaggttccagtctaggtcctgctgctcacttcgtagaaagccaatcactgagacaacaagtattgccaatgaagaaggctttaatcaggtgctgcagctgaggagatgggagcacagtctcaaatccatctcactaactgacttaaactaggggtttacatagcaagggaaaaatgtaacaatgtgtaagaaaataagaactaggtaggggtaaggaaacaatcatggtgaataagcggtcaggcatctgctgcagtgatctggtgagtttccattcttttatacttttttagaagcctgaaggtcctgtcctgaggaaggaacttagataaaacaaatataagtttcacactttaagaccaggagggtcaacttctatgtttttcaaaaagatctgtctgtgggactattgggtaagtttcagtttgatctaactctgacatgaatggcctttttgaacttagaattcccagtgagtcaaatataatgaatagaggcctcagaattatcattgcataaatgtgaaccatttgatttctacagggggaaaaaaaagaattgtgactttttacatttataaagactcatctcatcttgattaacaccagggtaaaaagtattaaaacatcttatctttcattaactttttattacgtttctgtttcagttcctccagtgttttctaggtcatgcaattatgaaaataagttagcatttttatcttacatctcaaacaactaatgtattcagtgttctatcccatgcaaaattccagaaatgcagcaaggagcaaaactagagaggggctgagctcttgtggtgcttactatgtagttatgaaaatggtcattaatcaaaccatcacaataatgaaaactgcataggaccaaacataaggtgcccccaaatacaatgccatcttcatctttctagtgagaacatcctcaaccaaagtgtttggccaaacagcatgtacaaatgggtaatatattgtaatgtacacttgggatatttaatctatggttcacatacatatttaatatgttactttaatttaaatattttatacttattaacatgactttttcctttctcacatttcatgaaacaattttgttaaaactcttcatacgcatctttaacaccaatgtgtatgttcactggatccacgctgtaattatctaatacagagcacatcatcaatccttctgcaagttgctaaacatctgctgatgctgcaaatttaatccccaggcattagtcctcactcgtggtcatgttctccacactttcattactgactagattgtttttccagtgctttttaaagggcgtatttaaaaaccacttgaaactgtaagtgtggctttctaaaactatgtgattccaacttgcaataatgaagtcatacctcaggaataatgactaaacctgctttaaatatctttatctattttttcatccattttgtcaaggtgaccttcctaagaataaaaataagcattgcttgagatttttttttttttttgagacagagtctcattctgtcacccaggctggagtgcagtggtgtgaccttgggtccctgcaacctctacctcctgggctggagcaattcttctgcctcagcctcctgagtggctaggattacaggtgtgcaccaccacgcctggctaattttttgtacttttagtagagacagggttttgccatgttggctaggctggtcttgaactcctgacctcaggtgatcacccacctcggcctcccagagtgctgggattacaggcatgagccactgtgcccagctcttgagatgatttctaattgtttttttgaatagtactttgctgctcaaaatgaagaaactttggaagcacttgaatataagtcaaatccctcttttttacggcaggatttggtggcgtgagaaaaaacacattttatttgaacacatgccatatataatgatacactgaaataagtgttatgaaggcaaaacacctttgttccaagagagtatataaggatcctgacctccactcaggatcaataatggctttccttgatctgaagtctgaatagaggttaactctgtgtgtgtgcgtgtgtgtgtgtgtgtgtgtgtgtgtgtgtgtgtgtgtgtgtttggtggtggtggctgggaggagcgggtgctggagagagaattctgacagcgtgaacacttgtgcaaagaccctggagcaagagggatcgtggcctatttgaggcactgagaggcagccagctcccgagagcaagggcagagcagtggaagatgtaaatctccataatactcccttccctgagcactaaatgtatgtgccctttgcttgattcaggtttaatgtatacttttaacgtctggatggatttctggttagtctcaaagccccaacaggcatgaccatgtctatccctagctcagactcttatggtggtaggttcaattaggaaggatgatgggcagttgaaggtcagatgcccagaaaagtcttaagtcattgactctgagtatatcatatacactcacagggctgggacaccttgatgtcagatggtgactcagcagagaactcaaaatagaagaacgtctttttcacccttcagatgactttagggccaaaccatagagctctccccagagactcattaatactttaaaagctctaaagcatcagtgttaacactggatcaggtaacagcacgtatatgttagccaaaatatgactaagagatttgctctctgataacaaggcctttgactattatgtaaaaacaaggtgaacaggaacgttctgagtctgtttataaagtacctataataattgttttgtttactacatttcccagaaaggaaatttttccatagttgtaataattgctaaaaatagcagtctacaggcttcctctgatataaacaaattcaacagaagatacctggccttatttggatgcatggatgtacatactccaggaaatgataggccaagagtaataagaaaaagaaagtaacaagacaaacctctcctttttctagtacacatggtatgtctttcttagttcattaaactttagacaaagtgataaacagatcaagttgtcatcatctgccttgaaacccaaaaatattgaaacaagttccctaggcccagaagggaaggaagaggacttgtaaattttgctgaggctgccacagaaggagctaaccactggagggttcagactggagggttcagaaaccaggggaatgctaggcaacacaaggaaaattcaattagaaagacttgaagcaataactaccagcactaaaatttccagggagtcactgatgtggccaatatgaaagaggaatcctgttcctcctttcagaggtatggatgactgcgtttacagtctggttcagtgttcagacagcttattaatgcttaagagaaaaggaaagagaaggaagatagaaagaagaagtacagcaaggcaagaagtgcccaggggagcaggtgtgctaagttgatttaagtggcatggcaatatacagaacttcaaaaataaaatttatcttttaaaatttaaatgtaaattaatgttctaaaaaactataggaactgaaaataaatcaaatacaaatatctacttcgacctaatcttactgtaatttaagtttctaggaaatatcatagaaactgaagtggaaccaattacagaaaaagaatgcaaaataaaccatagtaccgaaaataaaaacatattctggtcgtttgtgtaggttccctaataaatctagacggagaatgatgtttttgtgttttagtgtatgccaaactttagacaccctcctcttttctaggagatacaaatttcaggagcgatatttagctattacacacatagcttttcatcagagatgggggtagctgacacacacatggcccattctgcccatacctttcaggtcaatctctgatggcttggctgggctgtttccagctagcagaaaggatattcaggccccttttccttgcttttccagggacagagcttgtagagtgctgagaaatccaattacaacttcctttcatggtgaaatccaattacaacctctcccatggtgaaagccaatctttttgatacaaaaggaaactaaacaaaagggcttcaggcaggggatatgcttgtgctctgccttctcactttgacaattatgcaggaaggttgcaatgaccttggcttgccttgcttaggaacaaaagtcataatcttctaccccctactcccacaaaaaggaaaaacgttttcatatctgattccaggagtttggggagtttcctcaaggatccattagtcaggcaaagcaaattttgagccaacacttgctccctcccacacacttttttttccggcaagatgacttttcttattgaacttggaatgccatgttaaatgataaataaattagtgaattatttaggccaatatcctcccataatctgttcccaacaactttttttttttttttttttttgagacagtgtctggctctgtcacccaggctagagtacagtgtgcagtggtgcaatctcggctcactgcaacctccgcctacccagctcaagtgattctcctgcctcagcctcctgagtagctgggactacaggcacctgtcaccacgcctggctagtttttgtatttttagtagagatgaggtttcaccatgttggctgggctggtcttgaacttctggcctcaagtgatccacccacctcggcctcccaaagtgctgggattacaggtgtgagccaccgtgcctggcctgtttctgctacctttgtgatatccaatgctgtgtgtcaccctttcagccaacctgtttgcttgaggttagtgagactgtagtactgcttggagaggggtcatcctaaattcctaaaacctggttgagataaacggaaacagttctcaaaacagtaatttatgaaaatagatattttatgagtacttgacacaagtctataattgctgagatatttaaaaataaaattactaaccacattctattcaaatctctgtcacttctgtataatcactgtactccactgaatgtgtgtaaaatatgtatttgcagcttatagggaaaaaaatttgcaaattttcagaagaatcatgcagtcaactaataggttcttagttgaagattagtggagtggggagtggtaaatggttatctttttcaaaacttaggacaaactttacactaggttcaaataaaagtgctatggctacagagttaatgaacccaccattcaaagtggccctaaatagctctgaaagcaaagcatttttacattatttgattcaacttgagttatctaattgcctatataatatgatagggacccaggccggacacaatggctcatgcctgtaatcccagcactttgggaggctgagtcaggtggatcacttgaggtcaggagttcaagaccagcctgaccaacatggtgaaaacccgtctctactaaaaaatataaaaattagccgggcgtggttgtgtgcacctgtagtctcagctactcaggaggttgaggcagaagaattgcttgaacccgggaggcggaggttgcagtgagtagagatcagccactgtactccagcctgggcaacagagcaagactccatctcagaaaaaaaaaaaaagatagggacttgataggaaggtaccctgagatatacaaaaatcagaagaattgacctttatgataggtaaataaaacatgtaaatggtttcatgacgtgtttggtcagatgttcatgctgtcttagctcattgaaatcatttttaactttcaagccattagttcagtggatcctcccaaccttttactggggaccaaacaattttgagctaattctctctaaatcaagggagtattctattagaattcagaagaaacaaagcacaaattcttaaccctaagtgtcttctttttctctctttttcttccctgttgcccaactccagctaatgggttttaaggactttataatgagaagcaggttaatgtcttactagaaaaacttttcaataatttcctaaaatatggggagaagaaaatagtggaagatgttgttataaaatagaaaaatgcttggttgaaaccttggtactcgtattgatcttgtactcattagctttttggataggcataggcggggaagagaagtatcagcatcatctcactgataaaaacagctgatgtcttcttacagtctgaaaatgaagccattgatttcaaaagcaaatgttttattatactttgaaaaacactctggattggatcattcaaggttatgatagcctgagataactgcagcctcaaactcccgggctcaagcaatcctcctgcctcagcctcctcagtagctgggactacaggcacgagccattaagcctggcttgaggggaaaagtcttttcccatggtgggaggagaagaattaacagctgtggaccagctgtgggcaagctgtgtcttttccttgcttgaaggcatcttcttaacattttctctctgaaggcataaataagcttccaggttttcaccctattttcaaagaacttttcaaactctagccttaaaatccattagggtttattacatctgcttctttcagaaaaggtagataataagtaactttgcaccactgaggtaagcaagcaattgtttcccatattaaatgtgttggccctcaccaaggtacatgagaagcttggaccacgatctgaatcctaaagggacttctgctgggactgaatgcttgcattagcggttcacacaagaactaaatgctcatcaaagtacaccattattccccagaaggtcccaacaccatgagaatgaggctacttggaactgttctttggtattatttgttgtttttcttaatcctagaagagaactaccccccaataaataattcttggtccattcacagagctgaaagcacttgaaattcctctcccaactagcagaatttaacaactgacttactctgttagcaaaagagaggcaatttccactgaatccaaaggagttttatattatactggtagagtttaactaataagggaaattcaaataagagcagtcagaggataaagccaagaactaggcattcaggggaaagaaattacaggggtagtagagaaacaaataaattaaggggtagggagaagagttaaaggcagaaaaagcagaggattaatctatctgataattacaggggctaggctttaaaaggtgtattgtcttactattaacaacatgaagccaatcattcagatattattaagttactgcaacgtcacaaacgccaggactttaggtgagccatcctaagagcagattcagggtttgtgaagccaagagtttatacatatgtttggaaccttcttttttaaaaatataaaagtcaaaatcaagtctagaactttgtatggaggctgcacaagtgaggggccttgaaactcaagcttcctagttttatggcacgtctatcctggccatattcaaatgtctataccccaaatacaacaaaaagttcagaaaaataaataaatgtaaatatgagaaaatcctgtgttctctttctctgagaaagagaaaatagtagcacagataccatagtaggacttgagcaaagaaaaataaatatggccaaaataatgtctcccactataacacaggacagggtgtggtggaccctttctgaaggattggcaaatgtctgagaaaaagaacaggcaactgtctccctggatggatccatcccatctggagctctggaatgagacacagtgagattagtgagtggtatgataagacgagaaactctgaaaggcatgattaagagatggtgaaaggtggctattgcacaagcttgggtaagataagcctgggggatcctctaaatataattaaagtaatccctcaattacacattatagaaaaggaggaatggactagtttcgcctgagcaagaaagaaacagacctttaagaatgtgtctgaaaagctgtgcctccgggtgccctttggcttccatgctcctcactgctgaccaggcacagtggcaaagagggatggtcaggaagcactcactgaatggtagttctgtgaaatggaggtgagggtcacagatgggagtgcatggatggtacacaggtgaagtgcttagcatagaacctggcatatagtaaaatctcaggaatgtatatgccattgaatgagctactattaaatggtctaagacaaaaatgtactttttcaataaaataatactttgatgaccataagtgattctactactgagtacatttgagtgctattccacacaaaaatatttaatgtttacagccaattatatatggcttcttacaaactcagtgactcaaagcaactgtttcataatgtctcgagatctggtgggtcagaaatttgggcaggcctctcagaggtactcagctaggagatgagctgatctggagtggcacaggatctctccactcacgtgtcctgcgcatttgcaaggacagatgcaaagctgggattggtagaactgttgaagtgtcttctgtgacatgacagactcagaaaatggctcaaggctcccaaaatgagttttccaggagattaggtaaaagttccaaggtttcttatgacctagcctcagaagtcccagaacatcatttctatctcaatcaattggccaagtaagtcactaaacccagtccagattcaagggaaggagaattagactccacctctcaacaggagaaatagcaaagaatttatagcaatctctaccataatatttatacctattaaataagaaatgtaagaaattgtctcaaggcagttactcatgtgagttagaatagagttgacatttgtgggtgtttggctcttaatgggagacctatttctgccatgacaaatgattcctctggagatttgttttaatggtacatgggtcagccaatagaaaaactctaggcatttgaaattcaaatgctggatgttctctataaaatgctgtctagctatcatcttttaaaattccagctgaggttctcctgaaagtttggtaatgagacaccctgttcctaacagaaggaaagggctctccttccagttacctatcatccctcatctttaacctctctaaatccataaaaagaaacagtgggatgaagaaaagaaagaaataacctaaggactctagtaaagggatgaattaaagtgtctgaattattcattattggggttattaagccattttctgccttatgcatgtttcaaagatatgataacatctttcatttcatttttacagttggtgaaattaccaaataactataggatcacatttgaatctcaaaacaactccagaagatagataagaaaatgtaatattacctttcctgttttgtagatgaagaaaccagtgacttgatcaaagtctcttagctggtaaaaggcagttcaagtctggaacttagatcttccagttccgtaccaactgtcctttaaactatgcagctgcctttgaataagctcacgcatttgagcaaaataatattgatttagtttcacatcaatactgcatatttaagtctttgagaataataattctgtgaattccaaaatttgtctcatttttgcatttttcatctggagttttattttctatttctgcaaaaataatctgtattttgtagtcagtgcacaccaaactcgaatgtctcaaaataaatgactttttactcatccaagaataaatggtattcatcatacttagcaaggacatcatggttttgatttttcaaagtactttgcaagcatcagctaattaagcctccctgagtcttcagtatgacagttgttttcaaaatatctctcatttcccaggaaagttctccattctgtcttatttatacaatcagcacatttgctcagttcttaaaataagaagctaaaggccatgaaattatttttgatcaatatgtggcaaatacaattagctcagtgagacaaaaatgcccagtgactagtctaaaggacaacgtggaacacaatggaagaacacaaggcgttttaaagtctagatactggattgtcccacaaggtccttcaaaaataaaacacaggcatcttctttataattgaaacttgaaggggtttcctgcttggatcattctaaatgacatgaccatactctgcgtttaaattttgttttcaattacaggatggaaaaaaactcttaaaaaatagttccatctttggactcagtaaaaatcagggaccattcagtaaatgttggctctcaaaaagcctgcacaagtggccatctgaggttatatgacaatccctagacttgttctatgccttaaaatatcttccatacagctacgccaggattctcagcattcgatagctctttttgggttaagaacaatgtgaacatacctcttacctgagaatagaaatacattaattcaggaataatcttttttcttttttttgagatggagtctcactctattgctggagtgcagtggctcaatcttggctcactgcaacctccacctcctgggttcaagaaattctcctgcctcagcctcccaagtagctgggattacaggctcatgccaccacgcccagctagtttttgtgttttcagtagagacggggtttcaccatgttggacaggctggtctcgaactcctgacctcaagtgatctgcctgcctcagcctcccaaagtggtgggattacaggcatgagccacaatgcccagccctaattcaggaatattcctatttcctcggtatggtttagatgcatgcaaaaaacaaagatttaaaagtatagaatataggataggtgagtttgtgtttaatgagtgaactaaaagtaaatatgttctggaactagctcctgggaagcttgaaatcccctaggggaggaagatacggaaaaggggaggagaaacactaaggttcttttcccttatatcacacttaatacaagacatatgtagttaatacaagatataaatgactctaatgatattactgatgacaggcagcaggcagaacaatgaaaataataatcatttgcatgtgtaaggtacttcagagtttgcaaagagcttcctcacctcaccttgcaaggagctacctttgacatcggaaggaactggtattcccatcctatatatgaagtttggagagagaaagtaatttgttcaaggtagtatttagtacttggcaaagccagggcccaaagccagaacttctggcttctagtctgtagcctgttcactagtctgtttggggagaatattggatactgagtccaaagctcagcgtttctaattcttgcccacctcttaagccttgtacatttggccaaataatttagactcttcaaatttctgtttctttacatttaaaaattctgtccctcctttcttcattgaatcaaatgagacagtatataagaaaacactttataaactgtgaaatgctaaataaatacaaggaatgtataactaaatccatcttaataagttaatattccttggaaccctgcctcaagacatccttacagttaaactttcctcccttttgtgttaaagaataaagagttcctccttctctttggagttaaacctttcacatgtgctttaatagtagaccagtaaatatgtatccaggatttaccaagatggtattgtctcacttaatcttcatactattttatagacaatgagctgaagcccccaaaagctacacaatttgcttatttacgcaaattaagtattacagcctatgacatcctgtttcagaacttatgcctttaattgttatgaaatattgtcttgctaatggttttggcaactggtctgttttgccttattttggttttcggttgctgtaaaacagtatgctctcacattaaatggcttaaaatcacatccctgtatttgctcataattctccaatctggattgggctccactgcatgattcttctgctgattttgtctggagttaattcatctggcttcagtgagctaggaacacatctggggctgaatcatccaggagggtctgttatcctgcaaggttccagccacatggtctctcatcattcaatagtctgggtcaagcttttgtacagcatggctgatagcttccaccaagaggaaaaactccaatgtgcaaaggtttaccaagtttctgctggcatcatgcttgctaatgtcacattggtcaaagcaaatcacaaggttaaggcccacatcatagggaaatgaagcccagaagttgtggtttactgggggtcatcattgtttaccattatctcctctcttaccctttatcttcaatttttccttatttacctgtcttttcccttcagcacagaagggaaatctggggccgggcatggtggctcatgcctgtaatcccagtacttccagggggctgaggcaggtggatcacctgaggtcaggagtttgagaccagcctgaccaacatggtgaaacccccatctctactaaaaatacaaaaaaattagctgggtttggtggcgcatgcctataatcccagctactcaggaggctgaggcacgagaattgcttgaaccctggaggtggaggttgcagtgagcctagatcacgccactgcactccagcctggaaaacagagtgagactctgtctcaaaaaaaaaaaaaaagagaaagaaagaggaaaggaaaggaaaggaatctgaatgatcacattcaaatacaaatataaatttcctgtaactgcatattccctttaagctaccacgttactctcctttgcacagccaatcatttttagagtggtctacactcactgccctcacttcatcactgcctgttcattctccaatcactgcaggctggcatccaccgacaccacagcaacaaaactgctctccctgagatcctcaataacctctgcacttccagaggcaatggataatttcctgaccttgtttgctttgaactctctgtgacatttaacacttcccttttctcatgtgactcttctttctctcactgtttgtatctttagctcttcccatcctctgatggtgcctaatgatcttcactccccagggttctggctccagctctctgctcaactggttgaataactgctcatgctacagcatgcaagctacatctgtaaccccaaactccatgcttacctccagacctatctacccaagtatctactagatatctctactcaaattcaacaagcccaaaactaatccaccgtctgtcttctaaaaccaaaccttcctcctataatccttcaccttggtaattaataccaccatttactaagttgttcatatgagaaatgtgactcaagacttttccttctcatattcctacaatatctaattcgtcattaagttttatctgttctttttttaattatttcttagaactatccagttgtgttttggtaaatgagcaacccattctctgagagagggagaggtgggtgacacttgatggttttcatggtgtgactgatcctcccaccacaactgattttgatgcaggatattttcttgaccccttcacggaactcgcggcaggggtgccttgtttactcagcccgccctgctcaatcccttgcaggagggagtgcgcaagcgaatgactgcaggaacctgagcgagcgaaggcaggaactggccactttggcaccagcaggagcaaactccatgtgggcccctcaccagcgtccaggtgtgggcaccagccacgccaagccccagagggcgtgtaaccatactcttagctccaccgtccgcagacagcagtgtgttatcagctcagtgagccctttgcctcatcacgtagggcaactgccttccgccagcaagggcaaagggccagtgcgaccgcctttttggatacctgcacgtagtgtgtccgagttcttgtccagtgcccaagaggaatgaggtcacacagatgaattgaaggatggcgaatgtggagaattttttttttcagtgacgaaagcggctctcagtggagaggtgagctggaaagggaatgggaagggaagatccctctcctctgaagtcaagccacctctctcctatgtccaggcgcttcttctcgacatcaggctgcttcttccctctgctggctgagttctggggtctttatgggcacaggatggggacggggcaggccgtaggtagttttggaaaaggcaatattcaattggtaaaaagacagtattcagaaataaccaatcgggagagaatggaagttctcactttgggctgtgggtttcaggcttttcggcttgaaggtgggattttgccagcgacccgcccctgtatgcctacagtttctctgcctcctgttgctatcaattttaagctaccaacatgacgccactgaacagaatcgggaagagacatgcggaacacatattatatagtatttccaccaacagatataatagatgtaaataacctcaaaagagtagataatagtaaaataattatgaagtgatgagtttctactattttctttgcttttaacataattaaattatacatgtatgtaatttaatttttaattgatgactttaacaaccaactcaaaaaagtcttgaaatgtaacaaacagctctcacaaaccagtacaggttggatctatccctcttttctccactcctaagaccacagcccaaatgtaaggctctgaccacctcaccttgatgttacaattgtctctcacaggtcatgctactggtctgtcctccacacagctgtcacacatacaaatctggttatatcatcacccctgtccacacatgtgtgcacacacacagacatacacacatgcgtgcacacacagacacttacaataattctttgggtccctatagctctatggctggaatttttaattccttgtttaatgcactatgacttttacaatatggctatctgcttacttttgagccttatctaccccagcccacttcccctattgacagcctagagacccaaatattaacatcctagagactcgatgcttctgcaacttcacccatgctgctgcctgccaccctctagagtacatctagctgtgtgagaacatccttcatacagctaactactgtttattagttttcaaacctcagatcaagaattaccttctctggaggtcatctctatacagtagttaagaacactgtagttaagaacacagacagacctgatatcaaacagaagtgttaaatatctgctgtgccacttcctagctgtgtaaccctgaacaagttacttaatctttatgcccgagtttccttactagtgaaatgattacaataatgtgcttacctgatagaactgttcagaaggtttaaagaatatgtgtgtgcaaagctcttagaatagtgcctagaacttaagtactttggatgtagtaaagttagctattatcaactacctaatttaaaaatgcctcctatctctctttccattgcattatgtacataatcatcacattacactatatgattttatataaatatattatatatttatagatacattattagtatatacatatatagatacgtgtatataatacatatatagatacatgtatataagtatatagattatatatgtacacatatagtatacatttagccctcaacctgtgggatctgacactatctccaggtgcacatacatagtatatacacatatgtatactatatatatatatatatacttatatacatgtatctatatatgtatatatttatctatatacgtatctacattacatacatatatgtatctatacacacacacacacacacacacacacacacacacatatgtttcatccacggttcctgtctcataattcccatagacctttttataatgttataatgttggtgcattttaggcctcataagcggacctcagaataacaggatttctctctctctaatcttctatttttttacctgctactttttctccccaaggcaggactctaatcttcctctgcctttacctaccttgtgtgattgtaggtcataagacccccatttcagaaggggttctgccccatattctggaggaaggaatgttgcatggagaggccaagaagaggcccagcacagtgatccatgtctgtaatctcagcacttttggaggccaagatgggacaatcgtttgagcccaggagttcaagaccatcctgggcaacataggaagatcctgtctctacagaaaaaaaaaaaattaattacccaagtgtggtggcaatcacctgtaacctcaactacttgggaggttgaggtgggagcatgcttgggcccaggaggtcaaaatcacgccactgcactccagcctcacagtcagagtgagacccacctcaaaggaaaaaaaaaagaggccaaaaagaatctgaacagatgggccttaccgggtttccccactcagcctttgagtactaaagcataccctttttgtctaaacacatttctatgtggttgtcaatggtgcctatcctttcatgaagtctccataaaaggcccaaggggacgaggtttgaagaaattacaagataactgaacctatggaggttcctagagggtgtgttccggggagggcttggcagctctgtgccccttcccccatacctcaccctttgcatctcttcacttgtatctttttgtaatatcctttattataaaccagtaaatctaagtaggtgtttccctgagttctgtgatgcactctagcaaattaatcgaaccccaagagggagtcatggaagcccaacttgaaaccagtcagccagaagttctggaggcctgatcttgtgactggtatctgggaaagggaagatgtcttgtgagactgagccctcaacctatgggatctgacgctatctccaggtacacagtgtcagaattcatttggaggacactcagctggtgcctgctgcagagttgattgcttgcatgttgatgacaaaaaatctcccacatttggtcacagaagtcttctgtgttgattgtagcgtggtgtgagaccacaggaaaagcagttagagattttccacacccagaaactcttaagagagaaactatgtgtccttgtgcttaggcagtgtctagtaagtactcaatgaatgaatttaaaaaaaatggattagtgatgcaagttctggccaactggacattctttccttttgattcattcagctacatttagatttagggaaatgaagggaacttgtgagatcatgtgagatcatgcggacagattaaaagggaaatattttctcaaatttaattagttatgcatgttgctgcaacaaacaaaaagaaatgagccttatgatgcaaaacacgtttgataattcttactccccttttaagttgtaccatttgtaagaaaatagggtagcattccatgtgcctaattccactgttatgtgtgatgaatgtcggaaatactcctggcattaaaaggagcctaaatgtgtggccagaatggactttaatgttccactggacaatttttctgacctcacagcaaaacttaaattacattattttctgagaatctaagttgtttattcaagaatcacaacttaacttatcaggaagatgagagaaaaaagaattaaaatttattgagcatctcctaggtatcaggcatttttaccagtaccatttcttctaactctcacaaaactgaattagatgttttattagtcaaggttctccagagaaacagaacaaataggagataggtaggtaggtaggtaggtagatagatagatagatagatagatagatagatagatagatgatagatagatagagatatagataatgaggacttagtttacattaatggagccagtcccaagatctgcagtcagcaaattggaaagccaagagagccaattgtatagttcccgttcaagtctgaagacctgagaaccaatgatgttgagttctagtccaagtctgaaggcctaagaattggagggctgatggtgttaagtcccaatccaacagcagaatatcaatgtcccaactcaaacagataggcagagagagagagggaattctcccttcccctgcctttttgttctattcaggtccccagtggattgaattatgcccactcacattgggtagagcaatctgctttattctgtctaccaattcaaatgttaatttcttcagaacacaccctcagagacacacccaggaataatgtctaagtagatatctgggcatcccatggtctagtcaagttgacatataaaattaaccatcacagatgttatccccatttttagatggggaatctgaggcttagagggctaagtaacttgccaaagatcatatagatggcaaatgttgctccagagttcaaatgcatgtctctctaatctgaaagcaccagtctgcttccgctaaaccaatggttctcaatcagggcgattttgccccccatggaacatttggcaatgtctggagacatttttgtttgtccctagctggtgggggatgggggctcgctactgacatctaatgggcagaggacaggaatgctgctaagcatcctacaaggcacaggacagccccccacaacaaagaatcatcaagccaaaatgttaacagtgccaagataaagaaacccttcactaaaccatactattttgtatttctatagttttcaaaaccagtagaatagtaataacatactgatctaaaatataaggctaggcacagtggctcatccctgtaatcccagtactttaggaggctgaggtaggaggaatgcttgaagccagaagtttgagaccagcctgggcaacatggaaagaccccatctctacaaaaaaaaaaaaaaacaattagctgagcataatagtttgcacctatatccccagctacttgagagtctgaggcaggaggatcacctgagcccaggaactggaggctgcagtgagctatgattgcaattacactccagcctgagcaacagagcaagaccctgtctcaaaaataaaaataaataaataaaataaaatataagtgactatagttccataactctaataaatatttgtggaataaatgaataaataagtaaacattgaatttaaaatgtagaggaaagaaactgcgtttttcaatgattctttacaattagcattcactaggaggatagaatgttttaaattatcatcgctaatagagtccacatatttactttaagcatgaattaccatatataaaatattttattttaatacaataaaaatcatggaatatattttagtgggtttagtagtttaaggggaaaagatagcagcaatttaggattcatacaattaatggaattattttcaattttagaatcctaaaatattagggttagaggatcatctaggtctcactcttcattgttcatcacttgagaaaactgtatctaagaaagggcaagtgactttcccaaggtctcctggcagtcagggacactgctagagccagaatccagctctcctgacagtttaatgcttttcttgttttaaggtgtttttcaatgtattagagttttggggcagcggggggaggttgctccatgtttttacttaaatacatttttctttcatggaaaattgaattcctatgctttttgccttgtttaggccataagatgttttattgaaagaaactttcaatatcaagtaatccaaccaaccttctaagataagccttttccttcaacacaaagaagtgcattttgccaagtacgtaccatcttactccttaaaatgtttggaactttttgtttaaaaactcaaactcaaagtgaaatctcaatttgtcacaatggtggtttttttgtttgttttgggatttttttagtttttgtcccccttccttacacctttgtgtaagaggtaaaatggagaatttgcaaaataactagaaaaaagctggagtgggagccaggaaatctagcttcaatcccagctccccttctacagagctcagtgatctccagcatgtcacactgtaggctttctaggcctgttcttcatctgccacatcctggggttgttgtaaagatcaaataaggtaatatcccatttgtaaatttatttggtaaacccaaagcactatggcaatagaaatgtcaagtatattttatatgccattacccgttctaaataaagtaaacacccattccattgttaatattctaaatttctccttgttatatgtagtcattttcagaaggatcacttagaagaattatacttgagtctccaagtacatgtccttttcattaaaactgggaattgattagtccagactagtaaggttataaatgatttaagtttctccccacacccctgattcaaccctcccacccccaccccaccacacacacacacacacacacacacacacacacacacacacacacacaataccaaatcactttctatgtgcagctttactctctattcttccaactgactgttccctggtccaggtggcccaccctggaccacctggatttgaatagtgagataggtaaaaatgtgttcttgttcccaatatgatgaggaagtctatgctatagccctgttttcttcaataaaaacttcatttgctgctagtttgagaggccgaggcaggtggaccagttgaggccaggagttcgagaccagcctgggcaacatggcgaatcccctgtctctactaaaaatacaaaaattaggcannnnnnnnnnnnnnnnnnnnagcctaggaggcagaggttatagtgaaccaagattgcgccattgcactccagcctgggcaacagtagcaagactctgtattaaaaaaaaaaaaaggaaaaaaaaaaacttcatttgctgagttagaaccaaagacccacaaagacccacaggaattcctatgtgtcacactaaaaatgatgatgataatgacagaggaaaatatgaagaaaatatgaaatggaagtcatctgttgtgaaatggagatgaaacatatacatatgttgccactccctgctaaaattccagaataatgataggaaaagaatagtaataatatagactcacagtgactgagataaaagaagaggagacaaagaagacaagtgtcaacacatctttagaagatggaagactgacttagaacagggaaagcttaaacctaagagtctgcagagaaggatgccatagacaaagaaggaagccattcacactgaagaacccatgcaagtttccagaattggaggcaccaggtgatttggaaggcagggtgaggatagaggctgaaatctggagtattggttgaaagcctatcagattaactcttagattcaagatccttcctcctgcctgcacagccaggggacttccatgtttcaacacaaacaggaaaaagcttattctctggctctgcactcagaataaacacaatgtcaggtgggaggtggagccatacagaaacctagggactaagtgaaaaatcagtgtgtgcactgagagaactccagtctcttcactgatttcacagaatgctagcaaccaggtttatatttgcttctcaaggtaagaggtatgaatttctcctctagagaaaagaaaatctccctgtaatatctgtcaatgacatttggggtgccccatcaagactgtcaggttactgctccttggaagccctccaatgctccatggaactattctttggaagccctccaagccctgtccataaagttctaattggctttctagtgactcactgcaaagtattaatggacagccaaatacatcagacattagagaaaagctttcaacaggaaaaacaaagatcaaaacaaactaactggggaaaaaaggaacaagaaggaaacagaaactgcagggtgcagaggaaattttcaaaatatttgattaatatcctcaaggagacaagaacatatgtcacactaataaagaacaggacaatattaaaaagaagccttcgggaaataaaaaattaacagtatataagcatattctcactcatatggaagcgaaaaagttgatctcatagaagtaagaagtagaacagaggatacttgaggctgggaagggtgaggagaagaaaggaatagggagctatttgttaaaggacgtaaaactatagctaataggaagaataagttctagtgctctataccactgtaggatattatatatttcaaatagctagaaagaagacactgttcccaatacaaagaaataataactgtttgaggtgatggatatgcaaattatccttatctgatcactatacattatatgtagtgaagcatcactatgtaccccatgaatatgtataattgttatttgtcaatttaaaaataaaattaaaaaagaaaatgaagtataaaggtataattttttttaatcaataaaacaggccaggcacagtggctcatccctgtaatcctagcactttagggggctgaggcaggcagatcactttgagctcaggagtttgataccagcctgggtatcatggcgaaaccctatctccaggaaaaaaaaaaaaatcaataggagagatgtaaggtaaaagtgagaaagtttcccagaatgatagacacactgttgaagagaagagcaaaaatgattagcaaatcggagaatcaaccccagaattctgatatttaactaatataaattctagaaagaaaagacaaaaaatagaagggcaaaaatcattaaggaactaacacataaaatgctccccagaactgaaatatataaatttccaaattcaaagggcctaatgagttcctaaactaaatgtaaaagtatccaaactaaggcagagatggtaatatttcagaagactagggccaaatgtaaaaacataaaagcatccataaagaagaaaaaaatactatgttcataaaaacattggggaaaaactcacatcagagttcttactagcaacactggaaattataagaaaatagaccaatgttttaaaaaaaattctgagaaaaaaatactccaatctagaattctatatctattcaaactatgtatcaagtaaagggtaaaatacagatatttttctaatatgcaataccttaaaaattctgtctcctgtgtgtggtttctcaagaaacttatggagtatgtgcttcatcaaaatgagggagaaaactaagaaagaaaaatatatgggacttaggaagcaagaaatcaaacagaagaaaaaagacaaaggggattaccagggcgtggtgaccccaggtatggaccccaggagaaaagctgcccagcagccggagatacaccagtccaaaggaagcaagaactccgaggctctgggagtgccacttccaaggggcgaaatggacacgagggatttccttacggggttgttgatgtagctctgttgttgttattgttgttaccatattaagaggaaattttaaattttgttggaaaattcaggaagaataagtgatgggtgcacaaaaaagtacgtaaaaagctttaaaaggaaggcaatttttaaatcaaaaccaaagcaaaatatcgttcaagaaaataaatgtcagtgtggttcaacacatgaaatgactacttggttcagctgtgaagaatatttacattgtcatgaatgttaaataaaaatttaaacaagaattatgataaaattattttaggaagagaaaggaggaagagaagtgtgtgcgtgcgcgcgtatgtgcgtgcgcgcgtacgtgtgtgtgaagtgatagttgttgcaatattaaatccctagagtaatatttaatatattttaaaatatccatttaagcacattgtttagaaatattggaataagtagcagaagaaactgctcagtttctttataaacctcaaagtcttacttaaaactctgtgaatgtgtttatgtttgcaaaaaataatttaaaggagtcatctagtatttctgggcgatccataaaacctctattaaatactaaaagctgcagccctaatcccagttacaggtcagactaccagacttagggatatcctgcaaaaaaatgtaggctgcccactactttcaagaaccacaataatataactggtgtgtgggaaaagccttagacccagagttcatctggagacaacttacttaacctctctgagcctcacttgtctcgtttctaaacttaaagagttcgttcggaactaactaaactcaaatgaaaggcaaataccaaaagtgagacagatcaagcacaaacgccagcatcccttacagaggacagtctcaactcagatgcagccaactgctgtcatgaagacctgttgttgctaagaggtcagatggttcaagagaaactggaaatttggattttgacatgaaacctctggaatttaaaatactggtttaaaatgcacagtgcctaccaaaccaaacctatctgcaggccacccctaactcacagattgccagtaaagacctctaaatcagatgaacattaataccctctaggtctattactctgtggcagtgcagtgctgcatgactaaaaatcttcactgaatgaatgtgtttctttaccactaaacaggcagcgtgtttttactcaaccttgacatatgacttttttttttcattatgaatactcatgaatcttaagacctgagatctgcacagagtctttactcgaagaagtactgtcataaacagagataggttctgccgaacatggccggaccgaaaaatcagggagcaattttcacaggtacacaatcgagtaagaactgccatcaatctgtcttttcagacatattaatccacaaagatagaaatcacttttatatgccaaggacaatatcaagctcagtatttgctaagactatctttcagtttttcatgaggaaacttttccctgccactgataattatcttcttggttcacagatctggaaagcatgaagactgggctttttttcctatgtctcttgggaactgcagctgcaatcccggtaaatttcctttcttctgttattacatctctttctcctgacatttaatgcagaaatcctccatttaaaagaaaatgttcttatataatggtttgaaattctctttttattttaattatattctttattgcccaagtaacaaacaaataactggaaaactcaagataaggtacttaaaaaaaaattttagaactatcaggttctacaggacacaataaatatgcagcagaaagtttgggctatcagtttattagccatagaatcagcccaaatacacaagagacaggaagaaataaattctcccagggaagctcatcacattgttattataaacccaagattttaggccaggtgcggtggctcacgcctgtaatcccagcacttcgggaggctgagatgggcggatcacctgaggtcaggagctcaagaccagcctggccaacatggcaaaaccccgtctctactaaaaaatacaaaaattagccgggcatggtggcgggcacctgtaatcccagctactcgggaggctgaggcaaggagaatcaattgaacccaggaggcagagattgcagtgagctgagatcactccactgcactccagcctgggcaacagagtgagactccgtctgaaaaaaaaaaaatacttagggtgcatatccacggtctccagcagcattttcttcaagatcaaatagatgctggctgagaaattttgagagtctataatgaaaacagaaaccaatggtttaggcaggaaacgatatggtaatcataaatcagctcctaattcacccttgggaggctgtccaagcaagtatgctgaaagtaggcagggctagaatattctcttcttcatggtcagatatattggccccatttgcacagcaataaagcagctgtacacaaatcagatcatttgaaaccgtgtcagtggcctcaaaacaaactgaaagttaaaaaacaaatgaaaccatagcatgaatgaccactggagatgttctgcaaatgattcatgtaatccttcattaaaccaaaggattcgtgccatattttttttctttttcaccaaatggaggaatcagcctcctttaaagagacaaaacaatttctcaatcgtccctttcctcccttcttctctaggtctaaaattctgtccttgctttttggataagttgttagctagcttctggttgacaaatgtgtcagcaaaaacaaactccatggcacccagaccaagctgttcttggaagacagagtttatacccaccatcaggaatcatgcttaagtagtatggagctactctagctgaaattatacattacaccctgaaatcacaaaagcgggacaagttaatgttcaacactgaaaggagttcccacaaaaccgttgttttctcctgaaaatgtgctttgtccttgtggctgttgctgttatgtaaataaacattaaaaagtgtctttgggccacgcacagtggctcctacctataatcccagcactttgggaggtcaaggccagaggatcgcttgagcccaagagttcaagaccggcctgggtaacatagtgaggccacgtctctacaaaaaaataaataaaaaattagccagctgccatggcatgtgcctgtagtcccagctacttgggaggcacaggagggaggatcccttaagccagggtagttgaggctgcagtgagccaagatcgcacacagcactccagcctgggtgacagagcaagactgcctcaaaaaacaaaaaaagtgtttgaaccaaatgtttgaatgacacacttgcatttagacacattccagatgtttcctttctgggacaatttgatatcatgtaaacctagccaaactgctagaaagctaagtatcttctcatagaaatgacctattaaaaatttgtataattttccctgcctgcctgaattctccagatgaaaatggattctgtgtagttgggagattccaaatagatttccagagttaaataaatagaaatatgcccatagtgataaaacataatttcaattgcagaatatttctgaaagtaaaagagctgccattttttgtgtgcatttcttcctgcttgggcagtaggcggatggagggggagagagagtgaccagttctccactaataagcctaaaatctcccccatccattgccttctatgatgccccctgctggcagcttaccaaagtggccaccattctttctccttttcccccttctttaaggcttctttataaactttttcaaattcattacccatcttaggtgaaaaggagataagaagcaaaggagcaaaccaaacctaatatgaatcctgtactttggccagaagccgtggctcacatctgtaatcccagcactttgggaggccaaggtgggcagatcacttgaggccaggagtttgagaccagcctggccaacatggtgaaatcctgtctctactagaaaaataaataaatacaaaaattagcagggcatggtggcaggcacctgcaatcccagctactcaggaggctgaggcatgagaattgcttgaacccagcaggtggaggttacagtgagccaagatcaccactgtatttcagcctgggcaacagagtgagactctgtctcaaaaaaaagtttaaaaataaaaaataaatcctgtactccatgactattacacagtcagcactacaggacctgctaatggaataaaaataagttaatccaaatagaatctcagtttcatacttacacctggataggccatctgagtgtccagagtatctctctaataaagatccatggtgaatatctgcctcagatactgggcagtttatattattgacacagtgtgacattagtactagaaatagtaattttcagttgggcaactccttaaaatttataacatattttttatacataatcttattttgatatttctgctcacttgatatttcttgccaccttgagagatggcagggtagaaattaatgaccttggccggtcatggtggctcacacctgtaatcccagcactttgggaggccaagacaggaagattgcttgagttcagaagttcgaggccagactgggcaacatggtgaaactccatctctacaaaaaatacaaaaattacccaggcatggtggtgcctatagtcccagttactggggaggctgaagtggaagggtggcttgagcctgggaggcagaggttgcagtgagccgagacttcatcactgaactccaccctgggcaagaggctggagttaattaattaaaaattaatataatgaattaattttattaatgttttttaattaataaaaaatattaacgacctgtcaaaccacagatagaaagtaaatagcagaggcaagacttgaatggaggcctcttacctccaagttcagttgttcaacttccccatcatgcatcactgcccagctctttatccaagtctccaatcttgctagaaataggaccatccctctaatagaaattaatactccagacatgcccttttctacttaggcttagtgccctgtctcacacagtctgaattaattctaattttttttgtttttgagatggagtttcactcttgttgaccaggctggagtgcaatggcacaatctcagctcactgcaacctccgcctccagggttcaagtgattctcctgcctcagcctcccgagtagctgcgattacaggcacccaccaccacacccagctaattttttgtatttttagtagagacggggtttcaccatgttgtccaggctagtcttgaactcctgcccttgacctcaggtgatccacccacctcggcatcccaaagacctgggattacaggcgtgagccaccatgcccagccccattaagatttcctgaccaacgttaaggccaatggcgttaagaaatcaaataaatattgataaaaagtttataaatttttctgctaattatcggtgggtacttaaattaggcaaatgtacaatactatatcctatggttaattttatttgacttcaactttctgctaaacaacactttccaaaattgtaaagtacaaatgctttgcaaaagtttaaaaaacacagaaaataatttcaaaactcaaagttaccattatttaaatgcattttgttttattttcacccagtctctgcataaataactttttcttaaacacaattgagattctgcttccacttaacattctgttctaggcatctgcttatatcctcaaaaactctagagaatatttttaaattgttggtataaatgaagtatattgctactaataatgatgacaacaagagtaactagcaaatttgtaaattagcatccagacatgaataacaaaaaccagtttttaattttttcagacaaatgcaagattattatctgatcattccaaaccaactgctgaaacggtagcacctgacaacactgcaatccccagtttaagggctgaagctgaagaaaatgaaaaagaaacagcagtatccacagaagacgattcccaccataaggtaaaagtaacatcatttatattaatacaattttttaattctccaaaggtcttagtttcaaagcatggtaaaagagattatgttatttatgtctcagtttaatttttttaaaacatgatgatcacctcaactgcctccaatcactagaagaatgatgaggattaatgagttttactacttgggctgagctgctgtatacttgtttcattttataaaatccaaattcagtttaaacctgtggctacagagtgtgaggaatattataaacatgtttacatgatagtgtgtgaagaaaaagaataatgaatattaaatgttaccttaggcataaatatggttacattatcatttgtttgaagaatgaacttttttttcttttaaggctgaaaaatcatcagtactaaagtcaaaagaggaaagccatgaacagtcagcagaacagggcaagagttctagccaagagctgggattgaaggatcaagaggacagtgatggtcacttaagtgtgaatttggagtatgcaccaactgaaggtacattggacataaaagaagatatgagtgagcctcaggagaaaaaactctcagagaacactgattttttggctcctggtgttagttccttcacagattctaaccaacaagaaagtatcacaaagagagaggaaaaccaagaacaacctagaaattattcacatcatcagttgaacaggagcagtaaacatagccaaggcctaagggatcaaggaaaccaagagcaggatccaaatatttccaatggagaagaggaagaagaaaaagagccaggtgaagttggtacccacaatgataaccaagaaagaaagacagaattgcccagggagcatgctaacagcaagcaggaggaagacaatacccaatctgatgatattttggaagagtctgatcaaccaactcaagtaagcaagatgcaggaggatgaatttgatcagggtaaccaagaacaagaagataactccaatgcagaaatggaagaggaaaatgcatcgaacgtcaataagcacattcaagaaactgaatggcagagtcaagagggtaaaactggcctagaagctatcagcaaccacaaagagacagaagaaaagactgtttctgaggctctgctcatggaacctactgatgatggtaataccacgcccagaaatcatggagttgatgatgatggcgatgatgatggcgatgatggcggcactgatggccccaggcacagtgcaagtgatgactacttcatcccaagccaggcctttctggaggccgagagagctcaatccattgcctatcacctcaaaattgaggagcaaagagaaaaagtacatgaaaatgaaaatataggtaccactgagcctggagagcaccaagaggtaaaattattttaaatggtccttgtccaataaagccagcattatcaataaacagtcatgacctttctctgtgctctcacagtgtcctgtatggatgtctactagtacattactaaaatatattacagttatttctttttaggtctatctctatcattaggctgagaatgcctgttttatttgagttcccgtagatgcagatcttggatttgagtgttgtttatttaagaagcacagggaacaaagaggagtgcagaagtaacacaagaaggaaaggaagctaataaaaggaacatcattcaagccatgtaaagacattttctcagaagtattccatttggcgactgaaggagctagggtacttcttttggctgaggattgctagaggggtattaatttcccagcatttccagcctgtcccttgagtgagccaggtcaatttccatgatttttcaggcacggaaatgcagatattggccattgaaagtccctggaactagctggaatgataaattatgacagatctgaaggataggagatactggcaactgctgctctaatgccttgaaagcagatgccatattgttttcgagttgaatcaccagtgtccaacaaaatgtctctgacataacaaaagagccaacaatgtttgttgaattagttataaagattaaggtcctactttattaagcaaacacataccaaaatgataatctggaaactacagcaggatcggggcagggaggaagcatatttggagctttcattcaaaatcctggcagccacaaagtcctgtgccagcaggacttggcacagattttggtacacaaggtcaatggtaacctcagttactgagaactctgctgccactctaacgtaggagttttcttataccttaaaagcctggtatgaaagctttaccaacaaattcagagagatttccaatgtaactctggcttaactacaaaatcacaagataatactacatttctagtgttttctcaaatccaaagaggagactccaagtcttattgagtaatccccagagataacgcactaaatctcactgataaagatagaaatgggtcctgttctccaagggttactgtctacctccacagttgtgactgatttccctttcttttttcttttttttttttttttgagacggagtctcactccttcacccaggttggagtgcagtggcgcaatctcggctcactgcaacctctgcctcccaggttcaagcaattctcctgtctcagccactcaagtaggtgggactataggcgcctgccaccatgcccagctaatttttgtatttttagtagagacagggtttcaccttgttggtcaggctggtctcgaattcctgacctcaggtgatccacccacctcagcctcccaaagtgctgggattacaggctccatttcttcttttttttctgttttgttttgtttttagagatggagtcttgctctgtctcctaggctggagtgtagtgatgcaatcacagcttactgcaacctcaacctcctgggctctagcagtcctcccaccttagcttcctgagtaaccgggaccacaggcatgcaccatcatgcccagctaatttttttttttttggggggggggtgggtagagatggagtttccctatgttgcccaggttggtcttaaactcctgggctcaagtgatcctcccaccttggcctcccaaagtgctgggattacacatgtgagccaccacacccagcctggtttccctttctgagatttgaaatgatttgagcatgaaaaatactcgtgaaagtatgcacagtggaaatataaattaagtaatggctctcctcttagtagattttaacttttgctcttgttattctaaaggccaagaaagcagagaactcatcaaatgaggaggaaacgtcaagtgaaggcaacatgagggtgcatgctgtgggtgagtatgcatgaagcaagctgtttgtgactatatcaaggaagaaatggaatctgccactttgggcttgtccctccatcctttgtgaatgctgcacagaattttttctctccccagtcctccccaaggaaatgctcccataaattgttgacattttcttgtgcatacttgatatacaacaatgggtaaatgtgtttgcaaactggaagccctgttgagatattagtgaaagggctagagttcttccttaaatccttttgcttctgaaaagacttaattctatcttatttattctcaaatctgtaacttgctgatgaatttatatcccatacttgataaaggaccttattcctccccctatcacaaacattttgaatttcagccttatttcacttctgaccagcttgcacaacgttgcactaaggacttcagactatgaccatctcaggcatagaagagctgtctgttctttgcacatctccaatccaaactgctgcaagaggaaatctagattatcatgtaaaataatcagtaaaattatcatgtaaaatagaaggttccatctgacattaacacatcaattaaagaggattccaatgtcttcccacttccaaatttgcaaatttcaaggacttcaaaatttccccttcattagtgaaaatgaaactagttgagtgaatttgtatttacatactcaatttaactttgtccatgcttcctgcccaatcttttctgttagattcttgcatgagcttccagtgtaaaagaggccacatctgtaaggcagaccaacagggaaaacctcactgtgtctgccaggatccagtgacttgtcctccaacaaaaccccttgatcaagtaagtattctgcaaaatagtctttaagtggctccaaaaggttagtgactgaaataaaaatatttgccattgaaatttttgcttaaaaaaggtagatacctaggttatcatttggttatttgggatatttggaacatctgcagttttcattctactgagcttatctagagctaaattgtcatcaccgttggtacagtttagttgatttttttgatgccaaatggaacaattacgattttaatagtctcacctacctgaccacatctttggcacagcgctgttatcagcatatgagctttaaggagcagagtgtcttccagtgagcatttggctctatcagctttttcttctacttatcttccataggtttgtggcactgacaatcagacctatgctagttcctgtcatctattcgctactaaatgcagactggaggggaccaaaaaggggcatcaactccagctggattattttggagcctgcaaatgtaagattatgtccctcctgtcaaccatcatctctgagagggcttggggtgaatctggacatgcctgaattatctatatgcaaacagggaaaagctgatgtagttctgaacacaaaaattatcaactggagaaacttaaaaaataagaactctcaggccttaaccgtaggagattctgatttaactgaactaggttggaatcctgacattgttttttttatttgtttttgaagtaacctagacaattctaatgtgcagccagggctcagaaccactatgataatgctatccacttaatcacagagttgaatcactggaattttgctacattatttgccctcttcccaatttaagttaagcctttgccaagaagtctctgacaacacatttttccagaagtgttttaaggctgtcttccttccccaggatattctcaattgtgtttggctccccttaccactaagtgattctccacattagcagtgctcactaatgtttccgggtctcctccccttccagacacaggagaggatgaaacatgtcagcctcctggacgttaggtatgaccatatatcttgctttgtccagggaaatgtgaaaaaagtcatctatgtgagttctgggcagaagcattcaagagctggggtatggttctccatcctctgctcctttgccaccacaaactctctttgagatagtggcctcaaaaaatggcaacgtcattggtggctggcaagatggccaaataaggaccactctggtttgcagctcccagtgagatcaacgcagaaagagggtgatttctgcatttccagctgaggtacccagctcattgggactggttagacagtgggtgcagctcacagagggggagccaaagtagggtggggtgttgcctcacccagtaactgcaagggatcgggaaactctctcccctagcgaagggaagctgtgagggactgtgctgcgaaagacagtgcattctggcccagatactacgcttttcccacagtcttcgcaatccacagaccaggagattccttcgggtgcctacaccaccaggaccctgggtttcaagcacaaaactgggccaccatttgggcagacaccgagctagctacaggagtttttttccatatcccagtggcacctggaatgccagcaagacagaactgttcacttccctggaaatgtggctgaagccagtgagccaaatggtctagctcagtggatcccacccccacagagcccagcaagctaagatccactggcttgaaattcttgctgccagcacagcagtctgaagttgacctgggatgcttgagtttggtgggggggaggggcatccaccattactgaggcttgagttggcggttttcccttcacagtgtaaacaaagctgctaggaagttcggactgggtggagcccacggcagcaccagaaagccactgtagctagactgcctctctagattcttcctctctgggaaaggcatctctgaaagtaaggcagcagccccagtcaggggtttatagataaagctcccatctccttgggacagagcacctgggggaaggggcggctgtgggcagagcagacttaaatgttcctgcctgccagctctgaagagagcagcagatctcccagcacagcactcaagctctgctaaggaacagactgcctcctcaagtgggtccctgacccccatgcctcctgactgggagaaacctcccagcaggggtcgacagacatctcatacaggagagctctggctggcatctagcaggtacccctctgggacgaagcttccagaggaaggaacaggcagcaatgtttgctgttctgaagcctctgctggtgacacccaggcaaacaaggtctagaatggaccttgagtgaactccagcagacctgcagcagaggggcctcttagaaggaaaactaatgaacagaaaggaatagcatcaacatcaacaaaaaagatatccacacaaaaaccccatccaaaggccactaacatcaaagaccaaaggcagaaaatccatgaagatgaggaaaaaccaacacaaaaagcctgaaaattccaaaaatgggaatgcctcttctcctccaaaggatcacaactccttgccagcaagggaacaaaagtggatggagaatgagtttgaggaagtgacagaagtaggcttcagaacatgggtaataacaaactcttctgagttaaaggaacatgttataacccaatacaaggaagctaagaaccttgaaaaaaggttagaggaattgctaaccagaataaccagtttagagaagaacataaatgacctgatggagctgaaaaacacagcacgagaacttcgtgaagcatacacaagtatcaatatccaaatcgattaagtggaagaaaggatatcagagattgaagatcaacttaatgaaataaagcatgaagacaagattagagaaaaaagaatgaaaaggaataaacaaagcctccaagaaatgtgagactctgtgaaaagaccaaacctacatctgattggtgtacctggaagtaatgaggagaatggaaccaagttggaaaacactcttcaggatattatccaggagaacttcctcaacctagcaagacagaccaacactgaaattcagcaaatacggagaacaccacaaagataatcctcacgaagagcaactccaagacacataattgtcagattcaccaaggttgaaatgaaggaaaaaatgttaagggcagccagacagaaaggtcggaatacccacaaagggaagcccatcagactaacagtgggactctctgcagaaaccctacaagcaagaaaagagtgggggccaatattcaacatgcttaaagaaaagaattttcaaactagaatttcataaccagtcaaactaagcttcataagtgaaggagaaataaaatattttacagataagcaaatgctgagagattttttcaccaccaggcctgctttacaagagcttctgaaggaagcactaaatgtggaaaggaaaaaccagtaccagtcactgcaaaaacataccaaattgtaaagaccatcgacactatgaagaaactgcatcaactaataggcaaaataaccagctagcatcataatgacaggatcaaattcacacataacaatattaattttaaatgtaaacgggctaaatgccccaattaaaagacacagactggcaaattggataaaaagtcaagacccatcagcatactgtattcaggagacccagctcacatgcaaaaacatacataggctcaaaataaagggatggaggactatttaccaagaattggaaagcaaaaaaaaaaaagcaggaattgcaatactagcctcagataaaacaggctttaaaccaacaaagatcaaaaaacacaaagaagggcatcacataatggtaaagagataaatgcaacaagaagagctaactatcctaaacatatatgcacccaatataggagcacccagatatataaagcaagttcttagagacctacaaagagacttagactcccacacaataatagtgggagactttaaaaccccactgtcaaaattagacagatcaacaagacagaaattaacaagtatattcaggacttgaactcagctctggaccaagcagacctaatagacatctacagaactctccaccccaaattgacagaatatacattcttctcagcaccacattgtacttattctaaaattcaccaaataattgaaagtaaaaactcctcagcagatgtgaaagaatggaaatcataacagtctctcagaccacactgcaatcaaattagaactcaggattaagaaactcactcaaaactgcacaaatacatggaaactgaacaacctgctcctgaatgactactgggtaaataacgaaattaaggcagaaataaggaagttctttgaaaccaatgagaatgaagacaaaatgggccagaatctctgggacacagctaaaacactgtttagagggaaatatataccaccaaatgcccataagagaaagcaggaaagatctaaaattgacaccctagcaccacaattaaaagaactagagaagcaagagcaaacacattcaaaagctagcagaagacaagaaataactaagatcagagcataactgaaggagatagagacacgaaaaacccttcaaaaaatcaatgaacctaggagctggtttttttaaaagattaacaaaatagatagacagctagccagactaatagagaaggaaagagagaagaatcaaatagatacaataaaaaatgataaaggggatatcaccactgatcccacagaaatacaaactaccatcagagaatactataaacacctctatacaaataaactagaaaatctagaagaaatagataaattcctggacacatataccctcccaagactaaatcaggaagaagttgaatccctgaatagaccaataacaagttctgaaattgaggcagtaattaatagcctaccaaccaaaaaaagctggggaccagacagattcacagctgaattctaccagaggtacaaagaggagctggtactattccttcagaaagtattccaaacaatagaaaaagagggactcctccctagctcattttatgaggccagcatcatcctgataccaaaacctgaaggatatacaaaaaaaaaaaaaaattcaggccaatatcactgatgaacatggatgcgaaaatcctcaataaaatactggcaaaccaaatccaggagcacatcaaaaagcttatctaccacaatcaagtcaccttcatccctgggatgcaaggatggttcaacatacgcaaatcaatgcgtgtaagccatcacataaacagaactaatgacaaaaaccacatgattatctcaatagatgcagaaaaggtcttcaacaaaattcagtatcccttcatgctaaaaactctcaataaactaggtattgatggaacatatctcaaaataataacagctatttatgacaaacccatagcaaatatcatactgaatgggcagaagctggaaacattccctttgaaaaccagcacaagacaaggatgccctctctcaccactcctattcaacatagtattgggaagttctggccagggcagtcaggcaagtagaaagaaataaagcgtattcaaataggaagacaggaagtcaaattgtccctgtttgcagatgacatgattgcatatttagaaaaccccatcatctcagtccaaaatctccttaagctgataagcaacttcagcaaagtctcaggatacaaaatcaatgtacgaaaatcacaagcattcctatataccaataacagacaagcagagagccaaatcataagtgaatgcccatttgcaattgctacaaagagaataaaatacctaggaatacaacttacaatggatgtgaaggacctcttcaaggagaactacaaaccattgctgaaggaaataagagaggacacaaacaaatgctcatggataggaagaatcaatatcgtgaaaatggttgtactgcccaaagtaatttatagattcaatcctatccccatcaagctaccactgactttcttcacagaattagaaaaaaactactttaaagttgggaaccaaaaaagagcccatatatccaagacaatcctaagcaaaaacaacaaagctggaggcatcacgctaactaacttcaaactatactacaaggctacagtaactaaaacagcattgtactggtatcaaaacagatatatagaccaatggaacagagcagatggctcagaaataatgccacacatatacagccatctgatatttgacaaacctgacaaaaataagcaatggggaaaggattccttatttaataaatggtgctgggaaaactggctagccatatgcagaaaactgaaactggatcccttccttacacttcatacaaaaattaactcaagatggattaaagacttaaacataagacctaaaaccataaaaaccctagaagaaaacttaggcaataccattcaggacataggcatgggcaaagacttcatgactaaaacaccaaaagcaatggcaacaaaagccaaaattgattaatgggatctaattaaactaaagagcttctgcacagcaaaagaaactatcatcagagtaaacaggcaacctacagaatgggagaaaatttttgcaatctgtcaatctaactaagggcttatacccagaatctacaaggaacagatacaaatttacaagaaaaaaacaaccccatcaaaaagtgggtgaaggatatgaacagacacttctcaaaaagaagacatttatgcagccaaaaaacatatgaaaaaaagctcataatcactcgtcattagagaaatgcaaatcaaaaccacaatgagataccatctctcaccagttagaatggcgatcattaaaaagtcaggaaacaacagatactggagaggatgtgaagaaataggaacgctttcatattgttggtgggagtaaattagttcaatcattgtggaagacagtgtggcaattcctcaaggatctagaactataaataccatttgatacagcaatcccattactgggtatatacccaaagggttacaaatcattctactataaagatgcattcacacatatgtttattacagcactgttcacaatagtaaagacttggaaccaaccaaaatgcccatcagtgatagactggataaagaaaatatgacacatatacaccatggaatactatgcagccataaaaaaggataagttcatgtcctttgcagagacatggatgaagctggaaaccatcattctcagcaaactaacacaggaacagaaaaccaaacactgcatgttctcactcataagtgggagttgaacagtgaaaacacatggacacagggaggggaacatcatataccagggcctgtcaggggctgggggactaggagagggatagcattaggagaaatacctaatgtagatgatgggttgatgggtgcagcaaaccactatggcatgtgtatacctatgtaacaaacctgcacattctgcacatgtatctcagaacttaaagtataattaaaaaaaaaaaaaacggcagtgatcctgagctctggggagactgcaatgagcagagccctcctgccaacttgtattggacttgtagcaggattgcaaaattgacttctgtttctttaagccactgagatttagcattatttcttactgtagtatcagctaatagctacctttttctctattcaatagcacttgtgccctccacctacaaatttcaactctgattctacagcagtgattctggggcctagctgcacatccaaatagatcttggagctttaaaaacatcctgatgcccagacttcacgccagaccaatcacatcagaatttacttgattggaagctggcatttggtatgttttttaaaaccccaggcaattttgttgtgctgctgccagggctgaggaccactgtcataataatggggacctgagaaagctctgtcagttgccagaagtcgttaagcttcctattatgaggacttgccataggacacaaataagcccaaagattacagtacattttctgcttgtaacagctattcctacttgtacggactttgaagtgattcagtttcctctacggatgagagactggctcaagaatatcctcatgcagctttatgaagccaactctgaacacgctggttatctaaatgagaagcagagaaataaagtaagttatccacaggttagcttcttcaatgtctgtctacagggcatgaggaagaaagacgtggtgggggggctacctacctctgcatactggcaaaagcccactatgcttccccatgcccggttagcccatgtggcttaacagaataatagatgtcaccattcacgccacaaggtttcagacaccaccaaaccgccccattcttcccaatggtcagtggcctgaattagggctcttcaattcctacctagagcaagctctggttgagcaaagttaatataaatttagcattgatctagtcagtccaaacatcttatttaaatctaagcatttgttttgttctcataggccagacatagatgtatgatataaagtaaatccattactcaaaatatcagtaatatattaagattaaaaagcacagaacattgattccaaaagcttccagagaaaattcattcaccagatagttattgagtgtatcctgggtgccagaaattgacctaaatactggagatacagcaacgaaaagaaaatctctgccttcatgagtttacattctgggtgaagagacagactctaaacaaataagtatatatgtgtgtgcgtatgtaatgtttgtatatgcatatatttgtacatacatatatatgcatatatgcaattatatatagtaaaatgagcatttatgtaaatataaccaaatcagcaaatatatgtataagtatgtcagttgggattaaacatggtgtgaagacaaataaaacaagaaggagggtgtgcattaactgtgtcagatgctgtttataggttatgagttgaagactgagaattggccagggatttagcatgtcaaagtcatagctgaccttgataggaactgttcctggggtgggagcatgtttcaggagggaagctccagtggacagagttcaacagagactaggaggaatggatgcagcaagtatagacaatcctttcaaggagttttgctatgaagagataaagagaaatggggtggcagctggagtggaaagtgagtacaagagtcccacctagcagtgggagatggtagaggatgtttgcacgcttctggaaataacccagtcaagaaggaaatgttagtggggagcagagaatgcgcacaactgccagagggcgttcttcgatacatgtcccacccagaggagagggattggacttaggttaggagcacaggaaggtcgcagggagcaaagttgtggttctgggagcaggtggaggtcctgtttgcttccaattactcagtgaaataagaggcaacatcacaagctgagagtttcacaggcactgctcaagaataatttctagcccccgtcttgaataccttgtcacagagagccttgagggtattagctatgaaacagggaaatttcaatggggctggccaagcaataacacaccagggtgaaagcaagactgagtgggcactggatggatgacctagaagactaagagtggactctgtcatcgggggaaggagcagcacttttcactaactaatcaccttagtcaattcagcccttttcattaaaacctcatagtttaaaaaaaaaaaaaaaaagcagcgaacattacttggttaaaagaaagaggcaaaacatacttaaaatatttaaaagtttaaaaaagaatttaaatttcttctaaaaaccagaggtttcttacatcaggtgctattctgtgtagacatgagaaaggcctgtagtattgattggaaggaatttcatttagttgcacatgatgtcctgagcttgttttcccctatcgtgttactgtcactcttcaagtaaagtttatagcaagtgacaagtccattacatttgtctgattctctgacagtcttctgccttcctaatcccaggtcaagaaaatttacctggatgaaaagaggcttttggctggggaccatcccattgatcttctcttaagggactttaagaaaaactaccacatgtatgtgtatcctgtgcactggcagtttagtgaacttgaccaacaccctatggataggtaagaactctttacctttccatttctagatttatctctctgataaaatatctacatatctatgcaaaaggaaaatctaaacagatttaggacatttcccagttccattttagaatactgaaatgcctggttaggagtctaaacacaaagctgctgtgtatgatgtactctagaacttaaggtataataataataataaaaaagtctgaaacttgatagagcttatgttgataaagtttatgttttataattttatcttttaattccatttctcaatgaactttttgaagtccccttatcacaattatcaaagctatgtaatattcattaaaaaaaaaaagctgctgtgaagatagcagaatatggctacaccacagctcccaagtttacatgttaaggtccagcttcccacagatactcctccaactttctcattcttgatcgtaaattcccaagattggcccaatgtgggtcaagtgactacatctaaaacaatcaggtatggccagtagatgagaaccaggttgtaccaacatgactgctgggtacacccctatagatttagggtgggggaaggacagttcctgtgaagacagaaaacttgtgaatcaacatcccaaaagctgtcaaccttacccacaaatactttatttcgttggcagtttttatctgtattctatttatatcacatatacagcaaccttatgggagaaaaatgtccttggtgagcctgagagttaaatcttcatgcacaagctactcaattaataggatgccatgtatttcattgcagagtcttgacacattctgaacttgctcctctgcgagcatctctggtgcccatggaacactgcataacccgtttctttgaggagtgtgaccccaacaaggataagcacatcaccctgaaggagtggggccactgctttggaattaaagaaggtaaattcatcaccagccaaagaagagggatgtcttcttcctcagacaagccctaagccctgcatgcttcatagagaggtcctgccacatgttcgaattggaagctagaaaaaaaaaggtggcagcttcccagataggactcccttggtgcacatgctgtcattgcgaagtcacttcttactacctttatggcactgttttcaaagggtagcaagggtgaacatgcattgaggtctcaacagtcagctaagcctagaaagacgtgtgaatccagaattgggccaaatctcagcaggctttgtgtccttccttatttcatatcctaccttaacctgggccttgggccaaacttttcaaaattacacataaagaataaaaaagcaagcccatttctgacaatgggagatgtcagaacatctcagaatccattaccaacacactaaagactggattttacatcacaattagtgctgggataatcctttaacccaaaactcacccatggcttcaccctcaatgaatgggagctgtgggagggtagatcagagtattctttctttactcctgcagtggaggaaattaaatttagatgcttgttttgctgggttatgtcttaatatgtttccttttctttccttaagttaggcttgaattttatgagcaagtatgttttcaataattaagatatgaaaggctgggcacggtggctcatgcctgtaatcccagcactttgggaagccgaggtgggtggatcacgtgaggtcaggagttagagactagcctggccaacatggtgaaaccccgcctctaccaaaaatacaaaaattaggcgggcttggtggcacacgcctgtaatcccagctactcgggaggctgaggcaggagaattgcttgaacccgggaggcagagtttgcagtaagccaagatcccaacactgcactccagcctgggtgatagagtgagactcggtctcaaaaaaaaaaaaaaaatgaaagatgttcaaacaatgagcattcaaatctactcgcaattctcaccacacacacacacacaaaaatgatagtatgtgaggtaatgcattcgttaatcagatcaatttaaccattccacaaggtatatatattttaaaaggtcatgttttacatgataaatacataccatttttatttgtcaattaaaataaataaataagaaaaataccactcacagaacataaattaacagtgaacatcaaatctctgaaacagagatttcattcatgtttacaatatacccttgggataaacatgcagctaagccgttaaagaaagtcagttcatcaaatgtcagaagttcccaaaaagaaataacttgtgcatacttcatttttaaaatatcccccatgcatatgtagaatgccttgaaattagagaggaagaggtgaaagtatgaggatttacttattaataaataggtaagcagagagggtcagtccttttccttgcaatatcattctgtgaaataaacattctgtgaaaggatgtatatttttgtaagtacctagttctgtgtattagttgtctatgctgcatagtgaatcaccccacaacttaacaggttaaattctttctcacggtttccaagggtcaggaatctcacagtaactaacctggatggctctggattaggatctctcattaggttgtggtcaaggggtcatgcagtgcggcagttatctgatggcttgactgcagctaagggtctacttctaagcccactcccatggctctttgcaggagccttcagtatcccatcgtgtaggcctctggtctacagggctgcccacagcatggtatctggattcctccagagcgagtgaccaggcagaaagagagaaaaagccaagactgaggccccaatgtcttttataacctaacctcagaagttatatatcatgatttctgcctcattctattggtcacactgaccaatcctgctacagcaggaggaggagaaggagaccacagggggttggatgtcaattgtctttctaacatctatgatacaagcagagtacttataaaaattcaaatatatccttctgtcctgccctgcccaccattatctagaggggaaaactcagctgggataggatgtatttatggatgcctgtttatatgacatgtgattttaaaggactgataaaaaggcaaatttaaacagaggccattttacttaagaaaaccagttgcatctcattcttccttttgcaaagcttctggcagctcttcagtgtgtaagctcacccaggctccgctgggcggttgtctgggaggagcaggaagggcttaaaatccagtcatttacaaagctgctaatgatcttgtttgtgcactgtggtttggccatcattgccttattttgaagaaaggaaaaaattatcacataataaaccaataaagcagatattaaatattcagtcagaacacgtaaacaacttactgctttggaatgtagctaaagaaaaacaaatttatttgtaagtatacccttctttccttcaaggctgagaaatctacaggagaagataaagtttagccaatgttttcctgaattttaactgcctgtgatagacgtgctcatatattcctcacatagctgttattaactagctgtgtgaattagggcatgttgcttagcctcagtgagtctcattttccttatctgtaaaaatggggttcaggtaacaggtgcaggaatcctcatttattttgtgcccatgcataccatgcattgacacatacccatgctaatcgtcagaaaaccctccaagtgagactaacagggtaaacaactcagatgacgcaagttcccctaagccatttaaagacattatcctaagagtactggggggccaccaaagtgtttcaaacaagccagtgatttccctgggtttgtatttaagatggattctcctggttacattgtggtggggccaaagaattgttgagagaatactgtggtaaacccaggcaagagctgatgagaacttgaactaggggagtgaccaaaggggaaaaaaagagagaagtaaacatattcaagatatattttaagatataagcatactcaaatatatagcatgtggaaataagacaatatttgataggaaatatgtgggagccgagagcagacaggtgagagactgaaaagagaagtgcaatgcctaggtccctggctcagagcaggcagggtaaatagaggtaaatagaggcatcttccactgagaaaacacaagaacagaagtggatttggagtaaatgacaaattccattttagatacgttgaattgtaaagtattaggttgcctcctaagtgttagtttcatgcaaaagtaattatggtttggccattatctctaccactccatcaaaactaccattatccctaccatgcccaccactgatgggcacctacattgattttatatctttgctattgtgaatagtgctgcaacgagcatatgagtgcatgtgtctttttagtaaaatgatttttttataaatatacccagtatgggattgctgggttgaatagtagatctgttttaagttctttgagaaatcttcaaactgctttccacagtggctcaactaatttacattaccagtgtctaagcattctttttctctgcagcttcaccagcatgttgtttttagactttttaattacagccattctgactggtgtgaaatggcatcttattgtgagatggttttgatttaaattttcctgatgattagtaacgtggaactttatatatatttgttggccgcttatatatcaagacagggttttggaactgaaatgcatatttgaggattataagcatacagagaataattgacaccagggaagggaattaattctcccaaggaaaacgcattgagttacatgaaaaggggtctaggattgaacactgcactgagaaacaacaacatctagatgatggataggggaggaagaaagaattcagtaaggagaatgaagtttctcctgaaatgaaggaagaaaaccaggatagtgccatgcaaaggaggtgtttcaaagaggaggaagagattaacagtgccaaatgcgactgagatgtcaaagaagttgaaagaaataaggatatcctgggtagccttggttagagtagttctggtggaatggtagacatggaagtcacattctatgggttgagaagaaaagggagattagaaagggtaaggagtggatgtttgagtgcaggaaagacctagaaaagctacagagcattttctaaaaaaggggagcattttttagaataaaagagatttgagcactcctttcatttactcattcatttgctcaagaaatctttacaggccaggcgcggtggctcacgcctgtaatcccagcactttgggaggctgaggcaggcggatcacgagttcaagagatcgagaccatcttggctaacacggtgaaaccccgtctctactaaaaatacaaaaaattagccgggcgcggtggcgggcgcctgtagtcccagccactcgggaggctgaggcaggagaatggcgtgaacccgggaggcggagcttgcagtgagccgagactgcgccacttcagtctggcctgggtgaaagagcgagactccgtctcaaaaaaaaaaaaaaaaaagagagagagagaaatctttacagatggtctacataaatgcaggcactgttctagaggctaaatatgaaacatatttaaatgctaatggaagggtctagtaaaaaaggaaaggtggaagaaggatgtaagaaaaaaagaggaaagtaaaaggagaatcttgtgaaggtcagaagagatcttgagcataggtagaggaattagccttaacgtcaagaaaaaggacaatctcttatctgagcaacagaaagaagacaaaggctatgggtgcaaatataagtaaacgtataactaatgaagctattatctccattttacatatgaagccagtactcaaaaaaaaaaatcaaagtccataatctttcccattctctgggctagataaagattattagcaggaaaattacctagtgcccacacagagtagtataatagtttgttagggtgggccatgttggtaaggagtgatcttatatttgctagaggatgctgtcttcttccacaggtatggcaacaatttctttcacaagctactcaattaaaaactggaataacctagcactacacttctatttatttccattatttttcagctcaccttctagattagtatactgggcacttcttggctggacctcccgttaacctgctcttcctctatcagtggttctcaaccctgcagccaaattacctgcagagttttctaaacgtctacatgccattagtccacccctagggattctgattctagagtccagaggtgaggcctaaaaatacatatttgtaaaagttcatgagtgatgttgctgtcctaccaaagttgaggatcaccattatactgccttattagatggtttctctaatcccccaactctaatattgtttgtgctactactctggctactttctaaaagtgtcattttgcttcttgtttttttatagaggacatagatgaaaatctcttgttttgaacgaagattttaaagaactcaactttccagcatcctcctctgttctaaccacttcagaaatatatgcagctgtgatacttgtagatttatatttagcaaaatgttagcatgtatgacaagacaatgagagtaattgcttgacaacaacctatgcaccaggtatttaacattaactttggaaacaaaaatgtacaattaagtaaagtcaacatatgcaaaatactgtacattgtgaacagaagtttaattcatagtaatttcactctctgcattgacttatgagataattaatgattaaactattaatgataaaaataatgcatttgtattgttcataatatcatgtgcacttcaagaaaatggaatgctactcttttgtggtttacgtgtattattttcaatatcttaataccctaataaagagtccataaaaatccaaatgcttatgcaagtgtatttccagttattatttagacaatcaaatgtaaaagatcaacccaagactcacacttcatgtcaaattataattgtgcttcctaaaccctactaccttaagtgtgtgtgtgtgtgtgtgtggttgagaaaaaagtgtgagacatctcttacaggaaacaaatactcagtggcaagataagaggtgctcattaatgtccttcatcattatgtaagtttaaacagaaaaaaactaatatcaagtgcttttttaccaaatttgatataaaatgtagaacaagctgggtgcagaggctcacacctgtaatctcaacactttgggaagccaagtcgggaggattccttgagctcaagatttcaagaccagcctaggcaacatggagagaccctgtctctatgaaaacttaaaaaaatagccaggggtggtggcatgtacctgtgatcccagctacttggtggacttaggtaggagaattactcgagcccagcaggtcgaggctgcagtgagctattgtgccactgcactccagcctgggtgacagggcaaggccctgtctcaaaaaataaataaatgaaaataaaatgtgaaagattatgcactgcttgatccaattaattctaactttttgtgcagttgagcatgtgtgctggggaagagggcggccctgcaaaaatttcacataatcattgcctcacaataaagaaaatgtaatggtaaaacaggtagagggccataaagcgtcttgatgtccaatgtagaaagagattaaatattattaatgtaaattgatagcgaaaaacctgtcataagcaaaaatttgtctttttatttgcgctcttctttggtaactattacagtaaaagctagatcacaaaaatatgacattataatatagttttccaagttctgaagtaaggcaataaaaggacatgtcactcactttatttgactatttgaaagaaaatggttttttacatatttttctagctgaaatgaaagatatcaatacaattatcttttactattttttcaaataatcaaaaatgtgttgttgttgttgttgttgttacaaaccttatctgtgatagtcactgagagaacatgcccctaggaattttatctgaaagatatttacagaatagtttatttttttatcagaataatcttctctgagtatttcaaaatttcattcgttatctctttcatagctcaataaattacttattctttttttttttttttttgagatggagtcttgctctgtcacccaggctggagtgcagtggcacaatctcagctcactgcaacctctgcctcctgggttcaagcgattctcctgcctcaacctcctcagtagctgggattacaggcgtgcgccaccacgcccagctaatttttgtatttttagtagagacgaggtttcaccatgttggtcaggctggtctcgaactcctgacctcgtgatccgcccacctcggcctcccaaagtgctgggattacaggcgtgagccaccacacctggccaattaccttaactagaaccatatcatactatgtcctttctaaaaaattaagttcaatttgattaatcaaaatcgaattaagtattatttgtaactttttccaactacagaaataattttaggaactattccaaatttcagaacgtttttatatgaagctgaaaaggtcttagctaattacaaactaggttgctgggaacagtgaagttgtattcagaggtattaattaggcctaaattatcttttaccctcagacaactttcaaaaatattttagaatagtgaaaagtgattttaacaccaaggtaaggaaaccacctcaatatctactaaaaaattttgtttgaaaataatattcattttgaaacgaaaaatatttaataagagaaaatctcaaaccttaaatttctgtatcatttaaggctcttacatgtacagctagctcatctattatagaggcacgtta

SEQ ID NO: 16239 - DNA, 74097 bp, Human
aagagaagaacatgaatatctaaattaataaactgcaggatcaggtaataggtagccataattacctaaatattagcagcatgttatatgtgcctagagaacaaatgaataattcattaaggtggatggatggcatgggatgccatgctagaggagtacattaagagctgttaaagctaaattgtgtccccccaaaaatttctgtgttgaagtcctaacccccattacctcagaacatgaccatacttggagacagggtctttacagaagtaatgaagtgaaaacaaggtcatgagggtaggccctaatccaatatgatgtataagaatagacaattaggacacagacgcatacagagggaagagggaagacggcgtgaggacacaaaagcggggccatctgcaagccaaggagagaggcctcagaagaaaccaactctgccaacacctcgtgagaaaatacaatttttcttttctttttccttccttccttctttttttctttcttctctctctctctttctttctttatgagacagagtctcactctgtcacttggagtgcagtggcccgatcttggctcactacatcctctgcctcccgggctcaagcgatcctcccacctcagcgtccctaatagctgggaccaaaggcacacaccgcaaagcctggctaatttttgtattttttgtagagacaaggtgagcaaataaatttctgttaagccacccagtctctggtactttgttatggcagccctaacaaacaaatacaggagcagattatgagaatttactaaaccaaaccacagaaattaaattttatcctttcagctgccagaagcccacagaggtgtctaagcatcaacgtgacaaataagcagctttggttctgcaatataacctggaaatagtgaggacaccgacgtggagaatagagatgggagttgacagggatcaattgttctaatgcggaataatgcaagacataagatcaagccagcaggagtgagaaacagagatcatatcagggtgatatctgtggggcaaaagtaacaagaagataaggtgtaggcggtggagggtaaaccgcgaggcttccatgaagaagagtggcctgggaagtgaggaggacagcgaagccccaaacctcaccttgggatacgggaagtgaagcaggttccagagaaggggacaagataatgacttagggtaggataaatttcagacaattgcagagcatcacattagatgtgttcagaagagtggaaataaagttctgtgcctaggccctcatgcaggattctgttgctagaagtcagtgctggccgcagggagaccggagatcacagtggaggcaccagcgatccgagagtcctatgacgaatccctgggatccccacaatgtgtggagacagaagccaaccaaagagcgagaaagcatctccaaaccagcagaatcaggggcaggaggcccgccaaatgcacagcaagtcagccttggtagtttgcaaatggaaagatttctttgacccgctggagacttcagctcaggctggatgtcgctaattcacaccatcttaccaaaaggttctttccctgccctttggtgaatcgaggcagaagtggctggtggataactgggacccaagagttatctcagcgtcgggcaggcatcgacagctccaggagccctttccctgcaggcgggctggcgggtgagcgattccctcccttcccaggccttcccgggaatggaacgtgggcgcccgcgcccgggctccggttccacttggaacgcggactcgggagccgccgggcgagcgcgcagaccgcgggggcggctccctcgcacctccccgctcagcgcgccgcggcggatgggcgaggcggggcgaggccagagggaggcgggccaaaggggcgggcgagaggacgcgggaccgcggggaggtcgggggcggggagcaggcggcggcgggcgccgggaagaaaggaacatggctcctgaggcgcacagcgccgagcgcggcgccgcgcacccgcgcgccggacgccagtgaccgcgatggtgaactccagtcgcgtgcagcctcagcagcccggggacgccaagcggccgcccgcgccccgcgcgccggacccgggccggctgatggctggctgcgcggccgtgggcgccagcctcgccgccccgggcggcctctgcgagcagcggggcctggagatcgagatgcagcgcatccggcaggcggccgcgcgggaccccccggccggagccgcggcctccccttctcctccgctctcgtcgtgctcccggcaggcgtggagccgcgataaccccggcttcgaggccgaggaggaggaggaggaggtggaaggggaagaaggcggaatggtggtggagatggacgtagagtggcgcccgggcagccggaggtcggccgcctcctcggccgtgagctccgtgggcgcgcggagccgggggcttgggggctaccacggcgcgggccacccgagcgggaggcggcgccggcgagaggaccagggcccgccgtgccccagcccagtcggcggcggggacccgctgcatcgccacctccccctggaagggcagccgccccgagtggcctgggcggagaggctggttcgcgggctgcgaggtaagagcgcgcgacccgcagcggcagatgcacgaaccagaacggccggcgccggccggggccatcgcccgctgcggcagctccccgggctccatctcgcatcccctctgcgttccgcctcccttggaagcgcattccccacctccgctagtgctgccctatttccggtacccagcgcggaattccactgctcttttgttggtgcacatttattggatacctccttcttcaggatatgtcaccatagtcttttttactgaaaattagtgaaagcctaattagagtgaaagagtacatctgggttttgtttttttttttcttgtagaggaaaaaatgaacattacttgtgtaactgatggtagttgcaactgcatatttgccaatgtcacaaaatctaaaggaaaatgttatagtcacccgtggtttccttcttgcctggacactccattgtcccgggctgaaaagggtagcagtacagtgcatataatgtcaagttgtgggaggagtgtggcagattgtcattggtgcatttttttggtgatgtgtgtggttgttttgaggagtgggagctgttaagaacaccacaaatagaataaaataatatcgtgaagttatttggccgtttctaattctagacatttttctaaaaacagttgcaaaggaaagattacattgttttaaaaaaatttgaagtatgtttttaaataactaaattaatgttctttgaaattccaccaaaatgatgaagtcaccagatagcagctgataaatgtgtctgagcccagtgcgcccagctctacaaaaggcagaagaggaattttcaaatttgccagtgcccagtaagaggacatgaattttctagtaccagaggaaattctctttttacaaattttgtcagaggtatccttgggaaagtatttcatttgcttttaccctccaaattattttaatctatatttttaagagtttccattctcagttgagtttttcttgttcttctccttctgtcagttttgaaagtcttgcacaaaaacaatccaggtgttgttacagcagtgtgattaaaaccaggtcaggcctacactgaaatcccagttccaccactcattagctgtacgaccttgagcaagttacttatcctctctgatacccaatttttggattttttttttttttaaagagatgatcataacgcttaggacttgactctttgggagaattaagtgagttaagacataaaatgtgcagcatgtatttgtcatgttattagcgcttcagaaatataaatgtaaacattttggtacttcgtttatggagattcttatactagttaattttattaaaagcatgatggggaacaaaagatccttttcggataacctgtgtgagtaaattaataaaacactaacactttttaagattcaaaactggattaattatgttattttacaccatttaaaatgtgcatttaaaaaatattcactgaagtgagagagaagttccttttaagttaataaataatggtaagttgcatgatccttttaactcagtttaagcatttgataacacacctaaccttgtttgaataaactcaataacagaatatagagaaataaaatatatatttcatatgagtatgtatgtaaatttatttcttttaaaggaaaatttcaggaaacaaaatgaataagctcatagtcataaaacctctagccaaagtgtgtcaatggtctgatttgtaggagagcagactcaggaatcgggaattttttttttttttttaagagtcggggtttcactctgtcactgaggctggagtgcggggaagcaaacgtagctcactgcggcctcaaactcctgggctcaagctgccctcccacctcagcttcccaagtagttgggattacaggtgcaagctgctgctcctagctgaaaagttttaattatataaaatgtttaaataaattgttattcctttcttttatgaagaaatataattgatattcttgtcacttattaaataagcaacattttaaaatgtttagcacctactgtgaagatagcactgtgctagctgctatgaataaactagaatagcatatcactgttttcctatggacaaaaacccagaaatgtaaaataaatagccatgaatgggttgagattccccctgccccctttggatactgatgacagaaatcttatatgcactatgtaagcagtgccctaggatcagaacagaaagtaacttgcaatttttaaaggtgggagaaatgactgaagtttggagtggtcaggagtttccctggaagtctcttgcctttgtgactttgtatagctccctcaaactacctgagcctgagctcctcatttataaaatggaagaattgaacctagcttccaaggtcctttctagcttcaccatgctctggtctgttgtttaatgacatgaatccaagatggacaacaaatggtcgattttgctccttctacagtaaatagatctatcttcttagcagaagtaaaatagtaaagaaagaagacatgtttgaggcctgttgaggcctgtttgctgtatgcattgtatctaatcaaggaattgagaatgtagccctaaatattaggaaggagttgaaagtttctgagcaggaacagaacatgctgaaaggaaattgtgtcagcagcatggtgtacaggagagcttggcagagagaaaggaggcaagaagacctgtgggaggcagccagtaaggaggtgaagagggcctggaccaaaggaagccaaggatgaccgaaagatttaaagatgaagcccagatttaaaagtatcctcaagtatttgtttattcttttcttagcaaattctttttagtacaaagataaaatatggcactctgagtcataaaattttctgaatttcagaagttgaatgtttttctgaatgtatcaacctgttaaagtcagttcctgtttgttattttaggcgtatattcttgggcttttttttttttttcctagagaaactatgaagtactagctgtgcaagtcagggtgggctaagctgctaaaacagatacctccctccccttcaataccctgaagaacaagaagttaattttttgctcgtgtaacattttagagagggtattccaggttgaatacctggaataatgaatgaaataataagtcgactcttatttctcctaaaataattggatcttgacattgaaattggtgtgctgattgtatttaataagtgacctccaatgcagttatttcattttgccatactttatgtaatttttattttttctgccttccctttcgatgtctaaagggaagcataattagttattggaaaggttattgagacttaaaaaaagatttgaacatggctttggttgatgctaccacacagaaactgcaaacatccaactcaccgctcttagttgctgttcatgatagtctatgcacagtgactgatgaatttagcctgtcttgaggcttcagaacttagtcttatgtcatcacgagcagagctttatcctaaattacaggttttcaatgggggggggggaggggcagttttgcccctcaggggacatttggcaatctctggagacatttttgattgtcatacctggggggatgcccctggcatctcctgggttgaggttaaggatgctgctaatctacaatgcacagtacagccaccccacacacacacactacaaagcattctcccacccaaattgccaggagtgaggactttgagaaaccctgccctagactgttaaattcaaaaggaaataatggtttattgctcacagtgtgccaggcactgtgttaaactccttatattcatagttttgtttttatcctcacaacaacctgtgaagaaagaactctcatccgtcaccactttactgttgagggcactaagccttctaaaggttaaatgacttgcccagggccgcaactattagatgttgcagtcaggatttaattccaggcactttgtgttcaaagtgtttctcatccactgtgctatatgccagtagtgcccaaacctaactttagccagcaattgtctgcatctctttagtttatgaacatttatttattaggacatgcaggataaatcataccaacacagtccgtgtatccagaattctaattgatctagggagtgggagagcctgcctctctattttttttaaattggtgtgaaatatacataacataaaattggccattttaaccattttaagtatataattgagtgacattaagtagatttattatattatgtaaatggacttaacacgatttatttccagaacttttttatcatcccaaacagaaactctgtactcattaaacagtaactccctgtttccccactcccccttgccccagacgctagtaacctccattctacttcccctttctgtgagtctccctgttgtagctacctgatgtaagtgaaatcagaccatgtttgatcttttgtgtctggcttattcacttagcatagtattttcaaggtttatccatgcgtgcaaattcccttcttttttatgacgaaatactatttaattgtgtgtgtacatgtgcacacacaatgaaatactatttcatcataaaaaggaagtttgtacacatatatacacacacaccaaattttgtttatccattcatcagttcatgggcatttgcggtttttttccacctttcgactgttgtgactttccgtttatttttaatctgaactttactccatcacttcctccctttccttttttattcgcaccataattttgaacaagcagactttgtattttcattactctggggatttttttgagggaggcttgctaccctttggggttgtggtaaggttgtgccagtaacagaattcatgcagtaaaaaacattcatgggactttcttttgtgataggtactagggatgcagagatgaataatacaaggtctcgaccttcaaggagctcagggtttagtagggaaaacagaggtataagtaagtcattgcaatgccaggtcccagatatgggaggattccagcaaagagaggataaggccaggcacagccgctcatgcctatagtcccaacactttgggaagctgagatgggaggatcacttaagcccagcagttcaaggctaccctgggcaacatagtgagtggcaaaaaatacaaaaattagccaggcagggtggcacatgcctgtggtcccagttatttgggagtttgaggtgggagaatcacctgagcctgggagattgaggctgcagtgagctgtgatcacgccactgcactccagcctgggtgacacagtgagaggtgagagcctgtatctaaaaaaaaaaaaaagagaggatcagatttacctggagaggtcagagaaggtttccagagggagtaaaacttgagcttcattttgaagaatgaggggggaatacaaggagggaaaaataataggaacaagacctgttcctgttacagcaaacctgtaactcccaccatggaatgggcacgttttcctgtagacatttggagccagtgtgggcttcaagcctagggggctgatatgatcatttgtcaatctgaagatgactcttggaacaacgtagaggatagggtgaggtgggtaggctggtggctgacagactaggtcaggagagggctgaccaagaggaggaggggtgacgagggctggaactaaggcgtatgagctgggatggaaagaagctagatagaaaggaaacaaaaaccatcagaactgtggaaccaactccatgggagggataagaagagggcctattctagggtgaaacccaaatttctggcatggtaccattaacccaaacagaaagaggagatttccagagaaagaaaagcaaattttgcgggaggtgagtgtgagctgtctagagaatatgcaggtagaactacatgttaactgtaacatatacttgtctgcacctcaggagatggctgattaagaattcaggattcaggccaggcacggtggcacacgcctttaatcccagctgcttaagagactggggcgggaggattgcttgagcctgggaatccgagatcagcctgggcaacatagcaagacactgtctctaaaaaaaaaaaaaaaaaattcaagattctggagtcaatattacttaaggtagcaactgtctattctatagaaaatggacaaatatagataaaaagccacttccctttctaaaagtgtccctgcaattcaagtgaatactaggaaggattgtgttcattcttctaaacaagactcacatgtatcttagcacaaaaagaggattcttttatgatacaaatgcactgagaatttggtcaggctatcacaatgaactgatagttcagatggatttgagtctttataccactctggaatctggaccaactgggcctcctaaggccattttgcagatctgggcttgtttctgaagctacagacaggcctcttccaagcactctaagtgctccacaaataatatttctgtttcccagaacaaccccacaaaaaggtactcttactccatttttagatgaggaagtggaggctcatgatgtcaggtaagctttctcagctcccaagtggttaagccctcagtttaatgtcatttgactccagagccctatgttgcaccatgccttgataataggccatatgggtttcatgtatttcagatggggaaggttagtgtgaggtgaaagatacacaattaaccttttaaccatggaactgaaatatttacagatgaagtgatacaatagctggaattaattccaaaataattggggtggtactggtccatggcctgttaggaactgggccgcagagcaggaggtgagcagcaggctagtgagcattgctaccccctatcatatcagcagtggcatcagatgggtgaggatgtaaatgaactaggattggcattgagttgatattgttggatctaggtgatagatttatcattataatattctctctttgtgatatttctgatattttctaaaataaaaagttgtagttatttatttatttagacggagtttcactcttttgcccaggttggagtgcagtggtgtgatctcggctcactgtagcctccgcctcccgggttcaagcgattctcctgcctcagcctcccgagtagctgggactacagcctcccgagtagctcaccaccacacccagctaacttttgtatttttagtagagaggaggtttcaccatgttagataggctggtctcaaactcctgacctcaggtgatccacccacctcggcctcccagagtgctgggattacaggcgtgagccagtgtgcccagccaataaaaagtttttgaaaggatttagataaaatagttggggaaatggcatttttgttcaaagccaattatttatgtttggaatatcttttgtgcttggagttctccattacagagttccccagtgttcctattaataagtaacattgagcagaggaatgcactgtttagatcagcagtccccaacctttttggcaccagggaccggcttcatggaagacaatttttccacagacctggggtaggaagtgtttggggatgaaactgttccacctcagatcatcaggcattagtgagattctcataaggagcaggcaatctagattcttcacatgcgcagttcacaatagggttctcactcctgtgagaatctaatgccacccctgatctgacaggaggcggagctcgggcggtaatgctcacttgcctgcggctcacctcctgctgtggggcccggttcctaacaggccatggaccagtacccgtctgcagcctggggactggggaccctgctttagatgatgtactctggctttgcattctggcattagctaagcaccctcttaaaggaaattgggtctatactctcagtccgtgttctccctaacacctggaaacattgaataccttcaatgctgggaagttaactcccaccacaactagaacagctatgggaaagacaacagttgattttgaagagtgtcaccaatttgcacatgattccatccttaaccattcttatcctatcagctctgccaaacatggagaatagttggctgcaggacagctatttttcctacttgtagatgcaactatttctcacccaccaggatgtaaaaggtccctgtaccctaagattggtcctacatacacacccaatgggaaaatgagatgaaaaatttaaagcagtaaatatttgaggaagtagatagagtaatttagaaaaagaaaatacacagggccaagcacagtggctcacatctgtaatcccagcactttgagaggccaaggtgagaggattgcttgagctcaggagtttgaggccagcctaggcaatgtagtgagaccccacctctacaaaaaattaaaaacttagttgggcttggtagtatgtacctgtagtttaagaaacttgggaggctgagctgaggcaggaggattgtttgagcccgggtggtcaaggctgcagtgggccatgattgtgccagagtactccagcctgggtgatagagtgagactctgtctcaaacaaaaaaaaaaacagagacagaaaaaaagaaagaaaatatatggatgtatatcatataaaaatataaataagggaggccaagtgcagtggcatgcctgtaatcccagcactttgggaggctgaagcaggaggatcacttgaggccgagaattcgagaccagcctgggcaacgtattgagacctcatctctgcaaaaaatcaaaaaatgaggcggaaggatggcttgagcccaggagatcaagccttcagtgagctgtgatcgtaccactacactccaggctgggtaacagagagagaccctgcctcaagataaataaattcatacatacatacatacatacgtacatacatacatacataagaagacttgtttctttccatttgcaatgtttcattcaaaggctagaattaaattgccgtaggccatcacaagtttagcttgaatattattattttttcaagatggagtctcactctgtcacccaggctggagtgcagtggtgtgattttggctcactgcaacctctgtctcccgggttcaaccgattcttctgcctcagcctcccatgtagctgggattacaggcgcccgccaccacacctggctaagttttgtatttttagtagagacagggtttcaccatgttggccagactggtcttgaactcctgacctcaagtgatctacccgcctcaccctcccaaagtgctgggattataggcttgagccactgcacccagcctagcttgaagaaaatttgataggagtttgtttttttctatttataggccaagcaataccacgtataaatattaagaatcatggctgttccttagtgcctagttgtttataaaccatgggaaagaatgaaatcattgaccaaatgagacagggtaacagtcttccctgggagtaaagagactagcagtctctattgacatatattttaggcctggcctccaaaataaatttacccaaagaagtgatgtatttgtgtccagggctaccgagcctaatctttggctgcctctgtgttattctaagttgtaattttccatgtcatctaaatttgtaataattctttaatatgatagtgtttcagtgaacaaacattctgcttgctgcatttcttctgagtgagtaattccctgacaactaccagatcttggcagaagcaaagttggtcataagttatgctccactctcagtgctggtgaaacgtatgatgcgtaacacagtgtttttgaattcagtgctgattttcctaaaggacatttggaaggaaaaaagaaaaggaaaggaaatacccaaattcaggaatagaacttacatattattataagacttaaaaaatacatgaacactaatgatgaactcatttcttcgaagtaaaaggccttatgctattttttcccatttccctatgtggcttgattgtggcgaaagtggctgtgtgagtttccattattgaaggagttaaggtctgtggaatcaaagcatgagacaacatgcaaggaccaggttggtttccatttaacagccaacctaatctaactgaaaggattgagaggtttgtcttttttggaaagtgttaaggttcttccaagtaaccagcaatgtgactttaccacactgttcattaacggggctttggatggccaccatgtctgctgctggctgagtccaaaactgcggtcactctctccagcaagctcatggagggttacgtcatcttcactcagccagcccaacgctttttccatctgctaaaatgtagaacatggttgttgattctactctttctacaaagaaagagagggaacatggatgagttgctgcttttaaagattatatgttaattgctgttttaaaaatctgctcagctaagcacgcttagtgtaatcagtcaccatggagttttttaataggacagcttctgctcttacagagcagagtttttatgccagtaggttagaagcataacatgtttctatattgaagtgattctccaacaaggacttcttttcatcaggggtgacctaaaagttattacttgaaatataattacatcatgttcttaactgggtttagtagtaggataattacaaggttgtatccacctcaaataggaagaactgataagttttgcacaattatttaactcctctgttaggccttccttatttcctgttctctttttaaaatttgactaagatattgctaatgggcttgggagcctataaaatgatcagaattgttgccttatgttttgcatgtttggggtaacattggagccagatgtactcttaaataaaaggtaggcctacaaaaccagtttctcagttgcattcaaaatgtgattaaaaaaaaaaaaaggagaatctcccttataggtgaactttttaatttgtgctttattttcccttttgccattcatgagatttcttaaataaaatgatatcttttcttttcttcattattattttaaaggtctctggggaacaagactcatggaggaaagcagcactaaccgagagaaataccttaaaagtgttttacgggaactggtcacatacctcctttttctcatagtcttgtgcatctgtaagtagaatatttccttgcactaatgggaaagttttgaaaagatttgacctatccaaatcataattaaaaggaagtgtgtatgcaccagaggggcaactgggaagttaccttcttacctttgtttttaattctaatatttttatttgggcatttgtttattgactatcttcctatggtagaatgcaagctttataagagaagggacgtgatttgttctctgctgtacccccatttcccaaaactgcagatggcaacagaaggctctgaaaaatatataagaaagaatttttctaattgtgactaaattgtgaccaaatgctaagtgactgtggacttgcgtttaacacaggacgggagaggcaaagagttcaattccaatttagaatttggtcaagttctcttctgcactctggtaaacattaattaaaaatcagcattatctgaccagccagttcatcgtcagtggtggtgattttcactatgagatacgcgtggcaacttgccagacaccaagaaaccaagttagaggatttttgtattagattccttaacaatgaatacagtatcaccattattacagtatcatcattattgtcatactattattatatcagttaacataaagtctgcataagaattgtttccagaaaaatgactttccaaatttaactttcaggaaatacaaataatgctactaatattgcttttattggcgtatacatgtaatatccccttcttttggatttggatatgttgtgtcattgcctcattttaattcattatttcttctcaatctttaataattgctggacttttactccacaagaaacttgctataggcccatctctttcgtcttctttccttctttcagttcgtcttcccatcctctggtagggggaggggagggatgcctgagcgagagactagctgtaggaaccatttgtctcaaagtccagaaagccacaggtgatggatttgtcctctgaatcaaagggcgttcgatgatggatttctgtcatgtctcatctaaagtcttcacgagaacagatgaggaagcagttttatgaccccagagcctcctaccaaactcctctgagaaaaggtttccttttttttttttttttttaaattagagacagagtcttgatctgtttcacaggccggagtgcagtggcacaatcatagctcactgcagcctcgagctcctaggcttcagtgatcctcccacctcagtcacccacgtagctgggactacagctgcacaccaccatgcccagctaacttttaaaacatttttgtagaggtggggtctcactttgctgcctatactggtctccagctcctagcttcaagtgatcctcctgcctcggaagttctgggattataggcatgagccactgcacccagcctggatgtgatatttttatgttttaaattgttagagtttagaaacttgagattgagtttgctgcctgcattaaaatgatgcttaaacattaaactgcagtggccttaaatattaacaagttgattagaattactaagttcttttcaagctttacatatacagacaaatttcttatgcaaaatagaaggtaacccctgtacgtaagtctagaatttcagcagtccccaaaactgactgagcattagaatcactctgattttaaaatacatatgtggttttccgagatctactaacagagcctccataatgtagcctagagaaacgagttttcagatgtagtgataaatttggaaggtaagtcagagaagtaagctgaagacagagttttaggaaatatgcctaaagtcacataatgaattggttttcttgtttatttgagaatattgtcgctttttgttctttttcatgcaaatcacattttatttcttatgtgagtagctatatatttaaaaattttgtttttggaatattgtagaatctctacttaagaaagtatcttagcagtcatatggtctgacctcactgaatgctaaattctctttaaaacatccgtctcagatggttactcatactgcctctgattgaacaagagtcccaggttaagggacttacttctttgaaatcgttcatttcatttttctacagctatgttagaaagttcgtccttagcagtgaagccagagtctatctcttataacttctacccagttgcaccctccaagcctacctataccaagtatcttttttccacgttgcttttccaattcagctcttcgcaagtttggagacaaatacctaatctcctctaagccttctccaggttaagcctttccagttcatccagctgttgattatgtgattggagacacaagtttgagtaactcccatgatggaaagtccctctggtgaatgttctgttcatcagagtccctaagaaagcacatgagcctcaccatggtgagtggggccatgagattcctaaaccagacactacactgtggcttgtgcaacctaccatggccagactcatgaggctgtttcatcatataaataattccttagtctcttcaccaaaaactgtgaagcactgtgtcccccagctgtatgtgagctagcctgggaccatagtggaggactcctctttcaaccctgttaaatttcatcttgttaggatctgcccatttttccattctgttgaaattatcttggaactggattcattcatctcacatcagctactccccgaagcctcacagtatcagcagagttattatctctatccatatccttgtaaattattaaactaaaaaagattggtctaagaacatcagtccattaatcaaggctctttggttggagttcacttcattatattatcatccagctcagagtgttcataaacaagatgataggaaagacttttccaaatgcctgtctgagtaattcccccattcctgtgatctgtgagctgttgaccagattaaaaaggaagtgagaataaccaggcaagatttactcctagcaaaaccttactggcttctagtgactgagtcctttccctattgcttaccagctatctttttaattactagttttaaaatcttgccagcaatgtcaatatcaaatgaccaagaatatcaaactcattactctgtatgtaaatgagatagtgtacttacccctatggcttatgtattaggctgttcttgcattgccctaaatacctgagactgggtaatttataaaaaaagaggtttggccaggcactgtggatcaggcctgtaatctcagcactttgtcaggctgaagcaggtgtaatggtgagccaagagttcaaacttagcctggacaacaaggtgaaaccccctctctgcaaaaaatacaaaaattatctgggcatggtggcatgcacctgtagtcccagccacccaggaggctgaggtgggaaaattgtttgaagctgggagtcagtgattgcagtgagccatgattgcaacactgcactccatccagcctgggcgacagagcaagaccctgtctcaaaaaataaataaatgaataaataaataaaataaataaataaatagaaaagaaaaagaaagaaaagagatttatttgcctcatggttctgcaggctgtaagggaagcatagctccagcatctgcttctggggaggcctcaggaagctgttactcatggcagaaggtgaagcaggagcttgcacatcatgtggcaaaagcaggagcaagagagagagaatggggcagggaagaagccccacacttttaaatgaccagatcgcatgagaaatcactcgttacctcaaggacagtaccaagaggatggtactaaattcctgagaaatccacccccatgatctgatcacctcgtaccaggccccgccttcagcattggggattatgtttcaacatgagatttggatggggacaacatccaaactatatcaccttgcatagtaggtagggttttaaaaagcagtttggcacagtaagaaaagtacagattttttttgcatcagacagacctgagttaaaatcccagcttcactgctaacatgctaggtaaatgtgggcaagttaattaacatttctaagcctttgtttcctcactggtaaaacaagtatttggaaatatcattgtgaagattagaaataatacatgaaaagatcctaggatgctgtctgtcatacagtagtagtagtaagaagttattcttgccaaagattgttgagaatggcagaattatctcagttctaagagctatagtttctaattatttgagcctagactcagattcatttggagcagctaactgctcaccaagagcttattttccatcttaccaatgaggttatgtgccctgtgtttttaaaatcagtctacttaaccaagagaacagaaatgacatgagaattaagtaatctcactttctctgttatttaggatttattcctactcaaaacctgagagttgctatgaattcaccattaaagcacttattaatatacatgggttactgttataaatagcaatagtattgctattgtgtgagttaggtgttgaagttcaagaaaggaataaagaatatttagaagatctttgaaaacagtgtctgggtacggtggctcatgcctgtaatctcagcactttgggaggccgaggcaggcagatcacttgaggtcacgagttcaagaccagcctgggcaacttggcgagacctcgtctctacaagatatacaaaaattagccgggtatgttggcatgcacctgtaatcccagctacttaggaggctgaagcacaagaatcacttgaacctgggaagcagaggttgcagtgagccaagattgtaccactgcactccagcctgggcaatagagcaacactctgtctcgaaaaaaaaaaaaaaaaaaaaaaaaagaaagaaagaaggaaggaaggaaagaaaaaaaaaggaaaaaatgcaaggaaggtatttggtgaatctataataataaaaatgtatttgtcatttcctttttctgtgctctcattctataaaattgagtaaaaaatctatatatagtttaaacacattaatagaaatcacaaaagttagctgagtcaacattgtagaaacataatatttctgtatgtcaaagaaatagacaacattaaaaagcagaaagcaattacaaagaatgattataagaaacatcacaaagggttaatattttaacacatttgaaactcaaaaatcactgagaaaagcagtagacttccataaatattttatagagtagaaaaaataggccaagcacagtggctcatgcctgtaattccagcactttgggaggccgaggagggtggatcacgaggtcaggagttcaagaccagcccggccaagatggtgaaaccccatctctactaaaaatacaaaaactagccaggcgtggtggcaggtgcctgtaatcccagctacttgggaggctgaggcagggaattgcttaaacccttaaacccgggaggtggaggttgcagtgagccaagttcgcaccactgcattccagcctgggcgacagaacgagactctgtctcagaaaaagaaaagaaaagaatagaaaaagaatccatgggcaggcacagtggctcatgcttataatcccagtactctaggaagccaaggtgagaggatcaattgaggccaggagttcaaggccagcctgggcaacatagcaagactttgtctctattaaaaattttaaaattagccaggcatggtgacgcacacctgtagtcccaattacttgggagcctgaggcaggagaactgcttgaggctgcagtgagctatgattagaccactgcactccagcctgagctacacagtgagaccttgtgtcaaaaaagtaaaaaaataaaaattagccaggcatggtggcacatgcctgtagtcccagctactcaggaggctgaggcaagaggatgacttgagtctggaagatggagactgcagtgagctgtggtcatgccactgcactccagcctgggtgacagagcaagaccctgtctcaaaaaaaaaaaaaagaaaagaaaagaaaaataaataaaatttattcaaatacaaaagtgatgtggtttgactctgtgttgccacccagatctcatctccaattgtaatccccgtgtattgacggaggttcctggtaggagatgattggatcatggggatggtttcccctctgctgttctcatgatagtgagtgagttctcatgaaatctggttgtttggtaggtgtctgtcacttaccccttctttttctctctcctgctgccttgtgaagaaggtacttccttctcctttgccttccaccatgattataagtttcctgaggccttcccagccatttggaactgtaagtcaattaaacctctttcctttataaattaccgagtctcaggcagttttttatagaagtgtgaaaatggtctaatacagagacttggtaccaggagtggggtactgctataaaaaataacctgaagatatggaagcgactctggaactgggtaacaggcagcaattggaacagtttggagggctcagaagaagacaggaagatgtgggaaagtttggaatttcctagagacttgttgaatggctttgaccaatacactgatagtgatatggacaatgaagtccaggctgagatggtctcaggtggagatgaggaacttattgggaactggagtaaacgtcactcttacatgttttagcgaagagactggcagcatttttcccctgccctagagatctgtggaactttgaacttgagagacatgatttagagtatctggcagaagatatttctaagcaccaaagcattcgagaggtgacctggcttttcctgaaagcatacagttatatgtgctcacaaagagatggtttgaaattggaacttatgtttaaaggggaagcagagtgcaacaaaagtttagggagtttgcagcctgaccatgtggtagaaaagaaaaacccattttctggggagaaattcaagctggctggagaaatttgcataagtaacgaggagctgaatgtgagttgccaagacaatggggtaaatgtctccagggcgtttcagaaaatcttcagggcagaccctcacaacacaagcctggaggcctagaagggaaaaatggtgtgagccaggcccaggcccaggccccagctgttctgtgcagccttgggacatggcaccctgtgttccagccactccagctccagctgtggttaaaaggagccaaggtacagctggaccattgcttcagagggtacaaatcccaagcattagcagcttccatgtggtgttgggtctttgggtgcacagaagacaaaagttgagctttggaagccgctgcctagatttcagaggatgtatggaaacacctcgatgtccaggcagaagtctgctgcaggggcagagccttatggagaacctctgctagggcaatgcaggggggaaatgtggggttggagctcccacacagagtccccactggggcactgcctcatggagctgtgagaaaaggaccaccatcctccagactccagaatggtagatccaccaacagattgcactctgcgcttagaaaagctgcaggcactcaatgccagcctgtgaaagcagctgcaggggctgtaccctgcagagccacagaggtggagctgtccaaggccatgggagcccaccccttgcattagcatggagacaggggatcaaaggagattttggagatctaagatttaatgaatgccctgtcgagtttcagacttgaatggggcctgtgacccctttgttttggccaatttctcctatttggaatgggaacatatacccaatgcctgtacccccattgtatcttggaagtaactaacttgcttttgattttacagactcaggcagaagggacttgccttgtctcagatgagactttggacttgaacttttgagttaatgttggaacgaattaagacattggggttctgttgggaaggcgtatttggttttgaaatgtgagaaggacatgagattttggaggggccaggggtagaatgatatggtttgactctgtgtctccacccaaatctcatctccaattgtaatccccatgtgtcaagggagggacctgatgggaggtgactgaatcataggggcagtttcccccatgctgtttgcatgatagtgagggagttctcatgagatctggttttttggtaagtgtctggggcttcccccttttccctctctctcctactgccttgtgaagaaggtacttgcttctcctttgccttctgccatgattgtaagtttcctgaggtctccccagccattcagaactgtgagtcaattaaacctcttcctgcctattctcaggcagttctttatagcagtatgaaaatggactactacagaaagtgtgtaactttaaactcagtagtatccaaagaagtaatgaaaatggagaaacgaacaacaaaatcatagtacaatatggtgtatgtactaggacaggaagagcccttttaagaagagatctatgtatttccatttgtttatctctgaaagaaagcaactttgccttgtattctgaaaaagaaaggaatattttattttacttgtaaaaatcttacaaggatgctagtctaaatatagttttcctaatttgccagagaatccatgaagatcgagttgataacaagatcagtgaagtaaaggtcagtgagttaatctcacagcagctgcaggctaattccatttccagtgaaaaacgtcttgattgctcaccacatatcttttcaccacaaacagtttcagtcttaagatcacatgttgcaatccatgagaagtaactattaagccttcaactatgactggagggctcctcgccctttctgataaattgactggacaaaaactcaattttaaaatgacaagaaatagaagatgtataaatgtactttaaatgtgaccaaaatgggttgtgaaaacacaagacacaatatccaaaaatgctggcaacacagtacactgtagagtattggttgtttatttacccttgctattgtgtggctgagcttactgccactgcccagcattgcaagggcatcaaactgcctatcactagcctaggaaaagatcaaaattcaaaattctaagtacagtttctactgaatgcttatcacttttgcaccattttaaagtaaaaaaatcagtaagttgaaccatcatatatccaagattgtctgtatataaatattatacatctttctctcacttttaaaacaaaataatactagccaatactaccattctcaaaagcacttgtgtcaacagcctttaccccttaaagattttcctcacaattttaaaattgttacttactattttctttgaaatgttgaccaaacctggattaaaagatttgggggttttagtgactgtatttcacaaactctcttattgattctgcagcctcacttctgcctcctaaaaagccctcaccaaggtcacgggggatggctcttttcagcctcttcctggcatttggtccagtggcatttggcattctaggacttccctctttgtctttgataactccctctcttcctgtgttcctccttgctgtgttcacttgcttcgctttcttctttctgaagcatgtttacacagtgttttctctgattgggcctgtgacgttctttaggtcatcttttccacaaataatgcttcaactagtacttgcgtgccagtgactccacgtcccactcatgagctctgaacctagtaccagcttctgctggacatctacaatgggatctctcacaggcctctctcattggtaacatgccccagcctgaactcatctcccacccatctatccagccatgctctctagttcacctgaacacttgggtgtcatcctagatgctttcccttcccagtcttctgtgatcattctgcctcatcagaggctctctaatctgtcttctttcctatatcgctcttgtccctattttaatcctaatcatctatttcctgacttattcattccttaagttggtcagtaatttaattaaaaacagatttaggccctgaccttaaatgtgataagtgatatgaaaggagatgactggggaaaaggatttccctcaaggaaggcctctgtgaagcctgaagcaagaatgaaaacgagtcagacgaagagagaattgtatgaatgaaggctctgaggcaggaaaacactcagatcattccagaatcacttagaagccaagtgaagccagttcctggagagcagatcatcaaatgaagatggaaaggtgaccaggggccagacctgtagttttggtgggccttggtgagggatttacagtaggacaccccatggtttaagtatgaaagtgacaagattcctttaagttttaagaggcctcgaaatatgaaccacagattagatggaagctactctccctgtgtctggactttttagaatttccaagagctgctgtttctggaaccagattaatacaagtcagtcttccatttatttatttatgtatttatttgagacagggtctcactctgtcacccaggctggggtgcagtggcatgaacacagctcactgcagcttgggggctcaagagatcctcctgcctcagcctcccatgtagttgggaccacaggcacctaccacccagctaattttatttgttgtagaaatgaggtctcattttgctgcccaggctgttcttgaactcttgggctcaagcgatcctcctgcaacatcttcccaaagtgctgggatcactcttccatttaacatgctatctcaacgtcaagataaactttaaaatctttagataataggctggcattttacttaaacgatctttacttcttcagaactgccattccctataaatatctggttcttcaaccacatcaaaccacttgtgatctcaaaaagcctcagcgtacactgtcctttctgtcattctaattcctcctcatccttcaaaatcaactcaaggaccagatccagggagaagcttagtggtgcccacccgaaccggccccctccttcgagttgtgctgccattcgggcccacctcttcacacagggttgtcagaccagaccagctcatgcgttcaccgcccttgcagggatgggatgcagctgtgcacctctcagtgccgacacctggagagtctcacgaaatgttgacaacatggcctgtttccatttcttgttcactaggacttctcatttactaacacacagaatttcctgtagtatgtccacttaatcagttcaagcccaataattccttgatttgggtatagtgctttgcatttatatactgatggtccccaacttatgatggttcgatttatgatttttcaacttcatggtgatgtgaaagtgatacacattctatagaaaccacactttcaattttgaattttggtctttttccaggctaccatactctaaagatagagccacagatcccagtcagccatgtgattatgagggtaagcgaccaatactctacagtgtattgtattgccagatggttttgcccaactagcctaatgtaagtattctaaacatgtttaaggtaggccaggctaagctgtgttgctcattcagtaggttaggtatattaaatgcattttcaacttatgatattttcaatttacaatgagtttatcaggatgtaactctactataagtcaaggatcatcttgtatagcacttttaatttatagagtcccttcaaatgtttgtttgtattttatttccactgcatccctgtgaggataccataagttatacagctaacaaaacagttagttttcctgtgcaaagtgatggcttcatcttgtggcagattacctggaatactgtggccaaggcatcttagttctactgtctttatatatctagtacagttatatttttatggcagctctgatttcttctttggcccaagggttattaagagagggaaaaaatttaatttcttaacagatatatatatctatgtcaagtcatatatttaattcaaacccttaatattcctaggtaatttttgtctactttctctgtcaaagattgaaaggtacagggttttaagtttccaactgtaattgtagttttggtaattgttttattactaacaggtattgctctgtatattttgatgttctgttattcaatacataagaattcattacagttgaatcatcatgtatagtataatttaccaatgtaaaataacctttttatcaaactgagtattcaccttataatgtcctctgtcagaggattataataccacttaaaaccttttaaaaaatattttgttcctgataattttagctttgagtggttttcttataacaattctagagatgcgtttttattttttaaccaagatttaaagctttgtgatttagtaagagtctaaaccattcacagttcatgcttttttgtcaaatttctattatttagtattttcctctcttttatattttcctgttattttccatttctattcttttgttagactggaaattttttctttgctttcttttatcctagtgatttgaaatttatgtaatatatactattctacaataccctttatttgttttcaatatttgaacctatatttttcaacattattaagaataaaatagtatttgttgctattttgaaatgatagaccatgtttttaaggcaggttggtggttgttaaggcaccagtatcggccaggcacgatggctcacacctgtaatctcagcactttcggaggccgaggtgggcagatcgtttgagcccagcactttggccgatactgtggtttactgtattttgttctagtttattttatggaaaatgggaattcagtggttaagacaaggattaaatagcagaagaaagatgtgtacatatgtacagatgtatgtgtcctttatatgttttttagtactcttgtctcctttctggtcctcatttaaggttatctatttcatgcagtaaatttttcttcacaattcatttcatttagagagtgaatgctaccttccaagtgggctttctccagttttcctttcagggacttaaaggagaagtgatgttaacagttttatatttccattgcattttacagtgtgcagatgtcttcacatatatttccccatttgagctttacaaaagcccttagtattattctcattgtctagattccaaaatcaggcttagaggagttaaatagttgtccaggatctcaagatgcaagacccacaatcatgaacagaggcagatgttcaggatggaggcaagctgaaactcaaaaccaaatcattatgactccaaattcaggagtcttttagctgccacctgcatgggctcttggtgtagctgaccaccagagtttgtagagctgtcattcaggtgtgccatggactttcctgggacctcgcacaggagaaggactgagttaatgtttgctgattaaatatctgttacaggctgggcgcggtggctcacgaccgtaatcccagcactttgggaggccgagcagggaggatcacttgagctcacaagtttgagaccagcctgggcagcatggcgaaaccccgtctctacaaaaaatttgaaaattagctggccatggtgatgcatgcctgtagtcccaggtactcaggaagctgaggtgggaggatcacatgagcccatgagattgaagctgcagtgagctgagatggtgccactgcactccagccttggccatagagccagactttatctcaaaaaaaaaaaaaaaaagttacaataatcttcccttcaaagctggaaggcattatttacctgtctgtccagcagatggtgctacataaccaagggaatctgttgcttgcccttggtgaagctattaaagccaatacagatcttgagaatttcaaaagcaaaaatcaatactggattatgagtgctctaggaaaataaagagataaattttcaatttacatacttatatatagttataccatatttgtaaataaaaatatataaataatttatcaaaattcctttttaacagcaacaaccacagtaaacccacaggttaaaaactccacaacagtctatattaatcagtcaatgcaaagtacattccaattccaagttaactgaaaataatcaacttaatcatttggttggctctgagcagccttcactgcttgctcttgtgtcatgtttctttctgtcctcgattggctatagacttacagacggcttttgcagaggacagtgtactcatgtccatcctttgcatcctttgtgggagttggctaggcagcactctccctggggacactatgaactcctcttcttgagtgcagagatcacgtcttgttcatcttcatgcccaataccttgttccataaatatgaatggattagaattctaaactcttaactctgccccaagacagttctgagaggtagtaagtcatataacacctgaagaggactgttcttgtcctaattacattaggttataagatgacaggtgagggagccaaaccagggggcctggaaattattcatacatctctagatacagtatacaagttgtgtgtattatgtgtatttactctgtaattgattgcttgagatgaacccccaaacacactcgtgtttggatcattattatctacccttctccttaaataatcttaatttcctatgatgcttgaaagggaaagaggggccaggtgtggtggttcacacctgtaatcccagcactttgggaggctgaggtgggagcatcacctgaggtctggagttcaagaccaacctgaccaacatggtgaaaccctgtctctactaaaaataaaaaatcagctgggcatggtagcacatgcctgtaatcccagctacttgggaggctgaagtgggagaatcgcttgaacctgggagggggaggttgcagtgagccgagatcactccattgcactccagactgggcaacaacagtgaaactccgtctcaaaaaaaaaaaaaaaaaaaaggcagagtggggaagagagctgcatgaaggagagatttactaaatagtacttaatcccaaaataatttctataggtttgaatatgatccctgaaatttattataggttcaggtaagtattaatcacgggtattcagaactgtggtttaaaaaatgtatagaacatgtttccttccccttgaaactttttatcagctaattataggaattatattatacctgcaatcattaaagtccagaatgagacagtacttggtaaagtgctgaaatttataataaatgcattatagcaatccagttaaggaggaagagccaccattattgaacatttgttaagtgtcagccattgtactagataaattttagttattatttttatttaggcaccaaaaaatccatgggatagttggttatccccatcttactgaagaggaaactgaagctcagaaagtttaagcaacttgcacaggtcacatagcaagtaaggagcatggccaggaatcagaccctgatctcctttggtctactaagcttgcaaaggatcttcccgcctccttccaagaccattcaatattatcagtaaatgtccatggcaaggatgtagttcgagttatagggttccattcaagatatgattggtaggtgggaagcagatatgtctgtgtcaatcagtatcctggaagaaggagatgatgaactcaagtggtgattaagggaagtttaatgaagggactatttacagagatgtggtggggttaagagaaccaacaaggggaagtgatgcactcaaaaagttactacctccaggctttaggggattgggggagggagtggcacagtgtgaacccagtgtggttgtgagaaaagggattccctcagcagccatggccaaggttagagtctccactgccaaactgcatccaggtggtgagggaatggagaataggggtggggtaacaaactctgacctcggtatccccaaagggcaaaggattccaggtggtacagttcgtaaagattagcctcagggcacagaacagggcagagaagaatggagaattgatctggaggaaacaaacaatggcttgcccatgttattgcagggagagtaggctggtgtgcacagcaggagggtggggagcccagcatatagctgtgttggggcctgtgcagatcagcctcactggcagggaggatctgagccgagaggtggtggaagatgaaatcgagtaggcatgttggtagtcctaaatatcaagtaaacgttcctgatcttacattgatactcaatagtaagccaattttgtttcccataagccaatattaatattacgtatttcttttataagccagagatatagagagataccctagaagaatgataggggaaaggaaggcaagggtgagagaagaccttgtgtgaatttgtccaaaatgtttatccacaggaacaatccctttgtgaaggctgctggtatgtgaatgtgtgccggttcccttggggcgttcatttggatctttctgtgttccagtgacctacggcatgatgagctccaatgtgtactactacacccggatgatgtcacagctcttcctagacacccccgtgtccaaaacggagaaaactaactttaaaactctgtcttccatggaagacttctggaaggtatttgcaaataactttgaaagtacctctctatcacagaaaattgttcatttggcttcatcatttcaatgcatgagtatcgacaggacctgctttgcatttaacactgtgtgagacgtaagttatggtgagttgttagaagttactgttcctactctcaaagggggtaaactaacattgagaactttgcctgtgccttgcactgtgctgagtgtttcatatcttaccttatttaatttctatagtctaactctataaggtaagtactaagactatgccctagtttgttaatgaggaaaatgagattcaggatgtttaaatgcgtatggtcacatggctagggaacaagaaaaattgatttttttctagcctgacagctacttcatcctagtttgtaattcattccatgagtcaagattcaataaatatttattgagaatctcctagaatgtaaggccaatgaagggcagtgtggttcttctgtcttgcttcgccttttgtgttttgtctctttgttgatgatggcatgtatccccagctcttagaacagtgcttgattcaaagtaagcacattctttcaaaggtctgctgttggtggggcttggtggctcacgcctgtaatcccagcactttgggaggccaaggcaggaggattgctttagcccaggattttgaaaccagctgggcacaacatagtatgactttgtctctccaaaaaagttaaagaattagcagggtgtggtggtacacacctgcagtcccagctactcaggaggctgaggtgggagaatcacttgagcgattgcttgaggtcaaggctgcagtgagccatggccatgctactgcattccagctggggcaacagagtgagaccctttctcaaaaaaaatcccccccaaaaaaaaacccaaaaacaaacaaaaaaggtctgctgttgtgaagttcaacccaatccagccccttcccaagttgtcacaaattccaacgtagttaacagtataccaatgagtgataccacaggaaaaatattaaactgatctgagggatatggggcttggaatctaagaaaattggaagggaaattgaaaaggaaattattatttctccttggggagatagtttctaaaattcttactacaccctggggtcagagctgttgattttaaggatagagacaactgagtcacaggaaactattcatatataaaagtacctggcatccaaaaccacacttgtataatatgaatctttcaccatctgagtagggcaaatcagtctatctctgttgatcatctgacaaggatagcacactgagaaatagatctgtcttccctacaggcatagctagttgtacaaactaacaagagacttttgtatacacattccatgatgataaatgccaatcactaaagggacgaggagggattggagagttcaccatacagcaaaatagtccagacaggtgaaaggtctatcaaatgccaggctggtaatcaaaactgtagccttttctctaaacaaagtttagaaccatgattgtgtgggacattattttaataagggaaagtgcagttaatcatgaccccacctttagtccaagaacaaaaatcagagctgccacgtattaagtacccactctgtgccaggtgcagtaactatgcaaaagatgggttttccagatgcaagaaccttggttcagaggaccctgctcaaggcctcatagctaacaaatgatggggcaagatgctatcccaaatctctctgacaacaaaactcattcttatcactctactattttcatagagttgccaaatgcttggttatgcaaacgatgcaggcaggggcaagacagcggctgagcttggaactttttcaaagatgtttcctttgcttttagttcacagaaggctccttattggatgggctgtactggaagatgcagcccagcaaccagactgaagctgacaaccgaagtttcatcttctatgagaacctgctgttaggggttccacgaatacggcaactccgagtcagaaatggatcctgctctatcccccaggacttgagagatgaaattaaagagtgctatgatgtctactctgtcagtagtgaagatagggctccctttgggccccgaaatggaaccgcgtaagtgtctgtgactcattgccactcggtgatattcattcatttattctctgaactcccaccattcattcattcattccctgacaccttcaccaaggcaaaaataagttcagtgactcttcagtgcttatatttaaaccttggccaacttgacctttgacttcttaagttttcactacttcttagccttcttttagtttctacatgcatatttttcagaagactaaatcgttgaccatataacccctcaaaaattaattatctgagcgtttgaaaatttcatttaagatgccctgggccctgtttttacaggtccagtaacatcatccactaagttatttaacacaagttttctggttcaggaactctttttataggtcttgcaaacaggtttttgttcagaatggagttatttaatgtgtaagcttgtgaggcaattttttgttaggtttaaagcccattttgttcaaatgtttgagattttaggtatatatttgtacacgtgcatatttacaggggctttttgtacactttggtactcctacttcaaacatcttgtgtattaagggaggtcacttactattttagaagtattgtagttattataaagaaacaagaagacctccaaggccgtttcagggtgggcctttgcggttgctgtccctgggtacgtcactggtcggagtcatcttctaagctttgctcagctaattctgtcggttcatctaggttcttttcttggaaactgagttgcccagaatccacatttgttactatacaatgggcaatcaccttttcaattagtatattcttcttgtaccttccagtatacactctatttaataccagaacccataagaaacaaatttagtaaaaatccaggttgggcacagtttctcatgcctgtaatcccagcactttggaaagccaaggcggacagatcacttgaggtcaggagttcaagaccagcctagccaacatggtgaaaccctgactctactaaaaatacaaaaattagctgggtgtggtgacatgtgcctatagtcacagctattcgggaggctgaggcaggagaattgcttgagcccgagtggtgggggttgcagtgagctgaggtctcatcattgcactccagcctgggcaacagagcaagactccacctcaaaaaaaaaaaaaaacaaatttagtgaaaatccagagctttagaacaaaggaactaaatagtctcaaaggacattatcatccaagttatgatagtgatttcgctttctttaaaaaaaaaattattacagatagagtttcttgatgttgcccaggctggcctcaaactcctgggctcaagcagtcctccagcctcagcctcccaagtagctgggactatgagaatatgccaccatgcccagctttattttgctttctaatgtgcctttttgtagttcctgcaaagcataagcatgccttcatctgtggtaccctttccaatattttatttatctcacatcactaataagataaatttatacagccactgctctgtgccagacattatttaagaagttatttcacgcattatctcatctgccttcacaaaacaactctaaaataggtatcacctccattttatagatgaaaaaactgaggctcacttgcccaaagtgtcacagctaacaaattggactgaaccaagatttaagcagcctgactccaaaacccatgtttcgcctactaaacctcttccatattaattcctcctccatattaattgcgtcgttagggtggcttgtcgacgctctcagctccccatcagtactcaagcttcctgagggcagggattctattttgttaactgctgtattctcaaagccttgaacaatgcctcatatgtaaagatactaataaatatgtgctggatgcattcgagtgatttctactccagggtggattgccaaaggggaccttccctgtcatatctaaactatccttttattcttctacattctcaagtcactcccatttcttcttcccttcaactccaaacttcttggaagaatagtcttcatttgccacttccatttccttaccatcaattcacgtcttaaagcttaggttcttgcttttgacatctcaccaggaagctactagggacctctagttagcaaatccactgaacaaatctcagtttttatccccttcatactgtctgcagaaagtggcagtgttgaccgctcattcttttgacttccatgaagaactctacactttgggttcttttaactctgaaacccctttctctcacttctcttattcccaggttctatattcatatctccgtcttttctttcttttctctctttcccatgacattcagatggcttccactgacatctttatttggtgactcatcatttcttcaacaatgtgccaggcatgttcccattgctagaagtcccccctcttctagtagtgcccttgatgctggagaaacaaagcagcaggaaacagaagaaacgtcctttcttcacagagcttgcattctagtgatacaagacacatctctattccacctggatgtcccacacctcttgtgatttaatatgccccaaactaaactcatcgttttcttatgagatctgctctttgttctgttaatggcactgccgtcttcctattgccctgaaagagactccagagtcatttttgagccatgtttcctccttgccccaacttccaaatcagttaccaagttctgctggcagtcactgtggttacgacactctctcactccttcctttcccttcccatcttcactgagtgacttcaggcctcattacctcttggttattgcagactttgctaagggagctgtgtcaggggtccctaagaccacccccaggttcagtgattcactagaaggactcagcatagaggcatccttacagctaaggtttattatggtgaaaggatacaaaagaaaaggcacatggcaatatctggggaaaacctggtgtaggcttccaggagccctctcccagtgaggtcacataggatgtgctgaatttctccaggaacgagttgtagcaacatgtgtgaaatgtctatcagagagattaattagagactcagtgcctggggtgttcactgggtactggtactggtttatgactagcatgtgccaaaattcccgactctcagaaggaaagcaggtgttgagtgtaagccacattgcttatacaaatagcacaggcacagcaagcctctcttaccggtcagggaaagttgaatactggtgcagggagctgtttatcagtcaagttcccagatgccagccaaagtccaaccttgcaaacaggccttcctaaagaaaggccatctcaggcctgctgtgttaactcttttctgcacatgagccctctgttcctccccactccagtcttccctgctgccaccagaccagccctgttgtgtgcctcttagaactttcccttcacagactccttcatgtttgcccttcacaagctgaccacagaccacctttcaatctgccattctttatcttatgggagccaaactgaactacttcttctcttgaccaatggctcacggttgaaaatgcccttcccatttgtattagtctggtctcatgctgctgataaagacatacctgagactgggcaatttaccaaagaaagaggtttaatggacttacagttccacatggctggggaggcctcacaatcatggtggaaggcgaggagcaagtcacgtcttacgtggatggcagcaggcaaagagagagagcttgtgcagggaaaatcccacttataaaaccatcagatctcgtgagacttactcactatcatgagaccagcatgggaaagacctgcccccatgattcaattacctcctaccgggtttctccaacaaaacatgggaattgtgggagttacagttcaagatgagtttggttggggacacagccaacccatatgaccattcacctgtgcaagtccagatcctactcacctttcatggttcaggtccaacacagcttcttcctaaagccttttctaatccatccctccactgccagatccccaaataaggacagctttcctctgatctgccagccttatttcttttctcttttgcttcttattattatccaccttgtattttacttgtttaattataactcttatttccctacttgttataaatttgggagggaaaggacctttatatccccattagtgctgaagaagcatctgttttctaagagatcctctgaatatttgtggatgaaattcccaaatgctgacaatgccacttgatgaacttgtccctcttttggctgtaattttctctggggacctcaagtcgtctagtccctgagcacagttacccagagaaggcagccgtataaactgagcagaggctctagagcagagcagaggctctagggacaaacagccctggcattggttcccgagtctgccctcaaaagctttgggactacattgacctcactaagcctcagggccctcattcctaaagaggctaataacagtatgagaattaaccaagaaaacatgaactgccaggtcaggcacagtacccagcttgataggccttaatacatactttattttacaaggaaccagctgtccttgtaattgcctcaagtgttccactgattgtaactgtttgttttttggttttgtttttaatcagttggatctacacaagtgaaaaagacttgaatggtagtagccactggggaatcattgcaacttatagtggagctggctattatctggatttgtcaagaacaagagaggaaacagctgcacaagttgctagcctcaagaaaaatgtctggctggaccgaggaaccagggcaacttttattgacttctcagtgtacaacgccaacattaacctgttctgtgtggtcaggtgtgtactgaggacatgcatccctcctatttctgtgtggttgtacatacatcctattctggggttagccagaaaaacctttgcctgcagttagctacatgaggatgccaaggacccagacggatagcaagggaggggtaaaaactgaaggcttaccgaaataaaggatatttgaggaagggagttgggatcctagaatattacgagttggaaagaaccataactctggtccaagttcatctcaatgctggaacctttccagaaaaagtattgtgtttttctaacatctgtctttacccattataaggatggttagtgccacatgttccatcaccaagtcccccggccatcaaatcttgactcatttcctggagtttctcactctcagatgagcctctgctattagcacacaagcacagtaaccggagtgcttgtaggatgctcagtaggatacccaggttacctgctcgtgctcagggctaccaaaggcacgtaaagttccttccacagatcctgggatgttgccatgatgacccctctgtgagatagtaacaaaaatgacaaagattccactggcttgtctgggactcttcttcattcatttattcagcaaacattcattggacacttaatatgggctaggcattgttctcggctcttgggacatgtcagcaaacaaaataaagatccgcaccttggcagagcttgcatccaaccaggaggagactagagaataaacattaaacaatacaaataaatagtatagtatattagaaggtaataggtactattaaaaagaaagaaaaagcagagcaagaggaagtcagagttcacccactttaatcttcctggtgagcatgtcagcaacacccaaacatcactaacatggattattgcatgtatatttacacataagataagaagtgtttattctcataatagtctttgtcatcattcttgaggttaagttcaattctgctttatgtggcttgttggattgtcccagtccttgtatttaacaacatttgcagaaaatagtaccacattaaatcaattatagattatcccttatccaaaatgcttaagaccagaatgtttgagatttaagaaatttttcaggttttggaatgtctgcatatatataatgagatatcttggggatgggacccaagtctaaacacaaaattcatttatgtttcataaatgaaacttaatgcacatagcctgaaggaaattttatttttcccttagggatgttgaatcaactgttgtgtgccagcatgttgacaatgacctgtcacatgaagtcgggtgtggaattttccacttgtgcgttcatggcggtgctcagaaagtttgggattttgaagcattttatatttcagattttcacattagaaatactcaagctgtccttgctcacagtggccaaaaaaaaagaaagaaagaaaagaaatactcaaccagtagtccagtagtagttatcactagaaatgaatgaaaatctattgcagtattattgagtttttcctaattattccagtgcagataaaaagaaaagaataaaaaggaagagaataaaaacagagaggcaactctgatattttagtaaattctatttatagaaggtcttgagtatttcttctgcttcctcccttactttaaggatgaacattgttaagacaactgcttcatttctctatactgtttttctaagtttctggaagtggttgactactgcagggccagaatgggccagagaaatgacttgacacttgaaggccacttccttcccttttgagttcccaatgaagctgtcacatacaaggctcttggcttcagagttgctctcctgagtttttgattctcacccctactctctaacacatcaaataggaaagaaagaacaggagaactgacaatgaaaaggaaggaaaattttcacacttctctgaccagttctaatttaccatagtcctgtttttacttgattattgctcatgcatgtgtcctgtatgctcaggttccaggtgcggctacctgtcctgtaatggcagagatagtgatggctagtagctgactaaagggcttttaaatgtctcaaaatgaagcagctagagattctatttctagttagaaaagaagtctgtatcattaactgaatcacccagctttctcagtgtgacacctacaaaatgggcatttgacaagaaaaaaaccctcagtccagttatggtaaagcagtaaagatcagagccatcagtatggatgtaaaatagtgtatgttttagacaatcagacatctattgagtacccacctattaactataaggctctgggaagaagagagaaaactaccctggaggacaaactatttgatgctatttaggtgttacataatgaatgaatgactcagttcctatctttatatatgtacaaaatatatcctacttctcaaccagattacacatgttttgagtggatggtttatatttctttatattcttcatgttgcctagtagaaggacttgaatttaatagaagtcctagggccaggcatggtggctccttcctgtaattccagcactctgaaaggcccaggcaggaggatcatttgagcccaggagtttgagaccaacctgggcaaaagggcaagactcagtctctgccaaaaaaaaaaaaattagttgggcatggtgctgcacacttacattcccagctactcaggaggctaaggcaggagaatcccttgagccctggaatttgaggcagcagtgagctatgattgcaacactgcactccagcctgggcaacaaagcgagtccctgtctcttaaaaaaataataacagaagtcctagaaaagtttgtgtgttgatttacttttacattaaaagtatatggcatgttgagcagcgtaaatatagaaaagtgtagggaagactgagcaggaagtactcctttgggactgaaagacctcaggaagtcttattcctttgatggcacaaaattctccaagtatggaattattagctatgataaaaatgttttgccgctagtttggggggactcatggtagcagtttcattaccttgtaatgcatgaacagaacagatggacatccattcctggctgtattcatgtgttgttgttgttattgttttaattgttcttatttacatgcaggttattggttgaattcccagcaacaggtggtgtgattccatcttggcaatttcagcctttaaagctgatccgatatgtcacaacttttgatttcttcctggcagcctgtgagattatcttttgtttctttatcttttactatgtggtggaagagatattggaaattcgcattcacaaactacactatttcaggagtttctggaattgtctggatgttgtgatcgttgtggtaggtttgagaacaacaccaaatttcctattctattctacaagcatgttaactagagtctttgatctcctcagcattgtggatcttgatattcccaaaaaagaatctaaaagtccccctcaattatatcaacttctgttactaattattttctcattttgcatgagtaactttgctgagtatgaagtggagaggtatttacagtatgctctcagccacgctaataacaagagtatctcagtaattcatatttggctttagtatgccgtatgagatgtggaggagaaaacagttttttttctttgtttttttttccactaatgatatttttcttcaactgctggtaaaaatcaatttatattttcctgcacatgtgtgaagttacagcaataaaaaaacttgtcggccaggtgtggtagctcatgcctgtaatcccagcacttggggaggccaaggcaggaggatcacttaagccccagagttcaagcccagccagggtaacatagtgagaccctgtctttacaaaaaaaaaaaaatttaattagtcaggcatggtggcacacacctgtagtctcagctattccagaggccgaagtgggaggatcatttgagcccaggaggctgaggctgcagtgagctataaatgcaccactgcactgcagcctgggtgacagagtgagaccttgcctcaaaaagaaaagaaaaaagaaaaatcatcctgaaaatattttgtgcggcagagaaaactttctgcagtttaaaattttctgcaaatagtctgcagagtacaaatgtaagttatattcatcaaagttttctgtatgaggtataagaaatcaaaggcaggccatgcacagtggctcatacctataatccctgcactttagggaactgaggtgggaggatcacttgagatcaggagtttgataccagcctgggcaacatagtgagaccccatctctaaaaaataaaaataaaaaataaatcaaaggcagagtcataatcaagaccatgacaccatgtaaattctgtgtctgctcttgactctattataacttctaagatttttttcaagatgttttcccttcatccttatcacttaattaagcatccgtcacttccttcctgtggtttcagtgtataaaagaatttttacaagcttttctcccttcagcaataacaggtaacatttcgctaagtccagttgtacatttaagcatataacaacatgcttaattattagatgcttacaagctttgcttggcataggtgtaccatgtattattctatgtctttccttcccactgtcctatgatagccattaccttctgaaatctcagtaaatgatgcactaccctattagcattctctcttctgttagccctccttatgagagttattctttccctcatcccactcctaaaaattcatttggcctttgtggagtatttagatcaagtcattattaaactattccccactagaattattaatagttgataaaatatggaaaatatattattcatatgtgagtgaaagaacacttaaagcataaaaaagaactacatggccatatattgcatggcaataactatattagcagcaataataattgtaatagtaataataataatggctaacactttagaagcttctgtgttaggcatttccgggtgcttttcatggtacagaagctcatttgttcctcatactaaccctcttcactactctgccactgcctctcaagccatggatatgtgcactttagagtttttacttaaagtaaaaattcctgtagaatagatggtgttgaccccatcagaccgtgatgcagttagaagtgcatcccgtcttttacgatggccatacaacatcacacaaatcaaggtaaacccttgatccccaaattctcaatgtattaataatgaacagagttacacaagaattttagcatttaaggaaacaggagagacgataatactggaaataatttttcagaatatttctgttcggattgatggcagagtgcaggccatatacattgacaattattccagaacacaattattgtttggagctaaaaggatgcaaaccctgcctcttggcttatatggatttatttatgtttaggccattgaaataatggtagaaaggtaagtatgatatgctaattaagaacagacttcctttttatattttaaccaaagaactcaatatcaacaaaagactagtcagtggtattcaccctttttgatcatacacacctatcagtgaaagctttgactactacacaccctaatttattatctttatttgtaaattgtgtgcctactttggtgtaacaggtacatccgtaaaacatacacatacatagaattttaaagattggaataaaagttaatacaaatagaattccaaaactttcttaccacctacctagaagttgtaacattttcttcccatagcccagtgaattgccttgcacctgctttggcgaccaataggaagaaaggcaatgatatcatggaaattgtctctttggctcaacagccacagcattttgcaagtgtttctttgaaaacttgcttcactgtgtttttcaattttttttttaaacaacacttaatactgccagacaacaattcagacagtgtgctttttgtttataaagaacaaggaagggctactggaatctcacttgtcctttgaaacttttgctgaccaagtgtagaagtgagggcatgccttctgctcacccacaaaacacaccctgtgctccactggaccttcaaaccagtggaaagacccaacgctttttgttttatctagccaaaatttgcttatgcttacccaaaacctgaaaagaaattatattcttaatataaatacaatcacatcttgaaatcactttgaaattttctttattttccttttttctttccccaacatatgttctgaagtacacaggctgcatcagtcagccatttgtcctgagcaatagtctttcaaaactagaagaattacttgaaaaaaagaagactattaaggaatttaaactcaaataatttattgaccacttgctaggttgtacagggtaaatttttttttttttttttttttttgagatggagtcttgctctgtcacccagactggagtacagtggcaccatctcggctcactgcaagctctgcctcccgggttcacgccattctccctcctcagcctcctgagtagctgggactacaggtgcctgccaccatgcccagctaattttttgtatttttagtagagacagggtttcaccgagttagccaggatggtctcgatctcctgacctcgtgatccgcccacctcagcctcccaaagtgctgggattacaggcgtgaaccaccgcgcctggcccgactaattcatttattcagcgagtgttttctgagcacctactatgtacttgccactgttctaggcactggggatacaggaatgaacaaaatcacccaaatctctgccctcccaattttctggtatggagagaaagttcttttgtagatagggatgagaatcccacagaaaactcaggagtgatgtaacaatgcaaatgctcacaaaatctctttcctcatctttcattccctatttggaaggaaaggtttcaaagacattgatgttgtataaatgaccatcttcttcattattttataaacatttgtcctgtgcagagtaaaaacaactggactgcataacaaattatacctattgagagttgggtaaagagttaccattggatccagtccaccaacccaaatgtttttctacatgtattagctgagatgagctcctcatctcaggagaagcctattcccactgcaggccttcttgagtctgctgtgttcatcattcccaccaccaacacaaaaatacaagattggctctggaaatccttcacagagaaggaaggaaaggaagatggtgaggttggctttttagctgtgatcagcaaccaagctggtctttgctatgagaatcagtgggaccatgatctcgatggtcatctcaggaagggagggctaatgaagtggtctctggccatgattcctaagaagagagaatggacagcaaagatcgcagcacctgccacagcccacctgctgcagattcagaccccctggtggggccaggttgttatgactaacccctagcactgtctacatttagtggtgatggatgccaaggagggggcagtgtccccttggatctgattgtaaagcttagaaccaaagcatatgtggaaagttgtagggtcatgagttaagggacagaaatgagcaagagagaagcccttggctcatatattcccactgcaggccttcttgagccctctgtattcatcattcccactgtctttcaagcccaagctcatgctttgttctcatgggcactcatttttaggatatcttttgtccctcttgactttatgttgtgtgataccaactctttagtagttttttgtattatttaacttcatgtgtttatctgctcttgagtctcgagggcaggatttatgcagtttacttctgtttattcctcttagcccttgcacagtgctgtatacatagacatctactatatttttgttaaacagagcaaagaatggctggcaattggagaatgcagagaaaccgaaaaattttaaatttaaaaatcacaaataaaaacagcaggatgaaggcaagaaagcaaaagggtggaaagtgattaaaatgaaggtggcagaaaaaacagaaagcattcctctttgagtttgagtctgttatagtgtgatctcttctgtgtatgcatgtatgtgtgtgtaatgtatatgtgcacacacatgcatgcatgccttcgttgagtttctattccgaactaaggaaatgcaagcaatatactgttttacttattttatggcagggcttaacactttccatttgagtgagtgacttttaagaatgacatcgggtaagtataatggtgagcccttataattaatacattggtgaagaaaaatatactagtcatattaaggtaagtttcatatttctaaaacactgtaataaaatataaatattttgcttttcagctgtcagtggtagctataggaattaacatatacagaacatcaaatgtggaggtgctactacagtttctggaagatcaaaatactttccccaactttgagcatctggcatattggcagatacagttcaacaatatagctgctgtcacagtattttttgtctggattaaggtaatttataaatttcatgttctacattttaaataatattttctttaaaaaaaatgagttccacaaaatcatggaatacttgaatttgaaattcaagtgaccagccaaagctgctcaatatttactttgagacagggtctcactctgtcacccaggctggagtgcagtggtatgattacagctcattgcagcctcgacttcccaggcccaagcgatcctcccaccttatcctccgaagtcactgggactacaggcatgtgccaccatacccggctaatttttaaattttttcgtagagacaaggtctcattatgttgcccaggctggttttgaactcctgggttcaagcaatcctcccacctcagcctcccaaagtgctgggattacaggcatgagccaccgtgccaggcctcatattttacatataaagtaaactattgagactcatgtgatcattcctctcactgtcaatgacatacttctgctatctgaattagtgcaagatcagtccctataggttttgtttaacaaatgcagtaagaggcctttcagtgtgttagctgggcctggggccccaggctgctaacagatgagatgaacaggtgaaggaaaaggaacttagagaaagagagggaaggagcaggtggagggaaggggagagttgctgcacttggaaatgcttgctagaagggatcgcctcttttccaggtagaggctgtaagggaagctttacctagaattaaggttggaacagacactgcttccaaatagttccttgctcactattttccttattgtcccaagatataatgtgcatttccatgtgtgtgaaaggttatgacatttcatatacaacaagcctcaattctggagatgcaggaaatttcaataattctcaggcagcagctgccattcggtcaccagcacaggctctgattgtgctgtccagacagtaagtactagccacatgtgcctatttaaattcaaatttaaattagttaagcttaaatacaattaaaaacgcagttccttggtcctactggccacacattaagtgttcaatggctactgtctaggacagtggaaatgtagaacatttccatcatcacagaacgttctcttgaaaagcactgttctggaaggtacttacccgttatgtacttttctgagttggtattcatacctagaagacctgaggtttatcacaagacatagacttggaccaggcgcagtggctcatgcctgtaattccagcattttgggaggccgagataggtcccctgagcccaggagtctgataccagcctgggcaacatggcaaaacctcatctctactaaaaatacaaaaattagctgggggtggtggcacgtgcctgtagtcctagctacttaggaggcttaggcgggaggattgcttgaatccagaaggcggagggtgcagtgagccaagatcgcaccgctgcactccagcctgggcaacagagtgagaccctgtctcaaaaaaaaaaaaaaaatgcatagactttatcctgtatttctcatgctatttatttattgacatgcttgttcaagagaaaccatcactaaagcacaaaaccttgatcataacatagtaataataatcaaacagcaaaaataataatagtaataagaatgttctgtggtgatggaaatgttctatattttcattgtcctagacagtagccactaaccatgtataggcatggaacacttaacatgtggctagtaggaccaagggactgaatttttaattgtatttaatcttacttaatttaaatttgaatttagatatccacacatgtttggatagcacagtcagagcctgtgctggtgaaaggatggcaggtgctgcctgagaattactgaagtttccttgattattattagtttaataataataatcaagatagtaataataatcaagatagtaataataatcaagatctcagctgggcacagtggctcacgcactttgggaggctgaggcgggcagatcacctgacgtcgggtttgagaccagcctggccaacatggtgaaaccctgtccctactaaaaatacaaaaaaaaaaaattagctgggtgtggtggcacgtgcctatgatcccagctacttgggaatctgaggcaggagaattgcttgaacccaggaagcagaggttgcggtgagctgaatcatgccactgcactccagcctgggcaacagagcagcacttcgtctcaaaaaaaaaaaaaaaagatctcaaatgaattgggattgtattaagtaatgattaagtaatgtgattacagcaatcctcaagaaatatttcactgtggccagtaacaatgtgtaacagacctttaaacttctagagattttcctacaacatgtgtctcaggctgatgtgttttatttagtgcttctcttggaaatgtcttgcccctcgatactttatcattaaggtctttaaggcagggatcatgactctacttttttttttttttttttttttgggacggagtcttgctctgtcgcccaggctggagtgcagtggcacaatcttagctcactgcaacctccgtctcctgggttcacgccattctcctgcctcagcctcccgagtagctgggactacaggcggctgccaccacgcccggctaattttttatatttttagtagagacggggtttcaccgtgttagccaggatggtctcgatctcctgacctcgtgatccacccacctcggcctcccaaagtgctgggattacaggcttgagccaccacgcccggcctcatgactctacttctaatatctcatcatgtgctcttccactgaggcttctacttagagctacacaatctgggcagccatcctcagtgccttatctaccaacatgctcaatatggctttgcagggttcactgtctaccagcagggttcactatctaccaacatgctcaatatttctttgcagtcaggcagagcaggctttgcagttcaggcagggcagctggctgcaggccccagctgactcctggggatagaatgccaatatttcagacattgcagagatttgaggcaatgtacataaagccctccacatataactgatgcacaataaatgacagttaatattatgcaacaagaatttcctggggggttttataattaatttttatttgtgtgaagttttttccctcccttttactttaatcctttttggggggaaagcatcactagtcacagttcacggcagcctcgacctcccaggctcaagcaaccctcccacctcagcctcctgagtagctgaaaccacaggtgtgtgccaccacacctgactaatttatttttattttctaatgaaacagaatcttgccatattgcccaggctgatcttaaactcatgggctcaagcgatcctcctgcctcagtcttccaaagtgccgggattatagatgtgagccactgcactcagcctttttttttttttttttaattgtagatagcataaaacctactgttttaaccatgcttaagtgtacaattcagtggcattaagtacattcacagtgttgtgcagccatcgccattatgctgcattattttcagaactttttcattattctaaactgaaactttgtatccattgaacactaactcccaattcccccagtccctggtaacctccattctactttctgtcactgtgagtttgactattctaagtacctaatttaagtggaatcatacagtatttgtccttttgtgtcaggcttatttcactttgcatgatgttttcaaggttcatccatgttgtaacctgtcagaatttaatttcttttcaggatgaaataatgttttattatatacagtcacaccattttgtttatccattcatctattgatgtcttctctctcttacagctcttcaaattcatcaattttaacaggaccatgagccagctctcgacaaccatgtctcgatgtgccaaagacctgtttggctttgctattatgttcttcattattttcctagcgtatgctcagttggcataccttgtctttggcactcaggtcgatgacttcagtactttccaagagtgtatgtaagtatatatgaaattaagaagaaaaatttaatcagagttgtcactgcttctcaagaataaatcttcatatgaggttgctatatgaccaccaattatttaaaaccagttattttaagtaagaattaattaccttttcccaaaacattgatctacccatgcaaagaagacaatgcatcctgaaatgctgatgcttaagatagcagcccaaagtagtaaaatacagttaacagacataggaaaccaacactgttctgaagactgagtttttctttgcaccaaatgcagatggtagcttctagaaggctgtttgcctatattcttactcctgttgaatattgttgccatatatttagaacttcaagttattttctaaggaaaaaaacaagatatttctaatattctaaggtaaactcagaccagtacaagaattttcagtttttttttccaaagatcccaaatgtgaaataaaacaacaaaaagcagccagtgtcagatttctatgccatttagaaaggagttagtttaaaaaggaatggaagtaatagggttttgtgcatagatatctcgaattaatattgctgttgataaaagtgattttgctaagacccagcactgacaacacttggccactttgatcccattttaagtacttgtcagaatattggatctttgaactcaaaccattttgggtttttggggtttttttgttttgtttttttttgttttgttttgtttttgaggcacggtcttgctctgttgcccaggctggagtgcagtggtgcaatcatagctcactgcagccttgaactcctaggctcaagcaatcctgctgcctcagcctgctgagtagctgggactacaagtgtatgccaccatgcctggccaatttttaactttttttatgagaagggatctcactgtgtagcccagggtggtattgaactccagggcctcacactgtcctctcacctcagcttccaaaagtactgggattacaggcatgagccaccacaccaggccctgttgttttttttttaaagaaatttttaactttagaccgagggtgactgttgtcaaggtttagggttaagatgttttacctagattatgtgttgaaatgttatagccaattgctttataagttattgaataataattgtattttctttttttttttttttttgagatggagtctcgttccatcgcccaagctagagtgcagcggtgtaatctcagctcactgcaacctctgcctcccgggttcaagcgattctcctgcctcagcctcccgaatagctgagattatgggcgcacgccaccaagcccagctaatttttgtatttttagtagagacggggtttcactatattggccaggctgttctcgaactcctgacctcgtgatccgcccgcctcggcctcccaaagtgctgggattacagacgtgatccaccgtgcccagcttgtgttttctttttaaccaaatggaaataacctctgtagcatgaaagcattttattattattgcagaaggctttaattgctgatacaagtagcaagactttgtaaatgggattgacaattttctgttattcggcagctacctatactgctaaaaggtccaaaaataatgaaatcatctttaagaaatgttgcatcaactagtggacattctttgtttttgtattgtggtgttttgttttatttttatagcttcactcaattccgtatcattttgggcgatatcaactttgcagagattgaggaagctaatcgagttttgggaccaatttatttcactacatttgtgttctttatgttcttcattcttttggtatgtacatttttatttatagtgaggttcaatttaaacttcgtaaatccttgtcttctcttttctctcacactttatgtcctatcaattttaaataaagacccaggaagtagaaaaaagtgtggatgttggaaaacttattttccttttattaattcacagttttgagactcatatcaaatgtcttttctgtggtctttcattgatccatgtatatgtgtctattcaatgcaaaaaaaattagatctcttccatggtctttcatttctctctctatatatgtatctattccatgcaaaaaagaaattagatcaagtacaaatttataaagatacctaaaatagtgctttgcctaaaaagtagaatatgcttacatgctttttaaactcatatgtcagcactttcgtagtcacttgctagcatgacttttctctctttcttcttttctttttaaaaaataagaacggaaaagcaagctagatctaagatgtcgagtaatagttgagtgaatcattgcatgtcaaaattaggatattctgttttaaattatttatatcccattcatctagagactgcctacagagaatattcaaataattaagtttaaaactaaatgtaacaatgaatggaaattgcattaaaattattttcaaaaataatttttttattctcttgatttggtacaaatgaacatttttaatgtttttgccctaagtcaattaagtttttttaaggtgttttgttctttttcttaacatttatatattcaattgtctactgagaaggtgttaagccagcttaatttaggcaatatttttcatctaaacactaacagtcatcttaagaacaattttcttaagaaaataacattttttccatttcagtaaattgtgtaaagatcccttgaggaaggttaagtgatcacattttcagtaattcagtgtaataactctaaagtcagtccaggtattactggttaagtatatggtatttattgattgggtattagatgtactgtattaatttcctgtttaaaaaaaattttttttccggggagacacagcctctggtgtaaaacaaaggtgtgttccctagctgtactttaacaggactgaaaaggtcaggaatatcattcaagttcatatgtatcttgctgtatgcatggtttatggctcatttttaaacttacacctcttaagcttcttcttcctatcatatattaaaacaatggagagaagaataagcctctgttactctaccattgatagtacttcggattctagagtacctgaatctctactaagaaggcaaaaaccaggaattgagagtcctgcacctgacccttcagttgatctcaggccacctagttttctccgtttatcaatctgccaaacaaggatggatagagtcgtggcaactggaaaggctcaaatgtggaattgtttgaatgtggtcctttagtaggcagccatcttaccagatctagagtattcagtcatcttaccagatcagtcaccagaacatgaaaagaagctcttagtttctatctttatactaaaattgtttttttgtacgactgcacaaaaaagaattgctctccttgcacctcccagagatataggtggatagatacatacatacgtacatacatacatacatacatacatacatacatacatagacacatacatagatagaagtctactttcaatacaaacctgtcttttaaggaaatgacaagctgagcatagggttggccacctttctgagccgattgcctggtattagtttattgcccctgtttagcaagaaggcacagtgttaagaagtggctcagctgaaccaggataaccccactcttcccccacatcaacaggaaagacatcctggtgcagatgtccatctgataattcagggaacctcgggagacaggatggagaggagggtgagctagcttcctcttcccacaccttcaagagcctttctcaagcactttctattttttgaaatctctttagaggtcccagactttgatctgtttcaattaaggtattggcaggcattagttaacagccacttggaagcaaaaatagaacattagatccctgagttggaagagagaaggtagaaggtgttacttggactgcaattatctgcacttggaattgagcatttagtcaaaaacttatatgtattctatattctattctcatttctgctacagaattgtaaacaatattcttccttaatacagaaattcatagcccactaaaataagagcgttctcatttgttcatttctcaatcatttaataagtatttactaagccactatatccatatatatatatatatcatatatactgtataatacacactgtagtgttttttgtggattgtgtactatgaggtagtatgttagatactgccagtactggggtaaggaaaacagcctgattaggcccttacgaagattcctcagacttgtggggaaaacagacattatcaaatagaaatacttgcaaaccacagttatgtgttaaaaaggaaaaacaaagtaaaaaaaaagttggtgggggggaacctgatctcctggatacagtgcttcgagaaagtttgttgttggaaatgcaaaccattactactgtggaagggaaaggtcagaaaaatgaactcaccattactgaatagtaatagtagctatcaattaggtggcacttacctgcatcaggacctgtcctgagcactttacatagattgtctcactaaccagcccaacaaatatgtaagggagatactattatttttcccattttattaatgtaaaacaattaaataattctttaaaattagacttagaaaagtggagcaacaatcttagcagtgctaggactgaaatccaagtttgcttgactccaaagtctatctctcttccagaaactttttctttactatctgcctagtaggcctgctgtattcctatttgcaacagccttttaaactctttaaaaatgtgtcctgtaaatttcatatatgattatacaaaaaaacttggaataagcatacaattctacttatctgtgttaactgttgaaatttgaagagctttttggaattctatacccttcagtagtgtatgtaaaagtttctaaatatagagaacatagataagcaaaaataatattaaataaaataatcgcaccattagtaggtaaatatactaatattttgttgtattttattcttgtatgttttcacaaagtatatcataaaatttttcctgtggcatgacttaacggagaaaataatcttcccaaaacatgtggcagcaaaactgttaatttattacatcaggctgggcacagtggctcacgcttgcaatcccagcactttgggaagccgaggcgggcagatcacttgaggccaggagttcgagaccagcctggccaacgtggtgaaacactgtctctactaaaaatacaacagttagccaggtgtagtggcacatgcctgtaatcccagctactcaggaggctgagactcaagaattgcttgaacccaggaggcagaggttgcagtaagctgaggtcgcgcccctgcactccagcctgggcaacacagtgagactctgtctcaaaaaaaaaaatttttttttaaataaataaataataaatttatgtcttcataaagcactcagattaggaaaaaaaggataaacaaaaaggcatgtgtcatttttttgattgataattccaaattatgtttcttcctttaatttttgccctcctttcatttacaaacagaatatgtttttggctatcatcaatgatacttactctgaagtgaaatctgacttggcacagcagaaagctgaaatggaactctcagatcttatcagaaaggtaggaaaaaccttaattctcagaattcttctgtttctgacataaaatgagcattgtttcacccagattttcaaatcaacattgatccattgaaattgtttgaaataaagaatacattgctatatttcaggaataatttaaatgttccctatcttggagtcttgatggatatactgctatcttgaattttaattctgggaatccttttatgccctggaattaaattctcaacaatcttttgacactttaagagctgagctgaaggttcatcaccttcattattttgacatctcctgtagctggctctcacttcaggatcctgagttgagaataaactagaagggaagattatataaagggatttccacctcttctgtctcaattaccattttaaaaaaataaaaagttttagaggaaaacacttagtagttcaccctttacccttgaccttccacggcagttttaaaataagcaaaggaaaagattcatgaattcaggccatagcctggggcctgagaacttttacttatgcaccttctcaggaagggtttcattgttaaatagaagggcaggacaggaaagttgggcctctttgttcttctcaatgtaacttctttatttggtttaaagtataaaatgtatacaacaacaaataaccacatttaaaatacacagtttgtttcccaacatcattttgctaagtcatagtggctccttaactgtaatttttttttttattagtccaagccttaggattatgttatctgtgatatatgttataatagaaaacttaagcctcttaaaacaaagtccttgggatgggacctaagattcacattatcttgattccgcataacagttgcttacattttagcaaatctccagtgtgtatgcaagcactcctcacttggcacaattctgatacacacaaactttggttaccccagttttgttatgtaacaccaccttcaacaacacagttcaaatttcagttatcatagtatattaactctgagtaacagcacaaagtacaaactccactgctagctcttcagtgtatagatcagttacctgagtaacagatgtgcaggctgagcaggctcactggtcagtcatgacactattttcagtctgttactaattggtcactgagcatctgctatccaattcacaaacaaagaaagcatgtagtgttgcttccttgtgttccagtaataagcccatgtgacattttacaaaaatggataattgaaaaagagaatgggtgcagtggctcacgcatgttgggaggccaaggcggatggatcacctgaggtcaggagttcgaaaccagcctggccaacatggtgaaaccccatctctactaaaaatacaaaattagctgagtgtggcgacagatgcctgtaatcccagctactggggaggctgaggcaggagaatcgcttgcacctaggaggcggaggttgcagtgagccgagatcgtgccattgcactccagcctgggtaacaagagcgaaactccgtctcaaaaaaaaaaaagaaaagaaaagaaaagaaaaagagaatgggctagcaaagaaatgaaaaatggtaacactggaagtgaaaatcaaaacagagtaatggatttatagaagaaatagctgagtgaagaagaaataggagtgttgacactgcgatcattcaagagatccagatatggagccagaagaacttagggcaggtctatcaacttaaatgaggaaaatagctgtgataaaacagatgaagatgtcttgaggaaatgatgcctgcaaaaaacttcacattaagggaagtcttattagagatatttcacaataatgaaagtacaaaagaaaaaatgttggggctggacatggtggcttactcctgtaatcccagcactttgagaggccaaggtgggtggatcacttgaggccaggaagtcgagacaagcctgatcaacatgatgaaaccccgtctctattaaaaatacaaaaattagccagacatgatggtgcacacctgtaattccagctactcaagtggctgaggcacgagaattgcttgaaccagggaggcggaggttgcagtaagctgagattgcaccactgcaatccagccaggtgacagggtaagactgtgtctcaaaaataaataaaagaaaaatatgttggaagctcatccacatttaagaaggaatatgacaattcactaatgcatagaaaagaagttcactccacattgtaaagtgtacagtgtaatattatacaatgaaaacaaggcaagtgctgtttaaactactctggatacattttttacaaagaaataaaacactttagtttttaatgtttctaatgttttacattttagtgtattaaatcaatattagttttcttcttttttaagctccctatacatttataactgacactaagggagtgtttaatgttttgattaaaagttgtaaagatcacagaacaattgtaattcttcccactgattattcagatcattttgcacaatttcagcttgcatggtcacttacagtgccgcactatgtgcaaagcaaggtcaggtctaaagttcgctaatgaaaaatcctcggccaggggcagtggctcacccctgtaatcctagcactttggaaggcgaggcaggcagatcgcttgagctcaggagttcaacaccagcctgggcaacatggtgagaccctgtctctacaaaaaaaaaaaaatagcaaggcgtggtgactcacacctgtagtcccagctacttgttgggggctgagttgggaaaatcacttgagctcaggaggtcgaggctgcagtgagccagaatcacgccactgcccttctgcctgggtgacagagtaagatcctgtctcaaaaaaagggaaaatcctcatctacatttcactgggttttttgtttgtttgtttgtttgtttatacacacttaaggaaattactgtctagaagatagataatataaaaaataaaaatgcaattcatgattcgggtttcttggtattcctaagaactgttgcacagtactttatgctctgaggcagacagctatagcatatatagtaatttttgtttctatcacataaacttgaatacacatatgagtaaaagacctttagttcttcatgacttactgaaagaccctgactttttccatgtaactgttccacaagtgttttatggaaaactggatacattaattcttcattcatccagcacgtacttgttgaatggccaatgtacaccaggtttgtagtagttactactgtgaatggaaagtaaaacagatgcaaaaggagaatacactaaaccaagtcttttattttttctctctctgatagggctaccataaagctttggtcaaactaaaactgaaaaaaaataccgtggatgacatttcagagagtctgcggcaaggaggaggcaagttaaactttgacgaacttcgacaagatctcaaagggtgagaatcatgcttcctgaggttctgaaaaattcctgcttctaaagataaattcctggtgataagagtatttctagcccaagggctcatacagatactttttttttttttttccagaggcaggtatctttctggaacatgttataagaggaaaacttgcccccatttggtgatttctcctttcctcctgcattttgatgtctctgtgttgagggtgaactgggtacaaggaatgatttttatctgtatcctctctctaatttcaggaagggccatactgatgcagagattgaggcaatattcacaaagtacgaccaagatggagaccaagaactgaccgaacatgaacatcagcagatgagagacgacttggagaaagagagggtgggtctggtttaggagaaccggatttgatttggtacctacaacaccacagatgtatcaaacactatagaagtagtgggttattgagtctcttgcccattccccaccacactctctctctctctcagtcggtttatgtgttagtaccctgtttattccagaaagaatatataacacaattatgtataaaaatgggtggttagcatgatataaaaacgtcaaaatgaaaagcaagcaaaacaaaagtaaaaataatggattattaatgaagcttaaaaatgcattcataaaaacacatatgcttattaagattgggctacaaattgggccctaagcttgctggtaatcagcttgaaaagagaagcctgattagctgcagagtccacaatgtccgtgagagtgaagaaaacaaaaaatgacttaccaagagatgtgaaattattctggttagttagtggctatttaaattgttaacttttttttcttttttttttttttttgagatggagtcttgctctgcctcccaggctggagtgcagtggcacaatcgcgactcactgcaacctccacctcccgggttcaagcgattctcttgcctcagcctcccaagtagctaggactacaggcacatgccatcatgcccggctaatttttgtatttgtagtagatatggggtttcaccatgttggtctcaaactcctgactgcaagcaatctgcccaccttggcctcccaaagtggtgggattacaggcagtagccaccgtgcctttcctaaattattaacatttataataaaattaacagccgccttccatttgaatactttttacaaaatagttaaaaataaacataagtgggcttttatagtcagaaaaaaaaattcaaagctttaccattaactttcaaaaataaatggttagacagcaacaacaaaaatctgtggtaactgaggtacagagaacacagatgaatgttattacaaaagccactttcctatgagaagtctaggacagtggtttctaaatgccactccacagacagtgctagtaggtgacagacttctccagtcacagtgaaatttaagcataaagaaaatgaggaaaatttttacaaggctctatttagacaaagttcttattctgacattacatctttcctactttggagctgttgaatgtattatcttttatgaaaagaaggcgatccaggttgagcatccctaacccaaatatgtgagtctgaaatgctccaaaacctaaaacttcttgagcacaaacatgatagtcaaaggtcatgcttaaaggaaatgctgtcattggagcagtttggattttgggttttcagattagggatgctgaaccagtaagtataatgcaaacattccaaaatatttttgaaaatcccaaatccaaaacacttctgatcccaagtatttcaaataagggatactcaacctgtaatatatttcttcatttctttatttattttattattattttaagatggctcatggcccactgcagcctcaaactcctaggctcaagtgatcttccgacctcaacctcccaggtagctcaggtagctgggactgcaggcatgcatcaccatgcctggctaattttttaaaaaattttttgtggaggcagagtctcaccttgctgcccaggccagtctcaaactcctggcttcaagcagtactcctgcctcagcctcccaaagtattaggattacaggtgtgaccactatgcctggcccatatttcttcatttagttttttctttgcctgctgtgtttttaatgttctttcttgttcaaacaaaaagttggctattccttgctgttagttaaatttgccaatctatgaaactgaaaaatgcaggagtcccagcctggtgttaaatacaaagaaatcccaggtaaatggcatgcacccagttcctgcttgcccaagtccttggtgaggcttctgtggggtctcagtgttctgctcctcactcagtgaccccttgttcttcaggaggacctggatttggatcacagttctttaccacgtcccatgagcagccgaagtttccctcgaagcctggatgactctgaggaggatgacgatgaagatagcggacatagctccagaaggaggggaagcatttctagtggcgtttcttacgaagagtttcaagtgtaagtataaaggaattggcagaatttgcgttgacaagagtccacatgagaccaggcagttccctcatctctctgaattcactcctttccattactaatcatccagcttttaaaaataacttatactggccagacgcagtggctcatgcctgtaatcccaccactttgggaggccaaagcaggcaggtcatgaggtcagaagttcgagacgagcctggccaacatagtgaaaccccatctctattaaaaatacaaaaaattagctgggcatggtggtgggcacctgtaatcctagctacttgggaggctgaggcaagagaattgcttgaacccgggaggcggaggttacagagagccgagatggctccactgcacaccagcctgggcgacagtgcaagactctgtctcaaaaaaaaaaaaacttgtcaattggtgttttgtttcttacataatatgtttactataaaaattagcaaataagagcaaaagaaaacattaacatttcacatatttctaccaatgaaaaatgtttattaatatatcagtgtttgtgtctctatttgcatgtgtttatcaatgtttctatatatttttatggcctaacatatggttcgtcctgaagaatgttccttgtgcatttgagaagaatgaatattctgctgttcaagtgttctgtagatgtttgttaggtctagtttgtttacagttttattcaggtctcccatttcctggttgatcttagatgtgcctagatgtggtattcacgtttgaaagtggggtattaaagtctccaagtattattagttggagttcatcccttcaattctgtaaggttttgctttgtgtattttggaactctgttgttgggtgcatacatatttataactagtatattttcctaatatattgaccctattttctctctcaacttaatgaggctaaagaaaaaaaagaattgaccctgttttcattacaagatgttatccactttatctctagtaaaattctttgttttaagtattttttgtttgatattactgtaaccactccagctttcttttggttgctgtttgcatgataaatctttttccatccttttactttaaacttatttatatctttcagtctgaagtatgtctctcctgtagacagcatataattggatcttatctttttatccagtttgacaatttctgtttttgattagattgcttaatccattcatttaatgttatcattgatgtagttgatttctgtctgctattttattttttgttttctagcttacttttttttgttcctctttcactgctttcttgtacattaagtgaatattttcaagtataacatttaaatttttttaatgatttttcattttttttagtcaggagttgctctaagacttagtttatacaattaagttatgaaaaattacttcagatatatattaactgaatccagtgagatatagaaatcatttctatttagcttttttcctcttccctctttttgtgctatatattcatctatctatatgtatatatagtcatctacatatgttgcaaatcacattgttagaacaatgttacatttttataacacactgtgtaatatatagtatataattttatatctcttaatgaagctgagagaagaggaagtatatatttataaatgtgtatattaacctacttttttaccatttctaattctcttcttttgctcctctggattcaagttatcatctgtcgtcattctctttctccgatacagctttgctactgcctacctcctattattgtcaaatatattacatttctattatagaccttcagatccaattatgtacatatttttacacaactgctttttaaatcagttaaggaacaaaaggagaaatgtacatatatactatattttatacctacacagttatctttaccagtgttctttgccttttcatgtggattctgattactatctggagtcacttgctttcagcataaagaatttcctttagtattttttgtaaagcaggtttgctagcaatgaattctttcattttttgtttatctgagaatgtttttctttctccttcatttcctctggcttgtattgtttctgatgagaagacaggtgctaattttactgtggtccccttgtacatgatgactcaattttctctcaccactttcaagatttttttgcttttgtctttcattatttttactgtgatatgtctgggtataaatctctgagttcatcctacttagaaagtgttttttctgcttctttcactttctcttctcctttgggacccgcattatgcatatgcttaggggtatcacatatttctcttaggctctgttcgtcgtcattttttttccctctctgttcctcagagtgcatagtctgtattgatgtatcttcaagttcactgacttgttcttctgtcagcttgcttaaatctctgttgagctcctctagttatttatttatttatttatttatttatttatatatatatatatagagagagagagagagagagagaaagagagagagagagagacagggagacagggtctcactccatcacccaggctggagtacagtggtgtaatcatggctctctacagcctgaacacctgggctcaaatgatcctcctgcctcaacctcccaagtagctaggactatgggcacatgctgccatgcctggctaatttttaaaaaaaaatttgtagagatggcatcttgttatgttgcccaggttggtctcaaactcccggcctcaagtgatccttccgcctcggcctcccaaagtgctggggtcacaggtatgagccaccgcacttagcctgaattttttatttattatacttttcaactccagaatttctatttggttctttttagcaatctctgtctctttattctgtatttgatgatatcctgtatttgatgagacaatgtcatcataacttccttttttttttaagagatagggtctctctctgtcacccaggctagagtgcagtggcatgatcctagctcactgcagcctcgaactcctgaactcaagcaatcctcccacctcagcctcctaagtacctgacactacaggcatgagccactgtacccagctaatttttattttttgtagagatggggtctaagttgcccaggctggtctcaaactcctgggctcaagtgatcctccctgctcaggctcccaaagtgctgggattacaggcatgaaccactggacccagcctcctttatttctttaaccatggtggggttttttattatttgtttgtttgttttaacctgtttgaatatatttataataggtaccttcaggtctttgtctgctaagtctgacatctgggccctctcaaagacagtttcagttgtctttttttttttcttcttgtgtatgggaacattttcctgtttttttgttttgttttttgttgttttgttttgttgttgttgttgttgttaaagattggacatgttagataatatattgtaggaactctggctagtgattccctttcctccccaggacttgtttttatttctctttgcttgtttactttttcatacagtctgtttccccacagtgtctgcctctgactttattccttagagggcgcagctgtggccatgtacgtagtcactctgggaagacagtggttttagcagcgtgctcattaactttctctgacctctttgttatacctcctgcctctgtggatattagacccagttattacatttcattgtttactgattggtctattgttttccagaatgccttgggatgtaatttgctccacagtctgatccacttaaattcaggcctctttgcagggctagttttagaggccagtctttttttttttttttttttttttttgagacagagtctcactctgttgcccaggccggaatgtagtggtgcagtctcagctcactgcagcctcaatctctcaggctcaagcaatcttcccacctcagcttctcaagtagctaggactacaggtgcacgccaccatgcctggttaatttttgcattttttatagagatggggttttaccatgttgccccggctggtctcaaactcctgagttcaagcaatccacccacctcagcctcacaaaaggccgggattacagatatgcaccaccacgcctggcccctgaggccagtctttaactgtcttcttagctgtctctttccctggttctctctggtgaactagctggtaatttgtttatctcataaggctaccagattccttgtaaatgcttatccccacaatctccattgttttcaagagcatcgttagtctttaatttcctcacgcttcattccaaataaagtccattcacttgagaagagttctatattcctatgacctgtgtctccccatgagcaaaactgctactgctttacagagccagggacagtggcccacctctctgtggcatcctgctttatgaacaagtcactgggctcagatggcagtctctgattttctcaccttgcttcttctggcatggaaactccaccctacaagtgggaactgagtggaagaagagagccccattccccttagccactcttaacaggattagaacctctgcaacatgcatttaagaatgggaacaggctgggcacagtggctcacgcctgtaatcctagcactttgggaggtcaaggcaggaggattgcttgagccaggagttcaggaccagcctgtgcaacatggtgagaccctcatctctacaagaaatagaaaaattaactggtgggttgtgtatacctgtaatcccagctactcgggagcctgaagtgggaggattgcttgaacctggaggcagaggttgcagtgagtcaagattacaccattgcacgccagcctgggcaacagagtgagactctgtctcaaaaaaaaaaaaaaaaaaagagtaggaacattgaggctgggcatggtggctcatgcctgtaatcctagcactatgggaggccaaggcaggagtatcacttgacgctaggagttcaagaccaacctgggtaacatagcgagactttgtctctattaaaaaaaaaaaaaaaaaaggtgtaaaaaacttttgtaacaagagtgggaaagccgggcacagtggctcacacctgtaatcccagcactttggaaggccaaggcaggcaggcggatcacctgaggtcaggagtttgagaccagcctggccaacgtggtgaaaccccatctctactaaaaaatagaaaaattatctgggcatggtggtgcacacctgtagtcccagctactcgggaggctgaggcaggagaatcacttgaacctacgaggcagaagttgcagtaagccaagatcacgccactgcactccagcctgggcgacagagcaagactctgtctcaaaaaaaaaaaaagagtggaaatgttaggatgagaaatgctggcagcctgcccctccctgggagatactgtagccctagactggaagttgggggaggagggagccctgtgctcttagctgcacccatgtgaagttgtgcttctatcacatgagctggggacaggagagaaggctcagattatggcttcagtgccacagaatctcttcatactaaaatttagtagattttcttgaataaatgctttttcatttgctgtacacccttaaaagtttctagaaatttttaatatttgagttttaaaaaataattttcaacagttacagttatttcactaaagagagagtctacagaaccctcttgccaccattgcagaggttgtctttggcttacgagtttttaaagtatttgtatacattttttaagttcaaaataatagaattgtaagtgaacatgctgttttcatactgtttttcaagctttatttaatatattgtaaatctaattctattttattaaatagtctgccacagtataatgtctgatgtctccttagaattttattgtatggatgaacaatgattatttaatttcctaccaattgttgggtgttttttgtttgtttgtttgtttttgagactgggtctcactctgtcacccaggctggagtgcaggagtgcggtggaatgatcacggctcactgcagcctcaacatcccaaggctcaggtgatccttccacctcagcctcgcaagtagctgggagtacaggcacatgccaccatgcccacctattttttagagatgaagttttgccatcctgcccaggctggctcgaactcctggcctcaagcgatctgcacacttccgcctcccaaaatgccaggattacaggcgtgagccatcatgccctacccccccatcaattgtttgatgtagccatttttcaatgatccgcgattaagaagcagcactcttttatagccaaaaattacacatatataaaattttcctttagaaaatgttctaaaaatggaatgtctaactaaagggttaggcatacattcttaagacttctgatacgcgctgacttgcaggaaagttgtttcagttaacactcctaccagcggcatccgagagttaatctgtaaagcttgagacaacttagaaagtgtttcaaatgattgtgttgcttaagaaaaaaatcttagcacttccttttgaaaagccagtggggctgaaaagacaatgacaagcactttgtccctctgtactgtgttttccttgcagcctggtgagacgagtggaccggatggagcattccatcggcagcatagtgtccaagattgacgccgtgatcgtgaagctagagattatggagcgagccaaactgaagaggagggaggtgctgggaaggctgttggatggggtggccgaggtcagtagtcatgagctgaaaacaccgctgctgagcatggtgttattaatgaaaatatatgttgctgacagttgtatttgaagtattgaagaagagtaaaaaaaatttacgtttatagaaattcacaatgatgtttccatttactctcattttcagatttttttctctgaaacagaaacactctttctataaaatctcttgctataaaacatcaatgtagtcatattgtctaacccttaggctgagatgtttatctttctccataactacagataaaattataatctggaggtgttactttcttaatactccatatgctaatggtcctgccttcactgcagggtagaattaagtgaaaaattactccagcaactctgagatttgctattatatgctgtaaatctccagccttaccaaactacagattatttggtccctggacttcctaaggcatttccttctactgcccccaacaccagtttctttttccctttttaggatgaaaggctgggtcgtgacagtgaaatccatagggaacagatggaacggctagtacgtgaagagttggaacgctgggaatccgatgatgcagcttcccagatcagtcatggtttaggcacgccagtgggactaaatggtcaacctcgccccagaagctcccgcccatcttcctcccaatctacagaaggcatggaaggtgcaggtggaaatgggagttctaatgtccacgtatgatatgtgtgtttcagtatgtgtgtttctaataagtgaggaagtggctgtcctgaattgctgtaacaagcacactatttatatgccctgaccaccataggatgctagtctttgtgaccgattgctaatcttctgcactttaatttattttatataaactttacccatggttcaaagatttttttttctttttctcatataagaaatctaggtgtaaatattgagtacagaaaaaaaatcttcatgatgtgtattgagcggtacgcccagttgccaccatgactgagtcttctcagttgacaatgaagtagccttttaaagctagaaaactgtcaaagggcttctgagtttcatttccagtcacaaaaatcagtattgttatttttttccaagagtgtgaaggaaaatggggcattcctttccactctggcatagttcatgagcttaatacatagctttcttttaagaaaggagccttttttttcaactagcttcctggggtaaacttttctaaaagataaaatggaaaggaactccaaactatgatagaatctgtgtgaatggttaagatgaatgttaaatactatgcttttttgtaagttgatcgtatctgatgtctgtgggactaactgtatcacttaatttttaccttattttggctctaatttgaataagctgagtaaaaccaccaaagatcagttataggataaaatggcatctctaaccataacacaggagaattggaaggagccctaagttgtcactcagtttaatttcttttaatggttagtttagcctaaagatttatctgcatattctttttcccatgtggctctactcatttgcaactgaatttaatgttataactcatctagtgagaccaacttactaaatttttagtatgcactgaaagtttttatccaacaattatgttcattttaagcaaaattttaagaaagttttgaaattcataaagcatttggttttaaactattttaagaatatagtactcggtcaggtatgacggctcacgcctgtaatcccagcactttgggaggccgaaacaggcgaatcacttgagcccaggagttcaagaccaacatgggcaatgtggcgaaactccatctctacaaaaaatgcaaaaataaaaaatatagtactcaagtattcttgatcctgtgtttcaaaactagaatttgtaatgcaaatggagctcagtctaataaaaaagaggttttggtattaaaagttcatacattagacagtatcagccaaaatttgagttagcaacactgttttctttacgagagggtctcacccaaatttatggggagaaatctatttctcaaaaaaaaaaatcttcttttacagaaatgttgagtaaggtgacattttgagcgctaataagcaaaagagcatgcagtgctgttgaataaccctcacttggagaaccaagagaatcctgtcgtttaatgctatattttaatttcacaagttgttcatttaactggtagaatgtcagtccaatctccaatgagaacatgagcaaatagacctttccaggttgaaagtgaaacatactgggtttctgtaagtttttcctcatggcttcatctctatctttactttctcttgaatatgctacacaaagttctttattactacatactaaagtttgcattccagggatattgactgtacatatttatgtatatgtaccatgttgttacatgtaaacaaacttcaatttgaagtgcagctattatgtggtatccatgtgtatcgaccatgtgccatatatcaattatggtcactagaaagtctctttatgatactttttattgtactgtttttcatttcacttgcaaaattttgcagaattcctcctttctacccataaattacatatatttttcttctttagtcatggagaactccccccctcatctcttccctattatctttccctgtgtactggtattattaaaaagacattacatacgcaagtctttctcgacaatcaagaatgttattaatgtgtaatactgagcactttacttcttaataaaaacttgatatagtagcagatgtgagagttgtctgttttctaagtagtcacaggtaatgtgccttttatcatgagactttgactttgaaaaaggcaccttctctatgtccgaaaacattaattggtacatttctctgtttattacacgagctacacaattcaggtacccagttagcctttaagcacagggctgtcatttatggcatttttgtttttattttcctgaaacgaagattccagggcaggtggtttatttgagaggtgtaggcaatagggatagtggagtgggaaggacggggagaagagagggtgccagtaaagggcgtgtcgtctagctgcataacagcataggctgccaaagcctaattcctgtggtaaaatgctgagaaacagtttaggacaaatgagaacaaacaattcagacttatcccagctgaagggccaggactttggttgaaagaccactctgggagaatgatagcaattccctagcacgtccagtagacaaagcagcctttgctggcttctgagcaagcctgtaggcaaagaaatgcagacactggtagatgaaaaccagcaggcatacactgaagtgccacatggtcaaggtgcccacgttatacactatgtatgatcacgcattgttcaatcctaagggattccatccccttagaatactacaaatggggctccatggagttgtgccacatggtgactctctatgcagaccacccataaaacagataagtttaaaagcataaagaaacaagcactaggctaagactctggtccccactctatacttcctagtcatgtgattatgccaagacaactggtccagtttctctgaagactcttatttcttcatttgtcaaatgggaaaatcaatacttgtctccctcataggattttgcttgtgcagtaagaatatatatgtatgaaagcactttaaagctgaaatttccattacaaatggaaggcggtactacagtacctagcccagtgacttgctcagcaagttacaatctgttgaatcagcaaaaaggaaaggaattcttgacaactgcaaatttgaaaggtaaataaaggagaatgatgttgccaaatgataactcaatacttacttaaaagtcttctgtgtttgtatttcaaaattgggctattatttgtacagttttgtgtacggctttttcacttcatactgtatcataaacattccatgaaaccctgatttctattaataactacagagtgaatcaatataaattaatattatttatgaaggccggacacagtggttcacatctgtaatcccagacctttgggagactgaggcaggaaaactgcttgaggccaagagttcaagaccagcctgggcaacatagcgagaccctgtctctataaaaataatctgggcatagtggtacatgccggcattcccagctatgcagctgaagcagaaggattgctggagcccaggaatttaaggttacagtgagctatgatcacactaccactgcatttcagcctgaactgagtgacaccctgtcactaaaattaaaaaaatatatataatatatgaatatgtgatacatgtcaattaattcataagttgttatacatttttaattcatatgaattacccaaaatacatctgccctgttgttggacatttagattgttcccgttttttattattacctctaatgccatgactaacatatgtcgacataaattttttcacatatctggttatttcttcatggaattctgtatggagaaatatctggaaatgtaataattaggttaatctatatgaacacatggttttgacacatattaccaatttttcagaacatttataccaagtcatattataaccaaatttatgagtacccatttgtccacctgcaaacacagagaacttttttgtaaaaagtgtttatttttatttaaatttaaacagaagaaaattatgcacaaaaatgaagaaattgctgaatctcagatactgc

SEQ ID NO: 16240 - DNA, 151088 bp, Human
  misc_feature (1)...(151088): n = A,T,C or G
ggccactgcctcccaaagtgctgggattacaggcgtgagccaccacactggccaaaacttgttcttaagattgtattctgggaccttgattccaatcagagaaaagtgattgtatttttttatttttattttttttagataaagtttcgctcttgttgcccaggctggagtgcagtggtgccctctttggtcactgtaacctccgcctcctgggttcaagcgattctcctgcctcagcatcctgcgtagctgagatcacagatgcccaccaccacgcccagctaattttttcgtatttttagtagcgatggggtttcaccatgttggccacgctggtcttgaactcctgacctcaggtgatccatccgcctcggcctcccagagtgctgggattacaggtgtgagccaccgcgccaggccaagtgtttgtatttctattaaagaaagaatataacgggacaccattgacgacctgctccattgcaggcctccttgctgttcctcagactcccccctcagagcctttgccctcgctgtgccctccacctggagcgtttctccccaggatcctcatgcccatgctcatttgggtccctgccccatgtcaccctctccaggagcttcccctcacagcagccctggcctgtaccacagccgggtacaggtatttttttgtttcaactggttttttagttccagtttcctttaggttactttatttatttatttatttatttattttttgagacggagtctcgctctgtcgcccaggctggagtgcatgatctcggctgactgcaacctccacctcccggattcaagcaattctcctgtatcagcctcccgagtagctgggattacaggcgcccaccaccacacccggctaatttttatatttttggtagagacggggtttcaccatgttggctaggctaggttaatttttaaagggttttgcaatggtcccttgatctactttttaccttagatgggaaataaaactgatttcctacattggcagaatacaatgatcatttttgcctggactatctaggaggttaatttcagttggactactgaaaactgctggttcaatcattctccacgtttatctaagtctttacctttatctggacagttctaggacattgaggggaattttggtgtttcttcccctattatttcctgaagtcatttcactttaaaaaacaatagattcactgctcaaaaaaaaaaaaaaaagttacctactttctacttgcttccagtttaactgcaacacattttaaaaagagtctactgtgctggctgggtaagttaaattaaaacttctaaagggtccaaggtctaaagttcgcacattgttttgaggtcggctctgtctctaccgagggagatcccattatccgtagttctaccagtcccaatcccatatatttcctttagaatctcatgaatgaggaaaaagaagttcaagtgagggaacataggttcaaatgaaggtcagatacctaaaagagttttctggtgactgtgcgcggctggggtggaaaaagtggggaaaaggtacccagatgtgggtggccccggagggttgctccactccagccccggcagggcaggacagcgcggcctgcctggtagatgccccgagccactggagcgcctactgtgtggcgggcgggggacggcaggaaaacggcaggatgctgtgtcccctgaatctggcagggttctaggtgctttacacgtagcaagacacattctccgccccaaggcactcgcagtcagtccattttctgggttgcatcaggtgggggcaaactaggtccccgcagaagtgaagatgctgaaggaatacagtaggagaagaaatgcttctctcctgtcctccacaccaggcaggccccagaggctgagaccgacacgccctccccgaagggcagacccgccttgaggaaggcggatccgggtagggaccgccgcctggccctcacccgacccccgagaaagcaacccagcgcgccgcccgctcctcacgtgtccctcccggccccggggccacctcacgttctgcttccgtctgacccctccgacttccggtaaagagtccctatccgcacctccgctcccacccggcgcctcggcgcgcccgccctccgatgcgctcagcggccgcagctcctcggagtcccgcggtggccaccgagtctcgccgttcgccgcagccaggtggcccgggtggcgctcgctccagcggccggcgcggcggagcgggcggggcggcggtggcgcggccccgggaccgtatccctccgccgcccttcctccgcccggccccggcccccctccctcccggcagagctcgcctccctccgcctcagactgttttggtagcaacggcaacggcggcggcgcgtttcggcccggctcccggcggctccttggtctcggcgggcctccccgccccttcgtcgtcctccttctccccctcgccagcccgggcgcccctccggccgcgccaacccgcgcctccccgctcggcgcccgcgcgtccccgccgcgttccggcgtctccttggcgcgcccggctcccggctgtccccgcccggcgtgcgagccggtgtatgggcccctcaccatgtcgctgaagccccagcagcagcagcagcagcagcagcagcagcagcagcagcaacagcagcagcagcagcagcagcagccgccgcccgcggctgccaatgtccgcaagcccggcggcagcggccttctagcgtcgcccgccgccgcgccttcgccgtcctcgtcctcggtctcctcgtcctcggccacggctccctcctcggtggtcgcggcgacctccggcggcgggaggcccggcctgggcaggtgggtgtcggcaccccagccccctccgctccgggcccggcgtcccctcccccgcggcccgcgccgccgtccccgccccgtgacccgccgggctacccggggtgggctgggggccggcagcgcgggggagactcgctcgggcctgagccccgaggctcggccggtgggcgcagccggggtcctctgggattgtcaggcctgtccagcctcccgcagcatccccgccccctcccccggcggtcaagatggagggagcgggcggcctcccctccccacgcgtgttgggaggggttctcgggtagcggcgatggtcagccccggctcccccttccgcacgatcctccgcccgcagcgtggggatgctcgggcagctcctccactcccggtttaggtgtgaacgttggaggggtctggaggctgtggtggcgttttccggaacatgtccccctccatgggggacatctctggaggggagaagttagggccgcgtcccccgtgccggttaaaggggtaggcaccgggctcctccggaatcatcagggtctgtcggggctctctccccgccccctccgagtcctgggaaagatcggaggacggggtggagacaagtgggccttggcccccgcacccctctgcgttcgtgtccgaggcggcggcgggggctcccgaactcccctgaaatcgtggggctccatgtggcctccggcagcgttccaccctcccccacctggggaagggaaggggtggggagtgcccggccccgtcccggccttcctccttcccccgccagacctctccggcgcgcgggtggtggccgatccgcattgctgttcgaggccgcagtggagaaggcgcctgtggaacatcggtgggtgagggctggacccaggctggaccctggagatccggggtggcggtgctggtggcagggggcgggcaccctgcgcacttatcccaacccccgccccaatttcggaaatgctaggagagagagattgcagcaggggacgtggtcgggttcctgaaggcagaaaggcgggtgtttactagcgtctttttccctcctaagccggggttgtagtaggggctgggggctcagtgttgtcccggctaactgggtttgactcgagggtgtgtttgtgcaggagggcctgttgggggtggcgggcggttgtcagttcgtatttcacgaactaagaaaatgcttagtgttcaaagggagaaggaaacgtcaatagactccattccattgtggccggtgtccttaacttcgggagtgccgccagagcttaccaagggcacgcaagtccatttcccttgtgcctcaagtccatccgtgttgtaggcactactgtgccttctttaggcctaggccgccggcttgacggcgggtgaccggcgtcctccttaaataggcatcttgggctttggaaggtggaataagaggatttttcattcacccgagttttctttttgaaaacacattttcagcaacccatttccaaagaatttttatttacagcagaaattccccatcaagaggaatcagctggtttttaaggaattctgctgccttcaaagggggcggaaacagtcggttatttgactttacacgccccgcccccccttccccttctctgagtctgaagcatcccaaacactacttagccaaactagttcagatgaagtgatcgtttccccaagtagggtaacttcagtttccctttttcgttggcatctagcgaaaaatgaaaaaatttaaaatacaacttttatagaaaaggatgtattctgtttttactttcttaggtattaggaagagatttggcagataattcaacatgttcaaatatataaacattaaaactaaggttattaagttgcattgactactaggcttaaaaattagattataagagaatttgctcctgagtagtttgagtgatcaaagatatttggaatgttttagtaccacaaggtcttttttctgttccttgaggctttacaacaatttaaggttaatttagatttttccttgctttaagttcttttacttgagacctaaatggcagcccttattctttctgatgaataggtgaaattttgtttactgtgttggatttgtgtaatgtgaagttttattcttgaacagatcgttaatgtacttgtagaattactttgaatttgaatcactttcctgcattccttgtaaataagtttcagcttctagaatctcctcacttaggtttgtgcgtatcaacagtgaaaataagtctctgagagcaagggtgaaaaaaaatgcagcattcggtttgacaagtttcgagatagcaaaatatgcttgaaagtctggaaattcacatctgctttaagaaacatttcataatttgactttgtgtgtgtgtgtgtgtgaatagtttttcatgactttcagaagtgatttattttgttctttgttatatatatttttgaaggtggctgttttaggaaagataatgtaatcacaatattagaacataattttactgtaatctaattttgtgtgtgtgtgtgtgtgtgtgtgtgtgtgtgtgtgtgttttggatggaatctcactctgtcgcccaggctggagtgcagtggcctgatctcagcttactgcagtctctgtctcctgggttcatttaagtgattctccagcctcagcctccccagtagctgggattacaggttcgtgctaccacacctggctaatttttttgtatttttagtgaggacgggattttgccatgttggccaggctggtctcgaactcctgacctcaagtgatccgcctgccttggcctcccaaagtgctgggattacaggcgtgagctactgcccctggccaatttttgtatttttagtagagatggggtttcaccatgttggccaggctggtctcgaactcctcctgacctcaagtgattcgccagcctcggcctcccaaagtgccaggattacaggcaggaatgagccactgcccccaaccatcagtctaattcttatttttgctttttaccttttcatttttatgtagtagaggtgattgtgtatgttattttgtagttagcttttttcccctgaacgttgtattgtaaatgtaaatttttttttttttttttgagacagagtctcggtgtttgcccagtctgaagtgcagtggtacgatctcagctcactgcagcctctgactcctgggttcaagcgattctcccacctcagcctcttgagtagctggggctacaggaatgttccaccacgcttggctaatttttgtatttttggtagagacaaggtttcaccatgttggccagtttggtctcgtactaccgacctcaggtgatgcgcccgcctcggcctcccaaagtgctgggattgcaggcgtgagccactgcgcccggctgtaaggtttttacttaaccattctattgttgggaattgggtttccacttttttgttatagatagtggtgcagtgaacatttttaaatagctttttgcttcagtgtaattatttccttagagaaagttaccaagagtggttttactagttcagagggcttcaggatttttatggctcttgctagcggtgctctattattctttagaagacttgtattacttccagtgtcaagaaggttgctcttccatggaatggtttctttgtagtttgtcaaatattgtggggaatttttaaaggaaaaattgcatttttactgtcaagtgcatatattattaagtgcttttgttagttactggattattgatatttgagtttaatttggttcctctgaggatttaataaggtaatatatgtgaagatgttttgaaacctgtaaccattattattaatgagggtacttggtttatctgtcgtgctgatagtactgagtaaagtgcaggaatgaaattcctgaggaactgttctaaagctttgttgttgttgttaacctttctttttcatctgaaagtgttttttattagctgctagcctatgaccaagttatttttggtaacttttttgtaatttcatggcactattgggaattttcgctggttgactcttcttcttctacattcccttccccattaaaaataaaaatatggatttacaattgttactctattcctaaacctaaataatatgacattagaattgcttgggatacaggattcagtctgaataaaatatttttcttttagtgattttcagcttagtatttttactgcttctttctcttgaggcattgcaacttaaaaattgtgctgtttagccaggcgcctgtaatcccagctacttgggaggctgaggcaggagcatcacttgagcccaggaggcggaggttgcagtcagctgagattgtgccactgcactccagcctgggagacagagtgagactctatctcaaaaaaaaaaaaaatgtgctgtgatttaatgtagttgttcatcatgcttccatttaaatttcagtgagactgttcatcttttgcagttaaatatcttgtagaagggcctaaaatatctacgttgaatacagctttattgaagcatctatgtacatggggtttttgggatgaatcagtgaataaagcaaacatattgtccttttggagtttacattctaatgtgactaggcagacaatgagacattaaattaccagcctatgtataatagtgtataagagctatggaattagaagaaagcagattaaaggtatagggagtgtggggaggggaatgagttacaattttaaatggattgggggaacttaattgaggagctaacatttgagcaaagatttgaaggttgggtatttagccgtttgctttttatctaggttaattagtcatgtggcttcattagtaatttataaggtttaaatggcatcatcctttgttattcttttatgtgcacattgatactaaccatctctgaagttagaccaaaaaagttaattgacattgagggtcattagaggtaaattgtagatggctattactaaccaaagagacatgttttgtttttcttttgggcttacgtattttacctaattagtttagtttttgtttcaagtatgtggagaaaataaactttttaagtttgggccaaaacttgctttggttttctttttctttttctttttttttttttaagagaaaaatgtaagcctgtagttgcttaaagattccacattctgaaacagtgaaaacatgggatcagtcatggtgttcctttttttggttaaatgtaaacttgtattttcagtgttactctaattagcaatggtttatacttctacataagggatgttaactcatattgtagctatttaatagccatatattttgacttaaaggaggatctcaaggccaggcgcggtggctcatacctgtaatcccagcactttaggaggctgaggcgggtggatcacctggggtcaggagtttgagactagtctggccaacatggtgaaacccccatctctactaaaaatacaaaaattagccgggcatggtggtgggcgcctgtaatcccagcttcttgggaggctgagggaagagaattgcttgatcccggaggttgcaatgagtgcggaggttgcagtgagctgagatcatgccattacactccagcctgggcaacagagcgagactctgtctcaaaacaaacaaacaaacaaaaaaaggaggatctcatttttttgtcctaaatagctacagccgtgttagaactgtcaccttagcaaagtattgtttttttactttgaaacgaattttaaggttttagaagattgttctctagaattacaattttctgttttgactagtgatagtattttgatgttgtgtaaatagttgagcatgaacaaaaccctatttttttttttagctatttcaagtgattgtgacaacttcaacggagatgtaaacagtttattaacagtcacacctattatcttttttttttttttttttttttgagacggagtcttgctctgtcgcccaggctggagtgcagtggcacgatctctgcttactgcaacctttgcctcccgggttcaagtgattctcctgcctcagcctcctgagtagctgggtctacatgcgcacaccaccacgcctggctaatttttgtatttttagtagagacagggtttcaccatgttggctagaatggtctcaaactcctgacctcaggtgatccacctgcctcagcctcccaaagttctgggattacaggcatgagccaccgtgcttggccgctgccgtatctttttaaatgaaagtacttgtgttttttttgtttttttccaaaggatatctgggtcatctatgatgttactgttaccatctaagggtttttttgtttgtttttgagacagagtctctgtcgcccaggctggagtgcagtggcgtgatcttggctcactgcaacctccgcctcccaggttcaagcaattctcctgccttagccctcccgaatagctgggattacaggcacccgccaccatgcctggctaagttttgcatttttagtagatatggagtttcaccatgttggccaggctgctcttgaactcctgacctcaggtgattcgcttgcctcggcctcccaaagtgctgggattacaggcgtgagccacccccgcccagcctcatgagctaaggtgttttttttttttttgagacagttttgctctttcccaggctggagtgcagtggtgcaatctcagctcactgcaacctctgtttcccgggttcaagcgattctcctgcctcagccttctgagtagctgagattacaggtgcctgctaccccactcagctaatttttgtatttttagcagagacagggtttcaccatgttggttaggctcatctcgaactcctgaccttaagcgatccacctgccttggcctcccaaagtgctgggattataggcatgagccaccgtgcgcagcctaccctgtctcttaaaaaacagtaacaacaacaacaacaacaaaaaatcctaaatcttaaaaatggaaggcaaaaactctaagctttgagagattaggggacttgcccaaagcaatatttgtaggattttattacacctctccctttatttatttttttagagtcaaggtctccctctgtcacccaggctggagtgcagcctcaatctatggggccaagcatttctcctgtcttagcctcctgagtagctggaactacaggtgtacaccagctggctaacatttaaattttttgtagagacagggtcctgccatgttgcccagattggtctcaaactcctgggctcaagtgatcctcctgcctcagcttcccaaagtgctgagattacaggtgtgagccactgcaccgagccccctccctttatttttatttttaaattttaagttctggggcccctcccttgaaataaatagaaacgtaatatatacacaagatcatgctgtgtattttaaggcaatggtcctcaacctttttaacactagggaccggttttgtggaagatggtttttccataggggcaggggatgattttgagatgaaactgttccaccggccgggcacggtggctcacgcctgtaatcccagcactttgggaggccgaggcgggcagatcacgaggtcaggagatcgagaccatcctggctaacatggtgaaaccccccctctactaaaaatacaaaaaaattagctgggcgcggtggagggcgcctgtagtcacagctactccggaggccgaggcaagagaatggcatgaaacccgggaggcagagcttgcagtgagctgagatagcaccactgtacttcagcctgggggacaaagtgagactccgtctaaaaaaaaaaaaattgttccacctcagatcattatgcatttgttagattctcataaagagcatacaacctacatctcttgctatatgcagttcccagtagggtttgtgcttctataagaacctaatgctgcacctgatctaacaggtggggctcaggtgctaatgctcacacagctcctgttgtgcagtctggttcctaacaggcctgtttttttttttttaattagatggagtctcgctctgtcaccaggctggagtgcagtggcacgatctcagctcactgcaacctctgcctcccgggttcaagcgattctcctgccttagcctcccatgtagttggtactacaggcgcacactgtgatgcccagctaatttttgtatttttagtagagacggggtttcaccatgttggccaggatggtgtcgatctcctgaccttgtgatccgcccaacagcctcccaaagtgctggaattacaggcgtgagctgctgcgtccggccccctaacaggcttgttttatggaatacagtcacggacagtacttgcccttcaggatatctttttgtaaccttgattttggcttgctaaaataggaggtctattttcttttctttgtttttaatgtatgtggttctgtacttacgtggtgtgaaatctacataaatgttaaatccttggttatttatttattttgagacagagtctcactctgtcacccagtctggaaagcagtggcataatctcggctcactgtaacctccacttcccaggttccagtgattctcctgcctcagcctcctgagtagctgggattacaggcatgcaccactacacctggcaaatttttgtatttttttttagtagagatggggtttcaccatgttggccaggctcgtcttgaactcctgaccttaggtgatctgcctgtcttggcctcccaaagttttgggattacagcatgagccactgcgcctcgccttatttttttgagacaggttctagctctgtcacccaggcgggagtgcagtggtgccatcatggctcattgcaacctcgagttctcaggcccaagtgatcctcctatctcagcctcctgagtagctgggaccacaggcatgcgccactatgcccagcaaaatttttgtttcactctgttgcctagggtggggtgcagtggcaggatatcggctcagtgcaacctctgcctcttgcgttcaaatgattctcatgcctcagcctcccgagtagctgggattataggcatgcgccactacacctggctaatttttgtattattggtagagatggggttttatcatgttggccaggctggtctcgaactcccgacctcaggtgatccatataccttggcctcctgaagtgctggaattacaggcataagccactgcgcctagcttttttgtttgtttttattttgtagggacagagattttacctgttgcccaggatggccttgaattcctgacctcaaacaatttgccctccttggcctcccaaggtgctgggattacaggtgtgagccactatgcctggctggttttttaaattattattattgtttgtgtgtgtgtgttgcaggatcttaccctgtcacccaggctggaatgcagtgatgtgatctcggcttactgcaacctccgcctcctaggttcaagtgattgtcctgcctcagcctcctgagtagctgggataacagctgtgtgccaccatgcctggctaatttttgtatttttagtagagatggggtttcatcatgttggccaggctggtctcgaactcctgaccttagatgatccacccgcctcgtcctcccaaagtgctgggattacaggtgtgagccaccgtgaccagtttggtttagtttttttttttttttttttttttttttttttttgagaaatctcgctctgtcgcccaggctagagtgcggtgacacaatctcagctcactgcaagctccacctcccaggttcatgccattctcctgcctcagcctcccgagtagctgggactacatgcgcccgccaccatgcccggctaattttttttatgcattttaagtagagatggggtttcactgtgttagccaggattgtctcaatctcccgacctcttgatctgcccgcctcggcttcccaaagtgctgggattataggcatgagccaccgcgtccggcctggtttggtattttttttatgagtctgggttgtttatgaaaacttgtcacagctgttaaccttaactttttttttttcttttttttccgagacggagtctcgctctgtcacctaggctggagtgcagtggtgcgatctcggctcattgcaacctctgcctcccaggttaaagcgatttttctgcctcagcctcctgagtagctgggactgcaggcacgcaccatctcgcctggctaatttttgtattttagtagagatggggtttcaccatattggccaggctggtctggaacttctggcctcaagtgatccacctgccttggcctcccatgcctggcaaccttaactttttatttgctggtaattatttgtgtttgcattcatgtgaaaatttgaaattctcattaacatttaaagattcttacatagattgcttgtaattttaaccctgaagttgtgtcaagtgactttacaatgtcaatttgttttatttatttatttatttatttatttatttatttttgtgataggatctggctctgttgctaaggctggagtgcagtgttgcaaatacggctcactgcaacctctgtctcccgggttcaagccatcctcccacctcagcctcccaagtagttggaactactggtgcgccccacagtgcctgcctagtttttttgtattttcagtagatgtggagttttgccatgttgatcttgaactcatggcctcgagtgatccaccccacttaggcctcctaacatgctggtgttacaggtgtgagccactgtgtccagcccgaaaatgtcagtttcgtgccatgattaatagctaactacattttgggaatgtaataaaatttcattctataatgaagtctttgtaaaactcattagttgtggtatgaggcttgtcggcaatataagtgaacgtggtttatttttattaactgtatcagaactttagaatgttggtctcctgaaaccattgccttgagaggctttattgaacagtgttgccaatgatcagttttttttttaatttccttttttttgagactgagtcttaccctgttggccaggttggagtatagtggtatggtcatggctcactgcagcctcaacatcctgggctcaagcagtcctcctacctcagtctcccgagtagctggaactacaggtgtatgccaccatgcctggcttttgtatattttgtagagacagggtttagccatgttgcccaggctggtctcaaactcttaaattcaaatgatccacccacctagttttcccaaagtgctttaattacatgtgtgaggcaccgtggctggccaggtcaaatatttttcattgacgtttttcatattgctttttaaagtcatgttaaaatattcttaataatttttctaagtggaattaatcttgattataattttagttttttataaagggcgggttttgaaacaagtactgcatttttcttttcgggtttataaacatttgctgtggactttgtgcagttaactattttcattcctgaaacacatttcgaaatcaggaattgaagactaaatgtcttttcactgaagcttgagcagattttagaaaggggagttcttttttttttttttttttttggtagaaatgggggtcttgttatgttgcccaggctggcctccaacttctgggcttaaactgtcctcctgctttagcctctggtctggagagttctttatggcctctttgagaacttttactttacacatgattctatctagctttcttttctgatgtacatattggcagcaagtagaaaagcaatgttttcagaggcagatatattaacagcaatgagaaataacagtagcgtgatagaaagttgaaagacttagctgggtgcggtggctcacgcttgtaatcccagcactttgggaggccaaggagggtggatcacttgaggtcaggagttcgagaccagtctggccaacatggtgaaaccctgtctctactgaaaaacagaaaaagggccgggcgtggtggctcacccctgtaatcccagcactttgggaggttgaggagggcggattacaaggtcaagagattgagaccattctggccaacagggtgaaaccccatctctactaaaaatacaaaaaaattaaatgggcgtggtgatgtgtgcctgtagtcccagctactcgggaggctgaggcaggagaattgcttgaacccgggaggcagaggttgcagtgagccgagatcgggccactgcactgacgacagagggagactccgtctaaaaaaaaaaaaaaaaaaaaaaaaccagacttggggctgggcgggcgcctgtaatcccagctacttgggaggctgaggcaggagaatcgcttgaacccgggaggtgaaggttgcagtgagctcagattgtgccactgtgccccagcctgggccacagagcagagtgagactctgtctcaaaaaaaaaaaaaaagtttggaagactggtggctgggcatggtggctcacacctgtaatcccaacactttgggaggctgaagcaggcagattacctgagcccaggagttcaagtccagcctgggcaacacagggaaaccccatctcaacaaaaaatattaatacaaaaaatttagccagtcatggtcgtgcacttctgtagtctcagctacttgggaggctgaggcaggtggttcacttaagtctggatgtcgaggtgagccatgattgcaccactgcactccagcctgggcgttaaaatgagaccttatctcaaaaaaacaaagcaaagagcctgggaactactaaaatgggaactactaaaaaacagacacaagagctcaacaagtataccattctgggaggtttttttttttttttttttttttttttttgagatggagttttgctcttgtcacccaggctggagtgcaatggcgccatctctgctcactgtagttccgcctcccaggttcaagcagttctcctgcctgactcctgagtagctgggagtacagatattggtcacacaccgggttaatttttgtatttttagtagagacggggtttccccattttggccaggctggtctcgaactcctgacctcaggtgatccgcctgcttcagcctcccaaagtgccgggaccacaggcgtgagccaccgcacctggctttttttttttgacatagaatcttgttctgttgcccaggctggagtgcaatggtacaatcttggcccactgcaacctctgcctcccagcttctagcgattttcctgcctctgactcctgagtagctgggattacgggtgcccgccaccacacccggataatttttgtatttttagtagagatggggttttgccatattggccaggccggtcttgaactcctgacctcagatgatccacctgcctaggcctcccaaagtgctgggattacaggcgtgagccaccactcccggcctgggagttttgactgtaagtttatagctgtataccttaggccctaagggcattactgttttatagcacagtgtagttagttaatgtgctcataatggtgactcataacaccaggttaaatgattttttatatctcccaaagaagtatttttcaatctgcagatcatgaccccttagtagattgtgaaacacattagtggattatgacaagcatttttagaaaaatgaaaaagaataagaagtgttaggatgcattgcattattgaaataattgtttttgagatggagtttcgctcttagttgccgaggctggagtgcaatggcccgatctgcctcccgggttcaagtgattctcctacctcagcctcctgagtagctgggattacagacatgctccaccatgcctggctaattttgtatttagttttagtagagatggggtttctccatgttggtcaggctggtcttgaactcctgacctcaggtgatccacttgcctcggcctcccaaagtgctggggatacaggcatgaacccctgtgcccggcctaatttttgtatttttagtagagatggggtttcaccatgttggccaggatagtcttgatctcttgacctcgtaatctgcccacctcgactcccaaagtgctgggattacaggtgtgagccactgcacccagctgccaagaattgttttaagctttggtttgagttaatgtatatataccgcattgtaattcaaaatgtaatttttggccaactctgggcacattgcctatggactagtcctgctctgccacgagcagcaacagttcaatgaattttttttttttttttttttttttttttttttttgagacagggtctctgtcaccaaggctagaatgtagtggtgcagtctcggctcactgcaacctctgtttcctgggctcaagcgatcctcccacctcagcctcctgagtagctgggagtacaggagcacgctaccatgcctggctaatttttgtattttttgaagagatgaggttttgccatgttgttcaggctagtcttgaactctggagctcagatgatccacccaccttggcgtccagaaatgctgggattacagggatgagccaccgtgcctagccaaaaatttttttttaagtaattttttattgatatagtcaaaaaagttactgctttagagccagagaaacgcagtaaaaggattgagaaagagttttgaggttatatctaagctagggttgtcagatttggcaaatagaaatacaggacactcagttaaatttgaatttttgatgaacattgaccagttttttagtataattgtgtattaaattgcatagaaaaaagttatttatctaaagttgaaatttaactgagcatcttgtattttatctggcaactccagtctaagctggaatcatggttcactgtttttttttttttttttttttttttgagtcggagtcttgctgtgttgcccaggctggagtgcaatggtgcgatcttggctcactgcaacctccacctcctgtgttcaagtgattctcctgcctcagcctcctgaatagttgggattacaggcacccaccaccatgcccagctaatttttatatttttagtagagacggggttttcgccatgttgttcaggctggtcttgaactcctgacctcaggtggtccgcccacctgggcctcccaacgtgctgggattacaggcatgatctaccgtgcctggccatggttcactcttcagtaactaaaatttaagctctatgaaagcaggaactttgttttgttcactattgattgtatccctatttcttgaatggttggcacttaactgcttggtcacatgtttgaatgggcaagttactcagccactctcaggcttagtttatttacctattaaaagagaaagaatatcttccttggctgggcgcggtgctcacgcctataatcccagcactttgggaggctgaggcgggtggatcacgaggtcaggagatcgagaccaacctgggcaacattgtgaaacctcatctctactaaaatagaaaaaattagctgggcatggtggtgcgcatctgtagtcccagctactcgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattggctgcataactggcattagaatctgatgtacttttatttctaatacatttctttttttttttttttttttgagatggagtctcgctctgttgccgagcctagagtgcagtggggcaatcttggctccttgcaacctccacctcctgggttcaagctattcctgtctcagcctcccaagtagctgggactacaggcacctgccaccacagccggctaggttttgtattttagtagagatggggtagcaccatgttggccaggctggtctcgaactcatgacctcaggtgatccacctgcctcggcctcccagtgctgggattataggcatgagccaccatgcctggcctttctttgtcgtttcctttctttctcttcatccctcctctccttttttcccctccccgctgcctcctcctgtcttcccttctttccttcctttctctcctttttattttttcctttctttttctttctctgtctctcccaacccttcctctctccctccctccctccccttctctctccccccctccctccccttctctctccccctccccttttgttcctaagagacagggtctccttatgttgctgaggctgaccttgaactcctgagcccagatgattctgcctccttagtagctgggactacacccacctcccgttccgttgtcatcttttttttttttttcttttttggagacagaatcttcctctgttgctcagggtggagtgtagtggcacgatcatagcttactgtaactgtgtaacctcgaattcttgggctcaagcaatcatcccatcatcccacctcagcttgctgagtacctggggctacaggtgtgtaccaccatgtccggctaattacttttcttatttttaatttttcggagataggatcttgctctgttgcccaggctggtgtcaaactcctgggctcaagtgaaactcttgccttggcctcccaaagtgttgggagggattacaggcatgagccactgcacccagcctcctctttcttcccatttaactcctaaccacaccgaactttctgtctgcagagaggagcattggtcagcagttcacaaaatggctaggtgtgatggcgtgcacccatagtcccagctacttggggagctgaggtgggaggatcgctggagcccaggagttcaaggccctgggcaacacagcaagaccttatctctggctgggcccagtggctcacgcctgtaatcccagcactttgggaggctgaggtgggtggatcacctgaggtcaggagttcgagaccagcctggccaacatggtgagaccctgtgtctactaaaagtacaaaaattagccaggcacggtggcgcgctcctgtaatcccagctactcgggggggctgagacaggagaatcacttgaacccaggaggaggaggttgcagtgaaccaagaacacgccactgcactccagcctgggtgacatagtgagactcttatctcaaaaaaaaaaaaaaaaggtcgtctgtactattgcatgttagtagtttctttctgcttattgttgagtagtagtctattgtatgcatgtaccagtttgttcatctagtggtggacattgagttagcaggttttggctattaaaaataaagctggaggccgggtgcgatgtctcacgcctgtaatcccagcattttggaaggccgaggcaggcggatcacctaaggttgggagtttgagaccagcctgaccaacatggagaaaccccatctctactaaaaatacaaaattagccaggcgtggtggcgcatgcctgtaatcctagctactcaggaggctgaggcaggagaatcgcttgaacccgggaggcagaggttgtggtgagccaagattgcaccattgcactccagcctgggcatcaagagtgaaactccgtctcaaaaaaataaataaataaagctggtatgaatatttatgtacaggttttgtgtgaacatatgattttatttctcttggttggaatgcatagaaatgagattgctgggttttgtggcaagtgtttatttttccagggtacatataatcctgtgagtgtttatttaattttaaaagtaattgctaaactgtttgctaaagtgactgctatattttctttccctagcagtgtatgaatttttttttgaggcagggtcttgctctgtcacccagggtggagtgcagtggtgcgatattgtctgactgcaacattgacctcctgggctcaagtgatcctcctgcctcagcctcctggctgggaccacaggcatgtaccaccacacctggtagtttgctttgatttttagtagagaagaggtctcactatgttgccctgggtggtgttgaactcctgggctcaagtgattcatctacctcagcctcccaaagtgctgggattatagatatgagcccctgtgcctggcctcattgtggttttaatttgcatttccctaatgcccagtgatattgagcattttttcatgtgtttatttgacattcataccatctttggtgatgagaaactatgtttatgcattgcttaatgatggggatgtgttttgagaaattttttcggtgatcttatcattgtacaaatatagagtttacttacacaagcctagatggtatacctactagacacataggctgtcgtacagagtattactcttaggctacaaatctgtatagcatgttgcggtactgaacactgttggcagatgtaacataatgttaagtatttgtgaatctaaacatatctaaacatagaaaaggtgagtaaaaatacagcgtaaaagataaaagtggtatatctgaataggtcacttaccatgaatggagcttgcaggacaggaagttgcttgggatgagtcatttatcagtggtgtgtgaatgtgcaggcctaggacattactgtatgctactgtagacaaacactgaacagttaggatacactaaattgataaatatcttgcttattttgttttttgagatggagtctcgctctatcgcccaggctggagtgtagtggcgtgatgttggctcactgcagtctctgccttctgggttcaagcgattctcctgcctcaacctcctgaatagctgggattacaggtgcgtgccaccacacctggctaatttttgtatttttagtagagacggggtttcaccatgttggccaggctggtctcgaactcctgacctcaggtgatccacccgccgtggcctcccaaagtgctgggattacagatgtgagccaccgcacctggccagagatgaggtcttgctgtattgcccagggcgttgaactcctgggctccagcaatcctcccacctcagcttcccacgtagctgggactgtgggtgcacgccatcatgcctagccgttttgtgaactgttgaccaatgctcttttctgcagacagaaagttcactgtggttaggagttaagacttttaacctctgacctcaagtgatctgcccaccttgacctcccaaagtgctgggattacaggtgtgagccatcacgcctggtcaaaaatatctttctttaagagtaaatttaccttaacttactggttgatcattgtatataggtctgttgttaattgaaacatgcgggccgggcccggtggctcatgcctgtaatcccagcactttgggaggccgaggcgggtggatcacaaggtcaggagatcgagaccatcctggctaacacggtgaaaccccgtctctactaaaaatactaaaaattaaccgggtgtggtggcgggcgcctgtaatcccagctactcgggaggctgaggcaggagaatggcgtgaacccgggaggcggagcttgcagtgagccgagatcgtgccactgcactccagcctgggcaacagagcgagactctgtctcaaaataaataaataaataaataaataattgaaacatgcggtgcatgtgtttatttgcgatctgacttgtttggaaatatttgcattatcttccttctagatttagagcatcttgacagtaggaacaagtgttttgtacaactttgtatgcttagtaagttatcaattaacttgtcgtggccaggcgcagtggctcacgactgtaatcccagcactttgggaggccgaggcgggcagatcacctgaggtcaggagttcgagaccagcgtggccaacgtggtgaaaccctgggnnnnnnnnnnnnnnnnnnnncaggagttaaaggctgcaataagccatgatcacaatactgtactccaacctgggcaatacagcaagatcccatctcaaaaaataaatacataaaaacagaaaatattaagactttagtatctcagtttttttgtttgtttgtttgtttgtttgagacggagtctcgctctgtcgcccagcaggctggagtgcagtggcgtgatctccgctcactgcaacctctgcctcccgggttcacgccattctcctgcctcagcctcccaagtagctgggactacaggagcccgccaccatgcctggctaatttttttatttttagtagagatggggtttcgccgtgttatctgggatggtctcgaactcctgactttgtgatccgcccgcctcggcctcccaaagttctgggattacaggcgtgagccaccacacctggcctaccctgtgtttattacaaatacacaaattggccatttgtgcgtggctcatctacagtctcagtgactcagaaggctgaggcaggagaatctcttgaacccgggaggcagaggttgcagtgagcagagatcgtgccactgtacttcagcctgggtgacagagtgagactgtgtctcaaaataataataataatttgttgaatatgtgactgttggtttaatttttatttttatgagatggagtctcactctgttgcccaggttggagtacagtggcgtgcagtggcgcaatcttagctcactgcaacctccgcctcctgtgttcaggtgattcagcctcccaagtacctgagactacagacgtgcactaccgtgcctgactaatttttgtatttttagtagaaatggggtttcaccatgttggtcagcctggtctcaaactcctattctcaagtgatccgcctacctcgaccttccaaagtggcggaattataggtgtgagccgtggtgcccggccagactattggtttggtttggtttggtgtgatgttatgttatgttatgttatgttatgttatgttatgttatgttattttaagacagagtttgtctcttgtcgcccaggctggagtgcagcggcatgatctcggcttactgcaacctccgcctcccaggttcaagtgattctcctgtcttagcctcccaagtagctgggattacaggcgcccaccaccgtgcctggctaatttttgtatttttagtagagacagggtttcaccatcttggccaggctgttctggaactcctgacctcatgatccacccgccttggcctcccaaagtgctgggattacaggcgtgagccactgcgcctggctgactattggttttattattaagcagtagtagttgaccctgtcatgtagaaagcatggcatttataggcataccacgtttaatttcctcccctttttttatttttggagtacctcctgcttgtgaggcttgggaatacagtagtgaataagccagatgaggtctctctctttttggagcttatgtggtagtatagactaggcagaaagttctcattgcccctgccaccttatggcattgaggtgtttgagatgctgatgtttacttctgtctcataaaatcttgaaaggagttcttttagatgaagaggaaaacaaaatcagaagaatgggcctgggtcatgtctgtaaacctccccacgtcatggggaggctgaaatgggaagggccaggagttcaagaccaggctgagaaacataacaagaccccatctctacaaaaaatattttttaattaatgggggatggcagcacacacctgtagtcgcagctactacgaggctgaagcgagaggattgcttgagctcaggagttaaagattgcaggagctatgatcacagcactgcgctccagcccctcttatcagcagtctggtatgttgctaagggtcttgttctttttagtgcttcagggacagccactggctatgcccagaaataagtatgtttgagaagctttctgacctcagcttgaaaaattgattagggtcataattaaaaagggagggaaacaggattgagtgaaccggacgctaccgtgagtttattctcccagggcatacataatctcatgtgattaccacatagccctgttagataatctgttatcctgtcctcattttacccatgaggaaatgaaggcccagagaggttaaatgacctattcaaattcactcagaaggtggcagagatgagttactatcattgtattttggatctctggaaagaaagaaaactagtgatggtattaaaaaatgttattaatagtttcttttaatcaaccaggaacttgagtcactagcttctctgggtgaaggactatacttcaacagtatgaaaaacggaaaagaaaatgaggaattttggctgggcacagtggctcacacctgtaattctagcactttgggaagccaagggaggagggtcgcttgagctcaggaattcaagatcagcctaggcaacatagtgaggccccatctctacaaaaataaattagctgggcatggtggtgcatgcgtatagtctcagctacttgggaggctgactcaggagggtcacttaaacccaggaattggaggttgcagtgagctatgattgcgccactgtataccatcccaggcgacagagtgagaccctatccccccaccgccaaaaaaaagaaaagaaaatgaggaatttacatttgtgacagatacggaattcagggaatttagttgttcatagtctataaatgctataagaagtctccatacctttttttttttttttttttttttttggagacagagtcttgctctgtcgcccaggctggagtgcagtggtgcgatcttggctcactacaagctctgcctctcgggttcacgccattctcctgcctccacctcccgagtagctgggactacaggtgcccgccaccacgcccggctaatttttttgtatttttggtagagatgaggtttcactgtgttagccacagatcccgacctcatgatctgtctgcctcagcctcccaaagtgctgggattgcaggcttgaatcaccgcacccggccggaagtctccatactttttaacccaatctaaaatggtaaggaaatatataagaatgtctatttattattaaattttttctatataaaacatttcagaaaataaagactagcatttctgagccaagtggtagtagtggccattttttctggaaaaaaaaaaaaaaagaaagaaaaaacacatttagctatctatgatgtgaaaagatgaacattttatttaggtaataaatgttatgtcataaaataccatttattgtgtgcctattaggtttcaggagagctgtgccaagagcattacttgtatatcttttaagccttacaacagcccagcctgtcaggctggtagtgccatatctgttttacagatgaggaagtgatggattggagaaattaaggaaattgcctttaggtcaaagagataggaagtgacaaagctgagatttttaaccttgtgagatttcaaagtctttgctttttaataactgttccattgcttctaatatagagatatgacaaaaacaagtaaaaatcagtgaagaaggctgggagcagtcgcttatgcctgtaatcccagcagtttgggaggccgaggcgtgtggatcgcctgaggtcaggaatttgagaccagcctggccaacatgacaaaactccgtctctactaaaaatacaaaaaagttagccaggcgtggtgacaagcacctgtaatcccagctactcagtaggctgaggcaaggagaatcgcttgaacctgggaggtggaggttgcagtgagctgagatcgctccattgcactccagcgtaggcaacaaagcaagactccgtctcaaaaaataaataaataaataaataaaaataataacaataatgaagaaaacaatccggtgattattgtcagcaataaaatttcttcaatcaaccatgctttagtcctggcagttctctatcagtgagtttcaatcaaaaagtttgtttataatttttttttttttaaaattttgaaatttggaaacaacatcataaatgatggttagttttctgcagctccctattttggcagatagtctgttgttactcataattaatttgaactaaaaagtagtgttgtacgatatcatgggctgtgaatgtgtttgtgacttgatctgagaacccacacaccacttaggatgcttctgtaggaaaattagagtatggaactcacttgcccacgctttccctgtctcagtccatgttggtaggctgcaaagtctggggctagaaggacactgaacaagacttcagcagtacatgttagtcttccagagggaaggaatataatagttgagagaataattcctttcctctgtgactttaggcaaattcttggctatgctgttatttatttgggccaaacaatatcaggaggttgtacattttattcttaattactgcgatacattaattttatccatgggtttaacctagcctaccttttgctgttagacttcaactctacttgtgttgggttacccctctgcttaaaaatcaccctattcccaagcctgagggagtctaccttcaaagctttctatgacctaatccaaggcctgtcaaacttcgtaaagggccagatagtaaatttgttttttttttttgagatggagttttgctcttgtcacccaggctggagtgcaatggtgccatcttggctcactgcaacctctgcctcccaggttcaagtgattctcctgcctcagcctctcaagtagctggggttataggcatgtgccaccacgctcggctaatttctttgtatttagtagagatgggggtttcaccattttggtcaggctggtctcgaactcctgacctcaggtgatccacctgctgcggcctcccaaagtgctgggattaccagtgtgaaccaccgtgcccagcccgatagtaaatattttaggctttgcagtccatatacagtcccatttttttgtgtatgtttgcacgttttctttacatattttaaaagcccctttttttttttttttgagacagagtcttgctgtgttgctcaggctggagtgcagtggtgcaatcttggctcactgcaacctctgcctcctgggttcaggcgattctcctgtctcagcttcccgagtaactgggattacaggcacatgctgccacgcccagctaatttttgtatttttagtaaagatggggtttcgccacattggccaggctggtctcctgatctcaggtgatctgcccacctctgcctcccaaagtgctgggattacaggtgtgagccaccgtgcctgacctaaaagctctttacagtgtaaaaaatattctgagctttaagccatgtgaaaataggccatgggcatttgctgacccctaatagaactccattttacctttctgatcatgtttcccattaactcttcaaaaatatgacctccatttaaatcaagatggtctccttcctcactgcttgtggaggtccagtgcccagtgtctgcctcttgcttgctcctccatcattgttctgccattcgagatcctcatacttaccctttaagatctagcccaaattttccatgaaactaattctaataattaaaaacttcctgtagaacttaactttgtctagtacaagttagctttcttattcagtagtagcttactataaattacaagaataaaaagattaccattttccctcacactgttttgtggagaatgcctaaagttactttttctttttacaggtcagtattcctatttggcatcctaatcccctttcccaaatctgaattttgggatttgaagcttgcatttgagattatgatttgtcttccttgttgtacacaggagcagggactttacaattagtattcgcatccctgctccttcatacttcgtgatgtaaggcaagttattttcacttatgcttaagtttcttcccctgtaaaaaggggatggaagaggattaaatgaattaaacatgtaacacgcttaaagcaatgcctggcaagtaataagtgctcagtaacttttagctgttcttattagcatgtttggaaaccagtagaaactacaccagcaagttaaggttgaaaagtggtattgatgggcttggggtagtacagtatgaatggctacagtttagcgtttcattaagtttgtatattcattaattcattacacatttgatgctgtcagactaggacagagacaaagatgaatgaaacattatctctgcttccaggttacccagtgtagtagagaaggcaggcatgcagatagtttaaattggtagcactgggaggggactgccatgggtgggcagtgaagaaaaagggcttcaaaataatgagagttgagatggatcttcaaggaagataagcagttttcagtaaggccatgaagagaggaggaagttccaggcgggaagagtttgtgctaaagtacagggattgctatacacatggtgtatgtagaaaaaatttggttcacagtgtgatagaagaattggagggggtcctcactgaaagtaaggaaacacatttggaagaatatgtttcagttagaaaatgaaatgagcttaaagtaaacactaataaggtttttaaaatgtaaaatttcaacgtatttagaaagagaacagctggatgaatcttatgtacctgtcactcagctttagcagttatcagtaaatggccaacgttgtttcagctatactcccctctcctccactgatagtcttttgaaggggaatacaattgttttgtggcctccagaaagggataagtttatgagcaacgggtagatcgttgggagagacttgagtttcctgtcaggaagcattcttggtgcataagtcagaggtgatatgaatgccgtggaagggggtggcttactgtctggagaactcgagaagatgggaatgggcactgtccagtattgtggctacttccacacatggttctttaaatttaaaattatgttgattaaaatttaaatatttcagttcctcagccatactaatcgtatttcaagtgcttagctgccacatgtgcctaatggctgcaatattggacaacatgacataggacatcttcatcattgtacaaagttctcttggacagcatgggactagagccctaagatccttttctacctgagttgtttggattttttggtgtgtctaggttggatctagttgttcatggcttcatgaccaagccttttatccctttctctagagggactcaaggggtaaaggcactgaaggggtaaaacttcatatgaagagtgtggtggtggtggtggtgttttaagacagggtctcgctctgtcactcaggctggagtccagtggcatgatcctggctcactgcagcctcgacttcctgggcttaagtgatcctcccacctcagctcccaagtaactggaactgtaggcatgagccaccacacctgcctaatttttaaaactttctgtagagacgagatttcgccatgttgtccaggctggtctcaaattcctggactcaccttggcctcccagagtgctgggattgcaggtgtgggccactgcgactggccttttttttctcctttactactctagtgtatgctggaatatgaggaaataattatattagctagcagttattaaacacttaataacataccaggcactgttttaagctatgcgatctgtatggaatattacttaatttccacaaccttatgaaaagatactattttttttcttttgagaaggtactattttcatcttcatttcatagatgttgaaattgaaacacagagagctgaagtcacaggattaaggccacagagctgagaagtgatggagccggaatttgaacccaagcaattaatgctgatattagttcttgtgtgaatggtaattgttttgaaacaatgatcctagatgattatatgaccggattaatctggcagttgttctgtgtgaatttagagttgccttcccacctcagtttcctaaaaacaaaacaaaacaaaacaaaacaaaaaaaactctagcttcactgtgtttgggttgtcatggcctaccccctcttgccacctcatttgactcaactttttagggagaaaatattcaatacgtggtataggatttccctttctaataataatgtaaacaacaacaagaagtctgaaattggaagaacaaaatgactcacctaagtgagttaaccttaagaggtggaacttgatttctagattttagttaattgtctaactgatgtactaaatattagttacttaagtattaaaacgggtagacataatagttggggagctgctgtagagggggtagtttgagaaggcttctttcaggaggtgacatttaagttggtaactaacaagaaaggggcagccatgtgaatagctggagggaagagcattcttacagttttactggaagggggttagaggtatgtggtacccttatgccaaagaaaattagttacttctatacaaccagtctgattctagaaacctggatcaatgaaatattttgattatataaaaaaatctgttacccaggtcttgttgaaatagcattagaaactactgaaggacatatagaggaggagtgttgaaaaatggtgatggatgagcagaatggtgaaaaataaaaagacatgaagctctataattatattgtatggtgacagtaccaatagagattgcatgttttttctccccagtttttttttttgttttgttttttgtttttgagacagagtctcactgtgtcactcaggctggagtgcattgtcgtgatattggcttactgcaacctctgcttcctgggttcaagcgattctcctgcctcagcctcctgagtagctgggattacaggcatgtgccaccacgcccggctaatttttgtatttttatttgagaggggatttcaccatgttggcaaggctggtcttgagttcctgacctcagataatccacctgcctcagcctcccaaagtgccgggattacaggtgtgagccactgcgcccggcctcccccagttgttgaaacaataatggaaggtaattttattcttagattatttaatgtttttcagttatcaggatgtgttagattgtttgtgtatattgttttgcttgttaattaagtaacacagtgaataagacagacaaacatacgaaaatgtacatttattttatttttttgagacagtctgttgcccaggctggagtgcagtggcccaatctcggcccactgcaacctctgcctcctgagttgaagcgattctcttgtgtcagcctcatgagtagctggggccatgggtgcacgccaccatacccggctaatttttatatttttagtagagatggggtttcaccatattggccaggctggtctcgaattcctgacctcaggtgatctgcccgccttggtctcccaaagtgctgggactacaggcatgagccactgtgccaggccatttcatttttggaacgttcttttttttttttgaaatggggtctcgctctgtctcccaggctggagtgcagtggctcaatctcagcttactgcaacctctgccttccgggttcaagtgattctcctgcctcagcctcctgagtatctgggactacaggtgcatgccaccacgccaggctaatttttgtatttttagtagagacggggtttcaccatattggtgaggctggtcttgaactcctggcttcgtgatctgcccgcctcaacttcgcaaagtgctgggattacaagtgtgagccaccacgcccggcctgtttctggaatattcataatcttttgttgtcatttcaacagtgctcacagcagcttcaccaggtgtagattccatcttaagaaaccactttctttgcttatccatgagaagcaacacctcatctattcaagttttatcatgagattgcagcaattcagttacatcttctgaccccacttctaattttagttctcttgcttttttaccacatctgcagttacttgctctactgaagtcctgaacccctcaaaatcattcatgagtattagaagcaatttcctggttgggcacggtggctcatgcctgtaatcccagtactttgggaggccaaggagggcggatcacctgaagtcaggagttcaagaccagtctggcaaacgtggtgaaaccccgtttctactaaaaatacaaaaattagcggggatgtggtggcgggcgcctataatcccagctacttgggagactgaggcaggagaatcgcttgaacctgggaggtggaggttgcagtgagttgagattgtgcccttgcactccagcctgggcaacaggagcgaaactctatcttaaaaaaaaaaaaaaagaaaagcaatttcctctaaaactcctgttaatgttgatgttttaacctcctcccatgctcatggatggcattctcagtggcatctagaatggtgaatactttttagaaagttttcaatttattttgccatcagagaatggctatgaatggcagtagtagccttacagaatgtatttctttttttttttttctttttttttgagatggagttttttttgctcttgtcacccaggctggagtgcagtggcatgctatctcggctcaccgcaacctccgcctcccgggttcaagcaattctcctgcctcagcctcctgagtagctgggattacaggcatgcaccaccatgcccacctaattttgtatttttagtagaggcggggtttctccatgttggtcaggctggtcttgaactcccgatctcaggtgatctgcctgcctcggccttccgaagtgttgagattacaggcgtgagccaccgcgcccggccgtatttcttaaataaaatggcttaaacgtcaaaattatcccttgatccctgggctatggactgattcttgtgttagcagttatgaaaacatttatgtccttgtacattcccatcatagctttttgtcaatgagaagtaattttttttttttttttgagacagaatctcactctgtttcccagcgtggagtgcagtggcatgatctcagctcagtgcatcctacaactctgaggttcaagcaattctcgtgcctcagcttactgagtagctgggattacaggcgcccaccaccacgtctggctaatttttgtatttttagtagagatggggtttcacgatgttggccaggctgggctcgaactcctggcttcaagtgatccacctgccttggcctcccaaagtgctgggattgtaggtgtgagccactatgcctggcctaattggcctaatttcaatattgttatatctcagggaatagagaggcacgaggagaaagagagacaagctgactgctggttcgtggagtagtcataacacacaacatttattaagattgctgtcttatatggaccgtttgtggtgccttaaaagaaatcagggtaacatcaacgattactgattacagattactataacagatacaataataattgtaaattattatttacaattgtaaaatacaatcttttctttattatttacaattattgtaaaatacaatctgattacagattactataacgtatacaataatagtggaaaagtttgaaaatattgtgagatttatgagaatgtgacacaggcgcaaagagagcacatgttactggaaatacggcactaatggacttgcccgactcggggtttccacagacggtcagcttgtcaaaaatgcagcatctgtgaatttcaataaagcaaagcagaataaaatgaggtatgcatgtattgccatcacatgtacactagtaaaatacgttttttttttcagtaggtggatcaacctcaaattttaatataaagcattacttaaaggagaatatggggacattcatgacatttcttatatgtacataaaacttcatgaaaataatttaatgctatccagcagtttattttagaagtactggaggctaggcatggtgtcttatgcctgtaatcccagcactttgggaggctgaggtaggaggatcacttgagttcaggagctggagaccagcttgggcaatatagtgcgaccccatctctacaaaagagaaaagaagtactggagtgttgcagctcttacagaatttgtctagcaggttttccagtctttaccagaaatgcccccatgcagaagtagtaaatactgattcatgtaaaataataaacaactttatctttcagtttttaaaagacagggtcttgtaacgttgcccagactggcctttaattcctgggctcaagcgatcctctcacctgagccttttgagtagctgagactacaggctgcacctctgcacctggctctgcttgatttttaattgttgtattgctgttgcagctatgtttttttttttcttcagtgtgaggatgggcaaactttttatgtaaagtctcaggtaataagtattttaggctctagggccatatagcttctctgttgcatatcctttttttttttttccatttcccctcaaattccttttaccataagcaactcttgaggaacataaaaatcattcttagcccagaagccagaccaaaacaggttgtgggctgtagtgtcctgacccctgatttaaagattgatagctttgaaatggaaagttttaactttctttttttttctttcccttgttctgattgggctgttaattcattaggtatttactcagtgtgtatcatatgaggcatgattcctctgctaattttggtagtggtagaaagatacttttgccaagcttggttgttaggttttcatttgtccaagagttcctgaccaagtgtgaatggatgttgaaatcaaggtgtttctttggccacacaatgtgcctttgggggctatatctatgtgcttctggtaccttcttttaattttcacaaagacactgcttgccgaccacactgttttgtctaatgtggggctatgaccccctggaagaggcatcattttctgattttcacagaagcataatatggtcaggtgatggtcctgagtagtgggtatatgacagatacactagtaattataatacagatctaaactggagagttgaaaacagcatcgtatatttgattgagataatcgaaggaagacttcctgaaaagatggcatttgagtttcaaggctgagtaggattaagtattattatttaaaaaatgccttggacaatgcattaaatagagttaacaaatcacatcacttatagtctccaattaaaaacattttacttaaacataattttagacttttagaaaaattgcaaagatattataaagaattctcctatatatctcacctgtattcttcaagtaacattttaccatattcaccttaacattttctctgtattggtaattgtatatgtaagatttaatataaaataaaaattcttattaaacatatgagagacatgatgcctctttagccctaaatacttcaacttgtatgtactaataacaagggcattctatttcaaaaccacagtacagttgtcaaaataaggaaattaataattgtgtcaaactgttattctgtttatagaccttctaatgtcctttaaaacaatcaacaaatcaacatttttctggtcaagaaccagtaaatatgtatattctacatatatatatacacatatatatacacacatatattctacatatatatgtggaatatacgtatttactccctctgtccaagaaccaatccaggattgttaccttcggttatcatgtatctttggtctcctttaatccaaagcagtttctttgtcttttatgacttgacacttttgaagattacaggttattttgtagactgtccctcaactagggtttatctgaggtttccttatgattagattcagatatttatttttggcaggaatacaacagaaatgatttgtgtgtttttctcattgcatgatatcagaaagtgcattgtatatatttatcccattactggggttgttaactttgatcacttggttagagttgtgtctactaagtttcttcactataaagttatttttcacttggtcatttcatcagtatcttgtggggagttactttgtggttatataaatactctgtttctactttcccttactatatttagcttctgtggacacttttgcctgaaacagttatttactatggtgttaccaagtagtgatgcccttttcttccatcattctgtctacattttttttttttttttttttttttgagatggagtttcgctcttattgcccaggctggagtgcggtggcctgatcttggctcactgcaacctctgcctcccgggttcaagcagttctcctgcgtcagcctcccgagtagctgggattacagacatgcgccaccactcctggctaattttgtatgttcagtagagacaggatttttccatgttggtcaggctggtctccaactcccgacctcaggtgatccacccacctcagcctcccagagtgctaggattacaggcgtgagctgccacaccaggccttctttttctcttttaagagatagagtcctgctttgtcaccaaggctggagtgcagtggcatgatgatagttcactgcagcctcaaactcctgggctcaagtgaacctcccatctgtagctgggactacaggcacctgcataacacctgactgttttttaaaactattttagagatggggtcttgcgaagttgctcaggatggtcttgaactccgggtcttaagtggtccttctgcctcagcctctggattagttggcattacaggcatgagccattgtacctggcaagtgcatattttctttttttttttttaaggtggagtctcgaggccgggcgcagtggctcacacctgtaatcccagcactttggaaggccgaggtgggtggatcaagaggtcaggagatcgagaccatcctggctaacatggtgaaaccctgtctctactaaaaatacaaaaaattaactgggcatggtggcacacgcctgtagtcccagctactcgggaggctgaggcaggagaattgcttgaacccaggaggtggaggttgcagtgagtcaagatcatgccactgcactccagcctgagcgacagaggtagactctgtctcaaaaaaaacagaaagacggagtcttgctctgtcacccaggctgcattgcagtggcatgaactccgcctcctgagttcaagcaattcttgtgcctcagcctcccaagtagctgggattacagacatgtgccaccacacgtggctaatttttatagttttagtagaggtggagtttcaccatgttggctaggctggtcttgaactcctgacttcaggtgatccacccgccttggcctcttgaagtggtgggattatgagtgtgagccactgtgcccagccaagtgagtatttgcttatgtagtattttaattttatgatttttttttctttgagacggaggtttgctcttgttgcccaagctggagtacagtggtgccatctcggctcactgcagcctccacctcctgggttcaagccgttctcctccctcagccacctcctcctgaatagttgggattataggcgcctgccaccatgcctggctaattttttgtatatctagtagtgatggagtttgagcatgttgccaggctggtcttgaacctctgacctcaggtgatccacctgccttggcctcccaaagtgctgggattaaggcatgagccaccatgcccggccagagactgttcatttattttttttttttgaggcggagtctcgctgtattgcccaggctggagtgcagtggcacaatctcggctcactgcaagctccgcctcccaagttcacaccattgtcctgccttagcctcctgagtagctgggactacaggtgcctgccaccacgcctggctaattttgtttttgtatttttagtagagatggggtttcagcccgccttggcctcctggagtgctgggattacaggcgtgagtcagggcgcctggccaatcataccttcttttactgcattaattatggttttctttcgttcttaaaacatgtttatagtgaccacttttgaaattcttattaagtcagacatctggttatacaagcaatttctattgcctacttctttttccagtgggtggggttatactttcctgtgtcttagcttgtcgtttttttttttgttgttgaaaactggacattttaagtaatgtagtaactctggatacctcattagcctatggttgggggtggtggttgttactgttatttgcttatttgtctaatgactggctgaatgattttagtgttctatccttcttccctccctgtacagtgtgacacgtctgatgctagttttcttgggatgcagccttgggtatgcctaccatcactctagaatcacagtgattttggcatggctttgtctcttttcctgactgtacccagctgttaagctacactaattactaggtgatgctgtgtagtcatttcttggtgtccttgggggattggtcccaggacccccccgttggatataaaaatttatggatgctctagtccctcataaaatggcacagtatttgcatataccggtgcacatcctcctgtatgctttgtcatttctagattacttataatacctaatatggtgtaaacactaggtaaatagttgttatatattttttatttgtcttatttttattgtatttatttttaagtgtttttaatctcgagtgattgaatctgaggatgtgaaatctgcagatatggagggcctgcattgttttccgtggagctttgggcctaaactgctccacagactgatctgatcaaatttgcgcttctttgaagggatagtttctgagatcagtgtttgaaatttgttccaatccacagaggagtcctcccagctctctttccctagttctggccaccaaactagacaactacaatttagcacttatctccaatgattctcctcctaccaagtgcctttgaaagcatcattaactctttcataccttgttgcaaatgaaatttctttgggaagagattgtgagttttttttctcctaaattatggtgcaatataagtaatataccattttaacaattttaagtgtattaagtgttttttttttttgtagtttttttttttttgttttttgagatagtcttgctctgtcgcccaggctggagtgcagtggcacgatctcggctcactggaacctccacttcccgggttcaagtgattctctggtctcagcctccccaaatatctgggattacaggtgtgcaccaccacgcctggctaatttttctatttttagtagaaacggggtttcaccatattggtcaggctggtcttgaacttctgagctcgtgatccacccacctcggcctcccaaagtgctgggattacaggccttagccaccacacctggcctatgcattgcttttatatgtattttaaaattcataagttctcctcctatgatgtttttgtcccatgtgatttatttgttaaaccgtcatctttggccgggcgtggtagctcacgcctgtaatcccagcactttgggaggctgaggtgggtggatcacaaggttaagagatcaagaccatcctggccaacatggtgaaaccccgtctctactaagaatacaaaaattatctgggcatggtgacgcgtacctgtagtcctagctacctgggaggtggaggttgcagtgagccaagatcgtgccactgcactccagcctggcgacagagtgagactctgtctcagaaaaaaaaaaaaacaaaaaactgtcattttttatgttgcatttactgcattctggatttaaactgtgaggaacctcatggtatcagttaatatattcttccatcttaatgtttctcgtaaactggtagatctgtaaacttgattaggtctatcctattgtatcacatcagaagcagaaggtgctttttttttttttttaagggaaattgtgtgaaagtagacagaatggtaaagtgaacccctgcacacctatcacccagctttaatagttatcagctcataccattcttgtttgatttacaaccccattcatttctcccttctgtattattattatttagttaattattttttgagacagggttttgctctgtcaccaatgctggagtgcagtggcataatcacagctcactgctgtcttgacctcctgggctcaagtgatcctcccacctcaccctaccaagtagcggggaccacaggcgtgtgccaccatgcctggctagttttttattttttgtagaaacagggttttgctttgttgcccagactgatctcaaactccggcactcaagtgatcctcctgcctcagcctcctaaagtgctgggattacaagcatgagctaccacattcagcatgtaaatttctttatattaatttgactggcattttaagtcacacttgaatttcatatttggcaactattaaaagcatagagtcctggatattagtgttttgttaaacctgatctatctaatcataaatatacttaggtctaaaatatgctcttggcctttgtttattgcggttcagtatttgttactatattaaatagtaaaatatttggtttgagatactaatgaaaagattaaaagtaaagcataacttgaatggatacaaaaagaaacaagaatttagacttcagtggatttcagagaatactgcttcgatatgctaacattcctgttgggtgtccaaccgtgtcatagatcagtggaaattagtggtttctgcactttactgtactgtttttttatatgataatattttcctggttgaatgattcgttcttttgagtaaactccatggtcaaacaattactttttattagtcaaagatgtaaccacataatcactaaaaagaacagtgtgacttatttaaaggggattatgtttttaagtcttttatatagctttgtagggaggccatatgagtttaaggacagttcgtggcatttgttcaaggttttgtaacttggcatctcagcagccaccaggataccagatcatcgttctaagtaagatttaggcattttagccttcatgtacagactataagtacacccccccacacccctaccaaaactgtaaattcaaatgatgtttgaaaaagcatagaatttttgttaggcgaggtagtttattccttgtgatacagttccagagaggcagcataacctaggaatgaaaaacttagacgtggaatcagatacacctggtttaaataccagctctactgctcatgaactggatgattttggtcaagatacttgactgctgaggttcagtttcctcacctgtaaagtagaggtgatagattagacatgttgcatgtgaagtacttagtatggtgtctggttttgtagtaagatctataaaagataaattattagtcatattccttagacttcaggaatttatctctgtgccatgtttgaggcaaacagttacagaattagaatgttagaaatgaaaggaatcctagatgtcatttaattcaagtccattgttttctggatgagagaagaaagtgaggaaaagtgacagagttggagaccaagctaggactggcctcagaatgttaagagtactcttctagggatcgaccagtcgtgttactagactttttggatctgaattgtgcttttccttgaatgttttgaattttggcttgagtgttgtgattattttattaaaatgagattccagtcctattgtcatgactaatgtttatgagaaatataacatttcactttaatgatgttttttaattattctaaggggcctaatctttttcagtggaataagctttaggttgtattatattctataattcacttgaaaatagaattcatctttacttgacagccaaattttgtgtactgcatcttttctgagggagagagttggcaaggaaaggcacttgttacaacgatccacacatatagacgcatattatttagaaatgaaagtgctttgaatgatttagcttattttcagtttttttttttctgcagttgtaatcatatgacctgtttttctttctttttttttttttgagacagagtcttgctctgtcaccccggctggagtacaatggggcggtctcagctcactgcaacctccacctcccaggttcaggcgattcttctgcctcagcctccctagtagctgggactacaggcgcatgccaccacacctggctaatttttttattcttagtagagatggggtttcactgtgttagccaggatggtctcgaactcctgaccttgtgatctgcccacctctgcctcccaaagtgctgggattacaggcatgagccactgcgcccggcccatatgacctgtttttcttttatagatgggggagaaatatgggaagtgacttggtgtcagtcatctgtgttggttaaatcaagaatataatccgtgttttgcttctgaatagctctttataacagtgattggttactttgggagtaaagattattatttagagacagagtcttgctttgtcgcccaggctagactgcagtggaatgatcgtagcctactgcagcctcagactcctggactctggtgatcctgcctcagcctcctgagtagctaggactagaggtgcatgccacatgcctggctataattattattaatttacgtttagcattagtttttttcttccagtaggctattttactttatttatttgattttgatgaagtttgattatttctagtttgcttccttctatgacccctacctgttgtgggtctccaggcaagcagtgcacaggtagagccatccttaggtagcctttagacttaatattaggtgagctctccccacagatagcctctcctttatttgaatggaattatattttaagtttggaaatatttttcagcttatttagcctgttgaatttaataaaaataatatttaatcttttcagaggtcgaaacagtaacaaaggactgcctcagtctacggtgagtaactttaatgttacttattggggaaaattagtagctaaaacatgatctctaaccacagaccaaatgccaaggcaaaagattcccttcttttgaattttgtcatagataacttgactgtttaagtatgttattagcctatatgtgtttttttaatgactctgtataaaatgtacaattacttgttgtattagtccattcttacactgctaataaagatatacctaagactgggtaatttataaaggaaagaggtttaattgactcatgctctgcattgctggggaggcctcaggaaacttacaatcatggtggaaggggaagcaaacacatccttcttcacatagcgacaggagagagaagtgctgagcaaagcagggaaagccccttataaaaccatcagatctcctgagaactcactcactatcatgagagcagcgtaggggaaactgcccccatgattcagttatctccacctggtcttgcccttgacacacgagaattattataattaaagataagatttgggtggggacacagaaccaaaccatatcatttgtaaatagtatttttgtcacgtgtaataacaagaacaagtcgcttgttcttttctaaatgactaagtgcaaatctaagtgaaaaacctccaaaagatacgtagaacaccaagagtggagtctgcagagttctttatgctttttattttgaattaatgtgctttttttctgctgctttcatttttctcctttggctttctggtcttaaattttggaatgttatcaatgaaattgaaccggacatgaagggcagaaactataagtcccacatgatggaagaaataaatgagaagctatcacaaatttttgagactttgcctttattagattgttttacaagaatcaggaagatatacacgtatatggtagtaatatggagtagtgtggttgatcagacttaagcactgtcactgatgctgatatgctgggagaacctagtcagggttcttctatgaaggtatgacctggcttcctaccccatttatttatacttcacccttcttagggtacatttctgtgagttttaacaattgcatacaatcagtgtaactaccaccacaatcaagttaatagaacagtttcattgcccaccaaaatccctcaaatcacttttcagtgaaccctcctctctctccaaccattgatttgtcttccatccttacggtttgtgtccttcctcctctatggaagtttactcttgcttttttatgtcatgtttagtcaaaacaccattagttggtttgactgataacacttgaaaacctgaccttctgttccttctgttctctatggaagcaaaatattaaataaacaaaatcttcccttaatacatgtaagatatcataaacctaactaaacattttgcaacaaataataaacgttagctttatatgcaaatgtaaatacaggctgagcatccctaatcggaaatgctccaaaatttcatattttgaattagggatgttcaagcactaagtataatgcaaatatccccaaatccgaaaaaaatccgcagtctaaaatacttctggtcccaagcattttagatgaggaagattcagtttgtactaatttctaatagttttttttttttttaatattccagatttcttttgatggaatctatgcaaatatgaggatggttcatatacttacatcagttgttgtaagttattagattattggggataaactgccttgggggtagaataaagtaattccatgaagttaaaatgtggataaatgattgtcaaagtaacattgcttagatcatgtttagtcaggatgatttagagaaatagattagaactccttttatccagtctaatataattcattgtaaaagtacagttggtcctctgcatctgtgggttccatattcatggattcagccaaccttggatcaaaaatatttgttaaaaaggccaggcacagtgactcacgcctgtaatcccagcactttgggagtttgaggtgggcagatggcttgagctcacaagtttaagaccagcctgggcaacatggcagaactccgtctctacaaaaagtaaaaaaactagccgaacgtggtggtacgtgcctgtagtcctagtgacttgggaggctgacgtgggaggattgtttgagcctgggaggtggaggtttcactgagctgagataatgcccctgcactcagcctggtcaacagtgccagacagaccccttctcaaaaaaaaaaattttttttttttttttttttttttttttttttgagaaaaaagaggcatggttgcgtctgaaccaaagatgtacggacgtttttcttgtcattattcctaaaacaatacagtatgacaatttacatagcatttacattatattaggtattacaagtaatttagggatagtttaaagtatttgggagaatgtgcttagttatatgcaaatactattacattttatgtaagtgacttaagtattatgtaattcggtatctgaaggaggtcctggaaccagtcccctaccaataacaacagatagctgtattcttgttaaccctgctgtgtgtgtaaaataatgttagtagttgattgtcttttgtacattattttgtcacttaaaatagctggggtcagaaatgtttgacttcagtattaaaattcgtactgcaaactctgagtagagcctcctgaagaatttcaagagttcagtgtattgttaatgttttgaaatttttttattgttttgttagtgaatacctaatattgaatgaagcctgatgaggtataaaaagtaaaatgaaaacaaatatccctggtgaccgggtagtatactgtttctttgataaataaattatatgtttttagggctccaaatgtgaagtacaagtgaaaaatggaggtatatatgaaggagtttttaaaacttacagtccgaaggtaatttttactttttttctttttcttacaaagtaaaagaacattttcatagtcagtgttttacctagtttttaaagccactttgaatgattttacttctcagtttcaaatactgattattttatagactggtttgtgtaatcagagaggcttcttgatgtgtgtgcttattaaaatatttcaaccatttttaagcattgtgagctaatagagggatgtggtggtttgttttttcctcttaaaaattattattaatgtacttaagacaaaccatagaaacaaaaaacatttagatatgaggatttttaaatgatggaatggataatagatcatatgcctgggaaaaagggtatgattctcttgagattatttttgtcaaaggcatataagaactggtaccttgatgagctaaagaattcctaacaaattttattttgtaaaggtttggagtacttacttgtgtttttcattttagtgtgatttggtacttgatgccgcacatgagaaaagtacagaatccagttcggggccgaaacgtgaagaaataatggagagtattttgttcaaatgttcagactttgttgtggtacagtttaaagatatggactccagttatgcaaaaagaggtgggttttgatttcctaaatatgcctcatggtttattagatttattcaagcaaagattttcacagtgatcttacaaactttttttaaagaaatatctgggctgggtatggcggctcattcctgtaatcttagcacttagggaggctgaggcgggtggatcacctgaggtcaggagttcgagaccagcctggccaacatggcgaaaccccgtctctactaaaaatacaaaaatttatttttgtgtgtggtggcgtgcgcctatagtcctagctactagggaggctgagacagaattgcttgaacccaggaggcagaggttgcagtgagctgataccgcaccactgcactccagcctgggtgacagagcaagactccgtttcaaaaaaaaaaagaaagaaaaaagaaatatctactttctagaatagcccaagtaaggtaattttttagaaaaatgagaatgttaatgcatttttgttggaaaacaattagaactttagagaaaaattaaatagagtttttgtgatctcttaaaaaattagtttgtaaagcattttctacagttttgtggtcaagaatgctactgattatattcaactgaaaatttcttgtcccatttggcctacaatgctttagtttataagtgggcatgtggcaaatctggaaagaaatcaaagtataaggctaaggaagaaaggtagagaacggttggtagaaaacaattgtctaatgaaaatgaaaaagggtgaagaagtagaacatacgtattttaaaaatattcagagtatgagacaaggttttgagaatttaaaagcgattatgtagttatattaaaaatttagtctctttttaagtgtccattgatgaacaaagtgggaattcctgttactcatttgcaaggcattattgagtgttcagtaacacgttgcaaggcacttctgggcaatcctgaacttggttctcaaattctttttttttttttttttgagacggagtcttgttctgtcccctgggtggagtgcagtggcacgatctcggctcactgcagcctctgcctcccaggttcaagcgattctcctgcctcagcctcctgagtagctgggactacaggcgtgtgccaccacaccaagctaatttttgtattttttgtagagacagggtttcaccatgttggccaggatggtctcgattgtttgacctcgtgatccgcccgcctcggcctcccaaagtgctggaattacaggcatgagccactgcacccagccggttctaaaattcttttatttatttgtatatgccaaattctgtagtgaaatacgtaattctgttgtaaattgtagttcagtacaatttgattttcactattcaaatctataccaaaagctgtttttattgttgggctgattcttctacactgttacttggaaataataatataccaggattctttctcttagacttaggagtctttctctttgcttgctttttcagaggctaacagtactgggtattctttaactgtcttgatatgctgatgaaagcacagtgttctgtttttgaatcttctcaaatgtccttgtctttgattcacaactttttgtcttaagaggccttcagcatcccatacaaggaaacaagtctttttttagctgctacctttggagttgattttgtttatgtctaggagcactaaattatttatacttatactattgaaatattcctctgttataaattcaaaaattgactttggaagataaaattttagttgaatttaatacatagcactctggaaagagtattggccacaacaaaaaaaaaggttccctactctattggataccaggtcatttaacagccatttacggtatgcattgtctttttgtttttatgatgaattgatatttcccaaatgtggaagagtgaatattactttgagatgtttgtgatagtccattccttgctcctcttcaaaattaatgtcattaaatttttattactttattagatcttcatttctcagataattttagttcattatagaaaggcaagaaaatacagatcagagtgacaactttgaaaatctcactctactcataaggggatgggtgtattttgctatatattacaaaattagttttcttgatgaggacatccactattggagtaatttcaggtatcttattttttcttttctctctctttttttttttttttttggagacggagtttcgctctgttgcccaggctggagtgcagtggcctgatctcggctcaccgcaacctctgcctcctgggttcaagcgattctcttgcctcagcctcccgagtagctggttactgaggcatgtgccaccatgcccggctaatttttgtatttttagtagagacggggtttcactatgttggccaggctggtcttgaactcctgaccttgtgatcctcctgccttggcctcccagagtgctgggattataggcgtgagccaccacgcctgggcaggtatcttatttcaaaacttacagtggtttagtgaattatacaattgcgtccagtgcgtagtatcctgaaaatagtattaagtcatgtgtttaggacatcaggtctcttaagctaagactatccaggcagaaattgccctcttctataaaagaagaaaagtattaattaggaagtactatcagtatggagaaaaccattttagaattattaattggcatggtttccttctttttttttttatttcgagatggagtctcactctatttcccaggctggagtgcagtggtgcgatctcggctcactgcaacctctgcctcctgggtttaagcgattctcctgcctcagcctcccgagtagctgggattataggcacataccaccatgccctgctaatttttttttttgtttgtattcttagtacagactgggtttcaccatgttggccaggccgcatggttttccttaataacaaaattaaggcatttattactgcatctagattttttttattttttattagagacttactcagattactcccaaagtaaaggaaggtatggtttaatcaatgcttcttaatgctgggttcacgtttagtcacctggggagtttttaaaaatgttctcacttctagggatcctggtttaattataattagcctgggtgaggctctggacagtcagggtgtgagctatgggtttcatgtgatgagatcccaggagtggctctgttctgtggccttgagaatttgtgctttctaggccaggtgcggtggctcactcctgtaatctcactttgggagaccaaggtgggcagatcatttgaggtcaggagttcgagaccagcctggccaacatgttgaaaccccgtctttactaaaaaagtaaaaaattagcgggacgtgatggcacatgtctataatcccagctacttggggagaggctgaggcagaagaatcgcttgaacccgggaggcagagattgcgagatcatgccactgcactccagcctgggcaacagaataaaaaaagaatttgtgctttattttcttgcctcacagtcccctttctgtctcagaattggcaactgcctgaaatagtctctgctgttatcatttgatagtacttttccacatcttgaatggatagatagagtgttttttataatagaagtggatgaatgattagagtatactaatatgacattgtattttcctaaaagatatgaattgatttcatttctgagcttttataattctcttctgtaatagtctgtcaaattattaaggttgataatattaactaaaatttgagtgcatattctatgtgccagactctgtgctaacagatttacctacatttgttcacataatcatcacaagttgtttctgtagtagatacagctattatccacgtcatagatgaggaaacaggcatatttaggaaacttgctaaagtgaggacacaaatctagcttttctactctaactcatgttcttaacattatactgcagtgacataaattatgtggtttggtttgttgtttatctcagttgtcataagtcgaattaatgtttgtttgtttgttttgagacagagtcttgctctgtcgcccaggctgggtacagtggcgtgatcttggcgcactgcaacctccacctcctgggttcaagcagttatcttgcttcagcctccctaataactgggattacaggcacgtaccaccacacccgggtaatttttgtatttttagtagagatggggttttaccatgttggccaggctgatttcaagctcctgaccttaggtgatccacccacctgggcctcccaaattgctgggattgtaggcatgaaccactgtgcccagccagtaagttccatggttgttaaaggatttctccacaaataaagctaaaagtaaaaaaaaaaaaaaaaaaaaaaattctcaagcaatataagatgcagactattatgttgttcaagttttttttttttttttttaatctttggctttatttttggggaaaccttttttttcttttttgttttccttgggacggagttttgctcttgtcgcccaggctggagtgcaatggtgcaatcttcgctcactgcaacctccgccttctgggttcaagcgattctcctatctcagcctcccgagtagctgggattacaggcatgtgccaccatgcccggctaactttgtatttttagtagagactgggtttctccacgttggtcaggctggtcttgaactcctgacctcaggtgatccacctgcctaggcctcccaaagtgctgggatcacaagcgtgagccaccgcgcccagccagggaaacctttattttgaggcggagtctcgctctgtcacccaggctggagtgcagtggcgtgatctcagctcactgcaacctctgcttcctaggttcaagcaattcttctgcctaagcctcccgaggagctgggattataggcgtctgccaccatgcccagctaatttttatatttttagtagagacggggtttcaccatattggccaggctcttctcaaattcctgacctcatgatccacccaccttggcctcccaaagtgctaggattacaggcgtgagccaccacactcggctgctggggaaaccttttaacatgagtaaggtcagtgtgacttttaagttcttgatgctaacatcattgatttcaataaagtttaaaagttatattcatgcatatatgcaaatgaataaaaggctttgaaatagtgacttcttacggtacagtgaataagtttcctttggtctcttgaatgttatacatgttccagtttgatttactgagaaactgaaagtacctttacgtcatatgagctgtgagtcaccttggcacattcataattagaagagaccatcagattatcattggaaaatcagtttgtatttatcctttatttgaattccagtgcagacagatctgaggttctcttcattttgctaaaacttcttagggccttcagtcgcttttggctctgtattcgtgtatctttggaattgtcctgttatctctgcttgttttttacttgattttccatccatttccagtattcctttctcctctatttttttccttcattttctttctgctcttcctgttgcgccattattcatgttttcctctttactccaactcaactatggctttacttctgtttccttattccattgttcctcatactttttcctactgcttcattttctttgcagtattctcagcctagatgataggggtcagcaaatctgctcatcagtaaataaattttattgtagcatagctatgcccatgcgtttgtgcattgtctatggctgttttgatggctgtagccatagagttgagtagttgtagctgactgtaggacttgcaaagccagaaaatttgactgtctctttacagaaaagtttgccagctcttggcctaaatcatattttccgctgcatttagggctttttaggactgatcaaaaatacatgctatactggctttggtgaagtaacagaatgtgctctgtcctttaaacttacaactaattgcatgctttgattctaatactgtataatatcctgcgattcttattcatgaccattctaattggatttagtctgaagaattacttttgcttaacagattctttgtcacatttagtgaaaaatcataaaaggggaaggttggttaatggaaaagatctccatcaactaaccactaccttccttatctacaaatttatcttcttcctccgtgccatctttttttttttttttttcagatgatcttgctctgttgcccaggctggagtgcagtgatgcaatcacagctcactgcagcctcgacttcccaggctcaggtgatcctctcacctcaacctcctacataactgggactgtatgtgcacatcactatgcctgactaattttttatatttatattttttgtagagatggggtttccctgtattgcacaggctggtctcaaactgctgggcctaagagtcttcccaccttggcctcccaaagtcctgggattacatgagtcaccgcacccggcctcattattatttttcctctggttttagtagagaggatttttaagccaacttcaatcatgcccttgactctctcccttctacttacctccttgttctctttttctttttctttttttttagatggagtctcggtctgtcacccaggctgaagtgcagtggcgtgatttcagctcactgcagcctcagcctcctgagtagctggggctataggtgcctgccaccacgcccggctaatttttgtatttttagtagagatggggtttcaccatgttggccaggctggtctcgaactcctgacctcaagtgatcacctgcctcagcctcccaaagtgctgggattacaggcgtgagccaccacgcctggccatctttttttttctccttgctcttttataccacttctctgtttctgggctcttcaacatctgcctttctagttaatctttccctttagcatgaaaacctattcacttcctgctcatcctaaaaaggattcttttttgttttgttttgtttttgtttttgagacagagtctcgctcttgcccaggctggagtgcagtggcactatcttggctcactgcaagctccgcctcccgggttcacgccattctcctgcctcagcctcccgagtagctgggactacaggcacctgccaccacgcccagctaaatttttgtatttttagtagagatggggtttcaccgtgttagctaggatggtctcgatctcctgaccttgtgatccatctgcctcggcctcccaaagtgctgggattacaggcatgagccaccgcactgggcccaaaaggattctttttaatcctgaattcttctagccattatcctgcctaaggctacgattaacctctaactgccaggtcctttggaatctttttctgtctttattgctgcacttgaatgttggtttcaccctccttcagaatttcctcttctgtattttttatgtttattgatcattccttccctgcctcattcctgggcttcttttccttcacacaccccttagatgtgtgtccccagtgtttgtttctttgcctgctgctcttgccacatgacacacactgccagctaccacacacaagttccctcctatcatgtgtgtatcattgcccttataccatgttgtattaaaattatatgcttgtctcccctgttacagtttgagctctttgtgctccaagtaaagacagtgatactgtctttattatttattctcatggtctagtatagtgctttggcacatagtacaggctcaatataaatgtgtttgaataaatgaaattcagtgccttaatacacttttgtagaagcattattttatggaaagaatgaaaaagctgtaagtggtcttacatatatagtcatccagcagatacttagagagctctgggatgtgttccttgctgtgcttgttgctatggacagtacggagaaatacaagaatctattttgggtcccttttgagaacctagtgaaactgtgtacctagtgaaactgtataccctcaccctagaaaaatttacacacatgtagattttacatgtaattcttttaaaaattaattttttttcttttttttaaagaaacagggtcatgctctgtcactcaggctggaatgcagtggtgtgatcatggcttactgtagcctcgacctcctggctcaagcgactctcccacctcagcctcccaagtagctggggctacaggtgcacgccgctatgcccggctaatttttaaaaatattttatagacactggttctcactatgtttcccaggctggcctttacctcctgggttcaagcaatcctctaccttggccttcaaaagtgatgggattataggtgcaagccactgtgcccacgctaatgtaatttcatggtgttcacagtttcttcagggagttcatatacgccatgtactctattctaagcatttttagagttagagatagcaaagcacgtgaataaattcaagaaaaatggaatgttgtactgcatgacattgaatatcaaatggagtcagcgatgcaaataattgtctagattttacaaaaaaaattagcctggtgtgctggtgtgcgcctctaatcccagctactcgggaggctgagacaggagaatcatttgaacccagaaggtggaggttgcaatgagctgagatcgtaccactgcactccagcctgagtgacagagcgagactccatctcaaaaataaaaaataaaagaattgtgtagattttagtagttggaagaagttggagtgttaatgtgtaattagagaacagtgagaaataaaattctacagattgttttattctggtgtgctgttgtgttctcatatggttgtctttttggtcttgatagtgtatcagtaacagagtacgagtaacaaacagggatctcttctgaacggcgtgacattagaaaagctgtttacggcctcaactttgctgtggtttattaagacacagatatgtgttcattctggggccaagcagtaactggagagtggcacttattgaggccagtatggaggcagtacagagattattgagattaaaagaaagaaacaggtggaacggatctatgtaatggaaagctaaacagaatagttcgtggtacacagtagaaaagcattacatgtttattaagatatggtcatcttccatttattaaagttacatgttttataatttttagagtatatagaaattctctaccctatcatgtttgccaaagtcagaacaataacttcatttattaaatataaaaaaaataaaaacctctagcataaaatagaattttatttggacaaacgataaaaaaatactgtgtggtactagtaagagtaaggttgattcaagatacatgggagcagaatccaaagtgtagaaataggccaggtgcagtggctcatgcctgtaatttcaacacttttggaggctgaggcgggaggatgagttcaggagttcaagactcgccttggcaacttggcaaaaccccatctctacaaaaagtacaaaaattagccgggtgtggtggtgtactcctgtaaacccagctacttggtgggctgaggtgagaggttcacttgcagccagtaagtcaaggctgcagtgagctgtggttatgccacggcactccagctgggtgacaagcaagaccttgtctcaaaaacaaaccagccaggcgtggcggatcacctgaggtaaggagttggagaccagcctggccgacatggctctactaaaaatacaaaaattagctgggcgaggtgacgggcacctgtaatcccagctacttgggaggctgaggcaggagaatcgcttgaatccaggagacggagtttgcaatgagccgagatggtggtgctgcactccagcctgggtgacagagccagactctgtctcaaaaacaaaaataagcataggacatggggataaattgaagatttatgaagacacagctgaaggagacataaaagtagatttggctaaatggaaacatgccatactttgaatggaattatttaatactacaacgttgtcaattttcctcaaataaatctctaaagataatatattcagttttggccgggcacgttggctcacgcctgtaatcccagcactttggaaggctgaggtgggccgatcacttgaggacgggagtttgagaccagcctggccaacatggtgaaaccctgtctctactaaaaatacaaaaatcatctggacatggtggcaggtaccagctacttgggaagctgaggcaggagaattactcgaaccccgtaggtggaggttgcagtgagctgagattgcactccagccgggtgactccatctcaaaaaaaaaaaaatttttataatatatatatatatatccgtttttgtagaaattgacaaaatgattctaaagcttattagattatgtgtattaacagaagaactttggaaatttttttccacaagagtcataaaggaggacttgccctacaaaatatgtcagaattaaaacataacttgtcagctgggtgcggtggctcacgcctataattccagcactttgggaggctgaggcaggcagatcatgaccagcctgaccaacatggagaaaccccgtctctactaaaaatacaaaattagccggtcatggtggcgcatacctgtagtcccagctactcgggaggctgaggcaggagaatcgcttgaactcgggaggtggaggttgcagtgagccgagatcgcgccattgcactccagcctgggcaacaagagtaaaactctgtttcaaaaaaaaaaaaaaaaaaaaaagaattataactgtcacagtggctacgtatggagcatccaaaactgaatttatgtgggtattttattaatatgcaatatagcactttaattctggaggaaaggtggattattcagtaaatgattctgggacattggggacaaattagatacctacttcacactgataaataaaaccaaatagattaatgagaaaactgtgattaaacaaaacaacacccagactacactggagcaaatctgtgaatttgtttaattttgagtggagaaggactttataagcatgactaccagagcaaaaaaatcatgaagtaaaagatcgatacctttgattataaagagattaaagatttaggccgggtgtggtgctcacgcttgtaatcccagcactttgggaggccaaagcgggtggatcacttgaggtcaggagtttgagaccaacctggtcaacctggtgaaaccccatctctactaaaaatacaaaaaaattagtcaggcatggtagcacatgcctgtaatcccagctactcaggaggctaaggcaggagaattgcttgaatttgggaagtggaggttgcagtgagccgagattgtgccacatcactccagcttgggcgacagagtgactccatctcaaaaaaaaaaaaaaaaaagacttagacgtgtccaaaagtaccatacatttaaaaagacatgccacaaactgggaaaagtagaaaaatagttttaaaaatgaccagtgaatgtatgaaaaggtggccctcctcacttgtaatgatttaagaaatgcagtttatttttattttattgtatttttaaagaaattcagttttaaagcagtggaatatgattgtctatcagcttgcgctgaatggtaaatgtgagaaagattactactacttagtggtactgagggagttgcaaaacacttaacactgctagtgggatggtttaagtaaaacaagtagcattcttaaactctctattaggtaaagaataggtaagtaatgcatatgtttccaggacattttcagtaagactgtttactgatagggttgtgtaatgctaatatacttactatctagttttagtattatttttttctcttgtcttggatggtttcaatggagtcttatgcatgcagatatattaaaactagtaataaagcaagagaaggaatgtggataaattatctctaatttctattttgttctatttctatttcatactcctgggaaagaatattaagtgggcatgtgtacttgaacagttgttctgttttttattagaaaagaatccgaatctataaaatgttttacatatttgccagggaaacagaaaagatatttgtacagctgtaagaattggaattaatttcattttactgacttttccttaacctaattctgaacacttttgccataggtttgagaataagttgttataaaatgactactattcttcactaatagtattggcatttcaattcctaaattctgttttttgattcttgaacatttctgaatttactttttttgtcttagttcttctacagaatcattttcttcttttttctttttttatttttattttttatttttgagacagagtcttgctctgttgcccaggctggagtgcagtagcgcgatctcggctcactgcaagctccgcctcccgggttcatgccattttctcctgcctcagcctcccgggtagctgggactagaggtacccgccacagcgcccggctaattttttgtatttttagtagagacggggtttcaccgtgttagccaaggtggtctcaatctcctgacctcgtgatccatccgcctcggcctcccaaagtgctgggattacaggcatgagccatcgcacccggccttctttttttctttctctttaacttctgagctgaaaatagtaccttttataaagaagtgctcaaacgatgattggactgatttctccttatttctctctttctctctgtctctttcactctctttttagaatttttcttttttaagtagagacgaggtcccactatgttgcccaggctgtcttgaactcctgagcccaagcaatcctctttgcctcagcctcccaaagtgctcggattacaggcttaagctatcacaccaggcctaggctaatttcatattttgagatggcacaaatttctttcaggtagctagcttttcctcctcctccccacttaaaatagatcctgatccagaagcctaatggagaaaatgaaaacagaatgttcacccataaacagtatctttgtattggaatcttttctaaaacttcttttgatctttttaggagatagtgtgggaatcagcaatctagtattacgtacgtggaatctgtcaccttgtttttttaaatacagcaaacctcatgaagtgaatttccatattttttcttgttcttgttagttttgcaccactcaggctttgctgtagaatttgatgtatatttgattctgtagagcatgggctattgatcttcactcagctttcagaggaatctgattagtaagtttgagttttttattattttttagttgattttgaagtaaaatacagcaccattttaactgataccatttctaaacaattttcagttcaaattttaagttagctaatttagagcttaagaaaattgctttaaaaacataaaattactggctgggtacagtggctcattcctgtaatctcagcactttgggaggccaaggcagatgaattgcttgagcccagtagttcaagaccagcctgggcaatatggtggaaccccgtttctacaaaaaaaatacaaaaagtagccagacacggtggtatgtacctgtagtcccagctattcgggtggcagaggtgagaggatcatctgagcgcagggagattgaggctgcagtgagccaagtgagaccctggtttcaaaaaaaaaaaggttactaattgcagtgccttttatcttatttaatgggcttagtcaaactaagatgatgtattttatcttataaatgttttcccttgaattttaactgaagaatccaatttgtacctctcacaaacagaatgtattagtaaggaaaataaatactgctttttattacttaaataggatatatttttctcttagggattttttttctattttatctcactttatcgtagtgctagaaaatttaatcattcatttgagatagggagaaaattaggtttttttttttcttctattttgagacagggtctcattttgttgtccaggctggagtgcagtggcgccatcgtagctcaccataacctcaaactcatgggttcaggtgattcaccttagcctcctgattaagctgggactgcagatgtgtatcaccactcctggctaatttttgttgttattttttgtttgatgaggtctcattatgttgcccaggctggtctcaaactctgggcctcaaatgatcctcctgccccagcctcccaaagtgctgggattacaggcatgaacctctgctcccagcccattttttaaaatatattcacagcattgtgcaaccatcactacaatcaatttacattttcatcaccctgaaaagaaactctgaaccccttagcagttcctctctgtttgtttcaattttccccagctccaggcaactattgatttattgtcttcataggtttgcccattctggacattgcgtattaatggaatcatataatatatagcctttttttttcttttttttttttgaaacagagtctcactgtgtcgcccaggctggagcgcagtggcatgattgcagctcactgcatcctctgcctcccaggttgaagcgattctcctgcctcagcctcttgagtagctgggactataggcgcctgccaccacacctactaattttatatttttagtaaagacggggttgcaccatgttggccaggctggtctcgaattcctgacctcaagtgatctgcccacctcggactcccaaagtgctgggattgcagccatgagccaccgcatctggccatatatattatgataggcttgtttcacttagtatgtttcttccatgctgtagcatgtattagtacttctttctttttcatggccaaatattccattatacagttacacaggtacactacattttgtttattcatcagttggtggacattttcattgtttccaccttttgatttatacataatcctgctgcgaacagtgacttttaaagtttttgtgtgggccgggtgtggtggctcatgcctctgtaatcccagcactttgggaggctggggctggcagatcatttgaggccgggagttcgagaccagcctgcccaacatggtgaaaccctgtctctactaaaaatacaaaaatgagctgggtgtggtggcgtgcacctgtaatctcagctactagggaggctgaggcagagaatcacttgaagctgggaagccgaggctacagtgagccgagatcacgccactgcactccagcctgggtgacagagtgaaacttcatctcaaaaaaaaaaaaaaaaaaaaaaaactgcgtgtggacataggttttcaattctcatgggggtgtgtgtgtatgcatactcatacatacatacacatacctgcaagataattgctggctcgtatgctaaatctatgttgaaccttttacataactgttgggctgttttgttttctttttattattttttgaaaatagagttggggtctcactgttgcacaggctgatttcctgggcatagtggctgtatcattttacaatcctacatagctgtttccaacgtagctgtatcattttacaatcctactagcagtgtctgaggtttcttatgtttttcacatcctcaccagcatttgttattgtctgtctctttgattatacccatcctagtgggagagtaagaagtagtatctcactgtagattttttttttctgtttacaactttactttaaaaattatatatgcacacatggtaaaaagttcaaaacgtgtgtaccaaaagatttaacagtgaaaatagaaaataagtgtggtccttgttttcttccaccaaggcaaatattgttataatctcctaaacaacttgtcttccagatttctcattttcagtcaatcttgggcattgacataaagaaattcttagacattgcttttattagatcatctcatcccttgctcaaaatcttcagtggccactgttgtttacagaataaagttgggatgctatacagggcccttcccagtggaacttctctttttcaaccttatctctcattatttcccaatgtttttttttttttttttgagacggagtctcgctctgtcgcccaggctggagtgcagtggcgggatctcggctcactgcaagctccgcctcctgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccacctcggcctcccaaagtgctgggattacaggcgtgagccaccgcgcccggcctatttcccaatgttaatctacttattgacctactaagctggcatgttctgtgtgttagacatcaccaactttgtgccttctttttttgtttgtttttgagttggagtctcactctgttgcccaggttggagtgcagtggcgcgatcttggctcaccacaacctctgcctcccgggttccagtgattctcctgcctgagcctcccgagaagctgagacgacaggcgcgcgccaccatgccctgctaacttttgtatttttagtagagatgggtttcactgtgtttcccaggctggtctcgaactcctgaccttgtgatccacctgccttgggctcccaaattgctgggattacaggcgtgagccaccgcggccccctgtgccttcttcttttactcctggatttaatcccaacgtgaagaatctaccttactaactagagttttagatactttttcaaaaccaagcccacatctgtcctttttagagtcttctctgaccttccctgctcattgtggtttgtttttattgcctgtaacaatggctgttaaactttacattttaaattaatttatgtttgtatgtatttatttgttgagaaagggtctctctctgtcacccctactagaatgcagtggcgccatcatggcttactgcttcctgggctcaagctgttctcccatttcagcctccccatgcaccaccctacctggctaatttttttgtttgttttttttagtttagtttttgtagagacagatgtctcactgtgttgcacaggctgatcttgaactcctgggctcacttgatcctcccatctcagcctccccaagtgctgggattacaggtgtgagtcaccatgcccagactttaacattttctttttagtatagaataggtcagtttttttccctctgatgagatcccatgctgactcttagttaaaacaaggctttggttggaagaagagctagtgatgtcctagctccctacttactccactttcccttgccttctggggtgtcctgaagacatcatagggtgtcatgaagtacagttggagaaccagtggtctccatcatgtaccaaacactcatcttcacgaagcagtatgtagtgtcttttttaccggtatattttctctctcccaatgcattaaacttttctggagttcagaaaacaaatttatagaattaaggaaatgcgtcccccccaaccatggtgtctagtatatatacagtgacttacagataacaggtgttcaacatatatatattcctttgattgatttttgaaaagtttacatgtatatattttttatatacggggtctcactctatcactgaggttggagtgtggtgatgcagatcttggctcaccgcaacctcctcctcccaggctcaagtgattctcccacctcagcctcccgagtacctgggaccacaggtgcgcatcaccatgcctggctaattttttatatttttggtagagacaggattttgccgtgttgcccaggttggtttcgaactcctgagctcaggcagtccacctgccttggcttcccaagtgtgagccaccactgaaatacttatatttttaaacttaatttatttatatttattatatttttatgtttttatattttaaaaaatatttttatactcactagacccaattttatactcctaaaccagggaataactgtttttttttctcttacataggcatgataccatagacaatgattaaaattgtaattaccattcatttcttagttttgtggctgggacactgatgtcttcaaatgttagtttgcaaatacagtcagccctctctatccatgggttacacagctgtgaattcaaccaaccatggatccaaaatatatgggaaatacgctggggctgtgggtcacacctgtaattccagcacttagggaggctgaggcagatggatcacctgaggtcaggagttcaagaccagcctggccaacatggcaaaaccctagctctactataagtacaaaaaattagctggccatggtagtgcacatgtgtaatcccagctactcgagaggttgagacaagcaatttgcttgaacctgagaagtagaggtttccatgagctgagattgtgtcactgcactccagcctgcgcaacagagtgtgagaagaaaagaaaaaaaactgtctgaaaagaaaaaaaaaaattatatgggaaatcaaaagcatctatactgaacatgtacagactttttttcttgtcattattccttaagcagtaccacaactatttccgtagcatttactttgtattaggtattataggtaacctagaggtttaaagtatgcgagagtatgcaaatactacaccactttgtatcagggacttaagcatccctggattttggtatccctagggggtattagaaccaatcccccatagatgctgaaggacaactgtagtgtgtgttggaataatttattttcaaatggatcatttggagaacactattctttaggaaacatagcctcctaagttctgttccatacatccctttcacctccacggcgttgtagcatcctgctttcatgactgtgtcatcactcggaaggaactgcttctcttccagaatgcttttcaagatctactctgaccacagctataaactttacacttctattctcttcttgcccctcacagtgttctctgttcctctaagatcttaaactctgtctactcctaatccagcctgctgggtgtggctggagaaagtcccactggggggctgattagttaggaatgtagggtttccagctcttgctggagcctcagaagagttcagcagacttttttttttttttttttccttaaacctatttctgcagccttgatgaccactccttccagtccctcacctatttgctttattcatggcagaggctctttcttcctgcttgtcagtacaaagaggcaggattcttcacctggatctgtggattctcaaagaatttgtggagagaattcagggcattgatgaccttggatgaagagaaatttacatctttatttacactaaccttcaagtgaaatttagcattttttgccatttaaaaatatgggcaacaaacaactagtagtattagcagtatttatgacttaagcacctatagaactcagttaatttcatatcgcttgatgttatgggtatctcaaattattattttatgtatatatatttttgagatggagtctcgctctgtctcccaggctgagtgcagtggtgcagtctcagcccattgcaacctctgcctcctgggttcaaacgattctcctgcctcagcctcctgagtagctgggattacaggcgcacaccaccacgcctagctaatgtttgtattttcagtagagaaggggtttcaccatattggccaggctggtcaccaactcctgacctcaagtgatccgcctgccttggcttccaaagtgctgggattacaggtgtgagccaccgcacccggcctcaaattatttttagaaacagaatcttgatatggtatccgctctggccttgaacttgtgggctcaggcagtcctcccacctcagcctcctgagtagctgggattataggcatgtgccactgcaccaggcttcaaattattatgtatgttcatcacctctttaaatttataatagttattaaacctgttactggatcttaatatttaatgctttaattaagaacatgtatgttactatgccaacagatttttttagtttttgataactgcatttcattgttacttgttctcatttgatttcctgtgtattttacgaatttaagtacattctgaatacggtttcataggcttccctaaaatattgaaggggcccatggattaagaaaaaggctaagaatccctaatctagaggctccccacagtcctcttttgtcatcatacccctaccccattctagcctgaggagcgtggctccacctgtgcccttggttttgttgttccagtccatacatcctgcacccttaactgtgtttcttatccccaacttgtttctttgtgttattcttcagtattatagtctttaatataatctgtataatacatggtgtagtagtatatgctcgtagtatacaattcagttagaacagatgagtattcaatgaaaagataatctcctctctaacccccagtcccacttccctggggaagcctgtgttcttgtgtacaattcagaaaatgtttatacacatattttttatttatttattttttgagacggagtctcgctctcgccaggttggagtgcagtggcgcaatcttggctcactacaacctccgcctccctagtagttcaagcaattcaaggttcaagcaattcgcctgcctcagcctcccgagtagctgggactataggcgtgtaccaccacgcctacctaatttttgtatttttagtagagacagggtttcaccatgttggccaggatggtctcgatctcttgacctcatgatccacccgcctcagcctcccaaagtgctgggattacagatgtgagccactgtgcccagcctgttgatttaattttaaacagagtttcgctcttgttacccaggctggagtgcaatggtgcgatctcggctcaccgcagcctctgcctcccaggttcaagtgattctcctgcttcagcctcccgagcagctgggattacaggcatgcaccaccatgcacagctatatttagtagagatgggggtttctccatgttggtcaggctggtctcgaactccggacctcaggtgatccgcccgcctcggcctcccaaagtgatgggattacaggcgtcagccactgcaccccgcctatacacatttttttgttttttgtttttttgagatggagtctcgctctgttgtccaggctggagtgcagtggcgcgatctctgctcactgcaagctctgcctccctggttcacaccattctcctgcctcagcctcccgagtagctgggattacaggcgccggccactacgcccatctaactttttgtatttttagtagagatggggtttcaccgtgttaaccaggatggtcttgatctcctgacctcgtgatctgcctgactgggcctcccaaaatgctgagattacaggcgtgagccaccgctcccagctatacacgtatttttaatgccactccagtctatgttggaaccattttacttcccctttcttattttcttcttgtgttcttgaaggcctagatcagctgttgctgataggctgtcactgtcactttagaaagcccagagccttttgttccttagaactttgtttttaattgtattgtagcactcattgtattcgattctaaaagatttgcttcatttctgtaactagtctcttacacccaggagctcctagttcctacaggaaatgctgggaattgtatcagtcaaatgtgaatccccacctcgtccagacttatgagtgcattgtaggtactcagtaagtgctaaaaatgactaaatagtcccactgataccaatctatatactgatactttatatagtatatagattggtccacatataacgatgacacataatgagaaactgtcttaaaaagttgttgaaagtgccgcaggaataggaattgatcaaaacaatatgattttttaggtttatatggaactttgatgtttgagaaaaggctgatttagttgagaagaaatggttagctgaggattttgatgacttctctggaagcacatttgagggtttgtgatgttaaatctgatgttaatgattatttcatccagttttatgtcattttatagtttttatacatttaagtatatttatttctaatgtttaacactaccattttagttatttgaccattattctggccctttaaaaaatgctcagacaagtttgaatgatttttcagaggcattattggctcagaggtaaaagaggaaagattgagaagctgaatatgtactctgtttcctgggtatggggctggggatacccagaagaggttcacacgttggtcgagacatttctttatgaccaccagcaggtggcatcaccggcccaaaatgactaagtttctgcccagaatcagaagagaaggtgttgagagcccactgctgtgggggtagcatggaggtgggatacaggggctggaggtgatacaattttgtttcttcctccaacatcgcctgctagtctagaggcttttataaattgaaaaactaattctttatcatctcatctgatggtttttatgtttttccttttttctctctatacctgtagttccttcagaaacaggtaacacttttctaatagtcacgttgtattcttgcatcttgttgttacaatgcttttgtttctcaccataggggatgatggaaaattaatattctttgacttatggcattggtaaaatctgcatgcaaattcccacagttgcctgtagattagagccagttgtttttttctcaactttgcaggaatcctggttacaacattgtactatttactaccaacagtgttttttttttttaaaatccagacttgctgggcatagtggctcatgcctgtaatctcagcgacttgggaggctgaggtgggaggattgcttgagcccagggctgcagtgattgcggcactacactccagcatgagtgacaaagaccccatctctgaaaaaacaaaaacaaaaacaaattttttttaaagaaacagaaacaaaaatccaaacttgtaaccactgtaaaacaaatcagaatttacgatagtggatattattaatagtgcagaatggatacccagatcttgcttcctttctagctaatgatgcaatgttggcctgaaatgcattacttatagccagggattttctcagcatcctgatgatatagcctcatttcgtgctaactctccacttctgcacatcttcccctaagtcctttactcatctttagaaagagctacttttggtgaaattttaaaaccaaggaatatcattctttatagaatcacacttctgtgttttccccttccccatttctgtctcgaaagcgacagactgctacataacctgtgaatacttttttttaaaaaaagtttggtattgtaaacagaagatttaagattaaaatgtagcattgagaaaaatagatttattaataatgccctcttaacacaacctaaattctggtcagtggaataaagcctgggtcctaaagttttagacgcttgcttgcttttccacactggctcttacttggggatccttttagaaatttgtttagaataatactgtaaaaacatatttaagctactttgtgtgtacatttgggatcttttggtttgaagacggcttgactcaagactttctaaatattttcacacacacacacataccctgtagtgagaaaaaaatccgtttatatggttctataaaaatctctagctgcttcgagctttaatttcttgaatcaaaagagtattgtttttaatactgagcttctatctaaataaatgctttatttacttaaatgtgtgcttttcaaaaactagtatgattaagacattaacaggatcttagacgtaaaggaacagtcctgttgcttcttccagaagataatatgactcgtttggaattttcctatagtgtagttttttgtctagtgttgtgagaattaaagggatttcaggatcttaaggtaggttattatttgatgttttcttggaacattttacattcttgaaaatacacatggctaaattaatttttgccagcaatccacataactttaagataatgtagagaagaacgtgattcaggttagtatcaaataaggtcagatttctagtgccatcagtagctttcagcaaagatgaggtgttggtaagatagcattagtctcttagaatctcttagagagattttccaaaattcagccatttctagtgaatgctccattccacccccagctgagtcctgctgctctggggaactccctcagcacactcttggctcttagaattgctagcaatgggagtagtgctgctggtggagctggcagctaagcccagaggtggattaatgcttttattccctgatgtacaggtacacacactcatacctacccacacctagtttgggataagaagaggttagaattagctaggcttgaagttccatgcttaaatttgctggctcagatttcttattttggcatcactttgcccattagggagacaatgacagttatagaagcattgccaaataaaaaatccatctggaataacctcttttgtaggagtattgtgtgtttagttgttgattcgtcccttcctcctcttagtggcaacttacagtactgggaaggaacagtggctgggagcttatattcctcagcagagccagatcagcagaagtattactccttagttcgtagtaggtggtaccctatgggtccagtcatttaaatgcaagcctgtatctacagagcgtttcctagtgccatcattgcccagtgggcctttatttagctgagtctaactcccaactagagaaaatttcctgtgccagacagcagtatggtcagctaacatgtggatgctacatttgctttcataagtcagtactcttcaataacattagtagaagagaagaggacacaaagtgagagtgtgttaataggaagtccaggtatgcctgctacctgaactttctgagacaggtaatactgtagggcctgaactttgtagcagagtggttatatatgaagaagtgggttctgggaggggttaaaccacttagaatggcttcatttactaatggcaagagtttgctgggatattgaccactgtacatagacatgaatatggaaagttaaaaacaaaatccacatatatttggctgcaagtactccgaaggtatatctaattagtgcatccattaaacaaaagagatattttaggccgggcatggttgctcacacctgtaatcccagcactttgggaggccaaggtgggtggatcacctgaggtcaggagttcgagaccagcctggccaacatggtgaaaccctgtctctgctaaaaatacaaacattagctgggcgtgttggtgggcgcctgtaatcttagctacttgggaggctgaggcaggagattcccttgaacctggaaggtggatgttgcagggagccgagatggtgtcactgcactccggtctgggtgaaagagcaagctccatctcaaaaaagaaaaaaaaaaaaagagatatttttgatggattgatagaaattttctttttctttttttttttgagacagggtctcactctgtcgccaggctggagcacagtggcgtgatctccattcattgcaacctccacctcccgggttcaaacgattctccttcctcagcctcccgagtagctgggactacaggcatgtgccaccatgcccaactaatttttgtatttttagtagagagagggtttcaccatgttggccaggatggtctcgatctcttaacctcatgatccacctgcctgggcctcccaaagtgctggtattacaggcatgagccaccacatctggccagaaattttcttggtcacttctgagacatgcagagtaattacctgtaatataatttaatgaattatgtcaatatattaaaatatgcttcatgtgggctgggcatggtggctcatgcctgtaatcccagcactttgggaggccaaggtgggggtatcactaggtcaggagatcaagaccagcctggctaacacggtgaaaccccgtctactaaaaatacaaaaaattatccgggcgtggtggtacacacctgtagtcccagctactcgggagactgaggcaggagaatcgcttgaacccgggaggcagaggttgcagtgagccgagatcacgccactgcattccagcctgggcaacagaacgagactctatctcaaaaaaaaaaaaaaaatgcttcgtgtggcttaaaattatatgaaaagaaaatacctttactgatagtcatctgtgattccatttgctaaattaaacgtgaaagcatacttttactgaatactatatattccgtatcagtttagatagcagtttatcttcacatacataagttttaagtttacctttattatagtgcattggtcttttgttttcatcaacctaaattatgttcaataaatgtttctgttagattttaagttaaacaattatgtgaaattcatttttcgtaattgttttttaacatatgtctttgttggtaattcacgtgtgtgagtgtaactgattgccagattatataaactttcaaccaaaaccattctttgcagatgcttttactgactctgctatcagtgctaaagtgaatggcgaacacaaagagaaggacctggagccctgggatgcaggtgaactcacagccaatgaggaacttgaggctttggaaaatgacgtagtaagtaacatctttgtaattattgctagactctggtcagtatgacatcctgtcacttggttgtaatttaaatgtgcttttgttgttgttgttattgtagtgagtgtatttagagcagcaggtttgttgtataactagagactttctcccaagcaatatataaagaaaaatgtttgtcattttacttgtaggggttaagcaggagtactgtctgttcttgtggatgctcatgaattacttctttgtgattaaaataaataataagaagtagcttaaattaaaattagaaaccatgggaaatgccggtgtgttttgctttaacacccagccaaataaggtagcctaaggaaagtggtgtcttaattgttgacttcacctagagaagaggttgaagtaggacattttaagcctcttgtctgaagaaaaggttgtcattaagataaataattaggttacattggaattaaagcattacataaatttcttggtcttaaatttggattattctccacaaaattcttttatttctaaaacgcctcttgtcacatactagttttgtttctctctttaatgcattatctgtacttgaagtgcttagctgggtatgctggcacatgcctgcagtcccagctacttgggaggctgaagcaggaggatcacttgagcccaggagttggagtccagcctgaatgacataaggagaccccttctctaagaaataaaaataaaaacaaatacttaataaagactctgtctttaggatagagagcatagagatataaagcaaagtgtcttgccaaaaatgagtgttatggtaccaatatttgagtagaatgaagaatcttccattgagtagaaagagaatttgtaacatatctgtgtttgatgtttaaggcataacagcttaataatgacactcttcctcagacaggaagcctgaaatgtcctactttgacctaaagtctagtaataaaactggacatacacaggcaacatgtcattaattctcaaactttaacaaatcatatataacctaatataatggttctcaagtctgtacatcacgtcacctgtatgaaaaatatgaggaaacagagacttcttttacactattggtgaggtggataaattgatagagtctttctggagagaatctggcaatgctaatcaaaatttaaaatgcacatacactttgttccagcagttctatctctagtaatttatttttgccctcatatatccataagacatgcaaataattatatgtgaagattttttttttttctttttctgcagagacagggttttaccatgttgcccagggtgatctggaactcctgagctcaggtaatccacccacctcagcctcccaaagtgctgggattacaggtgtgagccatcatgcctgaccaggatttttttttttttcagcattatttcttttgttgttgttgctgttgttttgagagatggagtctcactctgtcacccagactggagtgcagtggtgcgatctcggctccctgtaacctccacctcctgggttcaagtgattctactgcctcagctttccaagcagctgggactataggcgtgcgccaccacacccagctaatttttgtatttttagtagagacggggtttcaccatatgttggccaggctggtcttgaactcctgacctcaggtgatctgcccacctcggcctcccaaagtgctgagattataggcgtgaaccaccatgcctggccatagcattatttctaatagtgaaaaattggaaacatgctaagtgtctatcaatatagcatgagttagatttatgatgtcaccattcaattgaaacactacatatctcccaaaaagaatggtgttccaatatggaaagatatctaagatttattaagagaaaaagcacattgcagaacactgggatcctatttgcttttttttttctttttttgagacagagtcttgctctgtcacactgcaacctccgcctcccgggttcaagcgattctcctgcctcagcctcctgagtagctgccaccatgcccagctaatttttgtgtttttagtagagaaggggtttcaccatgtttgtcaggctggtcttgaactcctgaactcgtgatccacctgcctcagcctcccaaagtgctgcgattactggcatgagccaccgcacctggccatgaaatttttttttttttttaaagagctgttcatattcttattgcctagaagatgtctgaaattacacccaagaaactctttttgagacggagtcttgctctgttgtccaggctggagtgcaatggcgtgatcttggctcactgaaacctctgccttccaggttcaagcgattctcctgcttcagccttctgagtagctgggactacaagcgcccgccaccacatctggctaattttttgtatttttagtagagacagggtttcaacatgttggccaggctggtcccgaactcctaatctcaggtgatccacccaccttggcctctcaaagtgctgggattacaggcatgagccactgcgcccggctgaaactctttttttttcttttaagatggagtctcgctctgtcgcccagacttgagtgcagtggtgtgatctcagctcactgcaagctctgcctcccgggttcacaccattctcctgccctagcctcccaagtagctgggactacaggctcccgccaccacacctggctaattttttgtatttttagtagagacagggtttcaccatgttagccagcatggtctcaatctcctgacttcgtgatcctcctgcctcggcctcccaaagtgctgggataccaggcatgagccaccgtgcccggccagaactcttaatagtagttatttatgcacgctgggattggaagacatttactttttactggatgtctttccgtattgtgtgcttttttttttttttttttatgtagggcatacattacttaagtaattttaaagcctccataagtaagtgtgatttcctgcccatgtgtttggcaaaaggaattgcattggtggtagacttacattatagtcttacctggagtagcacaggaggacccaaggttaataggtgaacttcgaggcaagccttagcattgaggttgccatcagcattgcttggttgatgtgttcattcttctgggatggattacaacctttactggactttatacttttcaccagtaaggctttaaaaaaggagttgaaacattagagaataattatccaggcagtaatattcactggtaaatagtcttccagcctgtggcccaattggttgattcttttacgttaaagaatgcagcctcagctgctctgcctatggagtaggattcttttatttactttcttaataaacttgcttgcccctggctcccccccaccaaaaaaagaaggcagcctcccttttgcgaatggtaatttcctatagtttcctcgtagaattgtggagttacctatgctgaggttataggttagggtattgagatccagagttgccacttctgaggtgtcacaactgctaatggtaaaaccatttctaaagcccagttcttgtgactttgtccagtgattgcctgttcaccgtttcatgctgccttcccatttgagcattcccaggaggaaggggaggttgccagggacctagtaccatagtccgaccttggaatcgttgaatatgagggaaagcgttggcttctcccttctttctcccaaacattggaagtatttttggctgttaaaaagcaccccttgttccatgtggaatcccttgtttaaaagaagtaaaatatgtacctcctgtcctccacagacctgaggaccagtgtgatctcaagaaggttacaggtaaatgtagatgtctctaactgaaaggtggcttttacaggttagagaaaagagagaaccctgatctgaaggctattttatgaagtaattaaaatgttctaaactttaaaaataactgctcaaataattgtgttgtatagttacttatcaactggaggggctgataagtatttttctaaaacatttttaaggaaattttttcctattttctaatttgctaattttgctcaagtagtttgttagatattgttaatatagatgttggttataactgaatgaaagggaacaactactttgacattttgaaaaacaagcttcattttcttctagtctaatggatgggatcccaatgatatgtttcgatataatgaagaaaattatggtgtagtgtctacgtatgatagcagtttatcttcgtatacgtaagtttgaaaagtttgtttttattttagtgcatttgtctttgattttcatcagcttaatttatgatgaataaatgtttgttagtttttaagttaaacaattacatgaaataatttttctcttattaccaactgtgataaatttccattaaaaaaagggaataaatgtagtttgcctataccctgtttttatgctctaaacaaattttggttttgtctttttttttcttttgagagggaatctcgctgtgtctccaggctggagtgcagtggtgcaatctcggctcactgcaacctctgcatcccgggttcaagcgattctcctgcctcagcctcccgagtagctgggactataggcgcgtgctaccatgcccatctaatttctgtatttttagtagagacggggtttcaccatgttggccaggatagtctcgatctcttcacctcgtgatccacctgcctcggcctcccaaagtgctgggattacaggtgtgagccactgtgcctggccggttttgtcttctaagttgttaaaaaatatctaaatttgcaagggcagagattatggtgaacagtttaaccagtttttgaaatatgttcctctggagaaaaggtaacagaaaaaaaagttagaattttgatttataaatacacagatcactataacttttagttttagttttagttttagtttctgtttttaccagtattctaaactctaaactttcttagtagttgattatgacagatacataaactgtggctttaaaggactcattttgcttttcttttcctcatgtttcagagtgcccttagaaagagataactcagaagaatttttaaaacgggaagcaagggcaaaccagttagcagaagaaattgagtcaagtgcccagtacaaagctcgagtggccctggaaaatgatgataggagtgaggaagaaaaatacacagcagttcagagaaattccagtgaacgtgaggggcacagcataaacactaggtatttaaaggaaatcatgatgcagtattttggatacacaactcaaggtctgtgtgagacggtgtattgttattatatttcctcttcctttaatatagcttaggtagagaatgcaagtagaattggtttaagatctgttagagaaaaggttatggtgatcttggaaaatatgcttttgagagtaagctctgtggagccaagtgttggtatatcacggtgagcaatccaagatcttgaagagcttgttaaaatagttatctggtgggggacacgtgtaacaatcacagcagtacaatatgatttgcttggttaaaggcatgttcaaagtactaggaacatacagaatgaggaggagctagcataacctgtagagtcagagaaaacctcattgaggaggtgacattttgtgataagataatagggtctttgacacttagagaagagttgggagaagagtttatcacctgatgaaaagccatgtacaagcatggctatgagaaaatttggccagctcaggagagggctggttgttgcatgtgtctggaacacaggatctgtgtcaggtgcagcagtggcagttgatagtaggaactgaggtcattaaaggacttggcatgtcatgctaaagagcaccctgttggaaggagatggggtgaataaaccctggggcattgaggactggctgagacacagagaacagttagtgcactgaaatagttcaactgtgagaatttggtaaccacctagttaagggatgagcctgaggtttatttgataactaagtgacttaatggatgtactggtaagagagagaggaaacatggagcaagtttgaggggaaaaacagtgactccgtttgtgcagctaattgcatatgtgggcttgtgggtctttcatttattcataaacgtgttgagaaatacctgctacctatctagtaaagtaagagatgcatcctctcttaaaggcagtcagcttagagtctggtgatttgaattgacatgtccactgatagatgttgacactgtgagactggcggttcagtttgaggtttcatcagcattgccgatattggagccatgaaaaaccaaagaacagccagtgagagaagagatctcagagaaaataaaattgagaaagtgaaggacaaaaaatgttgtgaagatagaccaagattgatggaatcagccatagagaggtcaagtgggatgagaatgagcacgcatctgttaaactttgtgcttaggagcagaatctaagggaagggacagtccagaggttagaactcagggtaagatggaagaacaggggcatctgggagtgaggcagtttggtttagtgtagaacctttttgtaacaagcattcccttctgtctagatgacttttagatatgtttcattggcttggtaccttttagaataaaatgatttagaggatctctcattttcagggaaaataaatatattcctcctggacaaagaaatagagaagtcatatcctggggaagtgggagacagaattcaccgcgtatgggccagcctggatcgggctccatgccatcaagatccacttctcacacttcagatttcaacccgaattctggttcagaccaaagagtagttaatggaggcaagtattttgaccagacttgtcaatatcattgataaaatagttttctaaatacttaaaatacttaaaatagtttacataactgatatgaatgtgcactttaatgatttggtgagtagctttcacttcagcattacttaaaattggcttttgtggatattaaattagtaaaacattgtatatgtcattgacatatatattatttagcatgatgaaatattcatgatgtactaagataaagtgctacatttaacccaagacaatcacttggccaaaaacacttcacatataaagaaattggaaactttgggtaggttctcaattttaaaaacactggataataaaattttttagacataatttatatggaaaattctaacctatgtgcaacactgtggttaatatagatcaattttcattatttgtttctatattatgcttacttcaagaaaggatctgaggtaacttataatacaagacatgatcaagagtcatgtgaagaaagtgactagagaaatttgcttaaaaaacaacaaaaacaacccttagtctaagggtggatgttacagtttagcaacttaagtaaaagaaacctgaatctttagtaggaagacattttttactctacctctaaatctaggttgaatatatcttgtaggttgtggatcttttccataaatcagggatactgaacaacagttctatggatggtatggaaatagtaatagcaatagtatgttactaactttgtgggaaaagagtggacattcaattttagctatttaaatttggaaagttagatgaaaatagagaacactaagtttccaatttcatttgttttcattgagtcttttctccagaattcctctccaaatggacactcttgagtattttcagtacttaatattgggggtgaaatttctttgctcactgaggaaagattttagttgtttataaacagaattttaaagttaaaaaacctgaagggggctgagaaatatatgatacttaagtgtgtggaaccctatggagaggagacctggactgtttgataagattaaggtaagtgatatgtaatgttaaatactagctgtatctttacctaggcatatccatcagtataaatttatttggtgatgactgctttgtagttgcagtatttattaagcagtcgcttagataagtgtttaactgtataaattatttagaaggtctccctttttctagtttaatgaggtcaagactttttttttgaaatagcaatgaatattatcatttgatactcacaggagtcacaaactctagaagagtaatgttttatttctacttaaatgggacttgcttaataagattccaaactgagttctgggttcaagtgtaaacctgatgaaaatcatagataattgtaaggaaccagcatttctaattggatataatagctactgcttattttcgttatgcctcagagttaaaactaatacagtaaataatcttactcctgagtaggaattattgtgatttattatgtgaaattatctagtgtatgttatattcctttaaacaaccagttactgagaaacagttatagaagcaggattaataggcaaagtcttaactgtcttcttcaatagtgtgtatagatcctaattaaccctttgggaacgtgtattcatttaaacagacttaatcttaaggaggttaaagtaaaatgtgaatttatgtcagttaagttatgctaaaacttatcacaaatcaaatgactgtcctcaaagggttaaaatgtacaagaaatcatttttgtcattttactttttttctgtttacttttttccctcatttttttctttagtttttatactttccttcatatcatttgttctgtcaggtgttccctggccatcgccttgcccatctccttcctctcgcccaccttctcgctaccagtcaggtcccaactctcttccacctcgggcagccacccctacacggccgccctccaggcccccctcgcggccatccagacccccgtctcacccctctgctcatggttctccagctcctgtctctactatgcctaaacgcatgtcttcagaaggtacaataccacaatttgttcatgtttttgtttgtctttgtttaactcctatgtgagtttataattacaaaatagtttcctcttcattatttaataacctataatttctgtgttttaactttagtttattaaaactatttctattaaccttttgttcattagagagaaatttgataaatgtgtgaagctataaactctcttgaattgttgttaaaaagggggtttatctctgcctgataattatgcttctttacagccccagaagggtctgccccacagccttccccctccttatttgcactgtatacagtagttaaacaaatgaactttcttcagccagtcttgaacttaggttcattttacagctctttggccaaggtcctagtgaaccttcctattggccataagcagggatggtgttttctgggtcttttttgagagcgacagcccatgtagctgactttgcgtgtctgcccttagattaaagtagttgatttttagaatgccagaagaattctaaatttaactgagtaatttttttaaagttagctttgcaatcttacatagtgaaaggctgctttaatctggaagaagtccttgatctgagataaaattgataaaaacgacatatgaatttgaatatttagctatttctttcctcgtcaaaaataagaataaaatcttgtaattcttattcagtatttggcgctaaatccatcattgccacatatcaaatacagggatatgttgtagaaaggtaacattctaatttaaatgccacccatatattaaaaacctgttttctgaatcataatgtccttttgatactagttctgaatatttgtgttaaaattttaatctgatttgttcattaaaattagttaatattgcttatgttgggactaataaagttttccgcacaaaatgtgtttctcctgcttccctggagaaaactgtattggctacttttaaataaattgttaccatctaagcaggcaggtcatatgactttgactgaagcatctaaccttgaagagcaagttccactgattttcaaggtgacttctttgctcaaaagggccttaatagtggtcactaaatgcaaaattctgttgatatttttcttgtagtccatcatttgagtaagcgatgtttatttaatgagaatatattaaataaaacatgatcattaatgactgtgaacatctttattacattaagatttaaggactgctcatgtattaacttcacacagaaatatactttctgtgtcattcagagatgttgaatatttccatttgaaaattatagtgtataacattagcattcttctaaagatcatgttcgtgtttaaattcctgttggaagccaggcatggtggctaacgcctgtaatctcagcactttgggaggctgaggcaggtggatcacttgaggtcaggagtttgagaccagcctggccaacatggtgaaacctcgtctctactaaaaatacccagctacttgggaggctgaggcaggagaatcacttgaacctgggaggcagaggttgcagtgagttgagatcgtaccactgcactccagcctgggcgacagagacagactctgtcttataaaaataaaaataaaataataattctattggcaacatatattaatttgaagttctaaagagtttggcagccgggtgagagagtgaggagatttggctttgacattagggaagttttcgcttggtgttaacaccagtaggcttctctgatgagggccattctgtccactcttttacctgatagattggtctaatgcacagtagactgatttagaaagagtagtcactagtggcatggcagaatcaataatgtagaattttgacaattcatatagtgctgatttctcccccaaatgtcagttattttggtcatctattaatagactaatacaagtcatccctttaatagaattttcagctcacagcctgctaagcctaagaaactgcttacaggttactgcttactgttttaagccgagttttaaaattgatgatcatgatagaagagataaataaactaaaattttagagaaatttaagaagggtatgtacatatgttttagtggtatcggggtgtatagggattaatagtcttctgtttaaattttttttttctaattttagaagtaatgtagaaaattcgggtcagggaaaggtaaaatatatggaaagttaaaaatattttatcatgtagtcataatttctagtaacatatttctttacaaataagacatagttgaaacagattgctacagttcttttaagagttgacatcttattgttgatttcttaccaccaacttcatccctccctttctttaaaaataaagggaaataataaaatttatttataaaactttgtggcattccacaaaataattctgaaagaattagtatggccaaaaaaatatgtatggtgttttttttttttctatttttaaccaaggaaaaactgtagagtgagtgagtgtgtgtgcatgtgtgtgtgaatgggtgtatttagcagaaaagtagtactgatgaatatcatggaatttatgtgatgttcactgtttcttccttagggcctccaaggatgtccccaaaggcccagcgacatcctcgaaatcacagagtttctgctgggaggggttccatatccagtggcctagaatttgtatcccacaacccacccagtgaagcagctactcctccagtagcaaggaccagtccctcggggggaacgtggtcatcagtggtcagtgggggtaggtaacacttgggcataatgatggtactcattttgtcattacactagatataaagagggctgagctacaactctgtttgaggaagtgtaagtatgtatatgttaaaaatagtagaatcaccaggaattgggaaacccatatttttattctgggctctaccacttattcatcatatattaaagcaagtcagacactcattctgaagttgagatttcgcagtgagtaaagtgttaataattcttgcctagtctacattatgggattgtgatgagattcctataaggttcataaatacagatatattgtaaaactataaagttttgtaaagtacctctctaatatgaggcaaacacagtatgtaacactatttggagggaccgtatttccttatctttttagcagctttgtttatcagtacattctataaacatttatttttggcttacattgtagtgtgtttctatagcatctgtatatggcactaattcccaactatatttccataataaggaatatcaaatacaaataaagggtccaagttttatttgtgattagcataaggaatatgctgacagcagctataaaagtataaaaattaggctgggtgtggtggctcacgcctgtaatcccagcactttgggaggctgaggtgggcggatcacaaggtcaggagatcgagaccatcctggctaacacggtgaaaccccgtccctactaaaagtacaaaaaaaattagccgggcatggtggcgggtgcctgtagtcccagctacttgggaggctgaggcaggagaatggcatgaactcgggaagcggagcttgcagttagctgagatcacgccattgcactccagcatgggcaacagagcaagactctgtctcaaaaaaaaaaaaaaaaaaaaagtttaaaaactagacgttgacatgattttacaataaggctgactgcttttgctactttgccaatcagtccttagtgctttgttcccataactgtggtaagcaagagcttacaaagaatacttaaaacaaacaaacaaacaaacaaaaaaaacactttttctcttttaatcagtccagagaacctttaaaagaaacaagatcggccagttgctgtggctcatgcctgtaatcccagcactttgggaggctgaggtgggtggatcacttgaggtcaggagttcaagactggcctgaccaacatgatgaaaccccatctctactaaaaatacaaaattagctgagtgtggtggctatttgagaggctgaggcaggagaatcatttgaacccaggaggtgaaggttgcagtgagccaagatcacaccattgcactccagtctgggtgacaagagcgaaactctatctcaaaaaaaagaaaaaagaaacaagatcttcaagcttaaggaaacaaaaacaaaactcagctgtgttaaatctgtttttagttgctatacatttctgctcagcttcatgtgatgcacattcatgtaattgtatcctaaattcctttgtactttttattttcttccttggtcttcaattatcttaagactaccaagaaaacaaaaattttaaaaatcttcttcagccggtcaggcgcagtggctcacggctgtaatcccagcacttggggaggctgaggcgggtggatcacgaggtcaggagttcaacaccagcctggccaacatggtgaaacgtcgtctctactaaaaatacaaaaattagctgggcattgtggcgcgttcttgtaatcccagctgctcaggaggctgaggcaggagaattgcttgaaccaggacccgggaggtgtaggttgcggtgagcggagatcgcgccactgcactccagcctgggctatagagtgagactccatttcaaaaaaaaaaaaaaaaatctgcttcagctattctgttaatcttttgacattacttagatggtctggaaataaattttgagaataacatgattagaagtgagagagtataagcatagttttggagatacactcagaatagcattatagattttctctttttactaattggaaaaatggcagttgttgaataatagttttcttccgtgacccttgtgacttaaaaaaaaaaaaacactgaaatgaaataatcgaaccattttctctaaacctttgaatctgagctctgcagttaggtttataatggtatatgaaacctattagatatatacttggaagtcatatgggatacaaaccctgcttttattatcttccccttttgactaacttgggtctcaagtttccttaattactgcacagtggaccttgatgttgctataaagaatgtgtagggctgggcatggtggctcatgcctgtaatcccagcactttgggaggccaaggtaggcagatcacctgaggtcaggagtttgagaccagcctggccagcatggtgaaaccccgtctctactaaaaatacaaaaaaattagctggttgtggtggcgagtgcctttaatcccagctactccagaggctgaggcaggagaatcacttgatacatttagttaggagagaaaatcatacttatgttagtaattgctgctgttcttcatatacttgtggttttgattgccagcaaattcctaacattttggaaaagaaaacagtaatgggataaagggtaagggctagagaggacagttttatttacctagatcttcagagaagcctgaagcctcttttaggaagtaacatttgaactgagaatgtaataaatacattttccctttcttctagttccaagattatcccctaaaactcatagacccaggtctcccagacagaacagtattggaaatacccccagtgggccagttcttgcttctccccaagctggtattattccaactgaagctgttgccatgcctattccagctgcatctcctacgcctgctagtcctgcatcgaacagagctgttaccccttctagtgagggtatgtaacaaagggcttctggatccataatctcagctgtgaaattgaatgttagagggtgatattatatgaaaaaattctaggttatttttattcatagacaagtatttttagtgcacatttaaaagtttatgtaaattttgatgttgtttaatactactaatttaatatagtgtctgtgttacaaaggttaacattcctgggtgtcaaatacctacataaataaaattattggtgtttcatatgacatctgcaaaggaaaaaaagcctctgtttaaatgaaagcattattttccaaaaacataggaaatcaaaattattgttcagtgttttcttgttttgcttttctaacttatctgaattttttttaaaaaattgttttctagctaaagattccaggcttcaagatcagaggcagaactctcctgcagggaataaagaaaatattaaacccaatgaaacatcacctagcttctcaaaagctgaaaacaaaggttagagtttaaagagtcattaagcttaactgtaggaataggaagaagtatgtctaatttcatgcccatacagaatatttttgttcaacatttcttcttactattgtgatagataaatgtattgcttgacaaattccaaaatccaaatttaatatttgaaattattttctgatcttatatcttattctaatttctatcatctcatactaaaaagaatgtgatgttaaagtttaaaaataaacctgtgtcttaacagttcttaattttacaggtatatcaccagttgtttctgaacatagaaaacagattgatgatttaaagaaatttaagaatgattttagggtaagtattgtactaactgatgaatttgagttttagaaaataagcattactaaagatttatctatttataaaaatgcgttatgtatacagtcagaaacatcaaaccatatatgtagaaagcagaacatttttaaagtggtctttgcctatcctttaagtgggataactaaaatcatgagatttggtaacaacaatatgtaggtatcaaatgagagtatagccctgacatttgaaaccaccatagcacagcttactatttgatggtcatttgtactttgttcagtgaagctagatattagtagagcaaggccaagtcattaataatctagtgtggcaaatggaagatgtactggactctggtgttctgaggtagttggagatttatactttgtacacaaatatattgtggtcaaaatctttctgtaacattatttctctgtcttagcacaggctttacttaacatctctccttgattgtcatttcattcttttgcatgttatttactataggtatcgaggtagattttgagaccaaccaataaatcttcttgaaacttagcttcttagaaaggaaaatctaaataccagccttttaaaaaaagtagctgaattaaaggatgagtgaaccaaaggcaaaggtagcctttcctcagcctgtgttttagctttctaaatgttaacaatagcttcattcttgacttattggtaacattcaaaatactacttattatttcatactttagcacatgtatctattcagctttaatgctattaacagttgttaacctaagttttcatttgttggcgggcacggtggctcacacctgtaatcctagcactttgggaggccgaggtgggcagatcacctaaggtcaggagttcgagaccagcctggtcaacatggtgaaaccctgtcttgaccaaaaatagaaaaattagctaggcatggtggcgcacacttgtaatcccagctacttggcaggctgaggcaggataatcgcttgaacccaggagacagaggttgcagtgagccgagatcacaccactccactccatcctgggcgacagagcaagactgcatctcaaaaaaaaaaaaaaaaaaaaaaagtttttcaatttgttaaacaatagttaacacatacaaatgatacaaagaatattgaatatgatcatgtgcccactacccagcttagtaaataaagcattctaacacagttaaactcctcttatgtatctgcccctcctcagctgcttccccctgtttccttccaaaaggaagggtttcttttctgtgcagttctttatatttatactgcatatgaatatatctgtgagcaatagatgatattttgcataatcttaaatttgctataaagtcttttttttttttttaattgatcattcttgggtgtttctcgcagagggggatttggcagggtcataggacaatagtggagggaaggtcagcagataaaaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaagcacatcttgcaccgcccttaatccatttaaccctgagtgacacagcacatgtttcagagagcacagggttgggggtaaggtcatagatcaacaggatcccaaggcagaagaatctttcttagtacagaacaaaatgaaaagtctaccatgtctacttctttctccacagacgcagcaaccatccgatttctcaatcttttccccacctttcccccttttctattccacaaagccgccattgtcatcatggcccgttctcaataagctgttgggtacacctcccagacggggtggtggccgggcagaggggctcctcacttcccagaaggggcggccgggcagaggtgccccccacctcccggacggggcggctggctgggcgggggctgaccccccacctccctcccggatggggcggctggccgggcgggggctgacccccacctccctcccggacgggttggctgccgggtggagatgctcctcacttcccagacggggtggctgccaggcggaggggcttctcacttctcagacggggcggctgccgggcagaggggctcctcacttctcagacggggcggccaggcagagacgctcctcacctcccagacggggtcgcggccgggcagaggcgctcctcacatcccagacggggcagcggggcagaggcgctccccacatctcagacgacgggtggccgggcagagacgctcctcacttcctagacgggatggcggccgggaagaggtgctcctcacttcccagactgggcagccgggcagaggggctcctcacatcccagacgatgggtggccaggcagagacgctcctcacttcccagacggggtggcggccgggcagaggctgcaatctcggcactttgggaggccaaggcaggtggctgggaggtggaggttgtagcgagccgagatcacgccactgcactccagcctgggcaccattgagcactgagtgaacgagactccgtctgcaatcccggcacctcgggaggccgaggctggcagatcactcgcggttaggagctggagaccagcccggccaacacagcgaaaccccgtctccaccaaaaaaatacgaaaaccagtcaggcgtggcggcgcgggcctgcaatcacaggcactaggcaggctgaggcaggagaatcaggcagggaggttgcagtgagccgagatggcagcagtacagtctagcttcggctcggcatcagagggagaccgtggaaagagagggagagggagaccgtggggagaaggagaaggagggggagggggagggggggagagggagagggacaatgatgtcttgctgtaggtattcttccccatttgaattttttcctcagcattattttttttaacatcattcagtctcctcttatactacacttggattgaatttaatatctcatgaagaaaaaacatttctactttgaagcatgtgaattagcatgtttttataacagctttattgagatataatttacatatataaataaaccgtttaaagtgtataaatcagtggtttttaatgagatataatttacatatataaatcaaccatttaaagtgtataaatcagtggtttttaaaatattcacaatgttgtacaaccgtcttctcagttgattttaaaacatactcttcacccccaaaagaaaccccgtgcccagtttagcagtcgttccacatttgcctccagcccttctctttcccctactcccaaccctaagcaaccgttaatctactttctgtctctatggatgggcttatttggggcaaattccatttcatacaaatggaataataaaatatgtggcttttatgactggcttctttcactcagagtagtgttataaaagttcatccatgttggagcatgtttcagtacttcatttctttttgtgactgactaatattccttgatgtggataataccacattttgtttatccattaatcagtttgtagctatttgtggtgttctcactgtttgactattctgaataacactgccacaaacatgagtgtgcagtttttttctcgtcctatcttttcatttcttttgtgtacctacctaggagttgaattgctgggtcatatggcaactgtgtttaaccttttgaggaactaccaagctatttgccaagatatctacactattttacattcccaccagcagggtatgagggtttctgtttctccacatccttgctaacacttattgtcttgtcttttttgattatagtcatccttgtgggtgtgaagtgttaacctcattgtggctttaatgtgcagttctttcatggctaatgatgttgaacatcttttgtgtttattggccatttatatatcttctttggattgatgtctgttcaaatctttacccattttaaaaattgagttgtctttttattattgggttgtgggagttctttatatattgtgtgtacaagtccctgttagatacatggtttgcaaatgttttctcctgttctgttggttgtctttttactttttcatcccttgaagcacaaaaatttttaattttgatgaagtccaatttatctgattttgaagtaagcttttggtgtcgtatctaagaaaatactgtttcatcaatcattaaggtttattactcttctgggtttttttaagaattacatttagaggtgtgatccatttggagcaactttttttttcttttgacacagaatctcgctcttttgcttaggctggagggcagtggtgcaatcttggctcacagcagcctcagcctcctgggctcaaatgagtagctggtactacaggtgtgcaccaccacaccttgctattaataacttttgtatttttttgtagagacagaatttcgccatgttgcccaggctggtctcaaacacttggactcaagtgacacgcccacctcagcctcccaaagtgaaaaattgctttcaccttgcactgcggactcgccctgaattctttcttgtgcaagatccaagagccctctctgggggtctggatcgggacccctttcctataacaatattatgagaataacatttgattttttttaagtgaaacaaattgttattaaaaaattaaaaaaggtcataggagagtgacttggtgctcagcccattttgagcagttatttaatatagcataaggtggggttcaaattcattctttatattaattttttatttctaattgacacataaccatacacttataaccatttttactgtgtaagttcagattcattcttccgtatgtaggtattagttgtcccagcaccatctgttaaaaagactattcttggccaggcacagtggctctcaacgcctgtaatcccagcactttgggagtcccaagcaggcagatcacatgaggtcaggagttcgaaaccagtctgaccaaatggtgaaaccgcatgtctactaaaaatacaaaaattacctgggtgtggtggcgcacacctgtagtctagtcccactactgtagtggctgaggcaggagattcgcttgaacccaggaggtagaggttgcagtgagctgagatcatgcactccagtgtgggcgacagagtgagactccatctcaaaaaaaagactattctttcctccattgaattatcttcacatgcttgttggaagtctgttgactacaaatgtgaaagtttattactggactctgaattgtcctccactgaatctctatgtcttatccttatggcagtaccatactgtcttgattagagttactgtattttaaaaggctgtactttttcagttagcagaaaacattttagctatcagcacaactttctgtaaaccttcattaatgcttgacttaaattccaagaaggagcaacataaaaagtcttatctctttaggagttttagtcttactacttttaggtgcctgaataaccaaatgtattatttagcctcttactaataactccttgatccataggggcataccaggaagaaaagaagtggtttttaaaaaatgagagtgggccgggcacggtggctgatacctataatcctaacactttgggaggctgaggcgggtggatcacttgaggtcaggagtttgagaccagcctggataacatggcgaaaccctatctttattaaaaatatataaattagccgggcatggtggcacatgcctgtaatcccagctactcaggaggctgaggcaggagaatcacttgaatccaggaggtggaggttgcagtgatccgagattgcatcagtgggcgacagagcgagaatctgtctcaaagaaaaaaaaagagagtggaaaaaaaaaatatgtgtcccagaacttaaattttaattaaaaaaaaataaaagagtgaactttctaattgttctcttcagataatataatgttattctcttatgttttattgcgtatttcctgtgtaccagatgctgttcttcatgcttgtatgttaaatcttgtctaacatctctgtcaagcaagttctgtttgtatctgcactgtgtatattaggcagcttgggcaaagagaagttaagtaatctgcccaaactcacatggctagtaagtaagagggctgaccatctggtgtttaagcttctagcagtgctttgaatagtaactaatgcatagtgcatgctgcactgtcagtcagtgattcattagagctaacttcatgacatgctcatagccccaaactgcatttgttcacaaatatctgtagtccttcatttaggcagaaatagaaataccttgtgtgtttgttgttccttcccttttgagccatatgcagagtgctgatagctttatttgtgtaagaattgctagtaatttgatctgttttgggttaataatgtgggttttagaggtaaatggacctaggtttgaatgttggcctctatacatcatgtgcgtaacattgtggcatgctatctacttcccccaagccaaaatgggttaattttagaacctgcttcatagtgttcctgtgagagctcgatgagatattgcctataaagtgtttagcatagtgcctagcacatggtatgtattcaatacatgttcattcttactagcaaaatatagatgacccagtattgtacagagtatgtacaatggtgtcattgtaccatttcatgtggagtcacataagaatttcagttttctgctgggcatgatggctcactcctgtaatcccagcactttgggaggctgaggtggatggatcagctgaggtcaggagttccagaccagcctggccgacatgatgaaaccccatctctactaaaaatacaaaaaattagccaggcgtggtggcaggtgcctgtaatcccagctactcgcaagactgaggcaggagaaatgcttgaacccgggaggcggtggttgccatgagttaagatcgtgccgctgcactccagcctgggcaataagagcgaaactccgtctccaaaaaaaagaaaaaaaaagaacttaagttttccattagatttagtatagtgcagagaggaaatacagcagagtgctatattccatatatagcaatatagcattagaacaatatattccaatacagcagagtgctatattcagataccaactagtggacttgctatttgtaagatggcaataatagtatctacatcaaatagggctgttgtgaagactaaatgaataagtctataaatagtttagaacagtgtctggacaggtacagtggctcatgcctgaatcttagcactttgggaggctgagacaggtggatagcttgagctcaggcattaaagaccaacctgggtaacatggtaaaaccctgtttctacaaaaaaatacacacattagccaggtgtggtggcacatgctaatagtaccagctactcaggaggctgaggtgggagaatcacttgagcctgggagatggaggttgcagtgaggtgagcttgcaccactgcgctccagtctgggcaacggagtcagaccctgtttggaaaaaaaaaaaaaagtgtccaacccatagtaagaaatgcagatgtgtttgacattgtaagaaaaagcaacaccaaaagtctgatttttgccttcactcaagaactcttatgataattaaactccgaagtccttggcaatatatatagttggtctgttatgtggatcgcctctactaaagatttttgtgaacaaatgaaagtttaagtagtaagttcctacatcgtgacttaaattgccagtgtgcccacataaataccctgtcaacatttgcccttagccacttgactctttagctatattggtaatgcagtaaagcttgcgatgcgccagagttgcataatgctgtttgccatgacaccaagagccttggtaatgaaaccattgaaattggtttgcctatactgaggctgaagaggtatcttggctctctaattttaaggcaacctttttggctgtgtaggtttctctttagcttgtttctcaccacctggggctgtggcttaggtccgttgtcctaacctgtggcttaggttctgtttttgttgcttgtacttgctcccccttttttcagccattcctgttttctttcttttgtagaggatgccatcttaaatcatcttcagccagtggtagcattttattttttctggtctgcaaacttaaaaacctcatcacttattttgctaatatctttgtcttctgttctttttgatggtccttggttttgcagtctactttaaaggtttttatttttttatgggtacatagtagacgtattattcatagggtctgtgagatatttagataaaggcatataatgtgtaataatcacattagggtaaatggggtatccatcaccatcatcattcatcatttctttgtgtaatgaacgttgcaattgtactccctcagttattctaaaaagtacaacaaattaatgctgactgtagtcaccctgctttgttgtcaaatactagatcttattcattctttatttaactttttaaattttaaacttattttatttatttatttttagacggagtctcactctgtcgccaggctggagtgcggtggcgcagtctcaactcactgcaacctccgcctccagggttcaagtgattctcctgcctcagcctcctgactagctggaactacaggcacgtgccaccacgcccagctaatttttgtatttttagtagagacggggtttcactatgttggctgggatggtcttgatctcttgaccttgtgatccggctgccacagcctcccaaagtgctggggttgcaggcgtgagccaccgtgcccggcctttaaaattattttaaatcattttaatatctttttcatttctgcctccggtcctgcagagttcttattcgttctttctaaattttctttgcacccactaatcacctcatttcccttcttctccccattacccttcccaacttctggtaaccattctgctatctccatgtgttcaattgtttttatttttagtgcctgcaaacgagtaagaatatgcaaagtttatctttctgtccctggcttattttacttaacataatgtcctccagtgccatctacattgctgcaaatgacaggatctcattcttttttatggctgaatggtaatctattgtgtatatataccacattttctttctccatttgtctgtcagtggacacgtaggttgattccaaatcttggctgttgtgtatatagtgccgtagtaaacatgggagtgcagatattccttcaataaactgatttcctttctgagtatatacctagcagtgcaattgctggatcatatggtagctctatttttagttttttgaggaatttccatactgttctccatagtggttttaccaatttacatgtccaccaacagtgtgtgaaggttcccctttatccacatcgttaccagcatttgttattgcctgtcttttggataaaagccattttaactggggtgagatgatatcttgttgtagttttaatttccatttttctggtgatcagtagtattgaatacctttcatatacctgtttgccattcataaataacgatgaggtcttgctgtttggcccaggctggtctcgaactcctgggctcaagcaatcctcccaccttggcttcccaaaatgctgaaattatagttgtgagccactgcacctggccttgtatgtcttccttttttttttgttttgttttgtttttgagacagagtctcactttgttgcccaggctggagcgtagtggtgtgatcttggctcactgcgccctacacctcccggattcaagcaattctcctgcctcctgccaccatgtctgcctaatttttgtatttttagtagagacgggatttctccttgttgcccaggctggtcttgaactcctaacctcaggtgatttacctgcctcagcctcccaaagtgctaggattacaggcgtgagctgctgcgcccagcctgtatgtcgtcttttgagaaatgtctattcagatcttttgcccatttttaattgagttactaaaattttccctatggagttgcttgagtgccttttatattctggttattgatcccttgtcagatgagtagtttgcaaatattttctcccattctgtgggctgtctcttcactttgttgatggtttcctttgctgtgcagaagctttttaacttgatgtgatcccatttgtccatctttgctttggttgcctgtacttttggggtattactcaagaaatctttgcccagagtaatgtccctgggagtttaatgttttcttttagtagtttcatagtttgaggtcttagatttaaatctttagtccattttgatttgatttttttttaatatggtgggacacaggggtctggtttcattcttctgcatatggatatccagttttcccagcaccatttattgaagagactgtcctttccccagtgtatgttcatggcttctttgtggaaaatgagttcacttagacgtatggattcatttctgagttctctgttctgtttcattgatctatatctttttttatgccagtaccatgccattttggttacaataatttgaagtcagataatgattcctcccgttttgttcattttgctcagtatggcttttgctcttttgggccttttgtggttccctacaaattttagaattatttttgtctacttctgtgaggaatgtcattggtattttgatagggattgcactgaatctgtagattgctttgagtattatcaacattttagcaatattaattcttctaatccataaacatggaatctcttttcatgttttttctgtgtcatcaatttcagtgttttaaagttgtcattatagaaatcttttactcatttggttaagtttattcctaagtattttattatatttgtagctattgtaaatgggattgcgtttaaaaaatttttcagattgtttgctgttaaatataaaaatgctcctgatttttgtgtgttgatttttgtatcctgcaattttactgaatttgtttgtcagttctaataggtttttcttttttggagtctaggtttttccaaatgtaagatcatattatctgcaaacaaggataatttgacttcttccattccagtgtggatgctttttatttctttctgttgtctgattgctccaattaggacttccgagtattatgttgaataacaatggtgaaagtgggcatccttgtcttgttccagatcttagaggaaagcctttcagtttttcccttttcagtatggtactagttatgggtctgtcatatatggcttctgttttgttgaggtatattccttctatacccagttctttggggtttttttgtttgtttgtttttgagatggagtctcactctgtcacccaggctggagtgcagtggcgcaatgttggctcactgcaagctccacctcctgggttcatgccgttctcctgcctcagcctcccgagtagctgggactacaggtgtccgctaacacgcccggctaattttttgtatttttagtagagacggggtttcaccgtgttagccaggatggtctcgaactcctgacctcatgatctgcccgtctcagcctcccaaagtgctgggattacaggcgtgagccaccacgcccggccaagggttttaatcataaggggatgtggcattttatgtgatataaattatatatttatatcatgtgatatatatttatatcatacacagtataaataatatatatatatattttttagtctttgtcttttattctgttaagatgtaccatgtttattgatttgcgtatgtcgaaccatccttgcatccctgggatgaatcccacttagtcatgatgaatgatctttttaatgtgttactgaattcggtttgctagtattatattgaggatttttgcataatgttcttcagagacactggcttctagttttccctttttgatgtgtcctttggttttgtatagggtaatagtggccttgtagaatgagtttagaagtattccctcttcctgtattgtgttggaatagtttgagtaggattggtattagttcttctttaaaggtttagtagaattcagcagtgaagccatcaggtccatggcttttctttgctgggagactatttcttatagctttgatctcgttacttgttattggtctcgttacttgttattgtatttgggttttggatttctttgtggttcagtcttggtaggttgtatgtgtctaggaatttatccatttcttcaaggttttccaatgtatcagcatatagatgctcatagtagtctctaatgatcctttgaatttcggtggtaacaattataatgtctcctttttcatctctcattttattatttgggttttctcttttttttctgagtctggctaaaggtttgtcagttttgtttatctcttcaaaacaatttactgttttattgatcttttgtattttcttcatttcaattttatttatttctgctttgattttttttatttcttctactgattttaggttttgtccttgcttttctagttctttaggatgtattggcagatgaagtttttccacttttttgatgtaggcacttactgctgtaaacattcctcttattgttgcttttactgtatcctataggttttgataagctgtgtttccattttcatttgtttcaaggaattttccagttttcttcttaatttcttcatggacccactggtcattcaggagcatattgcttaattttcatgtatttgtatactttccaaagttcctcttgttatctagtgttattttattttatttttatttttgtttttttgagatggagtctcgctctgtcacccatgctggagtgtagtggcgcgatctcggcttactgcaacctctgcctccccagttcaagtgattcttctgcctcagcctcctgagtagctgggattacaggcatgtaccaccactcctggctaatttttttttgtatttttagtagagagggggtttcaccatgttggtcaagctgatctcgaactcctgacctcagatgatccacccaccttggcctcctaaagtgctggaattacaggcatgagccaccgtgcccggcctctagtgttatcttattgtgatcagagaagatagttgatatgattttaacttttttgaatttttatttatttatttgtttgtttgtttgtttgtttgtaacagagtctcactctgttacccaggctggagtacatgtcatgatcttggctcacctgcaacctccgccttcctggctcaagcaatcctcccaccttagccttccaagtagctgggactacaggcacatgccgtcacatatggctgatatttttggattttttttttttttgtagagatggggctttgcgatgtgtcccagggttgtttcgaactcctgagctcaagcaatccacctatttcggcctcccaaggtgctgggattacagacatgagccactgtgccacgtcaaatctttagacttgttttgtggcttaacatagggtctatctttgagagcaatccatatgttgaggagaagaatgtgtattctatagctgttggacacaatgttctgtaaatatgtattgggcctatttggtctatagagcaaattaggtctaatgtttctttgttgattttctgtctgaatgatctgtccattgctgagagtggggtgttgaagtttccgactgttactgaggtctgtttctcttttttgctctaataatgtttgctttatatatctggatgctccagtattggttgcatatgtatttatacttgttataacctcttgccgaattgatccctttatcattatacaataatcttctttgtctgtttttatagactttgtctcaaaatctattttatctaagcatagctactcctgttcttttctggtttccatttgcatggaatattgttttccagctcttcaattttagtctatgtgtgattttataggtaaagtgtgtttcttgtaggcaatggatctttggtttttttttttttttttttgagacagagttttgctattgttgcccaggctggagggcaatggcgctatctcagctcactgcaacctccgcctcctgagttcaagcgattctcctgcctcagcctcccaagtagctgggattacaggcgcctgccaccaagcccagctaaattttttgtattttcagtagagatggggtttcagtatgttcgtcaggctgttcttgaactcctaacctcaggtgatttgcctgccttggcctcccaaagtcctgggattacaggcgtgagccaccgcacccagccttttttttaaatccatttagccactctgtatcttttgattggagagtttagtcgatttacattcagtgttgttactgattagtgaggacttaactactaccattttgttacttattatctggttgttttgtagtcctactccctcccttcccccttcttttttacttcctcttcgctccttttttccctccctcccttccttgttttgaaagtgattttctctggtggtatgttttaatttcctgctttatattttttgtgtatctgttgtaggtgtttttgatttaagatcaccatgacagctgggtgcagtggttcacacctgtaatcccagcactttgggaggccgaggtgggtggatcaagaggtcaggagattgagaccagcctggctaacatggtgaaaccccatctctactaaaaatacaaaacttagccaggcgtggaggcacgtgcctgtaatctcagatactcaggaggctgaggcaggagaattgcttgaacccaggaggcagaggttgcagtgagtcaatattgtgccactgcaccccagcctgggcgacagagtgagactccgtctcaaaaaaaaaaaaaaaaaagagatcacataagggttgcaaataacattttataacccattattttaaaccaatgacaacttgaaactttgattgcaaaaacaagcaagcaaagagaaaactaataaaaactctacacttcatctgcccgctttttaacttttgttgtttttatttatatctttattatactatgtcttaaaaaactgtagttataagccaggcgcagtggttcacgtgtgtaatcccagcactttgggaggctgaggtgggcggatcacctaaggtcaggagttcgagaccagcctagccaatatggcaaaaccccctctctactaaaaatagaaaaattagccggacatggtggcgggtgcctgtaatcccagctactcggaggctgaggcaggagaatcacttgaacccaggaggcccaggttgcagtgagccgagagtgcgccactgcactccagtctgggcaacagagtaagactgtctcaaaaaacaatacaaaacaaaacaaaaccctggcctagtggctcacgcctaatcccagcactttggaaggcaaaggtggggcgaatcacaaggttaggagttcgagaccagcctgaccaacgtggtgaaactctgtctctactaaaaatacaaaaattagccaggcgtggtggcacgcacctgtaatcctagctactcaggaggctgaggcaggagaatcgcttgaacctgggaggcggaggttgcagttagccgagatcgcgccactgccgtccagcctgggcagcagagcaagactctgtctcacaaaaaaaaaaaaaattgtagttcttatttttgaaaggttcattttttattcttcctgctcaaaatatgagtagtagtttatacaccacaattacagtgttacaatattctgtatttttctgtgtacttgttaccagtgagtttttgcaccttcaggtgatttattattgtttgttaacatccttttcttgcagattgaagaactttttttttttttttttttttttgagacagagtcatgctctgttaccagcctggagtgcagtggtgccatcttggctcactacaacctccaactcccaggttcaagcgattcttctgcctcagcctcccaagtagctgggattacaagcatgtgccaccacgcccagctactttttgtatttttagtaaagacggggttttgccatatttgccaggctggtcttgagctcctgacctcagggtgatccgcccgccttggcatcctaaagtgctaggattataagcgtgagtcatcgtgcccaacttggttgtttattttcaaatagcctgaattcaagctcactaatgttttctgctgcttgatacatttctgctattgagagactgatgcatttttcagtttgtcaattgaatttttccactttgggatttctgcttgattctttttactaataattattgcagtctcttttttaaatttataggattctgaatttgttctctgtattatcttggatttcgttgaactttctcaaagcattcagcttgaattctgtctgaaagttcacatatctcttatcacttgggaattggtcactggtgtcctttatttttagttcatttggtgaggtcatgttttctcagatggccttgatgcttgtggatgttcatcagtgtctgggcattgaagagttgggtattctgttctttgtagtctggttttgtttgtacgcattcttttttttttttttctgtttttgagacagagtctcgctctgtcgcccaggctggagtgcagtggcacagtctttgctcaccgcaacctccgtctcccggattcaagcaattctcctgcctcagcctcctgagtagctgggattacaggtgcgtgccaccacgcctggctaatttttgtatttttagtaaatatggtgtttcaccatgttggtcaggctggtctcgaactcctaacctcgtgatctgtccgccttggcctctcagagtgttgggattacaggcgttagccactgcatccggctcccattcttcttgagaaggtttttcaagtattcaaagggaattaagtgttgtcatctaagtcttcgctcactgcagccatacatgcattagagggcaccccaagactagtaatgttgtgactctgtagaggtatcaccttggtagtcttggggaagatctgggagaattccctgtattaccaggcagtctcttgtcctcttacatttctccaaacaaatggagtctctctttgtgctgagctgcttggagtttggggaagggtgacacaagcactgccatggccaccgtcactggaactgtacttggtctcacccaaggcctgtggcagctattttctggccaccactgatgttaatttaaggcccaagggtgctttagtcagtaggtgaagaatcctgcaagaactgggtctttactttcagtgcagcaggttcccttctggcccagggtgtgtctagaaatgctgcccaggagccagggcctgggatcgggagctttaggaatctgctttattgtactggggctgagctggcacccacttgcaagataaagtcctttttactcttctctcacctcaagcaggtgggtctccccatggacaccacagctgtgaatgtgcggggtcatatctgaagctggcacaatacgacatggcaccttgttttttattcaaggcacaagggctctttagtcagctggtggtgaatcctactaggactaggtatttcccttcaaggcaatgggttcccttctggtccagaatatgtctagaaatgtcatctgggagctatggcctagaattgaggcttcagaactatgcttggtgctttattttactgtggctgaactagtatccacattgcaagacaaagtcctccctactcttccctctcctcccagagctgtgagctgtggtacctggagttgggggaaggctggcacaagcactcccttggccaccctagctggtgtctcagtgggtcacatgtaccccaagtccactgactatgagcccagcacagtaccatgacttgtccaggaattgcagtccttctggtctagactgcctttcaagtttatttaggaccccagaggactttacccacggtggtggggcttaccaaaattaagattcttttggttttttttggcagagtttcgctcttattgcccaggctggagtatagtgacgcaatctcagctcaccacaacctccgcctcccgggttcaaataattctcctacctcagcctcctgagtagctgggattaccggcatgcgctaccacctctggctaatttttttgttttttagtagagatgaggtttctccatgttggtcaggctggtcttgaactcccgacctcaggttatccgtccgcctcggcctcccaaagtgctgggattacagaccatagtgcccagcccgaaattcagattctaatcactgggatggacaattcccctctgactagggctagtctaaatactccctctgtgggtgctggctgaattctgtcctatgctgctttccactgtgacagggcagcactgagtttcaatgcaaaatcccacagtcatttctctctctctcccccgagcacacagattctttctccaccccacactgcattgtgggggaatgtcaggggtgttggaggggcagttcaagactatcttccttatcttttttggtgtctttttccttgataggatgtcaaaactgggtactgtgatcgcttacctaatttttggttcttatgaaggtgctttcttgtgtggatagttgttcaatttggtgctccttgttggggatgatcactggaaggttctgtttggccaccatgctctgtctcttctcccctgccatctcctttttttacttaggggtttagaatgtctaactgaccaatatgtacagtcaggtctcattctgaattcacctacttaatgaccttccaagctgactaggcccagcgcttagtccagcctccatgacggtccctccacatcctaattagcctccctccagttcatttcacacaaagctgctgtgttcacctttctgaactataaatctgcccagtactctaccctacttaaaattccgtatagactgcccatttgccctgagaattaaaagccaaagtcctaaacgtagctttttaaaacttttttttttttttttttaatttttagatggagtcttgctctgtcacccaggctggagtgcagtggtgtgatcttggctcactgcaacctccgcctcctgggttcaagcaattctcatatgtcagcctcccaagtagctgggatttacacgtgtgccatcacgcctggctaattttttttttttatctttagtagagacggagtttcaccatgttggccagtctggtcttaaactcctgacctcaagtgatccacctgccttggcttcccaaagtgctaggatgataggtgttagccactgcacgcagccctgaacatagcttttaagttcctttattgtcatattccttttgacgagtctatcattttctgactcacttgtacatgtgtgtctcacccttggtccagccattggtgcttttctttacttctttatttttgttattttattttattttattattattttttaaatgagacagggtatcactatgttgcccaggctggtcttgaactcctgagcttaagcagtctgcttgtctcagcctcccaaagggctggaattacagtgatgagctactgtgcccagctcattggtgctatctttttttttttttttgagacggagtctcgctctgtcacccaggctggagtgcagtggcgtgatcttggctcactgcagctccacttcccaggttcacaccattctcctacctcagcctcccgagtagcagggactataggcgcctgccaccatgcctggctaatttttgtatttttagtagagatggggtttcagcgtgtgagccaagatggtctcgatctcctgacctcgtgatccgcctgccttggcctcccaaagtgctgggattacaggcgtgagccaccgtgcccggcccccattggtgctattgttttatgtgatagagccagcttctcccttttctttggatttttaaacatactcttccttttacttagactattctccatcccaacacctttcctaaacttctttcacaccttagactagctgacactttactgagaaacctttcttttttataggttgctttttctatagactctcttagcatttactcattttattgtgaagtgtctgatcttatttaaatgacaagtataagaggatagaaactatttcatatttttctcacccagcaggcacaatttctgacatgtggtaagcactcagtaaatattgaactttagaggctaggacatttgagtgctttggtgactgtggttgtgctatataggtactctgttattgttagtttatagtaaaagcattactcttaaagtatgaaaaaagccttattcagaacatttcatgcgtatagttaatattacgtagcttgtgctcatggcaaaaatgtattactaaagttatttaagatatttaagtataattgtttcctttatttagttacagccaagttctacttctgaatctatggatcaactactaaacaaaaatagagagggagaaaaatcaagagatttgatcaaagacaaaattgaaccaagtgctaaggattctttcattgaaaatagcagcagcaactgtaccagtggcagcagcaagccgaatagccccagcatttccccttcaatacttagtaacacggagcacaagaggggacctgaggtcacttcccaaggggttcagacttccagcccagcatgtaaacaagagaaagacgataaggaagagaagaaagacgcagctgagtgagtaaacctggaacttagaccatcctgttactcaattaacttttttttttttaaaggcatttaggtccttccaactgtgaagaatccatctggacttttagactactttatacattgcccttagtttacaaacagctagtccaaacaaatgacatcttaagtaaatgaggttattgcaccctgtgctactcttctgttcttccccttttttgtaccccagggctagaaaaacaaggcataaattaagaaaagtttttctgtaaatgaacaggagttgaaaaattatcaattcaggggacctatctttactggattccactcattagtcaccctcactgtgctgctaggttgaaaaactgccactgtcaaggagagaagcatgcggtgcttctacttggaattcaaaatatttttcatcagaaactgtgttttagttaatgtttagatttgttaagatagacttaattctgcacattcagtatattaattaaatggacttttaggggctaacctcagaacttaactaccattgacttaggtgtttgggtaccaaacaatccagttaaagctgaagttttggaatgcagcttattgataaattggggactgcttattcttgatttgaggcaatttttttttacagccatgactttttccaggtatgtcatgtaaaatatcttctcacataagaattactgcatgctagaatattggtatgttgactggtagctcatacctataatcccagcactctgggaggtccaagcaggtagattacttgaggttaggagttgaagaccagcctggccaacatgtgaaaccctgtctgtactaaaaatacaaaaattagccaggcatggtggtaggtgcctgtatcccagctactcgggaggctgaggcaggagaattgcttgaacccagaaggtggaggctgcagtgagccgagatcatgccactgcactccagcctgggtgacagagcgagactctgtctcaaaaataaataaataaataaataaaaggatactgttatgttaagaattgcttttaaggatatttcataagtagctactgtcttttcagctcaagtgtttgttgattggccaggcgtggtagctcatacctgtaatcccagcactttgggaggctgagtcaggcagatcacttaaggtcagcgtggccaaaatggtgaaaccccatctttactaaaaataaatattaaaaaaaattagctgggcgtggtggcagtctcctgtaatcccagctaatcaggaggctaaggcaagagaatggcttaaactcgggaggcagaggttgcagtgagccaagattgcactgctgcactccaacctgagcaacagagtgggactctgtgaaggaaaaaaaaaaagtattttttgattgcctttgagaggaacggttgtatattactcagatttttaaaaaattgttcttttatggctgtattctttaagggattaaggaatgggcaatataagtgtatatgtttcaataaaaacgattagtgatcttctagtgagaacagtttaaatctatatttagcaattttttttaaattgtcaggtatggaagattttagagcaacgtaaagtccatgtagatttcactggcctttatattttttttaggcaagttaggaaatcaacattgaatcccaatgcaaaggagttcaacccacgttccttctctcaggtaggtttattactttctttgaggttatctagtcccaaaaaaagaaaaattattagtaatagtccttcttccatacctgccatctgaattttgttttagtgtgctgaaccaaccttctttcttttttttacatggccattaatgaatactttttaaacattaaaaaaaggtctttgttttgtcatcaattagatgtgatcttgggcaaatctttgaatttctctgacccagaatttgacgatggttggctagctaggctgtcaggtttatagatacgtcctctgcacctgagggttttgcatcactggattcaaccaaccatggatcaaaaacatagttaggataatctatactgaacacatgcagacgtttccttgtcattattccaaaacaatacagtaaagcatttaccttgttttaggtattataaataatctagagatgatgtaaagtatataggaggatatgcataggttgtatgcgaatactacatgattttatgtaagggacttgagcattccaagactttggtatcttcacagggtactgtaaccaatcccccacagatactaagagatgactgtactattgttattattcgactgagatcataagaagatatatttatttttaatttttaaaaacacttccatcagtttcttaaaaatagctgccactgtttttaatattttttaattgacaaagttttaagttcctactgaaacattttttcttttattgaaatgtgaaaatttatgtgctgtgtttttgttttcaataaaagggacatagttaaagcaagtaaaattagaaagactgggaaaatccgtctttaaattgcaataatagttcatctgttaccttgagataattgaatttattgttgtttttgtagccaaagccttctactaccccaacttcacctcggcctcaagcacaacctagcccatctatggtgggtcatcaacagccaactccagtttatactcagcctgtttgttttgcaccaaatatgatgtatccagtcccagtgagcccaggcgtgcaagtaagtcatagaatttgatgttcacttagcctccccaattgtttgtatctgacaccaagcactctttaggttttcagtgacttgagggtgtgatggttatgcatatgcatttgaaacagacaggcatgcagagattcagtgtgttgttaagtatgaggacctaaatctgagaatgttttctgtgaaaaagatggtttagatttactgtagtttggggtttgttccttttagctgtgggtatgatctaattttttaatgactaatggagaatcaggaaaccttctcatgcctagctctctagcaatataaaactaagagtgacagaataccttgttattatcataggtgcctaatgttaattttttttttaattctctcaagcctttatacccaatacctatgacgcccatgccagtgaatcaagccaagacatatagagcaggtaaaggtgagaataatcctgcctgtgtttgcttgtagtttgcatgctgcatgaattgagtaactaagtttataatgaataaatagttgtagtttagctctgactttttgatgaggctatgcattggcttttgatgaacaacattacatagatattcacatggattttatgaagaaaaacaggggagaaaaaatgcccatcagttgtgattatatagtatcctcttcaaaaagagtaattggaggcctggtgtgatggctcacacctgtaattttagcactttgggaggccaaggcaggaggattgcttgagctcaggagcccaagatcagcctggacaacagagactttgtctctactaaaattcaaaaaaattagctgggcatggtggcatatgcctgtagccccagctgtttgggggactgaggcgagaggatcacttgagcccaggaagtagaggctgcagtgagctgtgattatgccactgccctccagcctgggcgacagagtgagaccccgtctcaaacataaatactggctgggcatggtggcttatgcctgtaatcccagcactttgggaggccgaggtgggtgtatcacctgaggtcagtagtttgagaccagcctggccaacatggcgaaaccccatctctactaaaatacaaaaattagccggacatggtggcacctgccgcctgtaatcccagctactaggtggggctgaggcaggagaattgcttgaacccgggaggcaggggttgcagtgagccaagatcgtgccactgcacttcagcctgggcaacagagtgagactccatctcaaaacaaacaaacaaacaaaaaacaaacaaacaaaaaaaccagactaattggctggacacagtggctccatgcctgatatcccagctggaggatgacttgaacccatgagttcgagagcagcatgggcaatatagtgagaccctatctcaaaaaaaaaaaaaaaagttaattccaaagctttttgatctgaaatctgatttaaatctgaacttaaatttgaagaagagggtttgctagattaatttactagattgctaaccttgctttatatatacctacagttatttccccaaagccagaatttcttttgaagcagaggggcaactaacttcaaccaatgttaagatcctattagaaggatgtttcggctaggcttggtggctcacgtgtaattccagcactttgagaggctgaggtgggcagatcacatgaccgggagttttaagaccagcctgggcaacatggcaaaaacctatctctgcaaaaaaaaaatagaaatcttagccagccgtcatggtgtgctcctgtagtcctagctacttgggagactgaggtgggaggatcaattgaaaccagaaggtccaggctgcagggaactgtgactgcaccactgggctccagcttgggtgaaagagcgaaaccctgcctcaaaaagaaaaataagatggatgtttctgcattaaaattagggagttgtcgtataatgtagttgcataaactagtattctgtgcttgtgtggttaaagagccttcgtagaaaaaatcccacatttttcttaaaaggaaatcttttggccaggtgtggtggctcacatctgtaagcccaacactctgggaagccgaggtgggcagatcacttgaggtcaggagtacaaaaccatcctggccaacatggtgaaaacccgtctctactaaaaatacaaagatcagctgggcatggtggtgcgtgcctgggtgacagagcgagactccgtccaaaaaaaaaaaaaaaaaaaaagagttcttttaatgttggaaaatgctaaagggttttttttttgccaaccagttaatttagagtgattaactgctatcagttgagaaactatagaaagtagaataatttatacagaaaagacatttctcagtgcccaataattgcctttctgacataaagttttcatttttcctgaattaataagatttcctcaatgtgtttttttgggtgttttgtgtgtgtgtgtgtgtgtgtgtgtgtgtgtgtgtgtgtgtgtgtatgtgtttgatacagggtcttgctttgctgctgaggctggaacgcagtggcgctatcatggctcaatgcagccttgacctcctgggctcaagcgatcctcccttctcagtcccctggatagcgggggctacaggtgcacaccaccacacctagctaatttttgtattttttgtagagatgggttttgccatgttgcctaggctggtctcaaactcctgggctcaagcgatctgcctggctctgcttcccaaagtgcctgcgcccagccaattttctccatgtttgacctaattgtgatttcatagatgttaactaaaactcttaattttcgttttctcagtatgctattttttttttttttagccttggaacatatgaacctgttgaaagaactctgcctgaaataatgtaatcaaattatagagtttaatcttattttgagggcctttagaaattctgagaagaaagtgggtttttttttttactgccattttaatgtagtgttaaggtgttcatgtatcaccagcaggtgtagctgttttcaatgattacttaaaacaatgcaatgggaactttttgttgtcattaaaatataaaaggttactgtagtaagagcaagcatgacagtttggctatctgatgggagagtcacattctaacttcaggaggtactgtctttttaatagaaatgatatactcagagtctgggcacggtggctcacgcctgtaatccagcactttgggaggccgaggtgggcagatcacgaggtcaggagatcaagaccatcctggctaatacagtgaaaccgtgtctctactaaaaatacaaacaattagctgagcgtggtggcaggtgcctatagtcccagctactcgggaggctgaggcaggagaatggcatgaacctgggaggcagagctggcagtgagctgagatggtgccactgcactccagcctgggtgacagagcgagactccgtctcaaaaaaaaaaaaaaaaaaaaaatagtagagaaagggctttgccatgttggccgggctggtcttgaactcctggcctcaagtgatccacctccctcggcctcccaaagtgctgggattacaggtgtgagccactgctcctggcctgaatataccacttttacctatcatcagttgatgaacatttggattatttcctttttctggcaatgagtaatgcttttgtggattttcatgtacaaattttcatatgaggctgggagcagtggctcatgcctataatcccagcagtctgggaggctgaggtgggcagatgacttgaggtcaggagtttgagaccagcctggccaacatggtgaaatcccatctctactaaaaatacaaaaattacactggcatggtagcgtgcacctataatcccagctattcaggaggctgaggcaggagcatcagaatcgcttgaacctgggaggcggaggctgcagtgagctgagatcacaccactgcaccccagcctgagtgaaagagtgagtctcaaaaaataaaaaataaaattttttttcatgtggccttagattttcatttctcctaaagtagaaatgctgtgatggaactgccaaacttttccaaagcagctgcatcattttgtatttctaccagtaatgtacaagtgttccagtttctccacatcctcataaataaccgatatgtctttggtttgggttatgtccattctagtggttatgaagtgtcattgtggttttttgtttttttgtattgttttgagatcgtgcccaggctggagcacagtggcacaatctcggctcactgcagccttcgcttcctgggttcaagcaattctcctgcctcaccctcccagatagctggggctgcaggcatacgccaccacaccaggctaatttttatattttttgtagagatggagcttctccgtgcttcccaggctggtctcgaattcctgagctcaagcgatccccctgcgtcagcctccagagtagctggggttataggcgtgcaccaccgcgctcggcccatttttgtatttttagtagagatggaatttcaccatgttggccaggctggtcttgaactcctgacctcaaatgatccgcctgcctcaccttcccaaagtgctgagattttagacgcgaaccaccatgccctgactataggttatctttttacttgcttgatggtgttctttgtaacacagtttttaattttgatgaagttcaatttatctgtttgttttttcttttgttgctgttgctcctgatgtcatatcagacaaagcattgcctaactcaaggccacagagatttactcctatgaaacgcctataaaactcctatgatttttatagtttagctcttaacatttaagtctacaatctcttttgagttaatttttgtgtatgagatgagagtagtggtccaggtttttccttttgcttgtggatatccgttgtccccacctcatttgttgaaaagactattctttcctcttaaattgtttgtttgtttatttatttttgagatggagtgtcgctctgatggagtggcgctaacttagcttcactgcaacctccgcctctcagattcaagcgattcccctgcctcagcctcctgagtagctggaattacaggggtgcgccaccacacccagctaatttttgtatttttagtagagacggggttttaccgtgttggtcaggctggtctcgaactcctgatctcgtgatctgcctgtctcctggcaccctgggaggctgagaggctgaggtgggaggatcacttgagctcaggagtttgagaccagcctgtaccattatgcctggctaattttagaatttatcttaaagtataaaatgtgaatccaatttatcttgttctaaatgactatccaaaatgttttaaccagttttattagtctgtaatttacatacaagaaaatgctcatctttttatgtttacattttaatgagttttgacaaatatatttgctcatgtaactacttgcttcatcagtgaagatggaaaacattgtgcctgttcctcttctctgtccaactgtactttattaccactagctccagttaaccagtaatctgccttcttttactatagattagatttatcctctttagatttctttttctttttttttttttgattaggtttttttttttctttttttacgtaaaaaaatctttttttggagacgtctcattatattgcccaggttggtctcgaactcttgagctcacctcagcctcccagagtgctaggattacagatgtgagccacctcagccagcccctagattttttttttttttttaataaatggaatcaaacagcgtgtaacagaggtgttcaatcttttggcttccctgggtcatattggaagaagaattgtgttgggccacacataaaatacagtaacactaatgatagctgatgaacaaaacaaaaaaaaatagcaaaacttataatgttttaagaaagtttatgaatttgtgttgggccacattcaaagccgtcccaggacgcaagttggacaagcttggtatataatttcatatgtgtgtcctaaacagtgtagtaatttgaatttcatgttagtatcagcttattcctttttgtttgtttgtttgtttttgagatggagtcttgttctgtgtcccagaattggtctgcaattccactgcctcagcctcccaagtagctgggattacaggcacgtgccaccacacctggctaatttttgtctctctctctttttttttttttttttttttttttagcagagacgggatttcaccatgttggccaggctggtctcaaactcctgaccccaaatgatccacctgccttggcctcccaaagtgctgggattacaggtgtgagtcaccgtgcccagccagcttattcctttttattgctgggtagcatttcattttatgattataccacagttaatttacccattactagtcgatgggcatttgagttattgccagcttttggctattatgaatgaagctgctgtgagcatttgtgtacaagtgtttgtgtttttatttcttttagttaaatacctagaattggaattgctgaggtatggtaagtgcatatttcatttttttaaaaaatttattttattttttatttatttattttttttgagatgaagtctcactctgttgcccaggctggagttcagtggcgtgatttcagctcatggcaacctccctgtcccgggttcaagcaattctcccgcctcagcctcccaagtagctgggattacaggcgcgcaccaccatgcctggctaatttttttgtatttttagtagagacggggtttcaccacgttggccaggctggtctcgaactcctgaccacaagtgatccacccgccccagcctcccaaagtgttgggattacagatgtgagccaccacacactgcctggtaaatacatatttcaattaataagaaactagcaatcttctaaagtgattgtgtcattttacattccaactgatcaggtacatgtgtaggttccatgtgttctgcatccttgccaacacttggtattgtgttatctttttaatttcaacaggtctaatgggtgtcttatggtatctcattgtgatcttaaatgtacatttctctgatgatgactgatccaggagcacctcatcatgtgtgtgtttgttttcagctgtcaacctttttttagtaaatggttcaaatcttttttccattttatttatttatttatttatttgatggaatctcactctattgcccaggctggaacgcagtggtgccatcttggctcactgcaacctccgcctcccaggttcaagcaattcttacgccttagcctcccaagtagctgggattacaggcatgcgccaccatgcctggctaattttgtatttttagtgtaggtggggtttcaccatgttggtcatgctggtctctaactcctgacctcaggtgatctacctgcctcggcctcccaaagtgctgagattacaggtgtgagccactgcgcctgtcctaataatttctttttgtctcaatgtttctgcctgggtgcactggctcacgcctgtaattccagcactttgggaggccaacctggatggatcatttgagccaacagtttgagaccagcctgaggaacatgacaaaaccctgtctttgcaaaaaaaaaaaagaaaaaagaaaaattagccaggcacagaagcgcattcctatggtcccagctacttggggggctgaggtgggacaatcgcttgagcgaggttgcgggggtttggagggcgatggaggggtgatcgaggttgcagtgagctgagattgcactactgcactccagcctgggcaatagagccagaccctgtctcacaaaaaaaagaaaaaaaagtcatgtttcttttcttactgtgaaaataaagttactacttttagtaaattattttaagttatttatatattctggttacaagtcctttctcagaatattgtgaatattttctcccagtctgcggttttttttgaagagccagtattgttaattttaatgaagccttatttatcaagcttttctcttaaggttcatgcttttttgtatcataataagaaatcttttacgtaccctaggttatgaatgtttttatggttaggtatatggttgatttcaggttaggttttgtgtagggtgtgatgtaaaggtctagcttcattttctccaccataaatatttactcggtttctctggcaccagcctctgttttccattggtggctttattttttttctgttcttgaaacaagagtctcgatcttgttacccaggctggagtgcagtagtgtgaccttggctcactgcaacctccacttcccagggtcaagcgattctgcctcagcctctcgagtagctaggattacaggtgcccgccactacacccagctaatttgtattttttttttttttttttttagtagagacagggtctcaccatgttggccaggctagtctcgaactcctgacctcaggtgatctgctcatctcagcctcccaaagttctgggattacaggcatgagccactgcgcccagccatagtagctttattgaattcagttgactgtattgtatgtgtgtctatttgtgaactgttttgttgtattgatctttgtatatatccttatgccaattctctctttattgctgttactttgtaaccaacctttaagttcatatgagtctcccagttttattctcgtcaaaattactcttattctgcgttctttgaatttgcaaataaattttagaatcagcttgggattgtgcactgaatctttatatcagttctgggagaaatatcttaacaatatggaatcttcattgaggtcatcatatactgctccatttatttaagtcttaagtttcaccagtgttttctagttttctttgtatcagttttgtgcctgctttcttaaatttatcccttaatatttcatctgttttgtgctgttgtgagttatattttaaaaactttcaacgtttgtttattcgtaaatagagatgcacttgatttttgaatattgaccttgtgtcttgatgtgttggtaaacccactgtttctggcagccctttaagacttaaacatacaatcatgatctaatcaccatgttggtgtttttgggttttttttttttgtcttattgtactggtgcattactgaaaaaggcatgagattttgccatgctcccatttttaggggtgagacattgtctttcactattaagcatacagttaggtgttacttcagttcctaatttgcagaggtgggtttgttttctttttaatcatgaatggttgttggattatgttcaaatacttatcatctactaagtatatcatattgaccaggaacagtggctcatacctgtaacctcagagctttgggaggccaaggcaggaggatcgcttgaggccaggagttcaagaccaacctgggtgatgtaggaaaaccccatatctacaaaacaatttaaaaatttgctgggtgtggtggcacacacctgtagtcctaactacttgagaggctgaggaaggagaattgcttgagcccagtagtttaaagcagcagtgagctgtgattgtaccactgtactccagcctgggtgacagaaggagaccctgtatttaaagtgtgtgtgtatgcgtgcgcatagatggatagataataatgtaattccattatggtcatacaaactgatatgaaatgccattttatcatataacaagtgtctttttgtggttgaatttgtttctggatttttcactctgcttcactaatctaataggactaccttctcatccactcactgccaacattgattttttttttcagattaccttgaattttctgtttatttttccatatgaactctataattaacttactactaaaaaaatcagttgcctttttaaaaccaactgatctttaaaatatatcttggctgggcccggtggcaggcacctgtaattctagctacttgggagactgaggcagaagaattgcttgaacccaggaggcggaagttgtagttgagttgagattgcgcacctgtactccagcctgggtgacagagcaagattccctcttaaaaaaaaaaaaaaaaaaaagaaacagaaaagataaatctttttacaataatttgttccaattagggtccaagtcaggcttgcaatttggatttgtttatatgttgaagtctttttttttttttaattgtttcatattgtggtaactttttttttttttttttgagatggaatcttggctctgtcacctaggctggagtacagtggcacaatctcaactcactgcaacctccccctctggggttcaagcaattctcctgcctcagcctcccaagtagcccagccttttttttttgagacagagtctcgctctgttgcccaggctggagtgcagtgatgcgatctcggctcactgcaagctccgcctcttgggttcatgccattctcctgcctcagcctcctgagtagctgggactacattcgcccgccaccacacccggctaatttttttgtatttttagtagagacagggtttcaccgtgttagccaggatggtatcgatctcctgacctcgtgatccgcccgcctcggcctcccaaagtgctgggattacaggtgtgagccactgcgcccggccttgtatttttaatagagatggggtttcaccatgttggccagcccggtcttgaactcctgacctcaaatgatccacccgcctcggcctcccaaagtgctgggattacaggtgtgagccatcgctctcagccttgcggtaactttttattacgaatgtattgagacattaataacctaggccagtcatgtttcatccctacccattgtctcttaaaagctttgagtccactggattattctgaagcaaattctagacattgcatcagtttatccaccaacattttagtgtgtatctttaagttggttttggttttgttttttgtttttgagatggggtctggctttgttgcccaggcttggagtgcagtagtgcaatcatagctcactgctgctgcgaattcctggtctcaaaggatcctccctcctcagcctctcaagtaactgtgactacaggcacatgccaccttgccagcttttcttttcttgtcttgtctttcttcttctttgtttttttgtttgttttttgtttttttttgagacagagtctcaccatctttctatcttgcccaggctagtcctaaattccagggcttaagttatctttctacctcagcctcctaaagtgctaggattacaggccagcactttaggaggtgctggatgagccatcacacccagccaagtcataggtttttttgtttgtttgttttttgagacagtgtctaactctgtcacccaagctggagtgcagtggcatgatttcagctcagtgcagtctctaccaattgggcttaggtggtcctcccacctcaacctcccaagtagctgggactaaaggtgcgcgccaccatacctggctaatttttgtattttttgtagagacagggtttcgaattcctgagctcaagcagtctgcctgccttgactcccaaggtgccaggattacaggcatgagccactgcactcagccctcacagttttaattacagtttttcccttagtttttgtcttgttcatatccagcttgtcttgtatttttttcccacgatctgaattttgctgactgtatccctgtgttgatatttaaagtagacttctgtcccctgtaatctttgtaaactgatagtaaataatgaaggcttgatcagattgggttttttttttttttccccaatgtttcacagatgtgtgtactttcagtgaggagtcatgtaatcagtctttttcctgataggagtagtcagtgagttcctagatgttttatctatccaggagataatatgtccctttagcgccttaatttttttggtgtgttttttagcagccattgatgataattgtctagcccaagatcagttatttccttaggggttgtaaaatggtgacattcttttcctttcatcccttcttcaattattgcctggaatatttctataaagaaaaactttcccatatccagctgtttggttaccctgaggtatagctttcttaggaaaagtaatttaaaatgttaatcatttccctttttaaggcagtcttcaaaataatgagttggttttctgttatcctccaaaggtaaccagtgaggtggtttttttgtcgttggttcttactatcagtataaacttctggaattttttttttttttttaattttttggagacaaggtctggctctgttacctaggctggagtgcagtgggatgatctgggcatactgcagcctcaacttcccgagctaaggcaatccccccacctcagcctcccaagtagctgggactacaggcaagcaccaccgtgcctggcttaatttttgtatattttgcagagacagggtttcaccatgttgcccaggctggtgtcgaactcctgagctcaagcagtctgcctgtgtcagcctcacaaagtggtgggactacaggcatgagccaccatggcaggccagaatcacaataaacttataaattaacttgagaagaaatgattgatgtcttcatgatgttgagtcttcctgttcaagaacaaagtataccttcaatagcatattaaagtttatccttggctggatgcagtggctgacgcctgtaatcccacctctttgggaggcagaggtgggcagatcacctgaggtctggagttcgagaccagcctggccaacatggtgaaaccccgtctctactaaaaatattttaaaaaaagtattagctgggtgtggtgtgcacctgtagtcccagctactctggaggctgaggtaggagaatcgcttgaacccaggaggcagagagtgcagtgagtcaagattgcaccactgcactccagcttgggcaaccgagcgacactctgtctcaaagaaaataaataaataaaaataaagtttatctttaaggttttgtacatttttttcagtgtatgccttaggtaggttcttttttaatgttagtgtaacccagggacttctcttccattgcatcttctaagtaattacttatgaagtaccatatatgaaggctattgctgtttatatgttagtttttaccctgctcctttactaaattccaatcctttgaggtattggataaaaatatttttagcatttttcaaataacaggcagagtcaagggcttggtttcttttcttcccctcctgtcccctaccctccccttttttgagacagggtctcacttcttcgccgaggctggagtgcagtggtgcagttacggcttaccgcggcatctgcctccctggctgaaaagttcctcccacctcagcctcctgagtagctgggaccatagatgcacagcaccgcagctggctaatatttttgtattttttgtggaggcagtgtctccccatgttgcccagggtggtcccaaactcatgagctcaagcagtccgctcgccctggcctcctaaagtgtagggattataagcgtgagccactgcgcctggcctggggatcatgttttaacatgagaattagtggagacaaacacatgatatctaaataatagcaccatagtatacttgactagctttttaattattttttaaatatacaggaaggtaataagtaacaaagtaataatagtgaatagtttaagctcagttagcataatcgggcaaactttcatttgataaaagtgataagtagttttcagtggcttttttgtttaccagaaggaggtggtttttaaatacgtgcatccaagataaaatataaaaaaatgttcaggtttgctttcctacatagataaaataatatgtaactagctctcccaaatttcagcaacagttagtgaatgtttagccacaaatttgcagttaattatataatcagttcttaggattttatgaacaagttctatattctttgtgccttatacctagttgtaagcagtcattccacaattattttcctgaagtggcttggttaatgccacaccagaaacaggtcacagacaatagtgctgtaagaaatgtgtgaggaaagaggcacatgggaagtagctagctcgtgctggaggaactggaaaaaaacctcacatgggagatgacagttgagctgaattcttaactagagttgtaacagggcgaggcccttacatgcagaccacctgtgtggattaagataagacataaagtaatcttttaaaagaactattatttagaaacctggtatatgctacatggtgctgtgttatactgggtttgagaaagaatgggaagtgttacaaggattcagtggttggaaattaaggaagatagaaagttagtgttggatctgttttggctctttggtcatgcctttgtttttctcaaaatgaatgcagtgcccgtcccagaaaataccatatgagaagcgatttcataatgctgtgagagtctgttacagggacttgatcaagtctgagggccatgagagaaagtccctctgaggaagttgctttcaagctgacacctgaaggatgaagcagaattatcccagctgggatttgggaactggtgtttgaggctgaggactagcatgcatgataggaaaataacccagagtggcagaagtgggagtggtatgagatggcatcagagacgcagattcagggtcaaatcattcagagcctcctagaccatgtgaacacatgtattatgctgtggagatactgtttaataggcagtctgcttttttttctgcagtaccaaatatgccccaacagcggcaagaccagcatcatcagagtgccatgatgcacccagcgtcagcagcgggcccaccgattgcagccaccccaccagcttactccacgcaatatgttgcctacagtcctcagcagttcccaaatcagccccttgttcagcatgtgccacattatcagtctcaggtaaggctggtaaggcctaactcttaatttttgtaccatataaaaaaacttttaatatggtaaagggattttcctttataatttttgcttttgtgtgatggtagggtagatagctaaggacttggggacccttttcaatatatattcgaaggttactgatgattgtaagaggttcagaggaaacagccaagaaagatttgagagtttacagctgtttctggaaatctggaaaccatggagttaaaaatcttaactaaagtctgcttggctctatttgcagtgttaatgtgctttctttattttttgtttgaacacagcatcctcatgtctatagtcctgtaatacagggtaatgctagaatgatggcaccaccaacacacgcccagcctggtttagtatcttcttcagcaactcagtacggggctcatgagcagacgcatgcgatgtatggtaggaagcactttgtttgtctcttccagtgtgtgtgactcttcttaatttaagtttctgaaaacatactctatctaagaataacctgaccttttatgacattgagggtcaagaatctgaaggaaaagatgaacccatttctttgcctgacttgctttataacttttggcaaatagtttctacttctgtacctggtcttcagatctctttcctgctttaactaaaatgtaatgatgtatataatggcaaagcatctttgtggagaaaggtacctttctcctcttcctcatcaatattatgctttggtatatcctgcctacgacatgcaagagaattttataataataaaagcataaaggtgttctccagcatgaaaacattttgcttcactacttgatctgagggtcactggcattacatattttttttgctgtttgttataatgataatactatgtttctacatcatgctgtattttaatggttgaatattatgtcatattagatatattttagacatgagtcacactttaaatataaccaatgtgaacagaatgctgaaatgaaaatgagaagtattttatgtaaaactaagcagtatttatatgtgagaataataagcaaaaaaacccatcttcgttttgtgactaaacagagaaatttgtgtagatcaacttagcagctgtctaaagtaccaaaataatagatttttcactgttgataatttaaaataaaatgtccatttgtatatcttatgatacagaattaatggattgcttcaaatgtttttcagaatatgtttttaaatagtactgatttcattaagatgttttgttctgaatatttctgagaactaccgtagtgtcgtttagttttcctatttgcgtttttggttgtttggagtaggggataattttggtttattcatacagttgaaaagtgtactgctatgagaatgagattatggttacatgtaactacatgggcatttcatttttaaagcctctttgaactttttgaaatactaagaatataaaatttttattttttaagtttagatgtcctgaacgagtatgtttaggcaaaattgagttatttaagaatttataggctgggcgcagtggctcacgcctgtaatcccagcactttgggaggccaaggctggcggatcatgaggtcaggagatcgagaccagcctggccaacatggtgaaaccccatctctactaaaaatccaaaaaattggccgggtgtggtggcatgtgcctgtagtcccggctacttcggaggctgaggcaacagaattgcttgaacccgggaggcagaggttgcagtgagccgagatcgcgccactacactctagcctgagcgacagagtgagactccatctccaaaaaaaaaaaaaaaaaaaaagaatttacagatttctggcaaaccttcttcttgagacattactacttttcataccacctctgtcctttttgaagaataaaagttttaacattccgtaggttaatgagaataggacttgggcagcagcaatcatccttcctgtcacctgtaacccacagcttatgctttcttcctggaggttcttgtctgccacaaaggctcactgctgataggaatttgtatatgatcaaaggtgtttagttttataaaacagttaagtccagtcttaattttccacattatcactttcaattttgtattgtggattacgcattttaaataaaaaattgtgtgattgctacattttggaaaacatttttttcaagaggcccatccgtaatttaattgtaaaagatactgacaaactaacttggtttattattttggttatgaccccgtcatttgacttgtctttagttgtcttaacggggactgaatatgcgtgcaaaggcacgattgatttatcatgctggcttttatgcaacttgtatatattttaacaattttcctgtttgctaaaggcttaggttaaaagttcattatgattgtttatacatttctggtgaatacatcatgatttaacaagtggaaagaacatctctttccttccattttctggcatactccccttggaatcagatctgaaacttttaagctaaaatttccattgcatttggagagtagttatttgtgtatgcatgcttttgagacattgtagcaataatactgtaatgttgagccgaatctttctcctcattgtgttcattcactgccaacatctggcttcatcttttggatgaatgttcattggttttgaaacagcctatagggtaaatactgtgtttgaggtacagatgattttcataactacttcctagaacatgtccatttgaagagcagtggggccttagaccccaaagtccatttatgtgtgggcaaataggaaatgttgcaaacaaaacaaagcactagatctaatgtccagtgaaatctggaatgaactagtcattagagccggttctttcatgccaggaaaaagttactcagccaaatctgaactactctcctgcagtttacacaggtggtatttaattgctgtctgtatggaggcaggctaggagcaaggctgtggacttgttgtgattgtcactagttaatcaagattccctttgtggtgcttaagaccctaaaaaggacactaggagctgggcatggtggctgacacctgtaatccaagaacttggggaggctgaagtggaggatcgcttagcccaggtgttcaagaccagtctaggcaagatggcgagatcccatctctaccaaaaaaaaaaaaaaaaaaaaaaaaaaaaagcccagtcatggtggcacatgcctgtagtcccacctacacaggaagctgagatgggaggatcacttgagtccaggactttgaggctacagtgagctatcatggcaccactgtaatccagcctgggtgacagagcaagaccctgtctctatttaaaaaaaagaaaacataagaaagaattgttttgttctatgccatcataagccataatttaatctgcttaagcatgttcttcattaaatctgcagtgatttatttgaattattagactttcaaagccttattatatcaaatataaacaaaatttgaagtacattcttataaactacaacaaacttacatagaagtgttaattttatactcatcttccctgaacaatttatattttataaatatattaaatatattgtcataaattttctcaaaggaaccaaatactttgagtatgaattgtgcttttctttttaagctacatcatatctaggtttttaaaacatttaatgcaaacagaagaacatgcacccagatgttggtgacaattttatgtcaccttttctcattcattaattgttatagccatagccaaaggcattgaaaacataggaccactaatgactgcaaaatgaaatcctgattattgtttttaaatttttagtatgtttaatacacatatgctaacattactgaacagttaaatgataaaataggataattattttattctaaaaaagtattgaccttgacctctttctagctatcttagaaagggcttttgtcaaaaaccttatctctttgatgtctctttttttgagatggagtctctccctgtcgcccaggctggagtgcagtggcgtgatctcagctcactgcacgctccgcctcctgcgttcacgccattctcctacctcagcctcccgagtagctaggactacaggcgcccgccaccatgcccggctaattttttgtattttgtttagtagagatggggtttcactgtgttagccaggatggtcttgatctcctgacctcgtgatccgcctgcctcagcctcccaaagtgctgggattacaggcgtgagccactgtgcccagcctctttttttttttttattttttatttattttttattttttttttaatttttgagaaggagtctccctctgccacccaggctggagtgcagtggcgcgatctcagctccctgcaaactccgcctcctgggttcaagcagttctcctgcctcagcctcctgagtagctgggactacaggtgcccgccaccacacctggctaatttttgtgtttttagtagagacagggtttcaccatgttggtcaggctggtcttgaattcccgacctcaggtgatccacccacctcagcctcccaaagtgctgggattacaggcgtgagccactgccccggcctctttgatgtctcttaatctaacttccatcattgcctctaccccatcccttctaagaagttactttaattttttttcctctcacatctactctttttttttttttttttttttttttgaggtagtctcactctgtcacccattctgaagtgcagcggtgcgatctcagctcactgcaacatctgcctcccaggttcaagcggtttttctgcctcagcctcccgagtaggtgggactacaggtgtgcgccaccacgaccggccaatttttgtatttttagtagagacggggtttcaccgtcttggccaggctgatctcgaacttctgaccttgtgatttgtctgcctaggcctcccaaagtgctgggattacagatgtgagccaccacgcccagcctcacatctactcttctaatccatctaattttgttttatggtgatgcttttacctttcagaaacagtaataatacaacttttccgactaactagagccattaggaagaattagatccagaatccttttttgatttgtttttggtagtttaatgcagataagtaagaaaatatagttaagttaaaaaaaaaaaaaatgaaaagcatccataatccctccacctgacaactgccttttaacattttgatgtgtatccttccaggtgtatttaaatacactcaaataccctacccctttatgtagacatgttttaataagaaataatattcatgtttatattcttgctatgatcctaaatttttggatccattactagataatctttcaggataatgacatttccattagtaatgtttttgcaaaattgtgtgtctattgaattaaacttgtaaaatagttttattttggtacatgatttatatcaaggttgttcagtagaatgccatgttggtgtttttattagataatgattttattccttttacttttaagcaagtcagcatgacaacttgacacctaagtacagaagaacagtgtcttccggtttagtcctttcttttaaaattctgtagcagtgtttaaagtgcttgtcatctcttatgaaaatgaattatgcatgaatacaaaaagaaattactaatatgtcaacctttccagaaaatttggaaaatgcacacctcaaaaggctaatttacctttctatttcccaaattcagcatgtcccaaattaccatacaacaaggagacaagcccttctttctactttgccagtgagttgggttttttatactaatttttaattgtacagtaaaacactttttaaaggatacatgttaagggagtagacttgttgaacaatattttccttgtgccagtcaaattattgaaagtacttatatatataaataattcagtttttaaaatggaaatacccaatttaagaaggctggagttaatgaaaaatggagttgtttcagaaatcaatttttgcataccaagcaaatgtgactgggaaatgcctaatattttccttgttagagaaacttcctaaacagctttatacacacacacacacacacacacacacacacacacaaacacacacacccaagccacaagcttggtataaatttaaaatgtttatttatacacacacacacacacacacacacacacacacacacaccccaagccacaagcttggtataaacttaaaatgtttatttatattctgataagatgaaatttatgcctaccaggatttttaattgaataggattgatgaaatactaagggaaaaacttttcagtcctgtgcatggctaaaggtttaaaatactcaggaagggccaggcacggtggctcacacctgtaatcccagtgctttgggaggctgaggcgggtggatcatctgaggtcagcagttcaagaccagcctagccaacatggtaaaactccatctctactaaaaaatacaaaaatcagccatgcatgctggcatgcgcctataatctcagctactagggaggctgagacaggagaattgcttgaacttgggaggcagaggttgcagtgagccgaagtcgtgccactccactccagcctgggtggcagagcgaaattctgtctcaaaaaataaaatattcaggaagcagacccctcaggatatcttgagcttaagcaagagatcatgacctctcaggtcattatcttggacagcacaggtcccctctccccacctggcaaaaagtacagaaatagttgctccttcatggagaaagtctgggcagagctttcttctggaaatgaacttttaaggtacatttttcctatttgtagggcaatttgtaaaaataagggccggacgtggtggctcacgcctgtaatcccagtactttgggaggccgaggtgggtggattgcttgaggccaggagttcgagaacagcctggccaacatggtgaaaccctatctctaccaaagcatggtggcacgcacctgtagtcccagctacttgggaggcggaggcacaagagttccatgaaccctggaggtggaggttgcagtgagctgagattgtaccactgcactcaggcctgggcaacagagagagactctgtctcaaaataaaaaataaaaataaggctagtcttggactttggtatttaaataggaaggagtactaatatttgtagaaatcctttagaaatttgtgccattaatattgtcaccttgtatgaaatgttgtgttctagaggatattaaggattcaaattttatgttaggcacattttgagttattttggggtgactcaatgtctgactctactaaatgccatattagcatttaaaatgcatttgaccttaaatctttgttaattatgccatgacttggtatccaaaaataagctgatacatacatacatacatatatgtgtgtgtgtgtgtgtgtgtgtgtatatatatatatatgtatgtgtgtatatataatttatttggtgctaggaaatgttaaatttaatcctttaatagatgctctttaaaaaggagtcttgctgtatgtatatactattaaaggggaaactatgtctgtgattgtagtgtgtaaaagatagtaggtgattttattatgtactcaatttgaggtctcaaatgtagttatcctcaccatcttactgtctctgttagtagtttggtgttgttttcctggtaagtagctaaggtccttaatcattaacacctaagccttaattgccttagcacaacttcccctaaaagggagtatcagtactttttaaaagaaactaacagttgggctgctaatttaatctgctgcttcatttccccctgttctaagccattttatgatggtttggtcaagttgccttttattccccttttagagttttcaactttccttcacttccctttttctgaatttaacatcagatttacaagttggaagattttgttttgttttataagttttgcaatgctggtgatctcttatgacttgtgcatccaaagtcaaaatgacaaaacctagttacaaattaaacacacagctttctgtacttaatttgcttcagtgagatcacagctgaggaaactagttctggaatgtggttagtgttattaaggatttttgactgatcatatgtttagaatcttaaatatttatgtcaaggaacactgagtgggaaacttctggactaggtctggaccaaagaagcatatgtctttgattatctttaatctaaaagattttatgaagactaaagttttataaatagaagtttaactgatgaataaatcagtattacaaataaaattaactttatttttaacctctctgggatctttagccagaatgagcatatataacaaaagcagtgaaataatatgtgtgggtcagaacccactgcccttcccactccactctccttttccctgattctcctgtgttttttccttctttaccttatcttggttcctttttttttttttttcttttgagatggagtctcactctgtcgtccaggctggagtgcagtggtgcgatctcggctcactgcaacctccgcctcctaggttcaagcaattctctgcctcagcttccagagtagctgggattacaggcgcctgctgccacacccagctaattttttttgtatttttagtagagacagggtttcaccatcttggccaggctggtcttgaactcctgacctcgtgatcacctacctcggcccctggttccttttttgtctctcttgtcttccaagctatttttttccttggcttttaaattttcttcctaccctgctttgtgtcactgtcacttaactggcctatcaaggaaccgaactgtatttttgttactagtattgatttaaagtataagtttcacatttctcccaatttattattattatttatttatttatttgtttattttattttttgagacggagtttcgctcttgttgcccaagctggagtgcaatggtgtgatgtcggttcactgcaacctccacctcccgggttcaagctattctccttccccactctccctagtagctgtgattacaggtgcctgccaccacgcccagctaatttttgtatttttagtagagacagggtttcgccgtgttggccaagctggtctcgaactcctaacctcaggtgatccgcccgcctcggcctcccaaaatgctgggattacaagcgtgagccaccgtgcccggctccatttctcccaatttcaaattcaaggaggaaaagaattcctgattaaggtacttctttcagatcttttgagctagaacaaaaaaacaaagggaaatatttctaattaactctttttaaattttgtttacaacgtatgatacatattttacacatcctttgtggtttttgttcgtcttgtttttaatcaatgccttgcaagtttaccggtatttaggtagggaaaggattttgtttttgtttttttaaacaaagcctatgtacattcactcagcttgggtatttgtgctatgcatgcaaattagctatagattagaaaaccgtattatagtctttaaatactggtaaacttaaattgcagagatgccttttaaaaatgcatagtaaaaatatttcatctttacttttctcttcaaatgattttaagatttttacatttttccagttgatgaataacttaaattatgagatttcatgggcataattattttctatatttattgttactttttaatattcttaatactttgcttagaaggtatttaaaagtgaaatttcaaactttttagtacaaaatttcttgaataaataaagttacaaaaaaaaaacaaaaacctctgagattccgtactgtatctttatgaacctccatgaacagaatttgggatttgggaattgcttttccttagacagatttagattgttacaaatgacatttttaagaggctggggtggcggtaggggttagtgctaatggtttaacagtaggggaccatggacaactgtagacatcactatccagtagaacattttgtggctgggcgcggtggctcacgcctgtagtcccagcactttgggaggccaagacaagtggatcacctgaggtcaggagttcaagaccagccagaccaacatggtgaaaccctgtctctactaaaaatacaaaaaagttagccaggcgcgcctgtagtcctagctactcaggaggctgacacaggagaatcgcttgaacccgggaggcagaggttgcggtgagctgatatcacgccactgcactccaccctgggcaacagagcgagactccgtctcaaaacaacaacaaaactgcactgtccaccgtattagctacttagctacatgtggcttttttattattcaaaaataaatttttaggccgggtgcagttgctcacacctgtaatcccaacactttgggaggccgagatggacggatcacttgaggccaggagtttgagaccagcctggccaacatggtgaaaccccgtctctactaaaaatacaaaaattagccaggtaatcccagctactcagaggctgaagcaggagtatcactttaacccaggaggcggaggctgcagtgagccgagatcgctccactgcactccagcctgggtgacagcaagactgggtctcaaaaataaacaaacatggccgggcgcagtggctcatgcctgtaatcccagcactttgggaggccgaggcggatggatcacttgaggccagtagttcgagaccagcctggccaacatggtgaaacccgtctctactaaaaatacaaaaatcagccaggcatggtgatgcttgcctatagttccagctactcggcaggctgaggcaggagaatcgcttgaacccgggaggcggaggttgcagtgagccgagatggtgcccctgcactccagcctgggcaacagagcgagactctgtcaaaaattaaacaaataaatacatttttaaaatgaacgtaagatttttacaagtacaacaaactcaggttcgaaatttacatcaaatcttttagaccaagtcagtgcctatacaacttggaggagctggaagtaaacttaatgagtatgatgatgatggagggcctgttaataagccaccaagttagaaaaaaaggactgtcttatagacttatgggactgtgaagctcaggaaggcttcatcgtttgtacatcatttgttctagctcccagaagacgttcactactcttaaaaacattcagagactatgttgccacagttttcttgttaaaatattctggcatatgttaattcctacagtctggaaaattttcccagtgtataaacaaagctgctgtatccagtctaaactggatatgaaggaatattaatgccagctgtggcattggcagtggatgcacaggtgatcctagaactggctctttgccttgccctttcccctgctaagagatagctttgcagctggagacgtaactgttagggctggagagttggtggcccttagccctacaacacctaggattatagaactgctccatgtgcctagcctaaccctctgcacaccatttacgtggaatatacccagagccgtctatgctggtgactcggcagccttgcctaccagactgctggaactagggtgcctcttcccaaagctgtgcttgcttctctcaccaatcagtcctgcatatgtctgtgtttgctaacacgttatatgaagaatgtggggaactattttggaatcatttctgtgtatgggcttattatcttgagggattttaggatttgtttctcaagagagggctgggaactataccttgctagagttgtcttgagaacgctctattctcagctcattgcctcgtggaggttagttttttatcatcggtgtgctgtccatagtcactggaagcagtgaacacatcctactctgcttctgattctcaacttactgtttttgaagcacatgaacaggccaggcacggtggctcacgtctgtaatcccagcactttgggaggctgaagtgggcggatcatttgaggtcaggagtttgagatcagcctggccagcatggcgaaaccccatctctactaaaaatacaaaaattagctgggcgtggtggcacatgcctgtaatctcagctactcgggaggctgaggcaggagaattgcttgaacctgggaggcagaggttgcagtgagcctgggcaacagagtgagtgagacttatatctcaaaaaaaaacaaaaaacaaaaaactgaaagacatgaagaaatggtttttgtaccaaggtttggcccacgctgagattcacaaagaactggctttcagttcttatctttattttgatttaaactggcccatcatgttgtcctttgaagttagtctagtaaatttctttccaaagggctggggcactcagaagggagtttacttttctatatttatttcataaagcaaagatgggagatcctccattagggcttgggaaagtaaactgagtggcagaagggctcctgtgattagctgagagagactgtggtccttcggccctgatgatagatccctggccttgccacataccatacacagtgcccgcacccccatcccccaccacacccaatatagtctgtgccctcaggacattgctccagggcagtagcatggtgaggttagcctgatgatggccttgagctaaagagtgtgcacctaaaatgcacttgtttgagtagtttctgcctatgccttcaagttgcctttttgggaaaacctagtgaccgttaagagtaaatgcaaactaatttgattttaatatcatatgtagagctgtattatatgaaccaaatgctagtctgttaagcaatagctacacttattttttcaagacaatggatggtttaaatggagtcatctatagaaattggtagtggcgtgagttatgcattgtaaccatcaagaaagttcagttgatgaagtgtagaggagcgatggaggttgtcagacatcggttgtgtacatgctcctttttctttcactttagtttccacgggctcccttgctcagcagtatgcgcaccctaacgctaccctgcacccacatactccacaccctcagccttcagctacccccactggacagcagcaaagccaacatggtggaagtcatcctgcacccagtcctgttcaggtaagggcaactcagaggtctgcatggagtggcttctttatcctagtatctgagtgctttcttcaggtgccaggtatcgcatcgtcagaacacatggcatgtccaccctcgtgaagatggatacagctgtgcccctggggtggtggttttaagaatcacatttaaaggctgggcgcagtggctcacgcctgtaatcccaccactttgggaggccgaggcgggtggatcacgaggtcaggagattgagaccatcctggcgaacactgtgaaactccgtctctaataaaaatacaaaaaaattagccgggcgtggtggtgggcgcctgtagtcccagcttctcgggaggctgaggaaggagaatggcgtgaacccgggaggcggagcttgcagtgagcagagatcgcgccactgcactccagcttggacaacagcgagactctgtctcaaaaaaataaaaaattaaaaaaaatcacatttaagatacatgttgataataaggtgattggataagctctggaaacttgcagtaatgaaaaatcaaatttaacataaagttcataaggcaaattcctatttgcttgggactttttaatttctaaggtttatgtgatgaggttattttcctatgagcttcttgaattatgtttgctaatggaggcagttaaagatgtctttgatatctatcagttccctggggcagtagtcttttttgactttagtatgtatgctcagaagtttctaactgccagactgagaatcaggcttctgtaccctagaaaggagttgtccagatgggaggcacctccagccttgctcttaccaccctgtacattctcctgtactttccagtgaccctcatcataggcccaagtgtgcaaagcttagctttgtgggtatcccttggctgcttttcattaaagaagttttcctctcaattctttcctgtcgctttgcagcaccatcagcaccaggccgcccaggctctccatctggccagtccacagcagcagtcagccatttaccacgcggggcttgcgccaactccaccctccatgacacctgcctccaacacgcagtcgccacagaatagtttcccagcagcacaacagactgtctttacgatccatccttctcacgttcagccggcgtataccaacccaccccacatggcccacgtacctcaggtaataccagctttagccaactttctgtgaaggccaagtagaatgtgaaggttatcagtaagcagctagaggctctcccagctaggaaaccctgtgtgtcatgccatttgcctgtctccctttccctctcaaatacacgtgatctggccctaagggaatgtttgtgtggttttgtcatgggatcagtgaaggtgctgattggtcagtcctttagttttccaactgagaccttaaaaatatctttgactctggaatgcaacccagtccttctttcctttctgtgtctgctttgctatgtctatatagcctcactactatatatatgtgtacatatatattcccctacacacttaccttggaagccaggcagggatgatggccttcacagagtctcagctctccgaagtgactaccggggcctgtcaacttgattgttactcacatgagttccagacacatctctccaattgttttccctggttatccatatatctgctttgaccataagttgtactcttgagagggcttggccttggacattggtgcagtgtaactagaagctggaagcacccaggtggtcccatttttctttaagagcagccctggaagcactttggagctcacctccagtgtaagctgctacaggtgaaaggtgtgcttgccatctcagtggttgctgtctgcatcagctgctgacaaaggtccctgcactccagggcccaggggattgtcttaatgaggagaaggagctgcactgaagttgggctctaacgctggccttgaggccctccctggggctgttacgggtgaattggctgtattagatgtctctgctactttcataacagaactctctgaggcgggtctaagtgagacctgccacaatgaattccatttcctgttaaatagtgcgccagtgaggctctggcaaggtgtgggctagagatgcgactcagttggatctatctctcagaaggctaccttgtaagtagagttccacagctctgggaagtttgggcgtcctcaccctgcaaagtttaggttctgtggtgtagcgcactgcagttgatttgctttttgatagtggggagggaagccggtttggtccgtgtgggccagcgtggtttggtggagtcagcttcataagagctggggtcctgtaggtgtctaccagaggctggtggctaagtaggcatgtgaacttacatgtaagtcagggatccctaaaacctcactctgtttttgtgctgaaagggcaaaaaggttaacacagggaagctcaaatttgccatgtgcccgtttgaatatgtgagagtaaaaacggcatttcatccaaggcttatcgtagtctagaacagtgcacagtgtgggaaaaaggaaacaagggctcttcctggccctgccaaccccctgcagagctggaatccagctgtttgggctgactaaaatcacctttccaacttgacagtgagtgagaccaggttgaacttggtacagagacgctgggctggcccagatgacttcaggttactcctttccatctcactggagccattaaaaactccaactcctcctcctcctcctgctccatcagcatatctctgagagagtcacgggggcctaagagtctcttttcactgcctggtgagcagaccagaagcagagggagagaggcaaatgaacagaggtccaagtaattcacatacttgactgtgacagtctctgcttattaatgtaatctgttttcctatttgaaagggatgttatctgcaaaactacctcaggccccacatggcagcctgattctgaagcatcattgaatcttgtatgatattaagttgagaaagctgcccttggatccagtgtctaatctttgtgaagatcttaccccatacatagaatacaatgatcagaaatgtcaagggttaggacagcacagccctgacttctacccaggctcacttgttgcctgctccctgacccttgcaggatctgcccaaaggtgaagcgcgtcttcaggtcaatagataatctactagagattgtccccagagaacagaactgggccctgaggcccaccgttgccctttcctgagagtcccagcccagtgaaaggaacacagttgacatgttgttgaagccggagatgttgcctgtatgcgtaaaagagctctctgtttcaggctcatgtacagtcaggaatggttccttctcatccaactgcccatgcgccaatgatgctaatgacgacacagccacccggcggtccccaggccgccctcgctcaaagtgcactacagcccattccagtctcgacaacagcgcatttcccctatatgacgcacccttcaggtgaggcgtgtgtgtgcaggggccgccggggcaccccaaagcattctgctcgcacaggtggaatggcaggcagggccagtgcttcaagccccgcatttgagaactagcaagacccgtccaggagtgtgcacaggagggactgtgacgatcagttcagcatcagggcctgaggcttccgggagccgagtctgtgtgtgttctgatggtatacaggatttggcttgatgagaagcagcagcagcagcaacagcagcctgatgcatgcctaggactcagttggccttccttgttatgacaggctggacagggcagtgttttccttcctgagtcccaaaagtctgacatgtggggggttattaccatggcagagtttgattgtagctctggagaagatactgctgagaaagcgctgtggatggactggctttgagtgtagcgttagccccagcccctgaacaggggagagcgccctgtgattgtgctctactacttgatggctgccatggcgatacttcacagtctgacctgttattctgaaagcaatactggtgcttggctaatatttggggagggggtttgttaaggcctttttttctaccccatgaacaagtcttctgggagttttatctgaagtggttttacgtctgactggtttgtttctacccacccacccaaccctccccactttggtgcagatgggagggggaaaagcgaattcaattttgagttttgttcagctagcacgaggatagtttacaatcatgtgctgcagagacactaggctgatgtgtggtgttgccagttttctgtttcaatgttcgcttttctttttacagtacaagcccaccaccaacagcagttgtaaggctgccctggaggaaccgaaaggccaaattccctcctcccttctactgcttctaccaactggaagcacagaaaactagaatttcatttattttgtttttaaaatatatatgttgatttcttgtaacatccaataggaatgctaacagttcacttgcagtggaagatacttggaccgagtagaggcatttaggaacttgggggctattccataattccatatgctgtttcagagtcccgcaggtaccccagctctgcttgccgaaactggaagttatttattttttaataacccttgaaagtcatgaacacatcagctagcaaaagaagtaacaagagtgattcttgctgctattactgctaaaaaaaaaaaaaaaaaaaaatcaagacttggaacgcccttttactaaacttgacaaagtttcagtaaattcttaccgtcaaactgacggattattatttataaatcaagtttgatgaggtgatcactgtctacagtggttcaacttttaagttaagggaaaaacttttactttgtagataatataaaataaaaacttaaaaaaaatttaaaaaataaaaaaagttttaaaaactgatcaagttagtgtgtgtctgtataagctacttctttgtaggatacttaatatcaaagcaggtgtgctaagggtgcattttgaatatcccggaaggtagctgtgaaatgatttttcttcttcacccttagttctggttcaaggtatctctagaaaaagacaagactgagctattctctttggtggattagagatctgcttcaggaggaggaaggttggccagagttgggcagcactgaaattccacatcctcgggctgacaccgattctgtaagcttcctttttaatatctcctgaaccaaaatgagtgtcattagctggaagttcccaattcgggcatttttctactttaccagtagggggcaggagacactcagaaaaaaattgcaataaagaaatccagagggcatgaaggctgaaaagatacaaagatgtacaaagctgcttattgacatggatggactcataagcatttgttagtattcccagattgcaacggggaggacaaagggaagagcgagtatttgggcagggcaaggattttgtagagacaccatggtcttaatagagcctttaaatattatgacagcaaatcaagattctgaaaactttttaattcacatatagcaatttgtacattatagcaaaatttgcattattcaagaataagttacttgtacagtacataaaacaatacataaaaatttgccaaataccttctgcctataatgatacaagatgaatccactttatgttatcacaatgtgctgtatattctaaccaaacacaggatgtcagatgtgtccttgttaatatactcgcaagttcctctagcttgtgggagatgttagagctaacacatttgcagtaagggacttagtcctgaatagaaagcatgaaggaatctcaggcaaccctcagggaagagtccaaggccttgactttaggttaagaaactgttatgtaaaaatagtgttctctggcccaagattttaatgattgctattcctttttcctacggtccagaaatgatcaaaggcagaagatttataccagataaagccatatggattgctggtctaaaattcaaggcaggttagttgacttaattctttggtgctggtgactgttagtttgtaaaagttcaataagtcagatgaaggaagggatggtgccgggagctgtcaagctgtactggtggggtctgtaattagagctaactggagggatcatgatgtctactgtccagtttggtgttgagccatggctctcggtagaagttgccggctggggcctggtcaggactggaaggagagtggtgggatgtgctgtgcctatggtgggctagctgcagccagtggggtgcctgccccacactgctgcccaccccttcatcagctgattctgctcccacataaagaaaggtgttggcttagtgtcacttcttcctagagccatgggagttttctgtcagcatgtttttgagctgtcctggtaacttggacgggaagcagtctggaggtgggtgccttccaaatctctgccacagaatctgaacttgcactttgcagcctgttagtcagagctgctaagtttgctctacctggtgtgcctcttggcaccacctgagagatgtatgtagagaggctgctaagaaatgagtgcccctggcatgaagacgtcatatcccagatgtttaacttctggctggagggagggaacttaatttggttcattatctactgggtacctttcctgtgcggaggggaggaccagtgactttcc

SEQ ID NO: 16241 - DNA, 84132 bp, Human
  misc_feature (1)...(84132): n = A,T,C or G
gtataaacttctgaaatgacacccttattacttattccaaaatgttctattcaaaatgcttctcagtaccaaaccattattactatgcaccttagaaaccactttcttttttaaaaattattatctttagagacaggatttcaccatagggcccaggttggtctcaaactcctgggctcaagtgatctgctccccctcggccttccaaagtgctgggattacaggcgtgagccaccgcgcccgaccagaaaccactttcttttgtttgtttgttttttgtttttttttgagacggagtctcgctccgttgcccagactggagtgcagtggcgcaatctcgctcgctgcaagctccgcctcccgggttcacgccattctcctgcctcagcctcccgagtagctgggactacaggcgcccgccaccacgcccagctattttttttatatttttttagtagagacggggtttcaccgtgttagccaggatggtcttgatctcctgacctcgtgatccgcccgcctccgcctcccaaagtgctgggattgcaggcgtgagccaccgcacctggcccagaaaccactttcaaacttactttccacttaaaatattttatactttttgttttgttttgttttgtttgagacagaatcttgcactgtggcccaggctggagtgcagtggcgcgatctcgctcactgcaacctccgacccccaggttcaagcgattttcctgcctcagcctccagaatagctgggattacaggtgcctgccaccacacctggctgatttttgtatttttagtagagatggggtttcaccatgttggccagactggtctcggactcctgacctcaagcgatccgccgcgccagcaaaaacgttttagtcttatctgtactcatttactcattcaatatttattgagtgcctactatcaccaggcacctttgaggcctaggtttacagaaataaggctccccctcccccaccccgagtcccctgaagggtactgtaattgtttccatttctccaattttcactttaatatatgtgaattttcacatgcttcattcagttcagtggttctcataatgtggtcccggaaccagcaccaacagcagcagcaactgggagacttgttagaagcgcagtcttaggcccaccctacactctagggatgggcataggagtgagtgtgtgtgtgtgtgtgtgtgtgtgtgagagagagagagagagagagagagagattgtgtgtgtgtgtcaagctcggtattaaataggtcaaagagcaacatctggcttctaaacccaccctcaggcctctccaccgagtacctgtctcaaacccaatctgatccaacaataaccagccttaattcaataatctgtgctacctgagatgatgggaataatcgtggtactataaatgttgcagaacaaaaacgactgcagtagattttctggggctacaccaactgaaaatgggccggaccgagatccgggagagcgttttcctgcgctagacacggcgttcagcctccgggttccgggtctagctgagtcagggcggcgttccagccgagtgcggcgtcggaaacccgttcggttgcgcccgaaccttcggtcagaggccagcgctggaagcccagaccacagcacccgggtttaaacaggagcggaggcgccgggaagggccgggggggccggctagggccggccagcttggaagccgcaccctcgcggccccagacgccggcagggcggagccacgcggccgcagccccagccgagacgcgagctcgtggctcgggcgtatgggggctccaacgggagcggctgcgccgcccggccgggtcaacgtcgtgcgcatgcgccgacccggcgccattttggtggccgggcgcggaggtgattccacactgaggcgagcgcggcggccggggtggtagtggcagtgttcgtgtgctcaggtctgaatcgccgagggaggaggcggtggaggaagaggtggcggcggtggcggtggtcgtagcggtggcggaggaggcgggtacgaatcagctgcgggcggagacatggccaacatcgcggtgcagcgaatcaagcgggagttcaaggaggtgctgaagagcgaggaggtcagaaatgaactcccggatatcccccacctctgcctggggcgggagggtcctcccagctgcgaccccgatatccccggtagtccctgggtggtcctccttgcggccgcccttctgcctgtgaggaagcagcagtgttcccctcctccttccgccgccttcccctcccctcccagagcgctaggatggacggtctcgcgggcgggtggtctggggtggaacatggtttggggaggtgatggacagggggcaactcctcggagggatggaagctcacaagagaacccgaggcggtggccgcagctggaaatgtggctgtggggtggggagggagcaggccgagcctgagaaaacccgggaagtgggttgggggaaggggaaaggtggtaactggatcccaagagcagtgctgctcgaaggcccacacttttgagggtattcggggttattgcctgtcaggccttcactgttcttttcttggggaaggagcagtgagtccttaggtattgattaaaaaggaaggacattcagagttagtccttcttagttgggtgttaggagtcaaagggagacataatagaatactgtcttatttggtggcaggggtaagggaattttcacctgagttagcaagttaattccaaataagataattatctcttttccacttaacccccaaattcctaggcctcatctttattgacatctcaatcttttgagtgggcaaaggcaaggtgtttggtgtattaaagacatgtaaatatttttagttaggaaacaaataatggaatgtatgagtagcttatttcaaaatattgtttacaagttacagatcagagagactgtcttaagacagtgcctctgtgactcgtgttgtgccacgaaacttcattatgatgtccctcatagttaacttgattcttacttttgaaaagcagacctattaaaaatgtgaaatttcaccagattaatacattgtttcatctccttattgagatttatcacgacttaacagattttcaaaaaagttgcctcccgttgctcttaagtcctgcagaatttagatacatttgtactacgtttatttatgtaagatattcacagtgctctagtaatttgactcaaaattatgcaagtattagtacagtttctcataccaagatcaacaagaatgccagattgtcttccccacatgaattaaacaaaaagtaatacagaaaatgattattttcaagattcacataccattattgaatatatcattgctatttgtgtttttcttttacagttagtactttaatagtgtcaataataatttgtgaaattcagcattctaagtatgtgatgagtatacatggagaaaaaattatttaaaattcaaaaatgacaacagacttattgaaagtagtatataagtcatggtcggttttacagagcatgtgtatgaactctgacctctatgtttgttcatatgccaaaactctgaatggaaggatgactttgtattttgtggtacaatgcagaaatagagtcataagtgtctgtactgatacaatgaaacagcaattttaacttatttaatatgaaaatgtattccaggttagttgacatatatactcctaatgaaagcagttgttgttgccaacaactgaaaacatttcttgtttaataaggttgtacaagcctgaaacttaatagacttttaatgctttattttctgttacttacggtaacagaaacagtaagttactgctctggtaattaatgtggtctctttgctttttatgagctgacttttcaccgtggtattcttagtactaagttgaagattaccagaaatacttgtattgctctctagtaatgcatattaaaaaaacactgctctttatacgtaagggatgttgaagccttacttcagataagcatcaaaagtgtttcagaagaagaaaacaggaaatgcaaacagacaggttttttgttgtttttgttgtttgtttgttttgttttgttttgtttagaacagtacctgtataaatatggaaggaaacttctgggaaaataagttggaaagaacatttaggaaagggtcacatcatttaatcttggaataaatataaccaataaatagcttattttcaccagtattttttgatattttagtagccccagttctataagtgtattgttattttcaactcattgaagacttgtagtatagtccatgtgtttcctttttaagggtgtaaatacagtcttttgaatggctgatcaaataaatgtttcatcatgtcacttttttggtaaatcagcactttaccgaagtttatttcatgtgtttgtatgcttgtgtttactaagaacactggttgatttaaggactttttggggtggccttataagagcctttgtaaagatagctgacgcttactggattctggttatgagagattataagtggccgttcttagagtgtgttaaaatacagccaacaagataaatgtgaaaaagcaaggtgcagaatagtgtggaagaggccaccatttgtgtcaaaaagaagggcatgtgtgtatttgcctgtatgggtaaaaggtttcatgagaaattggtaaaattgattgctttctgtgtagagagttgggtgtctggggtatagatattttttgaattttgtgtcatacaaatgtgatttacttaaaggcatcatttggcctctttcccttaagacagtgtttggaaatttgtcagatgtttctttttattaattaatatttattttctttgttttagatgtttgtttttaaatatgagtgtgaattttaagtagttttaaataatattccaaagttgttaggcatggaatattgatgtaaagtacattttataattagttattttatgagtaggattacataagtaaattattaattgtgaggatataaacccataatcaatgttttattcataagttttattatttactattagttattgctgctgttaataactagctgccatttgtagaatggctagttgttcttagtatcatttgtttttacgttattgctaattcttaagcacagttctttagatgtcctatttcctagatgagaaaatagagatttagagaagttaaattatttgtctgcaatcacagagcctgggatttggatctaggtctgcttgtgttcatattgtcccacgctgtcatgacttgctaaggataggcatgcttttaattaatttaaaaaatcgagcctggtttgtattactggttaaaggatttaaacacagtttaatttgctagtttaaactcattgaaataagtgttacctataattaactttaagatgtacttgaatttctttctttcatgtttttttttttttcttttaagaaggaatctcgctgtctcgcccagactggagtgcagtggtgcgatctcagctcaccacaacctctgcctcccaggttctagagattctgccgccttagcctcctgagtagctgggattacaggtgcccgccaccacgcccagctaatttttgtatttttagtagagacgacgtttcaccatgttggccaggctggtcttgaactcctaacttcaagtgatccgcctgcctcaacctcccaaagtgctggggttacaggcatgagccaccacacccagccagatttacttgaatttcaatataccaaatattttaaaatttgaaacttaatgaaataaaacacccttaaatcagtgcactctcttgttggtcttatgctatatggcacctgttggtttttcatgttgtaattgcactttggtaacattttcttttcttttcttttctttttttttttttgagacggagttttgcttttgttgcccaggctggagtgcaatggcgcgatcttggctcaccccaacctccgcctcctggattcaagcaattctcctgcctcggcctcctgagtagctgggattataggcatgcaccaccatggctggctaattttgtattttaagtagaggcgaggtttctccatgttggtcaggctggtcttgaactcccgacctcaggtgatccacccgcctcgacttcccaaattgctgggattacaggagtgagctactgcacctggccaacattttctagtctcatagggcatgtttaaatctatggcataaacaaattggtttcgtgaaaattactatatagtacattaagttttccctcatcatttaaatagatttttgtgtctattttcctttaaaattttaatgtacttgatctagcttgatctagattattctgtaatagaagtagttgtaaatctctaaaagtaagtcttttgatttctgtagaccatggattttttaaccttggcactactgacattttgggcagatagttctttgttgagtggctctcctgtgcattgtgggatgtttagcaacatccctgacctctaccagtatatgcaggtagcactgcagagccccagcgcatgtccccactatctcttcttgctggatgcatcaactaaaaatgtccccagactgccatatgttgagaactatgtagacaaaacttttttttttgatacagagtcttgctcagtcacccaggctggagtgcagtggcacgatctcagctcactgcaacctccacctcctggttgcaagccattctgcctcagcctcccgagtagcttggattacaggcgcctactaccatgcccggttaatgtttttatttttagtagagacgggggtttcaccatgttggccaggctggcctgacaaaactctttaaaagagtgtttatggccaggtggggtggcttatgcctgtaatctagcattttaggaggctgagactcgattgaggccaggagttcaagaccagcctgggcaacatagtgagagtttgttactactaacatttaaaaaaaatcagccaggcctggtggtatgtgcctatagtggcagctactcgggaggccgaggctggaggatgcttgagcccatgaggtcaaggctgcagtgaattgtgatcatgtgaccgcactttagcctgggcatcagcgagaccctgtctcataaatgaaaaaagaaaatgattcctggctatttattaactatataagaagaacacagccaggcgtggtggctcacgcctgtaatcccagcactttgggaggcctaggcaggtggatcacgaggtcaggagatcgagaccatcctggccaacatgatgaaaccccgtctctactaaaaatacaaaaattagccgggcatggtggtgagtgcctgtagtcccagctacttgggaggctgaggcaggagaattgcttgaaccggggaggtggaggttgcagtgagcgagatggcaccactgcactgcagcctggcgacagagcgagactccatctcaaaaaaaaaaaagaatactttgagacttaactgtatcagatgtgtaagataatttatctaaagaataaatggacacagacagtaaagacaaaaaatatatactggctttgaatgttttatttttaaaacttttaagtttgtttcccgtttttagtgtttttcttttaaaatttctcgcttttgattttaataaaaaggtaaaattttctaccaaaaatgaatgtaacgagaatttgaacagttgtttctaagactagaggcaggcgtggtggctcacatcggtaattgcagcacttggggaggctgaggcaggagaatcgtttgagtctgggaggtcgaggctgcagtgagcggtgattgtgccactgcactccagcctgggtgacagagcaacacactgtctccaaatagtaaaaaagtggtttttaaagtttttatttttattttattttttcaaaagtgtgtttgaaagttatgtaagttacagttttatgtaatatttaaatagtatttcttatggtttctggaatgggttgagcaaggaaagcctatagattgggttaaaaaaaatcaaagtctgtgcaggtaatatgtttggggtgaattccttgtatacagtgttacaaagactttgagctctgtccattgggcgtaggtttagacacatctgggctccctagcttcttccctttttatttatttatttttgaaacagagtctcactgtcaccaaagctagaatgcagtggcgtgatcacagttcactgcagccttgaactccccaggcttagatgatcctcctacctcagccttccaagtagcagggactaaaggcgtctgccaccatgcccagctaatttatgtaattttttgtagagacggggtttcaccatgttgcccaggctggtctcgaactcctggactgaagtgatcctccggccttggccacctgaagtgctgggattacagacgtgagccaccatgcttggcctgtcaccccttcttaaagactatacacctttttttttttttttttttttagacggagtctccctctgtcgcccaggctggagtgcaatgcgccatctcggctcaccgcaacctccgcctcccgggttcaagcaattctcctgtctcagcctcctgagtagctgggattacaggcatgtgccagcatgcatggctaatgtttttttttgtttttttttgtttttgtttttgtatttttagtagagacgggtttttaccgtattggccaggctggtctcgagctcctgaccttgtgatctgccgcctcggcctcccaaagtgctgggattgcaggcatgagccactgcacctgggtttttttttttttttttttgggagacagagtcttgctctgttgtccaggctggagtatggtggcacgatctcaactcaccacagcctctgcctcccgggttcaagcgactctcgtgcctcagcctcctgagtagctggtattacaggcgcaccccaccacgcccagctaatattttgtattgttagtagagacagggttttaccatgttggccaggctggtctcgaacccctgacctcaagtgatccaactgccttggcctcccaaagtgctgggattacaggcgtgagccaccgtgcccagccaagactatatactcttatttcccgtgaatacattattgacagttattgaaaatattgactatagccccaaaaggcttaactggttagagatacagggcagacaaaggatagataaaaatggtgggggcaaagagtaaatgctatgggattctaaagggtatctgcatgagagagattcctttttgttgttgttttgttttgtttttgtgacagagtctcggctctatcacccagcctggagtgcagtggctccatctcagctcactgcaacctccgcctcccaggttcaaccaatacctcagcctctggaatggctgggatcccgggattacaggcatgcgccaccacgcccagctaatttttttttttgagacggagtctcgctttgtcacccaggctggagtgcagtggcgcgatctcagctcactgcaacctccgcctcccaggttcaaccaatacctcagcctctggaatggctgggatcccgggattacaggcatgcgccaccatgcccagctaattttcttttttgagacggagtctcgctctgtcacctaggctggagtgcagtggcgctatctcagctcactgcaagctccgcctctcaggttcacgccattctcctgcctcagcctcctgagtagctgggactacaggcgtccacgaccactcccagctaattttttgtattttttttttagtagagacggggtttcaccgtgttagtcaggatggtctcgatctcctgacctcgtgatctgcctgccttggcctcccaaagtgctgggattacaggtgtgaaccaccctgtccggccacaatacccagctaatttttgtagttttagtagagacagggtttcattgtattggccaggctggtcttaaactcgcggcctcagatgatctgcctgcctgggcctcccaaagtgcttggcttaaatggtgagccaccatgcctggcatgcctggactttttttttttttttttcccagatggaatctcactgtgtcaccctggctggagtccagtagcatgatccaagctcactgcagccaccacctcccaggtcaagcggttctcctgcctcagcctaccaagtagctgggattacaggcgcgccccaccgcccagccaattttttatattgttagtagagacagggttttatgatgttggccaggctggtctcccaaagtgataagattacaagtgtgagccacaatgcccagccaagactatatactcttatttcccagtgaatacattattaacagttaccgaacatgttgaccacagccccaaaaggcttaattggttggagatacaggacaaaggatagataaaaatgggaggggcaaagtgtaaatgctatgggattctgagggtatttgaatgagggaggttcttttttgtttttgttttgttttgagtcagagtctctgtcacccagcctggagtgcagtggctttatctcggctcactgcagcctccgcctcctggcttcaagtgattctcaggcctcagcctccagaatggctggaattacaggcatgcgccaccacacccggctaattttttttgtatttttagtagagactggatttcaccatgttgaccaggctggtctcacactcctgacctcaggtgatctggctgtcttggcctcccaaagtgctgggcttacatgtgtgagccaccccacctggagtttttttgttttgttttgtttgagatggaatctcactctctcacccaggctggagtgcggtgacatgatcttggctcactgcagcttctgcttcccaggtcaggcagttctcctgcttgacccagtagctgggattacaggcgcatgccaccatacccagctaattttcctatttttagtagagatggggtttctagccaggctggtctcgaacttcagacctcaggtgatccgcctgccttggcttctcaaagtgctgggattacaggcatgagccgtcgtgcctggcctgtatgactgtatgagggaggttcttgagctaggtgccttttttttttttttgagatggggtctcactctgtcgcccaggggcacaatcatagctcattgcagccttgacctcctgggttctagcaggccttccacctcagcctcccgagtagctgggactacaggtgtgtgccaccacacctggctaatttttattttttgtagagatggggtctcactgtgttgcccaggttggtcttgaactcctggcttcaagcagtcctcctgcctcagcctcccaaagtgctgggattataggcatgagccacctcacccagccttcttgagctgagttctagaggaaagttaagactgacctcaaatttcaggagacagtcccaaaggaattctggtaatattgcaattttttttttctgagacagttttgctcttgttgcccaggctggagtgcagtggcacaatctcagctcattgcaacctctgcctcccgggttcaagcgattctcctgcctcagtctcccgagaagctgggattacaggcatgcaccaccacgctcagctaattttgtatttttagtagagaccgggtttctccatggtggtcagtcaggctggtctcgaactccgggactcaggtgatctgccagccttggcctcccgaagtgctgggattgcaggcgtgagccaccacgcctggccgagattcttaagtaaatgaacttttctttaggcacatgaattggaactatggaacaaagagattattgatacaattattcaagaagcacatttgcatatttagaacagaaaggttgcacagctcttacatactcaaacatagttttagagttagatcatgatcttaactttcttcatggttaccttttggggaggaaaaccaccctttttcatattaaagtaaaatgtgtacgtaataaagtgtgactggcatccaaatcaagaaacagacccttcccagtaccatgggaatctgcctgcctttctagttactttcctgacttctaataaccgattagttttgagtatgtttgagtaaaagaatagatgtgagtatatattatgtattttaagtttgaaagttttcaaaagatgcttttcaaaatctttcttaagaaaaatatagtgtcttagaaaatgtgccaaaatgtattgaatttcagagctgaaacagatctaggccaaacttctcatctataaaatcaggaaattgaggcccaaggaggttgattgtttctcagagaaacagagctggttaatggtgaacccaggctttttgcataccagtttagtcataataagtagttggtttttgggaatatccttttcataaatgatagtataaaagctgactgctaatacaactttacagaaggggataacaatgcagtattatttgtgtctttttttttttttttcctcttagtatgagaacttgaacttgccaaggaggtagagattttttaactcctgaagcataatttagttaagttagcttagtaattaagagcgtgggctttagaattagatttgctttgagtcctggcttttcttcttaaaacctgaagtactggctctgtatctcgatttttttaatctgtaaaaatgtgggaagattaggagagtccttgcggtgcttagaacaaccttgggacataattaaacattcagtaaacggatagctgttagatgtcagaattagctatgttttcatattctgtcgtgcttattattcttggattataaaggtattgttcaatggtttagtgattattggatgtaaatatgcctcaagaaaagctcaagatgagggttaaggtacttctaatagtgtttctttgtcacctgtgtgccaataatccatggggctagtggccaagtagtccacccttatctgcagtttgattttctgcagtttcagttacccattgtcaaccatcgtccaaaaataagtgagtatagtacaataaggtattttgagagagcacattcacgtaactttcattacaatatattgttataattactccattgttaatctcttgtgtttaatttatagattaaactttatgatatgtatgtacgtatagggtcggtactatctgtggtttcaagcatccactagggatcttggaacgtgtcccctgtggataagaggggatatattaatacaaaggaatatatgtgggctctgttctccagatgtgatttatttaatctttctttaggagacagttataaatcgttcaaagtttgtgttaaaatgttgccttcctgaatgaaaaagtttatttgggaaactctcaaatgatatagagataatgggattattttgaatttcttgacatggctctgggtttcctgaaactagaccaaagaatctagattctaatcctgtggtgtataatcttggatccctttgcaaatccctttttcagtgggctttgggagccagaaaataggcagtctcattcatctgacatccattttattctcttacataaatctgaaaaggtgggagaactttatttcattgaacatgcttttttaaaatttttttatttttttaaggctagtcaaacgaagcagtggaaatggaaaaggaaaaaagtctgtaactggttatgatcaattaattgtaaacaccactgcaaaaccctttttttctttctcttccctttagttctttgcttttactccaaatttagaataactgcctacagttgaatgcctactgtctgattgattgattgattgattgattttaagacacaaggtcttgctctgttgcccaggctggagtgcagtggcagcagagcaagaccttatagctcactgtaaccttgaactcctgggctcaagtgatcctcctgcctcagccttcctagtagctaccacacctggctaaattatcttttttaaaattttttgtggagttgaggttctcactatattgcccaagctggtgtcagactcctgggctcaagcagtcctcctgcctcagcctcccaaagtcctgggattacaggcatgagctactgcaccctgcctatctgacattttttatatatggcagctttatgggattgatagtattcttgtttcacagatccaacagttgcagctgtgaagaaattaagtaactttctcagtatcagtaacttggtggtggaacagaggtttgaaaccaggtctgtgcgtccaaaatattggtggttatggtagaaagagttatactcatatctgctgcttgctccctacatttttgaagatttttttaaaactaagaaatactttatacttagaagttttaaaagtaatacgtgaacatctttatatctgtggtccatatttaacagatagtaatcttctcatactgtgggctaaactgcctctacccaaatactgtaaaacatagaggtaaagctcactggataacttttttcttattccattttttctttctttctaggagtatctgctatgtgaagttagtgtatatccttccccttcatatttttgtttttactgttaatatctcctgaatttaaaaataaaatacttttttgcttttttttttaaagttttttttaaaaacagtttttatgaatgattgtaatgtatgtctcttggaaactttttctctttttttttttttttttgagacggagtctcactttgtcgcccaggctggagtgcagtggtgtgatctcggctcactgcaagctctgcctcccggggtcatgccattctcctgcctcagcctcccgagtatctgggactacaggcgcccgccaccaagcccagctaattttttgtatttttggtagagacagggtttcaccgtgttagcctggatggtctcgatctcctgacttcatgatccgcccgcctcggcctcccaaagtgctgagattacaggtgtgagccaccgcgcccggcagcattattttttaaagatctgtgatagtgcatgttgtgctagttctttaatatagactatattgtattccatgtcagtttttaaagtttatttccctattgatggcatttaattccaacttttagataaaaggatgtactggacatttttataattttttggggaacatgtaagagtttttctaggaagtagatttgtaagacctgagcgtattttcagcttctgcctgactggacattgcttcactgttctccagatgattgaatcaatttacattcccactaaaagagttctgcccgggagaggtggcttactcctgtaatcccagcactttaggaggcaaaggcgggcggatcacctgaggtcaggagttccagaccagcctgaacaccatggagaaacctcgtctctctactaaaaatacaaaaaattagccaggcatggtggggcatgcctgtaatcccagctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggcaagatctcagctcactgcaagctccgcctcctgggttcatgccattctcctgcctcagcctcccaagtagctgggaccacaggcacccgccactgcgcccggccaatttttttttttttttttttttttcagtaaaacagggtttctccgtgttttttttgttttattttgttttgttttaagatggactctcgctttatcgcccaggctggagtacagtagcacaatcttggctcattgcaacctccatctcctgtgttcaagcaattctcctgcctcagcctcctgagattatagacgcatgccaccacgcctggctaagttttgtatttttagtacagacagagtttcaccatgttggtcaggctggtcttgaactcttgaccttgtgattcgcccacctcggcctcccaaagtgctgggattacaggcgtgagccaccgcactcggcctacatttttaagacttatgtttttgtcactatgatggatgtgaaatggtggtttattctaatttttacttccctagtcagtagagatattaagcatgttttgtgtttattggccattaggcttttgtaaatttagtgtttacttttttttttttttttttaaatgagacggagtctcgctttgtcgcccaaactggagtgccgtggcgcgatcttggctcgctgcaacctctgcctcctgggttcaagcgattgtcctgcctcagcctgccaagtagttgggattacaggcatgccccgctaagcctggctaatttcgtatttttagtagagacgggttttgccatactggtcacactggtctctaactcctgacctcaggtgatccgcctgcctcagcttcccaaagtgctgggattacaggcgtgagccaccatgcccggccatgtttacattctttaactgcttttttaaaaattggatggtttggcctgggcaacaagagtgaaatttcatctcaaaaaagaaaattaggtggtttgtagttttctccttcttctgtaggaaattttttttttttttttgagacagttcttgctctggagtaaggctggagtcttgttctggagtcagggtttcgctttgttagccaggctggtctcttcctgacctcaggcaatctgcccatctcggcatcccaaagtgctgggattacaagcgtgagccactgtgcccagccagatttgtaggaattctttatgttatttatatgatattgtctatcttacattatgtggcttgatttttaattttggcttatctttttatgctttttttttaagttgtagtaaaatacacataacataaaatttatcattctaaccattttaaatgttcagtggcattaaggacattgtgtagctatcaccaccatccatctccagaacttttcatcttgcaaaattgaaactctgtacccaatattactaactccctatccccctaccacccagcttctggcagtcacatttctactttgtatctcaatctgtgtgactgctctatcattcattatttgtccctttaaaaaaaaaaactctgagtatactttcttcatttttgtttaaaaccgaaactctggaagttaaaaataacatccttgcccatgagcagcttttttttttaagacagagtcttgctctattattgctcagactagagtgcaatggtgcaatcatggctcactgctgcaacctcaacctcctgggctcaagtgatcttcccacctcatccttccaagtagctgggactacaggtacaccaccatgcctgactaatttttgtattttttgtagagatgaggtctcacactactttttgtagagatgaggtctcagcctaggctgatgtcaaactcaagtgatcctcccgcctctgcttcccaaagttttggggttataggcatgagccaccggagccatcaaatccctgtgcttcttacagacaccagaaaaagtttcagccttgttttcaacattgttctgctgtgctttgtccaaatgaacctttatgagctgcctgccatccagtttctcttgcccacaatttcacttgggaagaccaagccctcaaggattatgtcatgcacgcctgtcagaatagggctcctgggacacttctgcttattttttgtacagcttttcgagttggcttatgcagaattatcctctgagcacattatttgtccttttgtgactggtttatttcacttaactgtcctccttgtcttttagaagtttcatatatatatatatatatatatatatatatatatttttttttttttttaagactgagtctctctctgttgccaggctggaatgcagtggcgtgatctcagcccactgcagcctccgactccctggttcaagtgattctcctgcctcagcctcccgagtagctgggattacaggcatgtgccactacccccagttaaatttttttttatatttttagtagagacgggttttaccatgttggccaggatggtctcgatctcctgacctcgtgatgtgcccaccttggcctccctaagtgctgggattacaggcgtaagccaccgtgcttggcccagaagttctatttttaagagacaggtctcactcacacgcttacccaggatagagtgcaatggtgcaatgatgactctctgcagcccggaactcctgggcttaagtgattttcccatgcctcagcccagcctcctgagtagctgggactacaggtacaagccaccactcttggctaattttttttttttttttttgagacggagtctcactctgtcacccaggctggagtgcagtggcgcgatctcggctcactgcaagctctgcctcctgggttcacgccattcttctgcctcagcctcccgagtagctgggactacaggcgcccgccaccacgcccggataatttttttttgtattttttagtagagacggggtttcaccatgttagccagatggtctcaatctcctgacctcgtgatccacctgcctcggcctcccaaagtgctgggattacagacgtgagccaccgcgcccggccagctaatttttaaaaaaaatttttgtagagatgggaatctccctatgttacccaggctgatcttgaactcgtgggttcaagggatcctcccaactcagcctcccaaagtgctgagattataggtgtgggccaccatgcccgtctgcttttttgtatttttagtagagatagggtttttcacgatgttggccaggctggtctccaactcctgatctcaagtgatccacccgcctcagccttccaaagtgctgggattacaggtgtcacccaccgtgcctggccctgtttaattttaaagtagtcaatttttttctggtgtattttacttattgtcctcctttttgtcttacagaagtttaattttaaggtattcagattttatcttttcctacatggtgtgttttttgcattttaagaagtcttctcctactttgatattaataaaggcattctcggacccaggtcactggttggcctgacctcctgctctggaggcactgtgccggaggacccgtttttttttatttgtttatttttttaaagacattcttctgtatttggtttttaaaagttaattcattttcttaacttctgtactcaggtttctctctctaccatgtcatactgaaactgctccttcaggcagtaccttcccaattacagaacacagagtgagttctcgtgatcatccattttgtacatgttccttcagcatttccatttccatcttagaactctcctcctttggttgctctgatactgctcttttctgattttcctctaacctctgttactatcctttataaaatattgtcactgatttacctttcatcctccacttgtctctggaatgtttgttttctcttttttattccttttgttaataccataggtcaggtttttatatctcaggatggactatttatttatttgaaacatggtgtctgtctgtctatctatcatccaggctggggtgccgtgttgtgatcacagctcacgccgcagtcttaacctgttgggcttaagtgatcctcccaccacagcctcccaagtagctggcattacaggcatttgccaccatgcctggctgattttttttactttttgtggagacagggttttgccatgttgcccaggctggtctcaaactcctaggctcaagtgatccatgcgccttagccgcccagagtgctgggattacaggcatgagccgctgcgcccagcccagatagactatttgtattaaacgtttcctggcaacttgcaatagcttaagccggtaatcccagcgttttggacggctgaagcaggaggattgcttgagcccaggagtttgagaccgatctgggcaacatagtgagaccctgtttctacagaatatttaaaaaatgaggccagacacggtggctcacgcctgtaatcctagcactttaggaggccaaggcgggtggattgcctgagctcaggaattcaagatcagcctgggcaacacggtgaaaccctgtctctactaaaatacaaaaaattagtagggcacagcggtgtgcacctgtaatcccagctgcttgggaagccgagacaggagaatcacttgaacccgggaggcggaggttgctgtgagccaagatcgtgccactgcactccagcctgggtggcagggtgagactccatctcaaaaaaaaaaaaaaaaaaaaagcctggggtgggtggtgcgcatcagtagtcctaaactactctggatgctgaggcgagaggatcccttaagcctgggagatcgaggctgcggtgaactttgactttgccactgcacttcacagagccaagaccctgtctttaaagaataaaatagaataaaagtttgcttatgtacatttatttttctgccttcagtctctcccagcttttcttttctttctttttttttttttaagatggactctcgctatatcgcccaggctggagtgcagtggcacaatcttggctcattgcaacctccatctcccgtgttcaagcaattctgcctcagcctcctgagtagctgggattacagatgcatgctgccacacccggctaatttttgtgttttaagtacagacagggtttcaccacgttgatcaggctggtcttgaactcctgaccttgtgatccgcccacctcagcctcccaaagtgctgggattacaggcgtgagccaccacgcccagcctctcccagcttttctagtcaaccctaatggtgccatgccactggatttaattttaaaaatacaatgttacatcattctctgttaggttttccagtgcctatggggataaagtcaaaacctttatactgttgttcttgtgtccggaattggtgggttcttggtctcactgacttcaagaatgaagccacggacccttgcggtgagtgttaacagttcttaaaggcggcgtgtccggagtttgttccttctgatgttcggttgtgttcggagtttcttccttctggtgggttcgtggtctcgctggctcaggagtgaagctgcagaccttcgcggtgagtgttacagctcttaaggcggcgcgtctggagttgttcgttcctcccggtgggttcgtggtttcgctggcttcaggagtgaagctgcagacctttgcggtgagtgttacagctcataaaggcagtgtggacccaaagagtgagcagtagcaagatttattgcaaagagcaaaagaacaaagcttccacagtgtggaaggggacccgagtgggttgccactgctggctcaggcagcctgtttttattctcttatctggccccacgcacatcctgctgattggtccattttacagagagctgattggtctgttttacagagagttgattggtccgttttgacagggtgctgattggtgcgtttacaatccctgagctagacacaaaagttctccatgttctctagattagctagatacagagtgtcgattgctgtatttacaaaccctgagctagacacagagtgctgattggtgcatttacaaaccttgagctagataaagagtgccgattggtgcattcacaatcccttagctagacataaaggttctccaagtccccactagactcaggagcccagctggcctcacccagtggatctcgcaccggggccacaggtggagctgcccgccagtcctgcgccatgcgcctgcactcctcagcccttgggcagtcgatggaactgggtgccgtggagcaggggacaatgctcaggccacgcaggagcccacggcaggggggcaggactcaggcatggcgggctgcaggtcccgagccctgccccgtggggaggcagctaaggcctggtgagaaattgagcgcagcgctggtgggccagcactgctgggggacccggccgcatcctccgcagctgctggcctgggtgctaagcccctcactgcccagggccagcagggccagtcggccgctcagagtgctgagcccgccaagcccacgcccacctggaaatctagctggcctgcaaacgccgtgcgcagccccggttcccacccgtgcctctcccttcacacctccctgcaggctgagggagctggctccggcctcggccatcccaggaaggggctcccacagtgcagcggtgggctgaagggctcctcaagtgtggccagaatgggcactgaggccgaggaggcaccaagagtgagcaagggctgtgagggctgccagcacgctgtcacctctcattctgacctacctttcctgacctatttcctgttaagtcacagatacacacttgcattcctacacatacctcagactttcagtctccctcaaaccttcagcaatacaaaattgcttgctatttagttgtttcatctgtctggaataagcccttatcttttttctttacctttcgaaacctacttgtcctaaaataccacccctggtaagcctttcttgaagccaaagtttccttctgtttttcattgtcagacttcatgagagcagttatcttactattgataattgtacatatgtccttctactcctggtagattaaactccttgagggctcatattcatttttttctctttagcaccttgtagggttccttgaatgtagaagccttagtaatttaaagcacaccaaaaaagtctttgataggtatctaattttgaggagctgctgctaaaagtgctcttaggacataggtttagggcaggcttccgttacttttagcaaatgtgtgattatggatttttctagtgattagaaatgtaggaccagctagtctatgtactcttttctctcagttaactatgggtgtcttgcttttaggtttctttgtttcaagtgaagcatcttacttggttttgtcatacccaattttgggttgtctgatgctgttgcttctcagcgagctgataataaaacattttatgctttttcttaaatcactgtagtgacttagtttttgttgtatagaatatagcacagtttttgcctcctattagacattcagttatttccagtttcttgatagtgtacatgtgtgagaattttgagtgtatatctctgaaagtgatacatactgagtggtcattgagtgttggatgaaattttaggtgtttatattgttaggtgctttctttccatctgcccataggcactgtgaatgtgagtcattgaaagcagagttctttctcactgatcttccattccccattgcttagcaccattgcctgctaagcaggagatacttgttttcctgaatgagtttaaggatattcctaagctctagagagctcatccccaaccattgtgaaagtttcatcctgattctgggactaggaagagttgaatatattgataaaggtggcctccaggtaaagttggatttctgttgcatgtaagtgttaataatgtagtcaggtcttgaattaggatgatggaatgtccaagcccaaaactgggaaacaagatagtgggaaggtaatttttttttttttctgtagttttcccttttgaagatctcactggcatctatttagtatatatgacatcatctgtggttcaattctttagtgtaactttacattttttatttattcacatatttactgaatgctacctatgttaataaaatggacatgatccttgctgttatggaataaattatggctcagtaaggcagtgagaaattgaacagctaataagtgtgtttgttgactttaagtaaggggacctatggaagttgggtattctagcctcagggaaagagtttcttgggaataaccggtaactgatacttacaggataaattagaatgaccatgatcaactctgtatacgtatagatagttaataatcattttacaatgaataatggaaaaacattttattgtttttttctatgtatatatgtttttatttattagagactaggtctcagtttgttgcccaggctggagtgcagtggtatgatcatagctcactgtaaccctgaactccagggctcaagtgattctcctgcctcagccttccgagtagctagtactacaggtagacaccactgtgcccagttaattatttttaaattatttgtagagactgagttttgccatgttacccaggctggtcttgaactcctggcctcaagtgattttcctgccttggctttctaaaatgctgagattacaggcctgagcccctgcctggccaacttctgtttttctttttttcttttcctgatggactgtcctacgactgtttttatttttttaaccaaaactgcgtcataacctcttcttggtttaagggaggctaggaaatcttctttagttgagcacagtactcctcaattaaaatgagagtttctttagtagggaagaaggaaaaaagaaagttgattagacaactagccatgtagagggtagaggggcaagaatgaactcaggatcatttaggaaacctttttaggtagcttaggcaagaaattattgtagtatggggctagagttgaatagggagccgaagagaagttataagtatttgggagaccctctgtcacccaggctggagtgcagtggctcaatcacagctcactgcggcctcaaactcctggtcttaagtgatcttcctacctcagtctcctgagtagctgggactacaggcacgtgccaccacgccctgctaattttcatatttttttttgtagagatggggtttcaccgtgttgcccaggctggtcttgaactcctgggctcaagcaatctacctgcctcggcctcccacagtgctgggattataggcatgagacaccatacccagtcaacttttaactttttatcaataaaattttgaagagaaaagtcgaaaggacagtacacttgtatccccactagctaagatcatgttgctctcatgaatataattcactaccaaaaacttgagcatgcatctcttaaaaataatattcttttggttgggcatggtggctcactctggtaatccttgcactttaggaggctgaggcaggaggataagttgagcccaggagtttgagaccagtctggacaacatgacaaaagcccgtctcgacaaaaatagaaaaaaatagttgggtgtggtggcatgtggctgtggtcccagctgcttgggcagccgaggtcggaggattgcttgagcccagtaggtacagtgccatgatcatggctcactgcagcctctgcagtccggcctaggtgacagagtaagaccctgtctccaaaaaaaaccccaaacttctatttttcagttgacttaaaaaaaagtcttatctacgtaacgttcacagattgtatataattgtattcttgggtcttttacaatttatgattgttaaccccttcacatacctttctttttttctcatctcattaatactgaaaatcctgatgtctgtgattcctagtttaggtgtaaaggtttgattagcttcaggttaaacattttggtaagaagatcccaagtgatgttgtatacttcatattgaatcatattagtacatgtgtaatatcagattttcttactgttattgatgcttggtcacttgtttaatcatttgattaaggtgggaactacaagatttctttgtaaaggtacattttatgctctttgcaattagcaagtaaaggatggattacttctttggcatcctggaaataatcttatttccaacatccttttaccaggtgcactcacacacacccccactctcactcatgctggtacagtttaaccatgccagttaatctagcatgtttatctttggaatttgggaagaaacctgagtacccggagaaaacccacaaagacgtggggagaacatggcaagctccacataagacagcagcccgtgtgggatttttttttcctcataaatgttataaggaaatgatgttatccaaggacctgctgtattctctttttctctcttttttttttttttgagatggagtctccctctgtcacctaagctggagtgcagtggcatgatctcggctcactgcaaccttcgcctcccaggttcaagtgattctcctgcctcagccccccaagtatctgggattacaggcgcgcaccaccacacccggctaatttagtagagatggaatttcaccatgttggccaggctggtctcaaactcctgacctcaggtgatccactcacctctcttttttctttaattttttttttttgagacagtgtctcactgtcacccagactggagtgcagtggtacaacttcagctcactgcaccccctgccttccagactccaggaatcctcccacctcagcctcctgagtagctgggactacaggtatatgccaccacacctagataattttttttttttttaagtagagacaggatttcactatattgcccaggctggtctcgaactaagctcaagcaatccacctgcctcgacctcccaaagtgctgagattacatgcatgagccatgagccattgtacccagccctgctgtcttctctttttttttttttttttttttccttcagactgagtctcgccctgttgcccgggctggagtgcagtggcacgatctctgctcactgcaagctctgcctcccaggttcatgccattctgctgcctcagcctcccgagtagctgggactacaggcatccaccaccacgccctgctaattttttgtatttttagtagaaacagtgtttcactgtgttagccagggtggtctcaatctcctgacctcctgatccgcctgcctcggcctccgaaagtgctaggattacaggcgtgagccactgcacgtggcctgtctgctcttaaagagattaataaattagagggaaaactcagaatgtctttgtaatttaaatttttgttaagggaaaataataacgtttaaaataattgtttctctgtgttaataatgggtactgtacaattaatttccttttttaaaaaatatattttttgagacagagtttctctcttgttgcgcagggtggagtgcaatggcacaatcgcggcttattgctacctctgcctccggggttcaagcgattctcctgcctcagcctcccaggtagctgggactacaggcacacaccaccacacccatctggtttttttgtatttagtagagatgggatttcaccatgttggtcaggctggtctcgaactcctgaccttaggtgatccacccgcctcagcctcccaaagtgctgggattacaggcatgagccaccatgcccagtccttttttaatttttttttttttttaattgttgtcaccagactggagtacggtggcacaatcatggcttactacaacctggaactcctgggctcaagtgatcctccaacctcagcctcccaagtagctgagactataggcacgcaccaccacacctggctaatttttgtggtatttttgtagaggtggggttttgctgtgttgactaggctagtctcaaactcctgggtgaatcctcctgccttggcttcccaaagtgctgggattacaggtattagccactgcacccagcccaaactgtatttttttgtcttctagtacaccttgtaattttttattgaaagctgggcatgggccgggcatggtggctcatgcctgtaatcctagcactttgggaggctgaggcaggtggattgcctgagttcaggagttcaaaatcagcctgggcaacatggtaaaaccccgtctctgcaaaaaaaaaaaaaaaaaaaaaaatccaaaaattagctaggcatggtaagtgcatgcctgtaggcccagctacttgagggggctgaggcaggaggatcactttagccccggaggcaaaagttgcaatgagctgagatggcgccactgcccttcagcctgggggacagagtgagaccctgtttcaaaaaaaaaaaaaaatgctgggcatgttttactaggtaaaagtaactgagatacataagcctttagtgtgaggcattacgtttatctgacttaggattgggctgtgttttgtattaacattttttgtagctgtaggtgtgagaactaatatttcctccagtgttcttatttttgtttactttgttgtcttggggttccttagagacttcttaaataagatctgagacatgcagttatatatttttcttttttagttttttaattccttgcaagtattgcacaaatgcagttctttgagtaacgtcctgttgttatacaaaagccttcgtggccaggcatggtggctgacaattgtaatcccagcactttgggagtccaaggcagacagattgctttagcccaagaatttgagatttgtagacaaatggagacatggcgaaccgtctctacagaaaatacaaatattaaccaggcatggtgtcatgcacctgtactcacagctactcaggaggctgaggtaggatcatctgaacccgggaggcagtttgcagtgagccatgatcatgccactgcactccagcctgggtgacagagcaagaccctgtctcaaaaaaaaaaaaaaaaaaaaaaaaaacacctcttgatagtaaggtttcagtattctgttgtagtcttttagtgaatctgtgtacctgggctgtgatattcacagttgcttctcagttcacacttcctccttagttgagattggaaggctgggattgggtttttcacttcccttgggtcagttagctctgataaaactccagttggttaacctctggtgaaatcttttctcttgaaggcaggcctttttaaaaagaacagattactttggaattacttcagaatggctactttcccccttccccctgccagaagcatgcagggaattttcttccatcctcactgtgagaacctcctgcgttcaagtgaccctcctgcttcagcctcctgagtatctgggactacaggtgcacaccaccatacctggctaatttttgtatttttagtagagagcaggttttgccatgttgcccaggttggtcttgaactcctgggctcaagcagtctgtccaccttggccttccaaagtgttgggattacaggcatgtaccaccacacttggcctttttttttaaaatagtattgtaaatatttgggtttttaaaataaaacatttattctcagagttgtggaggctagaagttggaaatcaaggtgtcagcagggtcagattgcctctgaaacctctggggaatccttccttgcctcttcctagtttctgttggtttgccagcgtttttggtgttccttggcttgtagatgcatcaccccaataatctgtctttatgtggcatcctccctatatgtctgtcttaacatgttgaccaggctggtctcgaactcctgacctcaggtgttctacctgccttggcctcccaaagtgctgggattacaggcgtgagccatcgtgcctggcctgtttttactttttaactttctgctaaaatttttaaacttgtactgaagttgagaaaatagcataatagatatcatcacccagttgctttttctttttcttttttgtagagacggagatctcactttgctgcccaggctggtcttgaactcctgggcttaaacaatcctcctgcctcagtctcccaaagtgctgggattacaggtgtgagccaccactcctcctggcctccactttcggtagttatgaacatgtggctagttttgtctgtcagattcccactcccttctagattattttgctgtttgtttgtttgttgtttgagatggagtctcactgtctcccaggctggagtgcaatggtgcgatctcggcttactgcaacctctgcctcctgggctcagacgattctcctccctcagcctcctgagtagctgggactacaggcgtgcaccaccacacctggctaattttttgtgtttttagtagagacagggtttcaccatgttggttaggctggtctcaaactcttgacctcaggtgatctacccacctcagcctcccaaagtgttaggattaccagcgtgagccaatgtacctgtccccttctagattattttgaaacaaatcttctgagttattttgcagcaaaccccagaattctgtcattgtacagtgaataattcattgtggatctttaacatacaaggacatttttatgaaaccaaatcaattgtcttattatgtccaacaaaagaaacactaatttttgaatatgtaatgacacagtacatgctcaggtttccttgacttctgacttacctttttacagttacattattcttcttaatggttgtaatcatttagtttactttctagtccttttatgtcacaagcagtcttagagtacaaatgttatatcacatacagaggattgtattgtgtaggaaaaacatggacaacaaagactgaattgaaaaggtgatactggagagtaggacttgatgtgaagaagtttgaggagtagctttgactgtttttcttttctctttaataatcttaaaggtttcttatggggggagcgctgagacaggatacaccacagtcacccaggcaggagtgccagtggtaagatcacggctctctgcagcctgggattcctgggctcaggtgattttcccacttcagcctcccgcattgctgggactatggccatgcaccaccacacccacacctacctaatttttttgtagagacagggtttcaccatgttgtctggactgatcttttttttttttttccataaggatagagatgggctggtcttgaactcctgggttcaaatgatcagcccatctccaccacccaaagagctgggattacaggtgtgagccactgtgcctggcctaatcttaggattgaagtatataaattctaaaagttgagtaagtgtataataaaaactgagtgataaagtattgtgtcatggtgtaaatggcagtgtttttttcttactggcatacattgagatgtcctctaactgaaatcttagaagtgagccgggtgcagtggctcacgcctgtaatcccagcactttgggaggctgaggcaggcagatcataaggtcaggagttcgagaccagcctggccaatgtggtgaaaccctgtgtctactaaaaaatatgtaagaaattagccaggcgtggtgctgtgcgcctgtagtcccagctactcaggaggttgagacagaagaatcgcttcaacccgggtggtggaggttgcagtgagccgagattgccccactgcatttcagcctgggcgacagagcaagacaccatctcaaaaaaaaaaataagtaaaagaaaagctctgtcttgactcttgaatcagttttaaaacctggcttcactgattattagctttgtgactttgttgcctcagcttccttattggtaagcacgtaagtttgttttaagattgagttattacatgtacatcagttaaaatattgcctgtaaattatatatagatattgagctgggagtggtggtttacgcctctaatcccaacagtttgggagactgaggcgggagaattgccttagctcagaggtttgaggctgcggtgagctatgattgtaccactgtacctcctgtctggatgataaagcgatgtattaggtattattgttgatcgttcagcaacattacccactgtttccttgaaatattattcctgtagtgtcagtgatatcagactatccaaatatctttttcttcctttcttctttcctttctttccttttccctttccctccccttcctcctgcctttccttttttccttttttcttttttttcttttgagacagagtctcgctctgtcccccaggtggggagtgcagttgtgcgatctcggctcactgcaagctccgcctcctgggttcacgccattctcctgcctcagcctccggagtagctgggactataggcgcccgccaccacgcccggctagtaggttttttttgttttttttgtttttttttttttgtatttttagtagagacggggtttcactgtgttagccaggatggtctccatcttttgacctcgtgatccacccgcctcggcctcccaaagtgctgggattacaggcgtgagccaccgcgcacagccccccaccttttttttttttttttaaggagtcttactttgtcgcccaagctggagtactgtgcttctgtctcggcttactgctccctccgtgtcttggattcaagcagttctcctgcctcagcctccagagtagctgggattacaggcacgcaccaccatgcccccagctaatttttgtatttttagtagaggcggggtttcaccatgttggccaggctagtctcgaactcttgaccttagatgatccgcccaccttgacctctcaaagtgttggtattacaggcgtgagccatggcgcccggtctttcctatctttctgactgtatcttcagatcactcctgaacccgagacctgaatttttcatttacctacttggttctttggattttcacagataccttgtatccaacatgtctcaaactgatttttcccctctccctcaaaccctgacttctcaattctttgtttccttatctttattatactgtcatccacccagcaaaaaatcccctcttctaagatcatagcttttagttagtaactaagtcctttagattttacttcctgtctgccttaattcatcttcttttcattgcactggactttattggcatctctcactggtttcctaagtattctctctaatccccctccagccatttccccctactccagccaggtgatctctaagagacccagatctgattgttacaacacttcaaatttttattattcttcatgaccctgaataatctggcttttgactgcttctcctgcctcatttcatcattttcattctttgtattgtagtcacattggcggcatttcaattcctaaacctgtcaagtcctcgtttgcctccattttgcacagcgtgtacgctctgccttaagtgctggcttttcctaaagttaagtcttttaaaactaatttcctcaaggaagcttcctcttactttctagattttctgtctgctaaatgttcttcatagtatcctgtacttcatttaaaaattatataattagttcttcagtaccttagaatgaaataactattgatacaggttagagaaaatttctagttgatcattatactaccaatatctgttataatgccttgcaaatagcaagtacttagtaaatattcatggaattgataaattcagacttgaattactcttcattgtagattgagtaaagtttgacagaagtccagaacttaacttttttttttaagagatggagtctcactctgtcacacaggctggtgtggagtggcacagtcatagcttactgcacccttgacctcttgggctcaagtgattctcccacttcaacttcctgaatagctgggattacagacacacgttttttgttttttttgttttttttccacgctgtagagatgggagtttcactatatggcccaggcgggtcttaagctcctgggctcaagtgatcctccctcctttgccccacaaagtgttgggattacaggtgtgatttaaaaaatgctagctgcagcctggtgtggtggcttagcctgtaatcccagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcacacctgtaatcccagcactttgggaagccgaggcaggtggatcaccagaggtcaggagtttgagaccaccctggccaacatgatgaaaccttgtctctagtacaaatacaaaaaaattagccaggcgtggtggcgggcgcctgtaatcccagctacttgggaggctgaggcaggagaattccttgaacccaggagtcagaggttgcagtgagctgggcaacacagcaagactccatctcaaaaaaataaaaaaaaaatttaactgcctagaaggtagaaatcgagtgtatttcttaggcctttgaataataggggaaagataagtcatttatattaaattatgagaaaataatggcaactgttaagcttttaaagtattatttccaactaaattaggaagaactaaatttcacttttacatatgcatgacaatgatgagcagggctcctaaaacagttgtggcttgactaggaaacaaataataatttttttatatcaataagaattacttgtaactttagggggcatttagaattatatttgtcttatttgagatttggatttaaattttattttagagcattttttaaaaaataaatagaagtgaggctaatattgttaattattctctttaaaaaatacagtatttgctttgggttaaaattttctgccccaacatcattatcaagagtcagcatattacaatgataaatttagcatttactgtgtggcaggcattgttctatatactttattcgttaaattcaccagcgaaccctatgaggaactatcttatccttagttgacagaggatgaaactggagtacaaagtagttaattaacttgttcatagctagtaagttttaaaaaggttaaacaacaatatactttgtatttagtccttaaatgataaaatcttccagtgtttagtttttcccactagaatgtaagctccaagtgggcagggacttaggttttgttcactaacatttgagatagcatatactagaacctagtcattatttgaaagaatttttacagtgatgatggtaacaatgacaatatcatttcactgagagatggccttggaaatacattagaaccgctttgagttcttcactgttggttgttgacaataatgttttttttatctcattcaaattagcttcaacgttatgtgctattttgcatgcttcatgtatatcttaataaaatagttgatttgaaaattgctaacttctatagcttcttccctcttttttttttttttttttttggtgacagagtcttgcttcgtagcccaggctggagtgcagtggtgtgatcttggttcactgcaacctctgcctcccgggttcaagcaattctcatgcctcagcctcctgagtagctgggattacagacatgtgctaccatgcccagttaatttttgtatttgtagtagagacagggttttgccatatgggccaggctggtctcaagtttcttgcctcaaatgattcatctgcctcggcctcctagagtactggaattacaggggtgaaacatcctgcctggcctagctgctatagcttttatatatctctgttccttttgtgcattagaaatgccttgaagcccccagggaacatcaggaaaaaaaaaaaaaaaaaaaaaaccaaccagaggtcccgctatgtgtttagctgagttgggagaagaaagtttaaaaaagcaatctttgacctatccttatgaaaaatttacagtgataacacaattcttcagaatttcacccaaaagctacagctgccttggttgttgcagtcattgaagtgaataacacattattttattatttatttttagatactacatttttttcttagactgtggaaacaggactgtgaaattaattttgtaaaatcgggctttaatttttttttttttttttttgagacagaatctcggtctatcacccaggctgcatgtagtggtgcaatctcggctcactgcaacctccacctcccaagttcaagccattcttctgcctcagtctcccgagtagctgggactacaggtgcctgtcagcacacctggctaatttttgtatttttagtagagatggggtttcaccatgttggccaagctagtctcaaactcctgacctcaaatgatccacccgccttggcctcccaaagtgttgggattacagtcgtgagccactgcacccagccaaattaaaggttttatagttaatgttgttagggaaaggggaactatgctgcttacttctatccaagaaacttaattctgaaagtattctcattttacagtaataaaattgagagttaggtgttaagtgttatacctgaatgaataccacaagtaagcgacagaactaggattcagcacacatatgtcttactccaaaggccatgacttttgtaatactgtcatctttcaccattctccatgtcttgcttatagttcctgactcttaaagtaagactttaagttcgcttgtgggagcagggggattggagttttagattgtgaaataactggatgtttgaattaaactgtggtggtataaagaataattgttgcttgatggaaaattgagctgtgaaaaatttttggcttaactttgttttctttttatctttagttctgtgcaaataaagaccctattctaagccctctagaattttttttttttttttttgagacagagtctcactgtgttacccaaactggagtgcaatggcgaaatctcggctcactccaacctccacaccctggattcaaacgattctcgtgcctcaacctcccaagtagcggggactacaggcacacaccaccatgcccggctaatttttccggatttcaccatgttggcctcaaactcttgactcagtgatctgccttggcctcccaaactgttgggattacaggcacgagccaccgcatgcacctgaccagaatgctttttcataatgtaattcatcatgatgatggtattttcttgagcttatttagtacattttttcatacaataataatgttctttctatagagtgaaaaaaagagcaatttttttctgacttataatttgggggctggatgcggtacctcacacctgtaatcgcagcacttttggaggccaaggcaggaggccaaaggtggtggatcacttgagcccaggagttcaagaccagcctgagaaacatggcaaaaccccctctctactaaaaatttaaaaatttagccaggcatagtggtgcacacctctcgtcccagcgactggttaggccgaggtgggagaatcacctgagcttgggaagttgaggtgcagtgagctgagatcgcactgctgcattccagccagggtgatgggagtgagaccgtgtcttaaacaaataataataatttgggggtgatgtagacagaaataaggacagaggtatgaaaaggaataattatttagcattttactagccagagatttgggcagtcccaaaaagcagcttttctaatctccctctcctttcccaaaaaactttaatcagatcctttagtatcctatcatctttgggttatttacatactactttttggaggggggattgtggaaagctatcgagatctttgaaagcattgatgattagcaagatgattattcctgtaagaagccttaagaggagaaatgcaagtgtaagttaacactggcttcttaaattggtcagtgaaagttggatgcctccaattttcttttaacattatgcatagatactagacaattttttatttttatttatttatttattttgagatggagtctcgctctttcacccaggccatagtgcagtggcacgatcttggctcattgcaacctccgtctccctggttcaagtgattctcctgcctcagcttcccgagtagcaggactacaggtgtgcaccaccatgcccaactaaatttttgtgtttttggtttttttgagacggagtctcgttctgtcacccaggctggagtgcagtggcgtgatctcggctcactgcaagctccgcctcctggtttcacaccattctcctgcctcagcctcccgagtagctgggactgcaggtgcccgccaccacacctggctaatttttttgtatttttagtagagacagggtttcaccgtgttagccaggatggtctcgatctcctgacctcgtgatctgcccgcctcagcctcccaaagtgctgggattacaggcatgagccaccgcgcccggccatcagagtagttttactgttgctaaaatgtacattttctcctctaccacaaataccaaagttgttaatgattttttagggcataagaagtagtttcttattgtacatatttatagttaaatttagtttttggataaaaaatattttcagaaaaatgtaaaaaaaagtactaattagaaagtaagtttttaaatcctatgtttttattaaaaaacaggattaatttggagtgatgtgaactttgaaaaatatgggttttaagtcatgtattgtttatgaactaaacgttctgtactaaaaaatatttaacatagaaaaagagtaaaaattgtggttttttttttgggttggaggaggaagccaaagacagtcattcttacactgtttcatctagtaatcaagtttaagaaagtcagtctaaaagcaaaaaacataagagtagatatgttgtgtcaatcaggtaacaatatggaattctaaccaaaaaaaatgaagatataggccgggcacggtgcctcacgtctataatcccagcactttgggaggccaaggcgggcgtatcgcgaggtcaggagttcgagacaagcctggccaacgtggcgaaaccccgtctcgactaaaaataacaaaaattagctgagcatggtagtgggtgcctgtaatcccagctactcaggaggctgaagcaggagagtcacttgaacccaggaggtggaggttgcagtgagccgagatcgtgccatcgcactccagcctgggcagcaagagcaagactccgtctcaaaaaaaggaagatgtaacctgttctttagggattttggtttaaaaaatcgagaggatttactgtatttttaacataggtttgagaatataagtggagagcccatttgctggcaggcacttatgaatgttaatgtgagtcccactggatggttttctgaatcatttaaggttatcatggctctgagaatggactgtcataaggttaagagactcagtaatgctatagataggaaagtacttggagtagtttaaagtgcaaaataagtcaatgtagataaatttaaagtagaaatctggttttttgaagtaggtagttgccgttttaataaactaagcagaaaaacaaattgaagaaggccttttcttttgaggcatttagtcctctggaatttttcatggaaaggagaatctgttaggtagctagagctttcaccattctggtggatagtgtactatttcagtcagttaaactaaacatttaaagttgttatggttagttcaagtgagagtttatggcctaaatggcttttaatgaccctgaattttctgtttaagcagaacccatgtatcgtgggggtatagtgcagaatataatatcttagtgttcatctgtggatgattagatttatcgctttggacctgatatacatggaattggcaaacataaaatagcttttatactatttttccctaataacattcctagaaagtcaagaagccattgtattgttgttcatagtggtgttatttcgtttaaaacaatgaagttagaatttattagtttgttttaaatattcttaaaactggataattaagtcctagaaaagccgagacttattttactagagcagataatcaagcttatgaaagagggggtttcaagattttttataggtaatactttaggcgtttttcttgctgacataactaacatttattttctgtttatttttaagacgagcaaaaatcaaattaaagtagatcttgtagatgagaattttacagaattaagaggagaaatagcaggacctccagacacaccatatgaaggcaagtacttttttctgtatcaaaatattgtgcgtattagaacttgtctgaaacatttaatcagaataatcttaaacatctataaattatatggagggtaacttcatttggtttagataaacagcaatttaaaaaatactaaatttagatactgaatatagactggtatttcttactgaattttagctaatttttttctttccataaaacagttttagcagagctttgttacaggtattataggttagaatttaatagaataaaagatctggcatggtaaacctctaaatcatatggactgtagacactcagttacccttcatatggtatctaaaacagaccttgccttaaatatctcattggtaaaatgttgcttttgtttttaaagttcttctttctgtcattcagcatttcattcactcatgtcttcatacaggctgtagtccaaatgtttattttctttattcaggaaagcttttagtgattatttcaagccatagaaaggaggtggctttgctgaacttggtgttcacaaattaagtctgtagctactttagaccatggaatcgggtggtaagatacagaaataaaccttatagcattttactttcttattaggtgagtcttcattaattaatattactgtaaatttagattatatagcatataaccaaggctcttgcattaataactattcaaatatttgtttattagaaaacatataacaatatatggtaaccctaattatacagtctttacatgtattttctcatttaatcctttcagcaaatcttactaggtaaatacaacgattgctgtttcatagatgaagaaacaagttaagagaagtaacttgtttaaggtcaaccatctaagtagcacaactgatagcctttgtcttcaaagcctgtgcttttaatcactttatgtaaatcagaattgacttaatattggaagtggtggtgatgtctgttttgttttatctatttttttatatgcaaagttttactgttacccaagctggagagcagtggcatggtcatagctcattataaatttgaattcctaggctcaggtaatcctccagcttcctcagtagctagtactacaggtgcatgccaccatatccagttaaatactttgtgtgtgttttttgttgttcattttttgattgtttgttttttgagactgagtctctctgtcacccagcctggagtgcggtggtgaaatcttggctcactgcatcctccatctcccagaatcaagtgattctcctgccttagcctcctgagtagctgggattacaggcgcaccaccatgccggctaatttttgtatttttagtagagacagggtttcacaataacggccaggctggtcttgaacttctgaccttaggtgatccgcctgtcttggcctcccaaagtgttaggattacaggcgtgagccaccaatcccggccaccagctaaatactttcgagtggttctataattctgtaatgaacagttacccaaaacactttttttttttgagatggagtctcgctctgttgcccagcctggagtgcagtggcgcgatctcggctcactgcaagcttcgcctcctggattcacgccattctcctgcctcagccttccgagcagctgggactacgggcacccgccaccatgcccggctaattttttttgtatttttttagtagagacggtgtttcaccgtgttagccagaatggtctcgatctcctgacctcgtgatctgccagcctcggcctcccaaagtgctggggttacaggagtgagccaccgtgcccggctacccaaaacactttttaaaaatctaatattcttgaatattttcttgtttttaatccagattttttaagaccctagaatgtctttagcatattataccaattctgtttattcattttttttttttttttttttgggagacagagtcttgctctgtctctcacgctggagtgcagtggtacgatcttggctcactgcaacctccgcctcccgggttcaagcaattctcctgcctcagcctcccgagtagctggtactacaggcgcccgccaccatgcccggctaatttttgtatttttagtagaggcggggtttcaccatattggccaggcttgtcttgaactcctgaccttgtgatctgcccacctcagcctcccaaagtgctgagattacaggcgtgagccaccgcaccgcacccagcccatttttttctttctttattggagagatggcatcttgccaagttaccgaggctggtctcaaacccctggcctaaaacaatcctcttgccttggtgtcccaaagtcttgggattctaggcatgagccattgtgcccaaccttgtaccaattcttaagtgataaaattttattttttgttttatagttcatacgagccatttctagatatttaattttttatgctgtttatcgagtgcttcctatctgcttggcttggtctggcagttttcatggatgctgtttcatttagtcctttttgcaatcattaaatgtagaggagacctttagttatctttaaaaaatcagatgcttgtcctaatagcagatgtttttatataataatatactagcttcttcttgaagtcagaccttatagttattcttgaatttttttttaggttgttttgaagtatttttggaagatagtagggcagtgacattattctagaggtctgtcagcaaagttttaaattttttcattgatttttataaacaaggcacttcctgagctaaattagatagaagcaatatttaataggtagattaatttttttaattggataatgtatacttatatacattaagatatattaagatacactaattagccgggcgaggtggtgggcgcctgtggtcccaaatactcgggaggctgaggcaggagaatggcgtgaaccccgggaggcggagccttcagtgagcccagatcgcgctgctgcactccagcctgggcgacagcgagactctgtcccaaaaagaaaaaaaaaaagatacattaagatatattcttatggccgagtgcggtggctcacacctgtaatcccagcactttgggaggctgaggcgggcagatcacgaggtcaggagatcgagaccgtcctggctaacacgatgaaaccccgtctctactaaaaatacaaaaaaattagccaggcgtgatggtgggcgcctgtagtcccagctacttgggaggctgaggcaggagaatggtgtgaacccgggaggcggagcttgcagtgagccgagattgtgccattgcactccagcctgggcaacagagcaagactccgtctcaaaaaaaaaaaaaaaaaagatatattctttattggttagaaacaagtttggtcattttttttcttttctttttcccgataccgagaatgggaccaaaagtttggtcatttaaaagtgcttatatctgcctgggcggggtggctgatgcctgtaatcccagcactttgggaggctgaagcaggtggatcacgaggtcaggagttcaagaccagcctgaccaacgtggtgaaactccatctctactaaaaatacaaaaattagctgggtgtggtggcgtgcgcctataatcccagctactcaggaggctgaggcaggagaatcccttgaatccatgagacggaggttgcagtgagctgagatcgcaccactgcactccagcctgggcgacagagggagactgcatctcaaaaaaaaaaagtgcttatttctgctgctgctgctgctaaatgaatattttgataagattagatttaatatgctttttatatatttgaggtagagtaacttgaattctgttattttatataaaactattgagagaagttcattttgttaaggaaaacaccattcaaggacataaactttaatgctttttcttttaaatgtgacgataggttaaatgtttattgcaaggatgttgcagttttttgagtttttaaaaatctaaacttaaatgctaaagcaaaagtttacatgtggaatgttaagcaatttataaccattattaagtaatgaggcagctgtttttgtagtatttaaagaatcagattgtgaagtagagtactcacgggaaaatgccatattgtggatgttacttaactcaattttcttcacttcttttgccttaataattcaatgacaaaggaacagtttagttcttgagcttttcttcctaaaatttcttttaggtttatggaatcattgttgacagcttaaaaattctcattccttcctcatctcctctttgggttaagttaaatttaaagattgttaatttttaatattaaaagctattcttcaagaagttaatgttttaaagtaaaaactattataatatgaataatatagttatcataaagattccttagttgtattaccctgatcaaataatgctatgattaatgctaagtggtcatatattgaaagttgtcagagcgtgtaacataagggatagaaataagattttagagactctcgagtccagcattatttatataatatctgtgggccctcacactgctcctaagagattattttggccattaacaaagaactttgtatgatgggttatagagatggtttaatctggagtttaatcagaaaaaaaaaattcttaggaaggaaaaagaaaagcctatgtagtgctgaagccaaatttattataactatatttgaagctggcatttctaattctgggtatagacagttattgtcacaaaatttcttcaggtacccttctcttacctgtcagttttttttttctttccactacttttctttaaatttcattattgttatatgttctgtgattcaggcatttagttcaactcatgcatgaatcactatgggattctattaaaaagaactagccacgaggcataacggctcatgcctgtaatcccattactttgggaggctgaggcgggtagattatttgaggtcaggagtttgagaccagcttagccagcatgctgagaccctgtctctacttaaaaaaaaattaaaaaattagccaggcatggtggcgcgcacctgtagtcccagctacccaggaggctgaggtaggagaattgctggaactgggaggtgaaggttgcagtcagccgagatcgcaccattgcactccagtctgggcaacagagtgagaatccgcctcaaataaaaagtagccagaagagaggccaggcgcaatggcttatgcctgtaatcccagcactttgggaggctgaggcaggcggatcacctgaggccagaagttcaagcccagcctgaccaacatggtgaaacctcatctctactaaaaatacaaaaattagctgggcattgtggtgggcacctgtaaacccagttactcaggagactgaggcacaagatttgctggaacctgaaaggtggaggttgcagtgagccaagattgtgcctctgcactccagcctgggcaacagaacgaccctgtctcaggaaaaaaaaaaaaagagaaggattcgaaacaaaaagggcttgaagaaaatagtaccacttttattttttcctcagattcatagtcatccatccattcataacaatggaggagtgaggagatacatttgagagagtctagaatatactgaagaaagtctcttgtttgactttttgaagagctgagtgtatagaattttgaagataatgttcctagcacacagttttttattttactttttattacagggaatttcagatatataaaaaagaagaataggccaggcgcagtggctcatgcctgtaatcccagctctttgggaggccgaggcgggtggatcacaaggtcaggagattgagaccatcctggctaacacggtgaaaccctgtctctactaaaaatacaaaaaaattagtcgggcgtggtgacgggcgcctgtagtcccagctaatcgggaggctgaggcaggagaatggcgtgaacccgggaggcggagcttgcagtgagccgagatcccgccactgcactccagcctgggcgacagagcgagactccgtctcaaaaaaaaaaaaaaagaatataatgaaacctcttcagccagctttaataactatcagctcacggccatctgtgatctaatttattctttgattatcttgaaacaaaatctcatagtcttataaataaatatttcaatagaacagttttatttactatattttgtaatagtattctatgttattaatcttagagttaagagttgaatccagcctctcatccagtgtaagacttaccccttcagtgttttcttttcttttttctcttttctgtttatttgagatagattcttgctctgtcacgtaggctggagtgcagtggtgcgaacttggctcattgcaatatccacctcctgggttcaagcgattcttgtgcctcaacctcctgagtagctgggatcgtaggcacatgccacaatacccggctaatttttgtattttaggtagaggtggggtttcgccatgtttgccaggctagtcttgaacttctggcctcaagtgatctgcccacctcagcctcccaaagtgctgggattacaggcatgagccattgcacgcagcccagagtttcttaagaggcagttatcctttccttgagtaccccagttgtgagaagctagattgtgaagtggcacaatctgggctcactgcaagctccgcctcccaggtttcacgccatttcttctgcctcagcctcctgagtagctggggctacaggcgtccgccaccatgcccagctaattttttgtgtttttagtagagacggggtttcaccatgttagcnnnnnnnnnnnnnnnnnnnncctgacctcgtgatccacctgcctcagcctcccaaagtgctggtattacaggcatgagccaccgcgccgagcctagataagctttttaaaaatgctgtatagctgctagttgctcaagataacttcaaaacgaaacaaaaagttgccttctgtttgtatattactggttagaaaagctccttggtaaaattttgcattttatatacccatttaaaggaataatttgggctgggcacagtggctcacgcctgtgatcccagcactttgggaggttgaggcaggtggatcacgaggtcaggagatcgagaccatcctggctaacatggtgaaaccctgtctgtactaaaaacacaaaaaaattagccaggcgtggtgatgggcgcctgtagtctcagctacttgggaggctgaggcaggagaatggcgtgaacccgggaggtggagcttgaagtgagccgagatcacgccactgcactctggcctgggcaacagagcgagactctgtctcaaaaaaaaaaaaaataaataaaataaaataaataaataaataaataaatgaaggaatagtttgtctttatgtctatctctcttgttgaattttgcttaaaaaataaaaaatatatttaaagttttttatattaaaatagagacaaggacttgctatattgagcaggctctactcaaactcctggcctagctttaagcagtcctcccacctcggcctcccaaagtgttgggattacaaggcattagccatggacccagcttgtttttattaggctagtgcaaaagtaattgcagtttaattgcacaaatattaacaaataagtattgacatttaatttagggcacaaatgaaaagattgggaccttatttcatttgcgagaaccagctagaagtagaattttgtttatggcataatctctgtcctttgtatcatctgtacttttatacctccttgccttcttttttttttctgacccttttgttgttgttgttatttagcaattcttaacaggatggattagaggacacagtggagattaaaactccaatagttaattgtcctgatgaaatgttggcattgcattgtctggattaaatgtatttatctctggccttgttactcactgataaactaatacagttgtatgaaatggatattctgtatgctttaaacaacctttaaattaaaaactagtgcttttgattactttctttctggatttcaactttaaaatgaatttttataattgaatataaaatagctgctctgaaaagctcatcagtatatttgtcttatatatttgaattgagcagcattcttaactttgttttccccatttttttaggaggaagataccaactagagataaaaataccagaaacatacccatttaatccccctaaggtattgtaagcctatttttgtgcatgaagttacaaaatattttatatttctgacctcattttattaatatatattttagggcttattaaagtcacagctttatgagttgcttactgtgtaaacttgatgtggacaggattttagataatggcaggtggctggcttctgaaattagaatgaaaagcaaactcacccaaaggcagccagtaatggctcaaaactggaataggatgtacatctgacaatggctcatatactagatctagaaatacgtggcagtgttcccaaatttagagagcccttttacacatagacagaggttcttacttgactcaaagaagtatgtgttttaggagagtaccttctacattcagtcattatttgagtactttgtgccaagaactatagcagtaactaagacttatactgttcctgctttcatagagctcacattatagtggggaaaaaaaactgagcatggaattgcaactgtgataaatgttgaaagggagtatggaataccctaagatcatgtataacagggggacccaacctaaacttatttttggattgaaccactttctttatgtctctgcttttactgtcatcagcactttaggcattcaactttattccctgttttgtctattatttaatcacccttccatcttttccatttctactcattctctgcactgttggtctagaaatcttcctagagttcagttttgatcatgctgcttttctttccctgaataaagtctaaactccatggcttggcacttgaaacctagaacctgaccccagtcttgtttcccactctaatcttctaccacttccacccacaatgtgggtctcattttccatcttagattgtttatttgtaggtgatgcttattcttccacagctttctatcagtttcacttaaatctttgtccctattatttaaaattctagttttctatgaggcccgagtatcactttcttcattaagctgagttcatcaaatgtttctccctctcctctctcagtagcattttatacaatttatatagtggcaacacaaatatagttccaactcatgtattattttggatatgtatctttctctagcttttatgctcctgagtcatataggtcttttacacctatatattatcagtaattcccaatagtatagtgtcccttgggcatatgatagcagtcactcagaatgttctagaatttgttcattcaacctattggttgttccagtttaagaatagatatgataatggaagttccagggtgattttggctcacttagcattatgggctgcctattagtctattgtttatgtacatctattttctgataagtctggtcgatttttttattgtgataaaatatgcatgacataaaatttaccattgtaatcatttttatgtgtgcagttcagtggcagtgtatttaccttgttgtttaacctttaccattatctgtctgtagaactttctcaccttcccaaactgaaacttcgtacccattaagcaataactccccattattccccgctcccagcttctggtaaccactgtttctgtttctccgagtttgattaattcagaaacctcatgtaagtggaatcataaaatgtcattttgtgtctggcttatatcacctagcataatgtcatcaaggttcattcatgttaaagcatgtgtcagaatttctttgtttttaaggctgaataatactccattataagtatagaccatattttgttttcttattcagctgttaatggatatttggattttgtttgtttgttttttgtttttttgagatggagtcttgctctgtctcccaggcaggagtgcagtggcacaatctcagctcactgcaagctctgcctcctgggttcacgccattctactgcctcagcctcccaagtagctgggactacaggcgtctgctacctcgcccggctaattttgttgttgttgttgttttcttttttttttttttgagatggagtctcgctctgccgcccaggctggagtacagtggcgcggtctcggctcactgcaacctctgtctcctgggttcaagcaattctcctgcctcagcctcctgagtagctgggattacaggcacccgccaccaagcccagctaatttttgtatttttagtagagatggcatttcaccatgttggccaggctggtcttgaactactgactccatctgaaaaaaagaaaagaaaaggaagtcatacacattaagtgggtgaattatgtctcagtaaaggtgtagcctttatagtgtataatagcttcaaagtaattgcatagttgtggctctgttttaggcagttcaacctgtaacttcatttaatttttgaaataaatattttattaaatctctcccacctcatccccacttttttttagagacagggtcttactctgttgctcagtctggagtttagtggcatgcacagtcatagcttagtgcagcctttaactcctggggtcaagtgatccctccaccttggcctcccaaagtgctgggattacaggcgtgaaccaccacatccactcccttgttttattaaagcgagaaaaatagactcaaaacataataactgaagtatgtctgatgtttttgctactacctcatcttgctattgaagccactgttacctggccaggcatggtggctcacgcctataatcccagcactttaggaagtcaaggcaggagaagcgtttgagctcgggagtttgagttcagcctggacaacatagcaaggccctgtctctagtcccaaaaaaaaaaaaaaagaaaaagaaaagcctctacatctctaattctagctgttccgtttggaggtagctttgacatttagaaacatcttcttaggttcaaccccaatttgtattactgtgacctcaaccaattagtcatagttgcagtttagtgttctttaaatacggtatatatgaaataaaatttttttaaataacaaaaaaaaataaagaacaaacaagaaaatgttatataccctacttgtggcattacgctcttgcagtaaatgttaatgaacatgataaatatgttctagatgtatactacgttgatttgaatttttactgattggtaaataaaatgagaagaatggggaatatttatgtaaatttcttgctgaattgtgtgttcacatgtgtttggactcaggcttaattttaagtcttatgaggtaaaattatcaaggtagctggttatattctcattactactgtgcagctaaaatttgagaaaagatgaaaaattcacatttgtcttaccatggtcacagaatgttttgtgtttattattatgcaataaattattgaccggaagagtaggcttacttctaaaacagagaaaatatatctttgaatcaggtgataatagtgtagaaggaatttgattaaatgcatacaaccaatatgatttctagcattaaattgcaatgtatattgtgttagtgaaaaaatcattagtaaaaatatagtccagtggtgtatcctgcttgaatagagcaggctggatgcggtggtttgctcgcctgtaatcccagcacctagggaggcagggggcaggcagatggcttgagctcagaagttcatgaccaaatggcaaaaacctgtctctactaaaaatgccaaaaacaaaacaaaacaaaaaatactagtctggtatggtggcatgcgcctgtagtctcagctactcaggaggctaaggcacaagaattgcttgaacctggcaggcagaggttgcagtgagccgagatcatgccactgcactgcagcctggacaagagagtaagactctgtctcaaaaaaaaaaagaaattaagttgtgaattttgctctttttctttggtgttatcatcatactttttacatgttaagttgtatatacataccaatgctaataatctttaatgagcgtatgctcatctgtacatgcatattcaaaatagcattttcttttgtatgataagggagttaaagctggcttaataatataatatgctttgagaccctgtctcaaaaataaataaaaataagatacggccaggcgcggtggctcacgcctgtaatcccaggactctgggaggccgaggtgggtggatcaccagaggtcaggagttcaagactagcctggccgacatggtgaaaccccatctctactaaaaataattagccaggtgtagtggcacgtgcctgtaatcccagctactcagaaggctgaggcaggagaatcgcttgaacccaagaggcggaggttgcagtaagctaagatcgcaccactgcactccagcctggacgacagagtgagactccatctcaaaaaaaacaaaaacaaaaaaaagcaagaaacacacttcacatatcttcaggtcttaaaactggaagttacagatggaaatatgaactcacatctaccatgaagtgggagctgaagtgttaaactaaagagtgaatgaaatttacagtgcatcctgtaggaagagataagaaccgttgatgctatgccaatattgataatttaagaatagtttccttcatttctgtctgggaacattgagaatctgttgttacatagtgttcagatttccgtttttattcattgagtgcttcccaaagctagtgagtgttctgaagttcccagacaacgctactactagttttgtatataaaaataaggagacattattattatattcttaatagatacagggtcttgctacattgcccaggctggtctcaaactcatagcctcaaacagtcttcccaccttggcctcccaaattgttgagattacgtgcttgattcactgtgctgggccacggagataatcttgaagattaaattctttttttttttttttacaaaatttttattttattttattttttgagacagggtcttgctgtgttgcccaggctggagtacagtggcatgatcatggctcactgcaacctctgcctcctgggctcaagcgatcctctcacctcagccttcgagtagcttggactacaggcataccccaccatgcctgactaatttttttgtattttgtagagatggggtttcaccttgttgcccaggctgctctcgaactcctgggtccaagtgatttcacccacctcagcctcctgaagtattgggattacaggtatgagccaccacgcctggcccctgaagattaaattctttattggatcatctgcaaattcaaaattcttttttcttttcttcttgtttttttttttcaaatagggacggggtctcaccatgttgcccaggctggtctcgaactcctgagcttaagcagcccacctgccttggcttcccaaactgctaggattatagacatgagccaccattcccagcccaaattcaaaattatttatttctaactatagattatagtacaaagtaagaattagttcagtaatttaattgggtcttggcttttttcctatgtatctacagagaattctgtatagaagacccttctttaaaaagcagtgctgaacgccatatcctgctttttgctcacacctgtaatcctagcactgtgggaggctgaggtgggtggatcacttgagcccaagagttcgagaaaagcctaagcaacatggtgaaaccctgttcttgtgtccacaaaaaatatgaaaattagccaggagtgatggcgcacgcctgtagtcccaactactcaggaggctgaggcagaagaattgagctcaggagctcgaggatgcagtgagccgagattgcgccactgcacttcagccaaggtgacagagtaagaccctgtctcaaaaataaataaaaaaggccacgcgcagtggctcatgcctgtaatcctagcattttgggaggctgaggcgggcggatcactgggaattccagaccagcctggccaacatggtgaaaccctgtcactactaaaaaatagaaaaattagtcgggtgtggtggcgcacacacgtagtcccagctactggggagactgaggcgggagagtcacttcggcccgggagacagaggttgcagtgaaccgagatcgcaccaccgcactccagcccaggcaaccaagtgagactctgtctcaataaaagtaaaaaaataagattaaaacaaaaggcaaaatacacttcacatatcttcagctcacttgactgaaccgtaatccttctgacatcttcaatagtgttttaaaattatattttctaatcttgttgaaaatactaaaccacatggggttttttgtatgtgtttgttttgttttgtttttgagacggagtctcgctctgtcccccaggctggagtgcagtggcacgatctcagctcactgcaagctccatctccctttacgccattctcctgcctcagccatccgagtagttgggactgcagtagctgggactacaggcgcccgccatcacgcctggctaatttttttttttttctttttttttcttttttttttttttttttgagacggcgtctggctctgtcgcccaggctggagtgcagtggcacaatctcggctcactgcaagctccgcttcccaggttcacgccattctcctgcctcagcctcccgagtagctgggactacaggcgcccgccaccgcgcccggctaattttttgtatttttagtagagacggggtttcaccgtgttagccaggatggtctcaatctcctgaccttgtgatccacctgcctcgccctcccaaagtgctgggattacaggcatgagccactgcgcccagccaccattttaaagttataaaatgctgtgaattccttgagttctgacattatggcatatgcttgtttatgaattgaactcaatagtaaatagaggttgattattcaaaattcaaaaatccgagatttgaaatgctccaaaatctgaaactttttgagtgtttacatgtcactcaaagaaaatgctcgttggagcattttggatttcagattttcagataagaaatactcagcatgggccaagcactgtggcccactcatgcctgtaatcccagcagtttgggaggccgagaggggaggattgcctgagcccagaaggttaggactgcagtgagccatgatcgcaccactccactccagcctgggcaacgggagtgagaccctgtctccaaaaaacagaaagaaagaaaaagaaatactcaacctgtattaagatgtgaaatgtgtggttatatctcttacaaagcaatgtttgatgtgggctcagtggctcacgcctataatcctagtactttgggagcctatgtcgggtggatctcttaagcccaggagttcaagaccagcctgggtaatatggtgaaacccccaacactattagaaataaaagaattggctgggtgtggtggtgtgtgcctatagtcacagctacttttaagatggatcacctgagtctgggaagttgaggttgcagtgagccacagcagtgagaccttctctgcgggggaaaaaagggagaaatgtttgttgtgcataagccctatattactgtcttacttagcttgcattgtatttgatatttagccttataataacatttttgccgtaatattaagtgcacattcattccatgtgagtcgcttacatctggagatgctttattaagtaggatggatacagtgtcttttagggaagaccggacaaacaaggcagaaatcacagaagtgtaattaatatactatgacaaaggaaactgcaggtgtgtggaatagatcaggaagaagtgatatggaaagtgaaacttgaagagtaggaattagttgggagaagagggcacagaggtatgttattgagaaaacaaatatgtatgaaggcccagaacaggggaaaagtttaatatgactttttgagcaggagagtggagtgtgggatagaggtaaaaattgagatttcaggagtagtctaaggccaggttaagagtgtgggcttggccgggcatgatggctccatgcctctaatcccagcacttagggaggccgaggcgggtggatcacctgaggtcaggagtttgagaccagcctggccaacatggcgaaaccccatcttgccatgttggcgctccaagatcgcgccactgcactccagactccagcctgagcgacagcgcgagactccttctcaaaaaaaaagagagagagagtgggcccacatgaagggaatgagaggtcattaatggtccttaaagcagcatagtgatgcaaatcagatttgttttaaagggctctctttagttttggtgcggaaaataaattggagggaacagaagggaaggcagtaaagtcaggagactgtgtagtaacctagatgatgaatgattgtctcctttaatgagaaggtggatggagagaagtaggtatctttgaaagtagtaagattattaagactgaaaagaatcaagcatagcaagaatgaaggaatggaaagtatcttattttcggtattttaaagtcattggcgaattaaagtgcctttttagattgaatatgagttagcaggaggtaaggaagtagaaataggtagtgtaaacaaatcaagaagtcacaaagagaagagagaagtggaaactcttagcttctttccataaatagcttaggagcatatattaaagagtccgtttttttccagttggtcgtgttctgttgcccaggctgtagtacagtggcacgatcacggcttgctgcagctcaacctttcagattcaagtaatcctcatgcctcagctccctagtagctgggagtacaggtgtgtgccaccatgcccagctaatttttttatttgtagagacatggtctcactatgttgcccaggctggtctcaaactcttgggctaaagtgatcctcccgcctcagcctcccaaaatgttgagattacagtgtgtgagtgctaatttttgtgaagttcttagaacattaattggcacatagtaattaatctactaagtgtcaaagaatatgggctcagctggtcattgtcatatgtgtcagagataggaatacaagatcctccaaaagttcatgagtaagagctgatgaactctttaatttcatggtgttcccctagagttttagcattttcacttgttggtttgttattcttccataatgagacaaataatgagatgattggactcagaatctggaatcagattgtgggagtttacattgtgctctgtttagctatttaattagatttcttaaactctaagccttagtatctcctcagtgtttgctacatcataataggcatttcaataataagaatttgagaaaaaattctacagaaaaattaagagaagcacagccacttactatttgtgcttccattcactggttttacttacttttttcctcaaacctattctgcaccctgcctcacatgaagaaaagtgccatttactatttatgtttttattttatgtactattttatttaccaaaatggattttattctctgttgtattctcatagcatctaccattattctaggtaaattgtaagctcctagtaattgttgggtttgtttaaaggcggaacatttattaaagagtttgaaaacaacatatgttagtgacaacattcagcttactggatcctttgtcttctacaccccttctttcacctaggcaaaatgatgtaatagatatagggacctttctttttttagtttgaagatttcattttcttgtagttctacttaaactgttttatttctgttactgaaaaactcaagtgtgctttatattctaggtccggtttatcactaaaatatggcatcctaatattagttccgtcacaggggctatttgtttggatatcctgaaagatcaatggtaagagattttgaattcaccttctctccttctcatatgaataccaagactgtaagagtgttaaatgtgtaattgcctcaaaacatatattatactttatcttgtttgggcagtaactttataaagtctcttaagtgcataactgaaaatgcattataattgagatcacaatccatatttaaatagaaacttgttagataatgttagatgctagctttacactttgaaaagccttggatttcatttgttattttggtaaatttgattctttgctatcttaagaagatatttgtgaaagactaaaaaagtagaaagtaagtattgaagtagtcatatcccccttagatggaatgtaagttacaaaattgttgcaggttgtgttaattgagcacagttaagattttggtttatgaattctaacaaggagcacctttgtaggtgatgtcttcatttggatagcggtattgtgctttcactttttttgtctgatttgctctgcacagcattaaatgttttaagagttcctactctggagccaccaggttcacatcttggctctccagtttaccaagctgcatggttatgagcaaattacctaaagtctgtgtgccttagtgtcctcatctgcaaaatgggttgatacccacttcatagagctcagaggattaaataagttactttatgtaattcccttagaatagagctttgcttttgtttttgtttgtttgttttgagacagggtcttgccctgttgcccaggctggagtgcagtggcgcaatcacagctcactgcagccttgacctctaaagcccaagtagtcctaccacctcagcctcccaagtagctgggaatacaggcgcataccaccacacctggctaatgtttgtattttttttagagacagggttcctgttgcctaggctggaagctttgtgtagtctgacaatgataaagatgatagttaattatttagcacatgattttatagatggaaaaactaagaccaaaggtatgaaaagtaattggagtgggagaaaaccataaaactagaaaaaatcaattcagtgagtgtctattatgacctttccttctgattttactcttttacaagagaaggtataacagaacaaaatagaacagcagttggtaagaagacttggagccaaaactgtgtttaatgggcccagcctggctgcctaatcttctaaagattatatattatttttggtactagaatttttaagctatgtttttttgggtgtttttttttttgttttttgttttttgttttttgtttttttttgagacagagtttcactcttgtcacccaggctggagtgcagtggcacgatcttggctcactgcaacctctgcctaccgggttcaagcgattctcctgccttagcctcccgagtagctgggactacaggcgtgcgccatcatgcccagctaatttttgtatttttagtagagatgaggtttcaccatgttggccaggctggtctcaaactcctgagctcaggtgatccacctgcctcagcctcccaaagtgttgggattacaggcatgagccaccacacccggcctaagctatgtgattgatttgttaagaaaggggagaaaaaaaggtacctgaaagaaaatcaaataggaatgacagtatttagtgtatggccagtggtttacttagtaactggatgaacagactagagttacaggttttgttttgtttttttttctattccagtagtatatctgagtaaatcctgtccctcagtagatcatctcttgggatctggtttcttgatctgtatttcaatatattctatattccatatagatcaagactttctaacgtaaagcagtgtggaatagacttactttttatcttctctgttactcttttgatttgtgacttttaccaatttattgaacttcttaagtgtcagtgtttttaatccattaggttatcgccaaggcctctaaaagctctaagattcagtgatatgaatacatatttgcagtattagagacattgtactgttttcacttggcttctaggacattagattttctattctccctttcctatgctcactcccagattccttaaccagttccttgcatctttgtgtattagaatgcctcagggataagtcttggatttctgctcctttctagctgcactcacttccttggtaagctcatctgatttcatcataacttcacctttacatactgcaaactcacaaattatcttccctgaacttgagactcctatcctgctgcctgcttatcatctttacttgactatataacgaacatatcaaacataaactgaactgatagtctcctaacctgaaacctgcttctatagtcttccccaactaagttattggcaaatacgtccttgcattttctcaggccaaaatcacatcatgatccttggcatttctttctctggtaccccatgccctgtctgcagatctattggcaaaacctcccaacatcttaacagcagctttactaccacacttttccaaacggattacctctagcctgcatgattgcattagtctgcctccctgcttctggcttttacctactcaggctattcccagcacccagcatgacaactttgaaaacaaagcttgccgccacgtgcagtggctcatgcctgtaattccaacgctttagaaggcggaagtgggcagatcgcttgaggtcagaagtttgagaccagcctggccaacatggtgaaaccccatctctaccaaaaataaataaattagctgggcatggtggtgcatacctgtaatcccagctacttgggaggctgaggcaggagaatcgcttgaacctgggaggcggaagttgcagttagcagagatcatgccattgcactctagcctgggcgacggagtgagaccccatctcaaaaataaaaaaaaaaaagaaagaaaaagtttgcagatgaaaacttcccattgacttctctttttgcccagagttaagccaacagtactattacttgtaattatcttcctatatagctagttgaaagattatggtgtgtatatatagagagagaagttgaatttttataccaaaacattttctcctaatatgatgtgcaggaacaaaacattttttacatcaactattcccttttcctaaggcaggtgaataatcttgttttttatctgtacaattgaaatattagaatataccaaagacacattagataaaataggtgagactagatattcatgaagtcattactttattcccagagctttactgaggtataattgacatttagtgcatatccatatttaaatgtggatgtttaggtttcagaactggaatttgatagagaaaaatacagagtcttaatcataggaaaaatgaattacataaataattttcagcaggcatactagaaaataattggttaatcttggtcttttattaatgcatctaggggtgatgatatacctttattaatatttaacttattttagtatatttgtttattattattatttttttttgaggcaaagtcttgctctgtcacccaggctggagtgcaatggtgccatctctgctcactgcaacctccgcctcccgggctcaagcagttctcctgcctcggcctcctaagtatctgggattacattacaggcatgtgccaccacgcccagctaatttttttctatttttagtagagacagggttccaccgtgttggccaggctggtctcaaactcctgacctcaggtgatccaccggcctcggcctcccagagtgctgcaatgacaggcgtgagccactgtgcccggcccctggtttatttcttaattccacaacttgtgctgtgtggaaactattttctaatgttttccactgacacttactatgactaatggtgtctacttacctggggaagaaaatggcaacacataaaaatttcactcagtgacgctgcccttctaaaagacacaaacaggcacagaatatctgcctggtcgataaggtatgctcagcatcattactcatcagggaaatgcaaatgaaaatcacaataagataactactacatgcctgtaaacacaaatacctcatgcattgctggtaagaatgtggcttaaccaggcagggcacggtggctcatgcctgttatcccaacactttgggaggccaaggtaggtggattgcttgaggtcaggagttcaagaccagcctggccaacatggtgaaaccccatctctactaaaaatacaaaaattagccaggcgtgggtggtgggcacctgtaatcccagctactcgtggggctgagacaggagaatctcttgaacctgggaggcagaggttgcagtgagctgacatcgcgccattgcactccagcctgggtgacagagcgagactctgtcacacaaaaaaaaaaaaaaaaaaaaccggaaaaaaaaaaaaaccaattaagggggttaaaccacttaaagccagtaatatctaccaaagctaaacatacaccttaagtatgccctataagcttctttcctaggtatatatctaaaaaaaattagggtctatgcctacttttaaaaaaacatgtataaaaaattatttatggcagatttattaatagccccaacgggaaataacttaaatgtctaatcaacaagaaaattgatactttgtgatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagcactttgggaggccaaggtgggtggatcgcttgagcccaggagttcaagaccagcctgggcaacatggtgaaactccatctctacaaaaaatacaaaaattagccaggcatggtggcgtgagtctgtagtcccagctacttgggaggctgaggttggaggatcgcttaagctcaggaggttgaggttgaagctacagggatctgtgatcacaccactgcattccagcctaagtgaccgtgagaccctgtctcaaataagcagggccaggcgcagtggctcacgcgtataatcccagcactttgggaggccgagatggatggatcacctgaggtcaggagttccagaccagcctgaccaatatggtgaaatcctgtctttaccaaaaatacaaaaacgttagccaagtctggtagcatgcgactgtagtcccagctactagggagaatcgcttgaacctgggaggcagaggttgcagtgagccaagattgtgccactgcactccagcctgggcaacagagggagactccatctcaaataaataagtaagtaggctgggcgtggtggctcttgcctgtaaccccagcactttgggaggccgaggcggatggatcacctgaagtcaggatatatatatacatacatacatacatacatacatacatacatacacacacacacatacacatacacatacacaaaagccaaacattttgttgatccattcatccatccatggaaaccttaagttgcttctaccttctggctattgtgaataatattgttatgaacatttatatattaatactccagttactgctttcagttcttttggatgtatacccataagtggaatcactggattatatagtaactctgtgttttttgtgtgtgtttttgtctgtgtgtgtttttgttttttgtttttttttgagggactgccatactgtttcccatagagttttcaccattttacattcccacaagtagtgcacaagagttccatttctccacaacctggctaacaattaccattttttttatggtagccattctaatggatatgaagtgataggtcattgtggttccaatttgcatttccctaatgattagtggtgttgagcatctttttatgtgtttattgacactttatatatcttctttggagaaacgtctgttcacatcccttgtcgattttttaaccaggttttttttttttgttattgagttgtaggagttctttatgtattatggatattaagccctcaccagataaatgatttggaaatattttctcctgcaacacagaagtttttttgttttaagtagtggggtcttgctgtgttgcccaagctggcatcgaactcttgggctcaggtgatcctcccacctcagcctcccaagtagctgggactacaggtgtgtgccaccacaccagcttcacaggagtgtttatttttatttctaatttttattattttctttctttctttttttcgagacagagtctcgctctgtcgcccaggctggattgcagtgacacaatctcggcttactgcagcctctgcctcctgggtgttcaagcagttctcctgcctcagcttcccacgtagctgggattacaaacatgcaccaccatgcctggctaattttgtgtttttaatagagatggtgttttaccatgttggccaggctggtctcgaactcctgacctcaggtgatccacctgcctcagcttcccagagtgctgggattacaggtgtgagccactgcatgcggccaggagtttttaactttgataaaattgtcgtgcatattctcgtattttttgctttggtttcctgtacctttgatgtcatatccaaggaatcattgccaaattcagtgtcatgaagttttctcccttatgtttttgctttctagctcttacatttaggtctttgatccattttgagttaatttttatatatggtataatgtaagggtccagcttcactaatttgagagattatcagttttctttttttctgtttttttttttttttgtgtgtgtgttttgtttgtttgtttgtttgttttttgagatggagtctggctctgtcgcccaggctggagtgcagtgatcttgactcatttcaagctctgcctcccggattcacgccattctcctgcctcagcctccagagtagctgggactacaggcgcctgccaccacgcccggctaatttttttgtattttagtagagacggagtttcaccatgtttgccaggatggtctcgatctcctgaccttgtgattcacccacctcggcctcccaaagtgttgggattacaggcatgagccactgcgcccggcccaggattatcagttttcaagaaaagtgttcattgccttgttgagatatatgttagactacctatgtgatagtatgaaggacttgcaagatttagatgcttttattttacatgcctttatgtttttctttcaaattaaaataaatattatgagtttaatagttgccttagtattaaatacttcctttgagtgaaaatttttctttgctattcaggtaaatttcctttaaataaataattttattaaaaattacataagattttgtttcaggtgacaccatggattttaaaattagattgcttagaaagtccattggaaaattaaatagtgcacttaagtgttgtatatttcattggttatattttgtctttgtgttccttatgttatttttggtggtttaagtcagctttatgctgataacatctaggtagcttttgatatgtatgtgcctttaaacattctctttgaaattactcaaactatcaaatgaaattagagaaagaatttccccttgttattgtgagactagaaagacgggccattgcggtgtcttacacctgtaatcccagcactttgggaggcagaagtggacggttcacctgaggtcaggagtttgagaccagcctggccaacacggtaaaaccccgtctctaccaaaaaaaaaaaaaaaaaaatcagccaggcatggtagcaggcgcctgtaatcccagccacccaggaggctctgaggcagaagaattgcttgaacctgggaggcaaaggttgcagtgagccaagattgcaccactgcactccagcctgggggacagagtgagacttcgtttccaaaaaaaaaaaaaaaaaatgtaaaaaatggtgagtagaaagacaagaatgaacatttgaggactgagtttggctttttgttttgactcatgtcttaaaagaatattgtgcatttaaaagagatgaggtttcaccatcttgcccaggctggtctcaaacccctgggttcaagcgatcttcctgcctcagcctctcaaagtacagagattacaggcatgaaccaccgtgcctggtcctatttttaattttttgaggaaactccatactgtttttccataatggttgtactaatttgtattcccaccagcagtgtgcgagggtttcctttcctttacatcatcaccaacacttgttcattgtttttatagtagccgttctaacgagtgctaggtgatatctcattttggtttgttttttatttatctatttttgatggagtatcactctgtcacccaggctagagtgcagtggcatgatctcagctcactgcaacctcagcctcccaaatagctgggattagaggtgtgcactatcacggccagaaaatttttgtgtatttagtagagatggggtttcgccatgttgcccaggtaggtctcgagctcctgacctcaagttcaggtgatctgcccacctcagccttccaaagtattgggattacagacatgagccaccatgcccaccctaattaacagtatttgtcaaattttaatgtgcatcagaatcacctggaggacctgttaaaacaaccctggagtttctttttgttttttttttttttcgttttgttttttgttttttattttgtggaaaacaaaagtagaaaaactaaaaccccaaactccagaaaaaatcctaaaaaatgttttttcttaaaaaatactgtatgtctctactcctctccctccctcccaacagcccttcttgtgttcttttctaagtgccttacccccccacccccatgactatccattgttcttgctattgtgcccccacttcccaatatctatccaggatgtgcaccccatgttctcttacctggcgtcttacttttttctccctcaaatttcagcaagcctcatacttgcagtctcatttcgccagcatgcaagaactgtctcccccttccttttctgggactcaataatcttttccccttaccactccctcaccccaggctctattataagcaggagcatgtcctcctgccaaattccctccctgttcccacccaccccccaacccttcttatctcgagaaatgtcagaaccttcccctgggcaggcttagccaggaataaaacatttttgtcttccctcgttctataggacccttttccctccctccacatacacatgcgcctctaagagaaggaaatctttctctgggaccccgtattcccctggcctactccaagaaccctgtcccccgctccagcttcttgcactctcaagagcaacaacagtcttctctccaaggaatcatcttccctctctcaggatgtgtgcatctgctcagcctcccactcttacctttctgccccagaccccccacccaccaattctcctgggccaaagagccctttccccacctagcccagggaccccagcctccgggcctccacgcctgcgcggctagcggatgaggacattaatctcggccacactggtctccagcacgttctcggcggtggtcttgccgtgttgctccttgagatgccgcctaatggcaggcttgtgggcgaagcgcatgtcgcagtaggagcagcggtagggctgcgctcccgagtgcaggttgaggtggtcgtgcagggtggacttctgtgtgaagcacttgccgcagatgccgcacgagtgtgacttgacaccacgatgcacgttcctgtggtggttgaggttgttgctgtggttgaactccttgccacagcgagggcacatgaagatgaagtgctgctgccgcatgtggaagaccagcttctccacgccctggaacacttccgggcacttggtgcacttgatgttctttaaggggtttccacctgagaagctcccaggcaggggtccctggctgccccccgccccccgggcaaccatggccgccgctgctgcttccaccaggcccgaggtggcccccacgctggcccggcctcccggagtcaacagcaggctctccccttctgcgttctccgacaggctatagcaggccttcaccacaccctgcggtggggccacagtgctggggggcacgctgctctgggccagctccccaaggtggccacccacggagcctccaatgcccaggccccctcccaggcctccagggggcttgagccggtgtgcgatgtccagggccgactccaccttgacgatgcagatgtcagatacgtcctcatcctcatcctcttcctcggctttcagctccaagtcctcatccagtgggaactccagcttcactggccgcaggagtggaggggatagaggaggtggggggtgggggcttcggggctggctttggggtcctggctggagggaggagggacttgttggcgctgacgctgctcacaaggctagcctcacggaccccatcctctttgaggcctattttgggctcagtgaactggctgagggcattctggcatttctccaccacgtgctccatctgcaggtaggaggtggctgtaagatagttgacgatgtccctaacagcgaattccagggtgcccgtgtagcaggagagaagcaggtcggccacgatgcgtgcactgtgcatcagggagacctgcagctccgagctggggttaagcaggaactggtcccgcaggaacggtgagcaggcggctaagatgaccttgtggcctcgaaacttgaggctgtcggccacaatggtcacgtcgcagaaccactcctctgcccggagcttgttcatgttccgtagcgtagcggcctagtggccgggcagctggaagcgcaggacttcaccccagaggccattgtggcgggggtgggcaaccctggcccggttccgcgcgctgtttttttttaatcccctattttccccacccccgcggggccggaagcgccccccacacacgggcagagccagggcagcatgtaggcgcagggcgggagggtgtatggggcgcgctcgcgctggcggggccggctccacgtgggcgtaaaggggtaggggcgggagcggctcgtgcggtgtgttccaggcctcgcgcgcgcggcgacggcgtcggctaggactcaaaccctggagtttctgattcagtagctctgggatagagaaaacttcccaagggatgctgatgctgctggttggatgaacaacactgagatcattgctttaagacatccattgttggttgttggcaataacttaactttttggctaggggtggaggtgtaggagacagtctggctgtctccctcaggctggagtgcggtggcgccatctggactcactataaccttcgcctcccaggttcgagcgattcctgcctcagcccctcaagtaactgggattacaagcatgtgccaccacatctggctaatttttgtatttttagcagacagtgtttcgccatgttgcccaggctggtctcaaactcctggcctcaagtgatctgcctgcctcggccttcctaaatgctgggattacaggcgtcagccactgcacccagcctaaattaacttttatcgtaggcatctagggaagtactatttatgtaccaaacttgggaaaattgagaaaacagtcactaattttttctattttgtggttcaaatcaggaacccagttgaaaaaggctggtttagagtaattggctagttgtcgtggctcacacctataatcccatcactttcgggggctgaggtgggaggactgcttgagctcaggagttcaagaccagcctgggtaacatggtgaaaccctgtctctaccaaaaaaaaaaaaaaaaaaattgtttttaattagctgggcgtggtggtgtgcacctgtagtcccagctactcaggaggctgaggtatgagaatcacctgagccaaagaggtcaaggctacagtgagccttgattgtaccactgcactccagcctcggcggcagcgtgagactccatctcaaaaaaataaaagaaaagaaaaaagaaaatatatttgtttcatagtatcttgtttttagagtgccattgaaagaaagcctcacatgctattagtactaatgatttatcactttaactttgtttagagaaatggatagaaaaataagtgagtggataaaactaacaagaaggtggctgggcgcggtggctcacgcctgtaatcccagcactttgggaggccgaggcgggcggatcacgaggtcaggagatcgagaccatcctggctaacacagtgaaaccccgtctctactaaaaatacaaaaaattagccgggcgtggtggcgggcgcctgttgtcccagctactcgggaggctgaggcaggagaatagcatgaacccgggaggcggagcttgcagggagccgagatcgcgccactgcactccagcctgggtgacagagtgagactccgcctcaaaactaaactaaactaaactaacaagaaggatcttggcaacaagaaaaacaaggacagttcagaattcgagttgtcttaagaaatagaaaagctggccgagtgtagtagctcacacctgtaaccctaacctttgggaggccaaggtggatggatcacctgagctcagaagttcgataccagcctaggcaacatggcaaaaccccgtctttacgaaaaaaggaaaaacaaaaaaaatgctgggtgtggtggtgtgtgcctgtagtcccagctactcgtgaggctgaggcaggagaatcgcttgagcccaggaggcggaggttgcagtgagacaagatagtgccactgcccactccagcctgagcggcagagcaagacactgtcattaaaaaaaagaaaaaaggccgggcgcaggtggtttttcatgcctgtaatcccagcacattgggaggccaaggcgggcggattacgaggtcaggagatcgagaccatcctggctaacactgtgaaaccccgtctctactaaaaaaaaaaatacaaaaaattagctgggcgttaaggcgggcccctgtagtctcagctactctgaaggctgaggcaggagaatggcgtgaacccgggaggcggagcttgcagtgaaccgagactataccactgcactccagcctgggcgacagagccagactccgtctcgggggaaaaaaagaaaaaagaaataggcaaattgtaaagtaaggaagaaaatatatgataggcagatacataattataaatgtctatgacttaactatataattaagataaagatctaagtaacttttagctctacaattttttaatttttattaagaaaatactttgcttttgcctgcagagccctcttaattgggatattttcatgttttgcattttagggcagctgcaatgactctccgcacggtattattgtcattgcaagcactattggcagctgcagagccagatgatccacaggatgctgtagtagcaaatcaggtaagatggccgcttttgaaagactttcttatattatgtatgagtctctagccacttcagtgatttgcacattaacacatgagcatactctattgaaactaaattttgaaatggttttctttcttgtggtaggattattttgtcaggtgtaatagtgaaaatagacttttaacatcctagtttaattggatatagatgctgttttcctaacatgagtattttcaaacacataaagtcaaaagaattacatagtgaacacccatattcctaccatctagattctatgattaatgctcgtgtatgtgtccatctttttatccttcctttcagtgatgatccctccctgctaataattttaatcacctcctatcatgggacttatgtgacatggcacagtttccgatgaccttgtaatttgttgaacagaataaatatttttcatttcgctttctagctacagtggctgagtttattagttacaacagagactggacctaagttattagtatctgacctgttaagaaacagtttgctggccaggtgtgttggctcatgcatgtaatcccagcactctgggaggctgaggtgggtggtggatcacttgaggtcaggagttccagaccagcctgaccaacgtggtgaaatcctgtctgtactaaaaacacaaaactagcctggcgtggtggcacacacctgtagtcccagctacctgagaggctgaagtgggagaatcgcttgaacctgggtggcagaggttgcagtgagctgagatcacaccattgcactccagcctgggtgacagaacgggaccctgtctcaaaaaacaaatttgccaacacctactctaagccattggaatataatggacatttttttttttaaacttagaaagtttttcttctcttgacttctaagatattaccctcttttcttcctcacttcatagctgttctttgttagttcccacaattatttcccttcttactcgtctttcttaaatgtagttcctcagttctgaccttgttacctttactttctgtacacactcacacttggatgatcatatctgtactgatgttagtacctgtacattgataaaatgtttaggcttgccctctctcctaagcacgagagcctggtgtttaactaaattggtaggtgatggtatcatagaatgataggtttgtaggatttatgatactgcattcagttttggcagtgttacattcaggtatccaaggaacattcatatggttaaccacccaagtcacagcctttggagtttttctctgtgtctcctttgctcctgttgataaccattccctgtatcattctgtcactatatttacataattactctgattgccataggtcacttttaaaaaattgtttcttttcaactgctctgatagatctccttttctcaacctctttcttcctttctccatcttctacattgctatcaggtagctttataaagtgcaaatcttacttcactaacaaaaacttgttcgtagctctactgtcatctacttgagtccagattctttagtttgcagagtttttccatgatctgaactctgctttatttcctaaattcttgttttcttcaaactcatgctttttcaagcattgcattcatttttacatattgtatccaatctaccatatttcctctgcctgaggaaacttcctcttggcaaacttctttaacctataagattttaatttatatattatctttcttcttttcccttgaagatctgtttatgtatatatgtatatatccttgtcaatatattctgttatttgtctcagagtacttccaattagggttttccatgttttatatatgtgctatttgttcatatttgttgttataagcatggcttgtgttccagctttgctttcctattgagctctaagccttacacgttgaggttggactcaagggtttcttttagctcctaaaatagttcaataatttgacttatttccttgtgatgaataagtggtagaaactagatttatcgttttaatatgtaatagatttaaatatataaattacttttaaaagaaatattaaagtgaattgaatagttagtaatttatactttgctttactaagtaatggtggttccaaagtatttgataaatttacctctttccaatgcatatgggaagtcttttaataaaattactctattgtgagtttataatcatctcaagttatgtaataagttaggactttgcatgtggggtttccataaatcactgtacactaatgcagctgtaagaaaacagaagaatctagttgtattctagcctgggctgtgggtaatacaaaagctggttacatcgtaaaaaattattctaatgtccacatatttttataagctagtaatctgtgttcagttgtataatgtttgctgctttccagtgtttggaacatctcttaatacctcacttaacctaattttagtcttgctagttatatttgttgaatttggagattaaagtagattaatgttacttgtctttattattgtcaacacaaattgtgagtcgaagcttcaggttaagtggtcttttctcgagtgacataggttgtctataatgcaaagtgaatcacattttaaatgtagatttgttttatttggaaaagtaggattgtaggcgataagagctgaaatatatcaaatattataactgtaatgtcatgtcaatcaatttttccccccatatagtacaaacaaaatcccgaaatgttcaaacagacagctcgactttgggcacatgtgtatgctggagcaccagtttctagtccagaatacaccaaaaaaatagaaaacctatgtgctatgggctttgatagggtaagtacataagggcatgttgattttgatatattgattgattttaaattattgcaaattcttggctgacaaaagtggtttagaaaataagagaaattcgcagcctgggcaacatggcgaaacccatctctacaaaaattagctggacatggtagtgagtgcctgtaattccagctactctgaaggctgaggtgagagaatcccttgggcccaggaggtcgaggctgcagtgagcgatagtcatgccactgcactccagccttggtgatagagcaagaccctgtctcaaaaaaaaaaaaaaaaaaaaaaaaaggaaaataagagaaaatctagttttggtaaacatattttctgttttcaaagtcagtgatttttttatttttactaattactgtcattgattttagaagctttccatgcactgcaaatgtaaatcaacttacagaaaagaaacaaggtgttaattcccagtataaagagtgaatgattcagtattgtttaaatgtttccttgagatttaatttcctgtccccttttcttctctacagaatgcagtaatagtggccttgtcttcaaaatcatgggatgtagagactgcaacagaattgcttctgagtaactgaggcatagagagctgctgatatagtcaagcttgcctcttcttgaggagcaccaacatctgttatttttaggattctgcatagatttcttttaaactggcattcttgcctaatgatgttatctaggcaccattggagactgaaaaaaaaaaatccctgctctgtaaataaagctaattaaacgtctgtgtaaatttaaaaaggggaaatactttaattttttttcttaatagtgtaaaaattccctgagctaagctaaaaccatggaagaaacatgctactttagtgtttagcagtgtaccaagactagcaagagtttgcttcaggattttgttgaataattaagataatattttgagtgtgtcagggccattcaaattgttggtgttgcatcacagctaccttaactgtttttaacatggatcctctgtgcctgtgaatttacttgcatgcttgtacttgacttcttaggatgggtagctgaaaagaccaccattttaagcatttgagaattcttaaatatgaaatttattcagaattgaagatggtgacctattcagagcctttttgtccttgtcaacagactgggacagtgtctgattcccccttcaccccccccacccccgccttgccacacacagctaatattctaatggtaaatttctctgtatcaggtggggaaatgtgctgaaggacagtatgtatcccttgcttcatttttaggtcgtaggtttggaatgtcttgtcccagttcttcaaacactcttaaatttttcttaagtaatgtaaaaatggaactgccaattttatttctcttgcaaaaatagtaaatacttgatgttacattattcccaggtttaatgaaagaacccaacttagtttttcagtgaatttgacacctattttttagtgatgaaatttttctttgagaactggcaaggatgcagtcagctgtttgcagtttttagcctgattttggggtctatagagattgctttattggatacttcaagtcattcttgcttgcacttcccctattgacacatgaaagctgtgttggtgttttattgtacatacttcagatgcacataggaatagaagtgtgttataaatctagctttctttatgatgtttctgataatacgagaattgaaaactttaccttctcttgtacatagtcagactatttgtattaaatttacatttcattctaagttcaaaagtttgaaaattattagttttgcaagatcacacactaatgtaaccattttatgaaggttgaagtggatttatgcaggcagttctatatatagaaatacaattctttttaaatttttaggaccaatacaaaataacaaaaatgtaatggaatcagactgaattaaagtaaggctgtatattgaaagtcatattataaaaggtttgctttctttaagtgttatttatcttaaattataatcgttaaatgtttggaagataatttttgaatcataacgtcagcataacttcatttgacttctcaataatcttgatactagaagcaataaaagaaccattattaaatatattgtaatgttaaagatgtgaaggttcttccaaaaatttgtaaggctttcctaattaacagtaaactcttatagctgatattattacatactaaacacaagttgctgttttttccccatatgtttgcttacgcatgtctttatacaatcacctctttttattgctgtagtttattttctaaagatgccaaaggaaacaagatttttctttatttattttaaatacctgaaacctcgtactttatattttgaagtaaggtgggattgtgtgaaaatgtggatggtttttctccagtgttggttagaactactttttttaagtggagggcaacttggtagtattagtagaatttgggtttaaaaatatcagacacatctacccagtttattttttgcctgtattatcagggtatatttaattgtcctgtggttaaacaaaggtgagagagctcagaggtttctaaaggtcaagcattttacatatatacatacatacatgctcttggaggcagctatatcctgctttgatttttatgcacatgagccctatagggttatatactcatctaactacacttcagcatccccagtgcccaagaaattggaaagtacaatatttggtttgagacattcttcataaaagattctttattataaaaatttacctcatttacatttaatgtgatgatcttttttttcctttctggtatatttcccactgtactgtttggtttttgttattctcttgtctgtgggtagatttagttacccaaacatagaaactaaagcaattgcttttttcctctggtcttaaatatgtttggacaaaaagacactaaaaggtcaggcctaggggaaaagtaccctggtggaaattatttttgtaattcttaatatttttgagttggctccgtttgtcagttttaaaagcctcaaaaattatgttaaaaaaaaaatccagtgaaatcccatttagggcaggccgatttgttagaagtcactgatgctccagtaggcttttgttataatcaggcctgtttcctgagtatgtgcctcttttaaaagaagaaataattagctgtatagtatttcagtactgatgaatgaatgaatgaatgaatggcagttagtggacccaaataagtattcagtggtatataaatatttgaggaactaggtactgaattaggtgctctgagttggcaccccgaaatgtttggaatcacgactatgatttacttaaacacgtaacacattcaaggatatataaatggagtctaagtattttgcttttgaagagaataatctatgaaatggaagacttgatttttttttcattttttagaagtaatacacatttatgattgttggcacataaaactatgcaaaataattctttttaagtatctgtaagaaagaattggcagtttaaacggattttgcttatttatgcactacagaatgcagcatactgtattactgttgaggctgcttaataagtttaccaatgtgaaaagcagatcttgggtataagtgtatgcctgatttgagcttttaaaactgtgcagtaggtgtatggtaatgttttacaatcctatgtagcaaaataggaaattatgaatttttgttgttattgttttaaagatttaagatggattggggtagggaacagctggagccaggtataccttctagtatgtagagggaaacaatgtttagataggaaaaaggaagccgtctgtttacagttaactttatttcatggacttctacaaaatgttgtattaatcactttttctagttcaaggaatttcaattccagggtacaaaccattgatttaaaaattacgtttccattctttttagtatcagtttaaagtaaatgcttaccatcagccagttgctgtcactgggaagaaggcaacttgaagtatttactgataaaatagcctttattcccaagtgtgactt

SEQ ID NO: 16242 - DNA, 32658 bp, Human
aaatgagtcttttttgtttggttatttttctgagacagtgtctcgttctgttccccaggctgcagggcagtggtgtgatctcggctcactgcaacagggagcctcctgagcagctgggattacaggtgcccaccgcctcacccggctaactttttgtatttttagtggagccggggtttcaccatgttggccaggctggtctggaactcctgacctcaggtgatccgcccgctatggcctcccaaagtgctgggattacaggcgtaaaccaccgtgcctggccaaaggaattgagtcttaatcccttttgcatcttcagtctttaggataacgtctgacacacaacaggcattaaatatttgttggatgaatgaactgaactgcatagaatgcagaaagcctacatatactggccaggcacagtggctcacacctgtaatcccagcactttgggaggccgagacgggcggatcacctgaggtcaggagtttgagaccagcctggtcaacatagcaaaacccggtctctattaaaaatataaaaattagccgggcatggttgtgggcgcctgtaatcccagctactcgggaggctgaggcaggagaatcgtttgaatctggaaggaggaggttgaggtgagccgagatcgcaccactgcactccagcctcggcgacaagagggagactccgtctcaaaacaaccaaccaacaagcctacatatcctgccacacgtgctacaatccacagcaaactgtttcatccacattcaaccactttcttaaagtcaccatcatgatcctatcaagaaaaccgtaatttatatggtattttaatgtgcctttataaattactaatcactttcttcatgatgtatgttaaaatggcttatgtcacctgatgtaatccttaatgagggaaataaaaggccatgattatgcctggctttttttcttatatgttagatttgagtgttaaaatgacctcgaagcggcgaaagaaaggaacggaactgccctccacattaaaaatgagcaggctccataggttaattttactcttcctcacgcacggcacttacatgttgcaaactctctgctccacagcacgcacagacatcccaaatcccggattgggcctgaggaacatctctgcaaagagcgccaggagggcgtgggggtcccgcctctctcgccagggaccagggagtggacactcactggtccagtcatgaggaactcagcatcctcctgacgggaggcgcctctttcccagaagcggtgggtcaggaggaatctgactaaaccctgggttgccggcccggagggcgcggttgaccccggggcctcgaggttgtgggcgaggagtaatccgcccgccgagaccgacccgcagatccaggagaccgaaacccgagggcggcgctccagggtgctgaggagaccggaaaggcggccaggaccttccggtcgcctcggcccaccacccacccagtgtccgcgcagccctaaagcctggcagacgcggagcgcacgcggcctttgcctcggccaggacagggcagcggggagagggctgctagacaacaattcttgacccctcctcgacccacgaccgccaggtaggcgcgcaaagctcctacacctgcggcgcgcccccgtcccctggtccagcggacacgccacgcacgcagccccgcccagcgccgctcgcggtaggggcggagccgctgagctggccaaagcggatttgcccagctaggccaggggcggggcaggccctcccagccaggaccagccccagtctccccgcccctgagccgtgaaggaaatagggacctggccctgggccttgtgtagcgggagggggagctaggaagcagctgagggcagaatccaggagggcctggctgcgggggaatgaagcctccgccttcgcaggcaaaagcctttaaatacgggctcaggcccgggactcagagtgtaacgcgtggcagcctgagggaggggcgtgcgccgagagggagctcagatcgagcggggcgcgggtggagaagctgcggcagcgcggcccgtaggaaggtgctgtccgaacgatcgggataggagcggtccctgcgcttgctgctgggaagtgggtaagcgccgctcccaggctggccccgccgcccgggcgggatgctcccaggtctgggcgggatgtggagggagcggggctggggtgtgcgcgctgctcccggtcgctcgctgcgctgggtcccgggcttcccgtctcacgaccttcgtctttttggggcttagggcgggaaccgcattttggaactgctgtcctggggatgtggtcgtctgggcttcttattcaagactcgtgagtcttccagccccttctctttctgcctttacccactttcctgacttggatgagatttccctgccgcctccaaagccgaacgcccaccacaggaagcggttctctcgttggggacctcattttggccgcagagtcgtagtcttttgtttgtgtttaagagtctgctcacctgaggggctcctgcttttctcatgccgcccctcttaagaaaccaaagagaaacgaagccagaaagccctcttgagagcaaaatactaagactgccgtgatatctgtccgggatgtcctggaatccattgttggccccctacaccacagaattgctctgtttgatgtcggggaaggcctttcctgggtgcctcgggagaccatgtttgtgtgagatcttgaaaaattatacgtcctataaatatataggaagataacttagtagggttaggaattctagtatagagaaaagaggggttcgctggtagggatctattcatgggcatacagagcagtagctgtctatcgacagacctcaaagacacagtgagcctttgagtttcttcaaatcccttaagaaatggagaacagtagtctttcttcaggggggttctggaaatgaaagagctgactgtctgctctgagatgtgcttattagtggccaggatccagtttaaggtaaggggtagacaaccctgattgaaaagatctcatttcttctcccgttgctgtactcctttttctaacaaaatctataactggataagcataatccatcttccttcttgtttacttccacagctttacatgataacccttagacataaaattaataccggctttcttactgattaaatatttttctctggtcaggcatcttttactgtttaatttctggaaatgattaaaatgtgtgaagctgatgtatccaactataatgcccatcgttagctcctgggtacctatgcaaaatatgctgtagagagctggggctagaaggattatattccgtttagattgtagtagggcatttgttatttgttagtgaccccttctgggttggaatgtttatttgaatttatgaaattttacatgaagagtagttttggaacggtttggtttgttgtgactctcccaaaatacagaggtaaaaactcatttcaaaataacccatttaataaggaaacactcctatgtctctgacagcagaatagagggccagagggtacataaaagtagaaatagaaaatgggggccgggcgtggtggctcacgcctgtaatcccagcactttgggaggccgagacgggcggatcacgaggtcaggagatcgagaccatcctggctaacatggtgaaatcccgtctctactaaaaatacaaaaaaaaattagccgggcgtagtggcgggcgcctgtagtcccagctactcgggaggctgaggcaggagaatggcatgaacctgggaggcagagctttcagtgagccgagattgcgccactgcactccaacctgggcaactgagcgagactacgtctcaaaaaaaaaaaagaaaaagaaaagaaaatggggctgggcgcagtggctcacgcctgtaatcccagcactttgggaggccaaggtggatggatcacctgaggtcaggagttcgagaccagcctgaccaatatggtgaaaccccgtctctactaaatatataaaaactagctgggcgtggtggtgggcacctgtaatcccagctactcgggaggctgaggcaggagaattgcttgaacccaggagacggaggttgcagtgagccgacatggtgccactgcactccagcctcggtgacagtgagactccgtctcaaaaagaaaaaagaaatagaaaatggagttggcagacatctgtgtcatgcaaagtgtgtcactaacactatgtcaaactccatgttaaagcttattgaagattttattgaaacttccaagtgagcatttatttggacttgcacagattgtacatcagccttttcattgattctcccattgtcatcggtaagccgtatttcatgggaaatagcaaggcgagaatacccaaaataaagcttgtgtaaaacacatccagttctgtgatacaagttcacctgccatcagtagtctatcccagctgatgtatgtaaagcaagttgaaatgtggtctcacaatcaaggcagataagaagtaactctggggaaacatgctgaagttctttaggtaactcaaaaaaagaacttggccagatgcgatggctcacacctgtaatcccaacactttgggaggctgaggcaggtggatcaactgaggtcaggagcttgagaccagcctggcccacatggtgaaaacctgtctctagaaaaaatacaaacattagctggacatggtggcggacacctgtagtcccaggtacttggtacttgggaggctaggtgggagactcacttgaacctgggaggcggaggctgcggtgagcccagattgtgctgttgcactccagcctgggcaacagagtgagaccttgtgtcagaaaaaaaaaaaaaaagttgatagtattctggtcaattactgcaaaaatactatgatcggcaatctgaactaaagctatttacacagaagtcttcatctcaaaaagagacgcccttgtggagagttactcattcattcaattaataatcattgagaggctgctattctaggagtcaaggatacagcagggagcagcagcaaataactgttagcctggctgtgccttattaaactatgaactccttaagcccaggagctgcaacgagtagacactgattctacatttaataaatgtgttagcagaacctgtcctggttgagattaagagtaaaggctgccctaataaccttttggctaggagattaagtggtaaccttaaaagatcctctggtccaacattactttgagattctactctttaggtattctagatatactgggtttaattaagtgaaaaaagccaggtgttaatagtatatatggtattctattgaatttagaaagacaagattattagaatatatatgtatatttacttgtagctgggaggatatacaagaaaacggattgcttgtgtggaagcaaagtaggggatagcaaagtagataaggaaggggttggagtgagacttctcatgtgtaccttgttacaacagatttaattttgaaccatatgaacattattcagaatcaataatttttttttttttttttgagatggagtttcgtgcttgttgcccaggctggagtgcaacatggcacgatctcagctcactgcaacctccgcctcccgggttcaagcgattctcctgcctcagcctcccaagtagctgggattacagacatgtgccaccatgccccgctaattttgtatttttagtagagatggggttttgtcatgttgatcaggctggtcttgaactcctgacctcaggtgattcagcctcctcggcctcccgaagtgctgggattacaggcatgagccaccgtgcctggccagaataaataatttttaaaaatttatttcatatggctaagaatactatttgaatacagattcaaatagaatactgttctatttaattgaatcatataattcaaaattctgtccatttttactattttaccaaagttctatttcttttaattgttttttaaaagtcatgaggggcctggcacagtggctcgtgcctgtaatgctagcactttgtgaggctgaggcaggcagattgcatgagctcaggagttcgagaccagcctgggcaacatggcaaaaccctgtctctactaaaaatacaaaaattaacctggtgtggtggcatgcacctgtagtcccagctacttggcgggctgaggcacgagaatcaaacccaggaggcggaggttgtaataagtgcagctgagatggtgccactgcacttcagcctgtgtgacaaagtgagattctgtctcaaaaaaaataaataccgtggtggctcatgcctgtaatcccagcacttttggaggctgaggcgggtggatcacgaggtcaagaaatccagaccatcctgaccaacatggtgaaaccccatctctactaaaaatacaaaaattagctgggcatggtagtgtgtgcctgtagtcccagctactcgttaggctgaggcaggagaactgcttgaacccaggagacggaggttgcagtgagccgaggtcacattgtactctagcctggcgacagagcaagactctgtctcattaaaaaaaaaaaaaaaaagtcatgagggatcagactccatgagttgatatctataccactaaagatcaatgcataagccagattggtagtttattaacacaggctacaaacaatccaggatacctacatggattagtcagctcattttcttctagtagggaaatctatccagagaaccaaacgaaaatttagaatattgtttaatacagattcaaaccaaaaagaattggataatcttaattatatgatttgtcttttttcataatagggatattcttcttgccaggcattcaaattaggccagccttccagagtgcgttctctgatccatacaggagtatactaaaaaattcttaaactctctgattaccattttccttctctttggaatctgtgaatgggttagattagatgatgtctgaggtcttggcaaggcaaaaccattctttgcttttaagaatctgatcagtttgacagttctcattataacggataaatgagcatacttatgtataaatcagttccttgtcattttgattagtgtgaatcagttcacctaatgcttttgaaaatctatcaaaatctgtgtaacccacttttctgctggcattgggaaggaaaaaaatctgtgtaacagctttggtaattacagaaattacattttctttaaccaccttatggtttctgattaaagttgaaatggagtttaagattattgcctagtacctaaaagtaaactttgaaagccaaagtagtgtgtagggcatataatctcatcagaggccaattctggactgtggaactaatcttattctatatcatcgtaatctaaacctgttataaactcatctttgtacactagcatttatttaagcaagaatcgtacaagtatgttcatcctggagctttctctcagcaatcaaagttgtcctagtgtattatagacctaaggaaggttttactttgattctttactttctaaatattaggtcattataatctttgtggctccccttcagtaatatcagttactgtaattatttccatatgtttcatgctagtgcagctgagaacaggctaggtcatccaattggaatgttattttttaaatcactatttccataattcctcagagcgaatgtaggaaatctttccagatatctgtcaccttgacagtttttataaagtataattaatgtacaatattatttctttaaattttctgttttcaatactagaacagtcttactgttttccttctagtacaatcatgtttgaaattaagaagatctgttgcatcggtgcaggctatgttggaggacccacatgtagtgtcattgctcatatgtgtcctgaaatcagggtaacggttgttgatgtcaatgaatcaagaatcaatgcgtggaattctcctacacttcctatttatgaggtaaacatattaaacatctctttgtttttatgcttttttcttactgtctttattatatcatttatatgcactattaatataaaaatctataacagcaactggtaagaaattaaatgaaaaaaatctggatacaaaacacatggacattaaaacacattacttcgggtaatgtgggtaggaaaaatgaccagaaagaagtctatcagaatggtgtattagtgcagtgagattatggataattttttctctttcctgttttcttttcttttttttttttttttgagacggagtcttcctctgtcgcccaggctggagtgcaatgacgcgagctcagctcacggcaacacccacctcacgggttcaaacaattctgcctcagcctcttgagtagctgggattacaggcgcccaccaccacacccagctaatttttgtattttagtagaggtggggtttcaccatgttggccaggctggtcttgagctcctgaactcaggtgatctgcccgccccggcctcccaaagtgctgggattacaggcgtgagccactgcacctggccttcttccctgtttcctaattttgtctgttagtatcattaccatattataataaaattaaaaagtggtatcctgtaaaaataaaataaatacaacttttaataatattaatataaatttaatatatttttggattattttactaacatcacataaacattagatggacaaatggcatctttcatatttagagtttggtgccacaaatatttttaactggaatttcaaaattttgtgaatttagagaatttagaaaaatatgcttctaactattttactgagctatctggtttcctttttttttattatttcactgtaaaatgagttcatcatattatgcttttgaaactcaacagaaaagcatttgcaaatttgatggtagcattttctagctaacattaatatgtttatatttttccccaagaaaagcttggttattttttatttgttttttgagacggagtttcactcttgttgcccaagctggagtgcaatggcccgaacttagctcactgcaacacctgccttccgtgttcaagcgattctcttgcctcaatctcgttagtagctggaattataggtgcccaccaccactcccagctaatttttgtatttttagtagagacgaggtttcgccatgttggccagggtggtcttgaactcctgacctcaggggatcacccctcctcagcctcccaaagtgctgggattacaggtgtgagccaccatgcccggctgaagcttatttctttatgactattatcaaccatagactttagttgccttagacttttagaaggaaagtctcaatccagttttatctctaagataggtctgcctgctatctataggaatataagatatggaaatctatgaaaaagcatctatagactaatagtcactcaaaaacacagatttacttattatatctgaatcagatttaggattgaaatattggcggcacggtggctcacacctgtaatcctagcactttggaagaccaaggcaggcggattacctgaggtcgggagtttaagaccagcctggccaacatggtgaaagcccgtctctactaaaaatacaaaaaattagccgggtgcagtggtgcgcacctataatcccagctactcgggaggctgaggcaggagaatcgcttgtacccaggaggcagaggttgcagtgagccgagatcacgccattgtactccagcctgggctacagagcaagacttcgtctcaaaaaatatatatatatattactactatatttggtttagggtaatttttaaaaatgttttagaaagataacttgatggtgagttctataatgctgatattgataaaagggttgcaagtcatttgaaaccccataaaccatacttatatccaaacattcagtaatgaattctgccagcagtgtattctagtcttcacaaataagccaggcatggtggcatggccttgtagttctggctactcaggaggctgagacagaaggatcatttgagccaagggtttcaagtccagcctgggcaacatagtgagactcccatctccaaattaaaaaaaaaaaaatacggccaggcacagtggctcacacctgtaatccctgcactttgggaagccgaggtgagcagttcacttcaggtcatgagttcgaaaccagcctggccaacatggcaaaacctcgtctctactaaaaatacaaaaattagccaggtgtggtggctcacgcctgtaatcccagctactcaggaggctgaggcgagagaattgcttgaacctgggaggcagaggttgcagtgagctgagatcgcaccactatactccagcctggttgacagaatgaaactctgtctccaaataagtaaataaataaattagaataatgacacccatcagaatggttaaaatgatattactgacaataccaagtgtttagcaattagaattttatgcactgcttggtaagaatatcaattggtacagtcacttggcagacgtgtttgatagtatctactaaagctgaaaatataggccaggcacagtggctcatgcttgtaatcccaacagtttgggaggccgggcgagaggattgcttgagcccaggagttcaagcccagcctgggcaacattgcaagacccctgttccttttcttttttttttttttttttaaaggccaaccgcggtggctcacacctgtaatcccagcacttttggaggccgactccatcctggtcaatatagtgaaactttgtctctaaaaaatatttaaaaattaactgggcattgtggcatgtgcttgtggtcccagctacttgaggagttgaggcaagagaatcacttgagcccaggaggctgaggctgcagtgagccctgttggcgccactgcactccagcctgggcaacaaagtgagaccctgtctcttgaaaaaataaaaaaaaactattagtctgtgatccagcaattccaagtgtatatccaacagagatgcatacatatgtgcactaaaagacagaaggaacaacctaaatattaatcagcaatagaatggatgcatgaggctgggtgcggtggttcacgcctgtaatcccagcactttgggaggctgaggtgggcggatcacctgaggtcaggggttctaaaccagccttgacaacgtggtgaaatcccatctctactaaaataatacaaaaattagccaggtgtagtagcacatgcctatagccccagctactcgggaggctgaggcaggagaatcacttgaacctgggtgggggaggttgcagtgagccgagtttgcaccactgcactccagcgttggtaacagagtgagactccgtcttaaaaaacaaacaaacaaacaaaaagaatggctacatgaattattttataatactgcaacaaaatactgtactgtgttgaaaatcaatgaaactactcctgcacttaagaatatggttaaaatcttacaaaagtagtgttgccagacacaaaggagtacataccgtataattccatttgcgtaagtttcaaaaataggcaaactaatctatgattatagaattcagcatgatggtaatttgggaatagtagtgactaggagagggcatacagtgggctttgacttactgttaatgttctttcttctctcattacatgaattactgagaaaatagtagattctattaatatttaacagttaaaacacttccttttgtgttgtcgtgtttattgaatagacattgctttttaaactttgttctttaaaaaatacagtttaggccgggtgtggtggctcacacctgtaatcccagcactttgggaggccaaggtgggtggatcacctgaggtcagaagttcgagaccatcctggccaacatggtgaaaccccgtctgtatttaaaaaaatacaaaaaaaaattagatgggtgtagtggctcgcgcctgtaatcccagctacttgggaggctgaggcaggagaatcgcttgaacccaggaggtggaggttgcagtgagccgagatcgcgccactgcactccagcctagcaacagagtgagactctgtctcaaaaaaaaaaaaaaaaatttagtagtaactactttaaaaaaaaatggataatttgctttgctttttttctgggtaaaatttttattttactgaggataattttaccctgtgaaaggatttgagttcttctaataaaagtaccatataaattctaaataccaattatgataattacataatgaacctaataacagatagaacctatattattaactgcttctgcatcagttttggctttaatataattatgtaagtcttcattttgaggttttattatatgtatatgaattctgcattgctctgattttagtaactttaaatattaggagattatacacaggactgaattaaattttattctctgcaaatcctgactctataaaacttttccctcattttctagaatctagccaaaataaccaaggaaacccattactgtgattggtgacatcatattcatggttgtagtggttcatatatcttgcttgtcctgttattttaatcaaactaatggaaattcatatgtacatttttcacatcctccaattacttatgttaagagacctcggaaccattgaagaaaagggagttgcctctatatgtaatgccagacctatggcccctgaagggctttcactttgctatagacatagttttctaaacatccataatattatggatggatattgtttgaagtttctcccctaagagtgagcttcagtggtttaggtatgttttctttttgctttttgttgtggaagatttcaagcatgtaattaaagataacagtacaatgaatctccgtgtgcccatcatcttgtttcaacagttatctacgtggccagtcctccttcccaactaccaccatgctgattatttataatttcatccataaatactttatcatgtatctctaaaagataattttgtttttctttgagacagggccttgctctgtggcccaggctggagtgcagtggcccgatcttggctcactgcaacctccgcctcctgggctcaggtgatcctcccacctcagcctcctgaatagttgggactacaggcaagcgccaccatgcccagctattttttaaaatttttttagtagaaatggggtttcgccatgttgcccaggctggtagcccacaatagttgtgcttcaaccagtatctattggttgaagaaaccagtttgtttattggctagaaattatcacagtctaggccaggcacagtggctcatgcctgtaatcccagcactttcggaggctgaggcgggtggatcgcttaaggccaggagttcgagaccagcctggccaacatggaaaaaccccgtctctaccaaaaatacaaaaattagccaggtatggtggtgtgcgcctgtaatcccagctgcttgggagtttgcggcacgagaatcacttgaacctggtaggtggatgttgcagtgagacgagatggtgccactgcactccagccagggtgacagagcaagactgtctcaaaaaaaagaaatttttcagtctagattttgctggttcagttccttggagtttttcaacttattctttatttaatgtaaattggtagttagatctaaaggtacaggtccaatcagatttaggcttgattttttttttataagaatatttgttaagtggttttatacccctccatattcttaacataaatatatctcctgttaaactgggattttttttttaaataaaagggttccttgcaataggacttagaaaaatttatatttatttaagcatatagaaaaatttatatttatttaagcatatatggagtaaattgactttcacagccagttctatggcctgaattattgggagtaaaaatgtgcattcataatgacaatgcaaaatcatatatttgcttgaaatcacagaagaccttgaattttctgaaaattgtgttgatactcatagttaatggttaactcttatgagttagtcacatggtaaacaatgacaaagcattaaatgagctgctcttctgattgtagcaagtttaatggcaatttccattttactttatttacttaagtgtacttatgaggcagggcgtggtaacttactcctataatcccagcactttaggaggaggagcagggaggattgcctgagcctgggaggtcaaggttgtagtgagctgttacgcaactgcactccagcctggggaacagagcgaaaccctgtatgaaaaaataaaataggccaggtgtggtggcttgtgcgtgtaatcccagaactttgggaggccaaggcaggtggattacctgaggtcaggagttcaagaccatcctagccaacatggtgaaaccccatctctactaaaaatacaaaattagcccagtgtggtggtgcatgcctgtaatcccagctacttgggaggctgaggcaggagaactgcttgaacccaggagacggaagtcgcagtgagccgagatcataccactgcactccagcctgggtgacagaaagaggctctgtctcaaaaaaaaataaaataaaataaaataaatgggctgggcatggtggctcactcctataatcccagcactttgggaagctgagatgggaggattgtttgagcccaggaatgtgagaccagcctggacaacccagtgaaaccccaaaaccccatctctgccgaaaaaagatacaaaaattagccaggcctcatggctcctgtggtcctagctacttgggaggctgagatgggaggatcatttgagcccaggaggcggaggctgcagtgagctgagattgcaccactgcactccagcctgggtgacagagtgagaccctgtccctatttaaaaaatgagatgtgcacttatggcctttggtatatgatccttaacttgtctacaaaggtaatttgagcacaacctagacctttaaattacaatattaccatgccctttaacaaatgtaattctatactattaggttatctcatatcactggcaagctatatgtacaattccttttcttttttctttttagccaggactaaaagaagtggtagaatcctgtcgaggaaaaaatctttttttttctaccaatattgatgatgccatcaaagaagctgatcttgtatttatttctgtaagtattttcctttgttgtgtgaattttaatgtattcttgtctatataaaagtttcatcatactttaatagtaaatccattggtattaagcctcaacattgcttagtatagagttgtccggtgaattttggttgtcactttgtctgacagttcacaaaaccccgtaatcatctagtcaaatatgtcattacaagtcattgaacaagtaaactcaaagttctaatttgagatttagaactaggaaatgggcgggtgcggtggctcacgcctgtaatcccagcattgtgggaggccaaggtgggcagatcacaaggtcaagagattgagaccatcctggccaacatggtgaaaccccgtctctactaagaatacaaaaattagctgggcgtggtggtgtgcacccgcagtcccagctactcaagaggctgaggcaggagaatcgcttgaaccaaggaggcagaggttgcagtgagccgagatcgcgccactgcactccagcctggtgatagagtgagactctgtctcaaaaaaaaaaaaaaaaaaaaaaagaactaggaaatgctggtaacatgagagcacatgtgatgatagtatatttcatatttatttcattatttcttgtttccagtggttggcagaggtgagatgaagaaaatcagtttgcaaacttacaggcatctcctctctaaatgaattttacattaattgtttgtaacttggcatatgttggttagattatcaggctaaccaacagacacctttacctcataatgtggctgaactgtcctacctttataatgaaaaaaacagaaccaacacttgagattaaactctagtaaaccactatttgaaccaaagcaacttacatcttgctgtcctagtaaccatctactcaaatattctgtatgtaatgatatagctatcaccagttggaagctgagtgagggtgttatatgacttaagatctttacgagctgggcatgatggctcatgcttgtaatcccagcactttgggaggccaaggcaggcggatcgcttgagcataggaatttgagaccagcgtgggcaacatggtgaaaccctgtctctacttagctggccgtggtgctgtatgtctgtagtcctgactacttgggagactgaggtgggaggattgattgaaccctggaggttgaggctgcaatgagccattattgtaccttgcactccagcctaggtgacagaaggagaccctgtctcaaaaaaaaaaaaaaaaaaaaattcagtctcttctttttgacctccttaatcacttcagagaaattgatgcagcttttatgacttacctacccatcccctatttaaacttgcagaaagttagagtggaggcataaaaaaataagaaaatattttggagtagctaggtacctggaaaaaatcaatgagttacttagtctaatttttaggtgaccagagcctagaatggtaatagaataattttctgcagaaaggacatttaaaaataatctgtttttgaatgccagacaggaattattttgtagcaatcagttttcaactgttgttttcaaagctcctttaccaggggaagctgtctgatcatctcccatctctagccagtttcaccctacatcatgagctgtctttgcctttccgtacaccattacatgtaactcttgccctaagttgttccatgcatgtaaacaactttttcctcctgcttttcacacctcaactcaatcttcaagttttgatttattttcacttgattcctttatttagtctcccattgggttataatctcatcaagagaagagagttagtactacttactattagttcaaaaataattcctattccctttaagttttagacttttcagagcactttcatttttgtcagagcattataacattcatgtgttagtttttagagagctcactatcctcattttccaatgaggtcactgaggcagaggcagccacacttctccaaggttacatgtaatccaaaactaaatgcctagactctgggcccatgatttttttttttttttttctaaatgaaagtcttcgcccattggccaggtgcagtggctcatgcctgtaatcctagtactttgggaggctgaggcaggcagatcacttgaggtcaggagtttgagaccaccctggccaacatggtgaaaccccgtctaaaaatacaaaaattaggcgggtgtggtggcgcacttgtaatcccagctactcaggaggctgaggcaggagaatcgcttgaacccaggaagcagagattgcagtgatccgagatcgcgccactgcactccagcctgggtgacagagcaaggctccatcttaaaaaaaaaaaaaaaaagcaagtctttgtccacatagtattctatatcctgaagatgataggtaatgtctagctttaatgaactcagaaagcatttgtaaatgatattgcaatattttaaaagactgttgatataggactgtaaaaataggggaataagaaaggaggccaggtgcggtggctcacgcctgtaatcccagcactttgggatgctgaggtggacagatcacctgaggtcaggagttcgagaccagcctggacaacatgatgaaaccctgtctctactaaaaatataaaaaaagtggtggggtgtggtggcgcatgcctgtagtcccagttacttgggaggctgaggcaggagaatcgcttgaacctgggaggcagaggttgcagtgagccgagattacactactgcactctagcctgggcaaagaacaagactccatctcaaaaaaaaaaaaaagactttaaaacttatttttaaggactataataatatattatgtacaataaagaaagggaataagaaaaggcttacatttcatttcagattgtgaagtcctttaggataaccgtctcattcatttatgtatcttcagggcttagctggaatctgcctgccctagttatccggcatatagatagtagcttcctaacaaaaatttattgaatgagttctctagatgcttcaagctatttcttctgattattatatttataaaatgtattatttctatggaactaacagaggattaaatcagggctactgatgattgttaactccacactttaaccagtagttcagggtatatcttgaaatccctatctcacaggcactctgttctttatcccatatacttacatcaggtgaatactccaacaaaaacctatggaatggggaaaggccgggcagcagatctgaagtatattgaagcttgtgctagacgcattgtgcaaaactcaaatgggtacaaaattgtgactgagaaaagcacagttccagtgcgggcagcagaaagtatccgtcgcatatttgatgcaaacacaaaacccaacttgaatttacaggtataaaaaatgaagcattagaatctggttattcttatgtaaatactgatgtgttaaagttgcccataattaattctagcttaaaactttcctttgcattgggattctaggtgctgtccaaccctgagtttctggcagagggaacagccatcaaggacctaaagaacccagacagagtactgattggaggggatgaaactccagagggccagagagctgtgcaggccctgtgtgctgtatatgagcactgggttcccagagaaaagatcctcaccactaatacttggtcttcagagctttccaaactggttagtatatagcattcaactcttcattaaattaaagccaaatatttatttatttcaagcctgataaactacacagatacttttttaatagtagtaagaggttatgcttttgaagatcatattcttgcacattcaaattatgaaataattttcacaagggagatcatatatgagggtataaaagattctgaaaaattctgaaatcttaaaatagtaatttggtttttatcactctttccctctttaccctttttcttaatcatctgtcctctctaatttaaaacattttccctttctaacccatccattgtctcctcaaattgagctcatcagtatcttatatatctccctcagtaatttgcgtcaacgcaatgaaatataaactagatgtataaaattgctgttttagcttatcttactcttctctatgttttttttttttaaggcagcaaatgcttttcttgcccagagaataagcagcattaactccataagtgctctgtgtgaagcaacaggagctgatgtagaagaggtagcaacagcgattggaatggaccagagaattggaaacaagtttctaaaagccagtgttggtaaattcaaatttttctctagtagaaagagctagtgtttatttactgaaggcatattatttgctggtaccagcgctttatatatctcattgaatccttataacctgttaggtagatgctgttattttcttttttagagatgattcagactcagggaaatttgtgcaacttgctcaaagtcatgcagctgagtgactagatgtttctaacgccaaagccatattattccttactgcatactgcattgcactagagcaagggtgggcaaactatggcctttgggtcaaatccagcccacaacttgtttttgtaaataaattttattggaacacagccatgaccattagactacatattgtctatggctgcttttgagctacagtggcagtttaatagtctcctcagaaactgaatggtccacaaaggctgaaatacttactgtctggccctttaccatgaaagtttgctgacccaggccaggcacagtagctcatgcctataatcccagcactttgggagtctgaggccaaggcgggcaaattgcttgagcccaggagtttgagaccagcctgggcagcatggtgaagccccagctctgcaaaaaaaaaagacaaaaaattagtcaggcatgatggtgcacacctgtagctccagctacctgggaggctaaggtaggaggatcacctgagcccaggaggtcaaggctgcagtgagccatgttcatacccctacacttcagcctgggcgacagagggagactctgtctcaaaaagagaaaaagtttgctgaccctgtgctaaagaatgtggggcagtcatactagatgaatgagaaaaaaaaggagataaaaggaaacaatataaaaagttaaacgtagccataatgaaattttagttagaaaattatttggaagttacttgtggagttgtttagttgcctgcaaattttacataatttataagcccattatttatccatctgaattttattattaaaaaatcttagtataagctttctgatttagtataaagaaatttgtcacatgattgagttttctcgttcttacatgaaaatattgttcatttttttctttctgcagggtttggtgggagctgtttccaaaaggatgttctgaatttggtttatctctgtgaggctctgaatttgccagaagtagctcgttattggcagcaggtattaatctctataggtaataatttctgtttagccaggcatagtggttcacacctgtaatcgcagcactttaggaagccaaggcaagagcatcacttgaggccaggaatttgggactggcctgggcaacatagtgagaccccatctctacaaaaattttaaaaattagccaggcatggtgttgcacacctgtagtcctagctacttgggaggctgaggtgggaggatcacttgagcctaggagttggaggctccagtgactgacttatgatcgctccactgcactgtagcctggacaacagagtgagaccctgtctctgacataataatagtaacagcaataataatagcagtttctgtttagcttctcattaagcatgtcactttttgtccatgaaatgtttttgatggaatttatttattccaggaagtcaaaaattagtatattcaatttgcttattttatgtttatttattgggtatctgtgtttttaatttatctttcctgctaatcaatgttgatggaagtttgtgataagccagtattctaatttgctcccagagtaaaacaaaaacaattatccttaattataactcttctctcttttttttttttttttttttgagacaagatctcactttgtcacccaggctagaatgcagtggtgccatcgctgctcactgcagtgacctcctgtgctcaagcaatcctcccacttcaacctcaacttcaggaacgcaccaccacattggctaatttttttatttaaaaaattttttttgtagagacaaggtctcactatattgcccaggctggtctgaaactcctgggctcagcagtcctcccatctttgcctcccaaagtgctgggaatataagtgttagccagtgaacctagcctaattcttctctatcttgaaaggcataaaatcaaaataaaataagaacctatattataacgttggtcgggcatggtggttcacacctgtaatccctgtacttcgggagcctgaggtggacagatcacttgagggttgggagttcgagactggcctggcgaggctgaggcatgagaattgcttgaacccaggaggcggaggttgtagtgagccaggattgtgtcactgcactccagcctagatgacagagcgagacttcgtctccaaaaaacagaacctatattgtcatgctttcaagtggttttgtatctgctgatatttgttttggacctttcagactcacagagctaaaattagaaaccccttccaaattggaagcattaagtgagctctgggaagtagagttgatgtttattgaatgcttaccctgtactgggtactcttttgggcactttgcatacagtatctcatttaatcctcatcactaacattatcctctttatttgatgagggaactgacatggagatattaagtaatttgccccaattactagtcggtatatgtgcctttcccaaatattttccccgagtttataatttttcaggtttcagcagtagatatgggagggaatctaaagaaatgcacgtttctttttttaaaatgttttactttttagagacagggtctcactgtgttgtccagcctagattccaactcttgggctcaagtgatccttccacctgagcctcctgagtagctgggactacaggtgcaccaccctgcctagccggaaatgcacattttaaagtgaaaacagatacaattagtgtcattccagtcaatccatcatgatggctttatctcactgttcattgtgtgaaaaatgcagataaactcttgattttccaacactttgggctaattgcttaagctctcagggtttgattgagatggtccctgaaagcttaaagccttaaaaaagtttcttttgctttgcccacctggttaccaacctaaatttaacagattaagtgatcagagactcttataacatttagttagttaaaaaaccttgtcaaatagttgtggtgttatggttcatccagaggcagctagaactctgcacattgtttgttgcctgtccactttccactgaaactgaatttttgtgaatagtggggcacaagcaaatgaaggaatactttggggtttcattgcttgtagcttgtttccacagaatttggagacacggactaaggatagtatggtttcctatgtgccttatttaggttggtctcatagctgaacctcaaatgcgcttagaattaaaacttggttgtgcgctccacttttggcatccatcctagccttatgcatagaaaatcaagccaaatgaaattagaaatttttagaatggctttttttttttttttaaatttacggcagggtctggctctgtcgcccaggctggagtgcagtggcatgatctcggctcactgccacctctgcctcctgtgctcaagccatcccacctcagcctcccaagtagctgggactacaggcacatgccaccttgcctggctaatttttgtattttttgtagagacagggtctcgccgtggtgcccaggctggtcttgaactcctgagctcaagcaatcgcccacctcggcctcccaaagtgctgggattacaggtatgagctaccactgctggcctaggatggctttaaggaaggggatgagtgatttttttttttttttaatccataggcactagagtttggttaatttttgcctcttgttaatatgtaagcattgtatttgtacaatagcactcaccataaaattctgagtaatgtgtgtcataggctgtgcctcttttaactaatcattgcacaattgtacatgtaatttcaggtcatagacatgaatgactaccagaggaggaggtttgcttcccggatcatagatagtctgtttaatacagtaactgataagaagatagctattttgggatttgcattcaaaaaggacactggtgatacaaggtatcagtttttaaaaatatttcaacccttttgagattgtgttaactcctcatcttaattttttgattggggtaggtgtacataaaatacatgtatatatataaaatataaagaataaaaataaatatccatatcttcaccactctaccagcttcagaaatataattttacctgtatcttaaactccctggtattagaatataatgccacataaagcttaccaatactgattttttttttcctatagagaatcttctagtatatatattagcaaatatttgatggatgaaggtgcacatctacatatatatgatccaaaagtacctagggaacaaatagttgtggatctttctcatccaggtgtttcagaggatgaccaaggtaaggctttgagtctcatgaatcattttgagtccagacctgaaaactttttatcttttggaaaccttaggttgttcagttttatcatgtatatcattggtaggccctcttttcaacctcatttctctgaaattaaagtcttaggcataatgtcatcaacattgatttgaagtgatcagctgtggattggtccattgatttttccaacatactccacaaatccccaaaattccaaagagatgcttccaaagcagggtttggggcctcccaccatcactcccattgatactgcaatcagattattcccaactcttcctgcagtcctagtgttagaatacctatagtactatccccttatgtgtggttttgctttccacgggttcagttatctgcggtcacttgcagtctgaaagtactagaaggaaaattccagaaataaacaattcataagttttaaattgtgtgctgcttcatcctgcctgggacatttatcattcctttgtccagcatatccacattccatatgctacttagtcacttagtaacttttggcaatcagattcaaaaaacaggtatgtgtgtaagtatatatagggttcagtactctccacagtttcagacatctactgggggtcttggaatgtatccctgcagataaggggggaactactgtaatgtcatataactcctttcttatttctgtttttttgttgttgctattgttacagtgtcccggctcgtgaccatttccaaggatccatatgaagcatgtgatggtgcccatgctgttgttatttgcactgagtgggacatgtttaaggtaaggtaacagaaaagatactaaggaaaattctagaggtgttccactatcagctggggttgagtatgtgttcatgtatgtgtttttttgtttttttgtttttttttttgagatggagtctcgctctgtcgccctggctggagtgcagtggcgcaatctcggctcactgcaagctctgcctcctgggttcacgccattctcctgcctcagcttcctgagtagctgggactacaagctcctgccaccacgcccaactaattttttgtatttttagtagagacggggtttcaccatgttggccaggatggtctcgatctcctgacctcgtgatccacccatcttggcctcccaaagtgctgggattacaggcatgagccactccgcccggcccacgtatgtgttttaattgttcctgtggtttgtctttacaggaattggattatgaacgcattcataaaaaaatgctaaagccagcctttatcttcgatggacggcgtgtcctggatgggctccacaatgaactacaaaccattggcttccaggtaatcatgatcctggattgttttttttctttttgtttggtctttagtgtttgattcaacaactggggactataatctagtcaagttgacatcaaaagaccatcacagcaggtcagaatatgtttggctaattaagatgataccttctttctagggaagttcttttggggaaccaaatcaatatcagaagtttatttcaacaattaggaaagtgctcatttgctttttaaacccattgtgtgggttttagaattttcttattttctttagcagtaacgtaactctggggcaacatgtcagttctttaggaagtccctatgggatttttctgactactctacttctctacttcctccctaaatttgcgatctaaaggtagagaaagaaagaggtcttggtcaatcagcaggtgttcatcctataccttctgagtactcagcactgtgccagtgctgtgaggggtctgaatgaaacatatgggagtttcaatggtactggccctcttctgattcaaagtttgtcaactggccaggcatagtggttcacacctgtaatcccagcactttgggaggctgtggaggtagaccacttaaggccaggagttcgagaccagcctagccaacatggtgaaaccccgtgtctattaacaaatacaaaaattgctgggcgcggtggctcacgcctataatcccagcactttgggaggctgaggcgggcggatcacaaggtcaggagttcgagaccagcctggacaatactgtaaaaccccatctctactaaaaatacaaaaattagctgggtgtggtggcacacacctgtaatcccagctactttggaggctgaggcaggagaatcgcttaaacctgggaggcggaggttgcagtgagccaagatcacaccactgcactccagcctgggtgacagagcaagactccgttttgggaaaaaaaaataataaaaattagtcaggcttggtggcctgtgcctgtaatcccagccacatgggaggctgacgtgggaggattgcttgagcccagcaggcagaggttgtaatgagctgagatcatgccattgcatgccagcctgggtgacagagcaagaccctgcctcaaaaaacaaaaaacagtttgtcaattatggaacatttggaaagctgacagaagcctccacccagaacagtgtttttgtatgttacatctatttcagttctccaaggagtcccaaaggtattaataaggagctattttccatttcctcagagcagtatgtatatggggataggaggatggggaggtggagtaagttagggagaataaaaaaatatgccagggggttgttgtcaatgtagtgcccaagcaagcagaaaagcagcagtgtttgacagcttgctatgcacatctcagcaccagctatcttggagaggtatcagtaaggcctaatctgctattcaaaaatatctgatctggttctcttaacctctcaccaacttgttgaaggtccttatttagaattcagtgcccatttctcattcatgagagatttacttgtggaaagaatcaaatggcatccttgtctgtgaactcttccatccaagaccttggggactcttctattccacccctccctagtgagtaacaacatgactgtttttcccagtcatgactaaactcaggaatgttatttttaaaaggttatttgcaaggcatagacacattttctctcattcctgttttactcatctaagggaaaagatatgtagagaaatacatattttaaatgattttaagttattgtaaaagttaactttcctagtgagaaattaaaaaaaaacaggaatggaatcactaaataaggagaatttgtaagtcactgagacaactggttaatataaagcagaagccctttctttgtggtacgagtcagaattaaatattagtttttaattcaaaagacatgaaaagtgagtagtatgtttatctctgctgtggaggggagataaattcatgactgttgaagtagtagtgtttttaatgataagatgatgattttgaatatatggaataaatgaaaaatgtaataggcaaaaccaaaattgattatcatttagtgaaggctggcttgctgtatgctaagcactttacctaatttaatacttaccacgaccctttgagttaagtggtggtaacacaatttacaagtgaggaagaaagacctagagagtttaggtaatgcagcaagtgccagtcaggattccagctggggcctttcagactctgaagtctgaattcttaagaattatgctggccgggtgcggtggctcacgcctgtaatcccagcactttgggaggccgaggcgggcggatcatgaggtcaggagatcgagaccatcctggctaacacggtgaaaccccatctctactaaaaatacaaaaaaattgccgggcgtggtggcaggcacctgtggtcccagctgctcgggaggctgaggcaggagaatggtgtgaaccgggaggcagagcttgcagtgagccgagatcacgccactgcactccagcctgggcaacagagcgagactccatctcaaaaaaaaaaaaaaatttatgctgttggcagggcacagtggctcacgcctgtaataccagcactttgggaggccaaggcggatggatcacgaagtcaggagttcgagaccagcttggccaacatagtgaaaccccgtctctactaaaaatacaaaaacattagcctggtgtggtggcgggcgcttgtaatcctagctacttgggaggctgaggcgaggagaatcgcttgaacctgcgaggcagaggttgcagtgagccaagatcgtgccactgcactgcagcccaggcaacagggcaagactccatctcaaaaaaaaaaaaagaattatgctgttaccattcgggcacagtggctcacgccggtaatcccagcactctgggaggccgaggcaggcagatcacttgaggtcaggagttcgagaccagcctggccagcatgtaaaacctcatctctactaaaaatacaaaaattagccaggtgtggtggtgcacgtctgtaatcccagctactcagaaggcagacaggagaattgcttgaacctaggagacggaggttgcagtgagccaagatcaggccactgcactccagcctaggcgatagagcaagactccatctcaagaaaaaaaaaaaaaaaaaagagaattatgctgttagcttttgcaggttttttagtacaagggaaattgaaatgagaatggagtttgaaataaaatatgaactcactggaaactggtaggttaatttcatacatgtttctaaagacagtggtggcacataattgactactttgagggagtcaggtgtggggaatggcaggagtgagaaagtctagatatgaatattacgatggagtatagattaattctaggaacaaaaaatagggaagaaaccaaagatctctcatagcaactcagacaacttgagaatccttttctaagaaaaaaatctagattccccctgctcccatttcagtacattataaattcttacacttatataattgttaatagttctcttaaattttatttttttttcagattgaaacaattggcaaaaaggtgtcttcaaagagaattccatatgctccttctggtgaaattccgaagtttagtcttcaagatccacctaacaagaaacctaaagtgtagagattgccatttttatttgtgattttttttttttttttttggtacttcaggatagcaaatatctatctgctattaaatggtaaatgaaccaagtgtttttttttgttttttttttgagacagagtctcactgttgcccaggctggagtgcagtggtgcaatctcggctcactgcaagctctgcttcccaggttcacgccattctcctggctcagcctcccaagtagctgggactacaggcacccgccacagtgcctggctaattttttgtatttttagtagagacagggtttcaccatgtgagccaggatggtctcaatctcctgaccttgtgaaccacccgtctcggcctcccaaagtgctgggattacaggtgtgagccaccacgcctggcccatgaaccaagtgtttttaaggaaacaaaactatttttttaatcatcagatttatactagctatatggatattagcatatctggtaattatgaatctagaatttttttacatatttttataatactgttagctcagttattggatgagtgaaagataatcatgttggttttaatagtgtcaatttttgtaaaataaaaattaaacttcaaactctttactttataaattgtccataggccacactttaatatcacattataaagggaaggacagtcttcattcctcctggttattggtttgtttgtcattaaagatatattttgaatccatgaaattgctatgctaaacagcctttacatgtatggtctggttaaagttcctttgttccttttgttttaataaaatgtgtcactgattttttagctcaaaatcatcactgttaatttccagtcaccccaaatatggttaaaagattttttttttaatcatgaagagaaaattagtagcatttctttctctccccattatttattggttttcctcactaatcttttttttttagtccaaaagccaaaaatatttatcttggttttacattttaatttccattcttaattgtaatttttttctttaaataaggaaaccaatataatctcatgtataaaaacttaaatattttacaagttacatatagcatcattctaaaataagaattttttttgttttctgtctgcttttttcttatgtctcttgttgagttttatattttcagtggttatttttgcttgtgttagatcattattaaaatatatccaatgtccctttgatacttgtgctctgctgagaatgtacagtttgcattaaacatcccaggtctcatccttcaggaattttgcagttcaatgagaagagggagacaaatataaagatgaggacagaagcatctctacagatgaaaattacataaataaaacattctccatcaacaactatatgggtgtaatttttgtcaattcacaagtaactgagtcatgacagcctgacattagatgggaaaaaaatgacacctcactttttagagaaaatggtatatcattctctcaaatgatgcaacaaagggagggaatttagcaaataaacattggcaaactgtagcccctgggtcaaatctggccagccatgagtgagctaagaatggttgttacatttttacatggtcatatgttaaatggtttgaccaggcatggtggctcatgcatgtaatcccaccactttgggaggccaaagagggaggatcacttaaggccagtttgagaccagcctgggcaacttactgcctaggcaataagtaagaccccatttctacaaacaaacaaagcacaaacattttaaatggttatacaaatccctacataatatcctcaactttacctcttggctggcaaagcctaaaatatttcctacctggtcctttaagaaagtctgcatacctctgaaagagacaaatgctagagttcgaacataaggtgagcctttactcataagactttgaagtgaggatgagtttattaattagaatttgctttacatttctgcttgaaaatattattgtattctgcttagtaattttatattctagtaaaggcattgtaagtccaaagatgtatgaagatgtatgctaaagcagatagaattaggcacttgtcctgtccaaatgaggaatttttaaatttttaaatggtttttttttctatttttagacatctaatgctatagattcaaactttttctactcttgtctagatatgccaaatgctggcaaaaaattgcttttgttgttgttgttgttctttttttttgagacagagtcttgttttattggccaggctggagtgcagtggcacgatctcggctcactgcaacctctgcctcctggggttcaagccactgtgcccagcctaagaattgctatttggatgttgccgaatttgtaaaaacacagcaataagcaaaatccttttgaacaaagaagtcctgagttcatctcattggtggactgaagcaattctgtagcaaataaatcctttgaaagagctccaaaaagaagaaaaaaagaaataggtacttgtgccgggtgcagtggctcatgcttgtactttgggaggctgaggtgggggatcacctgaggttaggagttcgagaccagcctggccaacatggtgaaaccccgtctctactaaaaatacaaaaaaactagccaggcgtagtggcacgcgcctgtaatcccagctactcaggaggctgaggcaggagaatcacttgaacctgggagcagaggttgcagtgagccaagatggcgccattgcactccagcctgggcaacaagagcgaaactgtctcagaaaaaaaagaaaagaaaagaaaagaaagaaataggtacttgttttaaattgcaagatgtttcaatgcctggaactgataagtaaacaattattgtaagatataattactggccgggtgtggtggctcatgcctgtaatcccggcactttgagaggtcaaggtgggtggatgcttgagctcaggagttcaagaccagcctgggcaacatggcgaaacctcgtctctaaaaaaatacaaaaaattagccatgagtggtggtgcatgccagtagtccaagctaactgggaggctgaggtgggaagatcacttgagcccaggatgtcaaggctgcagtgagccgagattgtaccactgcactctagtctggatgacagagtgagaccctgtctcaaaaaaaaagaaaaaagttactggtaaatggaggaaaatgggcaaaagagggctcatagagccagataaacttgctgtttgaaatgggaggaaaaactcagtaattaggcatgtaacttaacagcaatttgagactttcatgtgaaaagttgaaagaaggtggttagtctttttttctctcctcaaccagttaaaga

SEQ ID NO: 16243 - DNA, 45427 bp, Human
caaaaattagccaggcgtggtggcgggtgcctgtaatcccagctactcgggaggctgaggcaggagaatcacctgaacccgggaggtggaggttgcagtgagccgagattacactactgcactccagcctggacaacagagcaagactctgtctcaaaaacaagaaaaaaaaaatttcatcaggagacacctgcaggggagaaggggaaacagggcagggctggctggtgaggaggctgagcgaggggcacctcaggtaaaatctgcagagggaggcctcatcctgggcctgcacaggagcccagggggatgttaggctctgggttgttcagtgcccagcgagggacacaggtttccatatctctcactggtgagtggcagctgaggccctcctgggatgtgaacttccaggcactttcaggtcctgtgggcatgctctgaagagtcccgagtgtggtcacgggggcaaaaagaatgccgggaagtgcagtaggcagcagtgtccactaccggtgggtttgggagggaaagatgagaagagttcactgggggccaggcacagtggctcatgcctataatcccagcactttgggaggctgaggcaggaggatcacttgagaccaagagttcaggaccagcctgggccacatagcaagaccttgtctctattttaaaaaatgagccgggcgcggtggctcatgcctgtaatcccagcactttggagcccgaggcaggcggatcacgaggtcaggagatcgagaccatcctggtaacacagtgaaaccccgtctctactaaaaaatacaaaaagttagccgggcgtggtggcgggtgcctgtagtcccagctacgcgggaggctgagccgggagaatgacgtgaacccaggaggtggagcttgcagtgagccaagattgccccactacactccagcctgggcgacagagtgagactccatctcaaaataataataaataaataaataaataaatgaaaaaactagccaggcatggtggtttgcacctgtagttctagctcctcgggaggctgaggcgtgatgatgccttgaggctgggagtttcgagggtgcagtgagctgtgatcacaccactgcactccagcctgggcaacagagcgagaccctgtctctaaaaaaaaagttcaatcaagctggccaggcgcggtggctcaagcctgtaatcccagcactttgggaggccatggtgagcggatcacgaggtcaggagatcgagaccatcctgaccaacatggtgaaaccctgtctccactaaaaatacaaaaattagctgggcgtggtggtgcatgcctgtaatcccagctactcaggaggctgaggcaggagaatcacttgaaccagggagtcggaggttgtggtgagccgagattgcaccactgcactccagcctgatgacagagcaagactctgtctcaaaaaaaaaaaaaagaagtttactcgttatgaactcatcactcattatgtcctctcattaatgtcctctttttttttttttgagatggagttttgctcttgttgcccaggctggagtgcaatggcatgacgtcagctcactgcaacctccacctcccagattcaagtgatttctcctgcctcagcctccagaatagctgggactacaggcgcccgccatcatgcctggctaatttttgtatttttagtagagatgggttttaccatgatggcctggctggtcttgaattcctgacctcaggtgatctgcccacctcagcctccaaagtgctaggattacaggcgtgagccaccgcacccggtctcattaatgtcctcttgagtgagccctgctgtgaccacttcctccagcctgtcatgggccaggagtgacctagctgcggagggacacgccagatgccccctttgctctggctgggctcaacacttgagcaatgaggaggctgacgctttgtctccccacacccgccccatccctaccacctgtatctagtcacggacaagttcactgagagcgtctacgtcctggccaacgagccatccgtggccctgtaccggctgcaggagcatgtgcgtcgctccctccccgagctggcccagcacaaggtgagctggggcctgctgggaggagcaggggctgtcagggcaggagtcaaggctgggacaccagcaaggaggcatgtggtggcaaagccaggtcagaggcgtggtggacagatctgggatagattttgaaggagatggcaagatgtgtgtattagttcattctcatgctgctatcaggacatagccaagactgggtaatttataaagaggtttaattgactcacagttcaacagggctggggaggcctcaggaaacttagaatcatggcagaaggggaagcaaacatgtacttcctcacatggcagcaagaaggagaagtatgagtgcccagtgaagggggaggccccttattaaaaccacaagatctcgtgagaactcacttatcaggagaacaggatgaggggaaccacctctatgattcagttgtctccacctggtccctctcacaacacatggggattatgggaactacaattcaaggtgagatttgggtggggacacagtcaaactatactattctgttacagttatgacctgcatggcaaggaggcagccgtctgactatctaagggaaggatgtgccaggcagggggaacagcctgtgcaaaggccctgaggcatggtggccaggtgttcacagaaagcccagacctgtgagggaagggagttgcaggaggaaaggtctctgcttccaccatgaggactcaggagagccccaaccaagagagctgggaggaaggccctctaggtgggggtggcctcccttgccaaatatctcctgcgccccctacaggcagacatgcagcgttgggaggagcagagccagggagccatctacactgtggagtacgcctgcaggtgagcgccacagcctccccgctgcagggccaccttttgctgctctggcctcctgggcattcaggggcatcccagccaactgcccagtaagccccaccctgccaggcctacccgagtgggtgtatggggtctgtaccacgattcacttggccagggccccaggtgggtctcttccctgtgctgagcccctccccagctgccacaggaaagagggatagggattctggaagatgcctctggggaccagcatttctctcccacagccaggacagatgggccagtggggtggatggcagccagggggaagcccaaagcacagatatggctgtttatttttaaattttttttgagacagaatcttactctgtcacccaggctggagtgcagtggcatgatctcagttcactgcaacgtccgcctctcaagtccaagcagttctcctgcttcagcctcccgagtagctgggactacaggcgcccgccaccttgcccggctaatttttgtatttttagcagagatggggtttcgccatgttggccaggctggtctcaaacttctgacctcaggtgatctacccacctcagcctcccaaagtgctcagattacagatgcgagccaccacgcccggccggtgtttctttttgttactgaccccttgcctcctgtgctttggttccattcctcgtgactgtattcccaagccttattccggttgcctcgggttgcccagttggccttggaagttcctcgactttgcacagacatgctgtttgcacctgacatgggctgtgggccattttattggcggctgaatgatgctcccagcagttcccttggtgtgttgctgtttggttgtgtgggcgaaggtgcctagacaagaaatcctgctgctggggcagtattctgccattggcagccttggcccccttggtgggacaagggttgaccagacagacagtatcttccttagctcaaggaaaagaaaagaaataggagttgctagagctgggaatggttatgcacgcctatagttccagctactcaggaggctgaggtgggaggatgccttgaaaggagttcagggtcagcctgcgtgatatagccagacctctcctctaaagaaaaaagaaatacggccgggtgcaggggcttacgcctgtactcccagtgctttgggagtctgaggtgggaggatcacttcagcccaggagtttgagaccagtctgggcaacctggtgaaaccctattcctacaaaaaatacaaaaactagccgagcctggtggcacacacctctagtcccagctactcgggatgctgaggtgggaggattgcttaagcctgggaggttgaggctgcagtgagtggagattgcaccactgcactccagcctgggcaacagaacaagatcctgtctcaaaaaaacaaaaaacagaccgggcgcggtggctcacacctgtaatcccagcactttgggaggccaaggcaggcggatcatgagctcaggagatcgagaccatcctggctaacacggtgaaaccgcgtctttactaaaaatacaaaaaaattagccaggtgtggtggcacctgtagtcccagctacgtgggaggctgaggcaggagaatggcatgaacccgggaggtggagcttgcagtgagccgagatcacgccattgcactccagcctgggcgacagagcgagactccgtctcaaaaaaaaaaaaaagaaaagaaaggaaaaaaaaaaaccaacaaaaaacctatgctttcttctgcttcctctagctgtgccatctaatccaggaacctacgccatgggtggctaagcacacttcaattttaactcgttaaaatgaaactgggtgcagtgactcacgccagtaatcccagcactttgggaggccgaggtgggcagatcacttgcggcaggagttaagaccagcctggccaacatggtgcaaccctatctctactaaaaatacaaaaattagccaggtgtggtggtgggcacctgtaatcccagctacttgggaggcggaggcaggagaatcgcttgaacctgggagacggaggttgctgtgagctgagattgtgctcagtctgggcaacaaagtgagactttgtctcaaaaaaaaaaattaaaaattaaaaaaaaattacaaaatgaggctgagcgcagtggctcacgcctgtaatcccagcacttttggaggccgaggcaggaggatcccctgaggtcaggagtttgagaccagcctgaccaacatgtactaaaagtacaaaaattagccaggtgtggtggtgggcacctgtaatcccagctacttgggaggctgaggcaggagaattgcttgaacctgggaggcggaggttgcagtgagccgagatcacaccattgcactccagcctgggcaacaagagcgaaattccgtctcaaaaaaaaaaaaagaaagaaaaaaaatattcagctcccaagtcccgctagccacattccaggtgcctctcagccatctcaatggataaagaacattttcatcaccacagaagttgccccagataccactgggctaggcgggaggccagcgaacatttgtctgtagtgaaatgtatattttttttttttttttgagacggagtctcgctctgtcgcccaggctggagtgcagtggcgcgatctcagcccactgcaagctctgcctcccaggttcatgccattctcctgcctcagcctcccgagtagctgggactacaggcggccgccaccacgcccggctaatttttttgtatttttagtagagacagaggtttcaccttgttagccagcatggtcttgacctcccgacctcatgatccacccgcctcagcctcccagagtgctgggattacaggcatgatccactgcgcccatcccagatttttctttttaagagatggggtctcgctgtgttgcccaggctggtctcaacctcctgggctcaagccatcctcttgccttggcctcttgagtagctgggattataggtgtgaaccacagtgcccaggtgttttttctttcctattttttacacccccattatcagcagtaatggccgagatattttttatgacatctttatacactgatccctccttcaaaacattagatgtttcagtggcagagaatgtgctgtgttgcacagatgtcatctagtcatagcagggaaatctaaaatgtaagcccactgtgagtccttcgggaagcccgcagaatcactgaggtacccaccgagccctggtggtgacctcaagtgctggggtgtgggacagttacctgcaggtccggagcgctgaccaggcctgtcctcccgtttcagcgccgtgaagaacctggtggacagcagcgtctacttccgcagcgtggagggtctgctcaaacaggccatcagcatccgggaccatatgaatgccagtgcccagggccacaggtagctcctgggaccgcccgcccccactgccactcccagctgcaaggaccgtctctcagctgcgctgggaaccgctgcttctcgcttattagaaaactgtctctttccttttgtcctggtgtctggtgacctcctcttgtcctgtggcatctataacctgagttcagtcacttaataccgaggtcctgcgctctgctgtgtgcctggccctgggctgggcactggggacatagcagtgaccgagacagacaggctcacaaggagacatacgacaaccaggtaaacatggcagacaagagcatgtcagatgcgctgtgaagaacactgcggggcccctcctaggaggtggcatgagttacatgcagacagagacgatccgggggcagacggagttccatgtggggcagtggtgagggcagacgctctggggctgggatccctgggagtgttcgagaagcaccgagaaggcttctgtggctggagccggccagctgggggagatggggccagggagatggcaggggcctctccctgtcccaggacccagagccaagggaggctttaagcccaggaccaggggtctgaaaacgaaaagcactcacagtccttgaacattggaaagagaatttttgaagagtagcccttctttttgtttttgttggcattctaagttaataaacacgcttatgaacacacactcatgtgccgggagcaggaatgtcgccttgggatgcgtctggctcccacagattggggttctggcaggcctgtcccccactgggcaaaagaaagaaagcatctgtgttgcttaactaagacgcgaaaattgcagaaacaagacttgagtgtatgtgtaagaatgggagtgtagcaatcttccctcaaacggtagcatgaagggtttatctgggctctcttgcatctgaagaggagcggcatctggcttctctgccatgggttggcattggcagttggaactagacttcactgaaaagccatagctcttactgtcaactcagggtttccaaaaatgctttcatatgccctgtttgtgcctgctgtttcaaaaacgcaacacactcctgaaagatattagtagcagcttgagttgctgctgacacctctctttgtaagccctgtgggtttgaagtgcccagtcttgtgtgagtgagttgcagacgtggcctctggagtgccttgtcccacttttaaaaacatacatatatatttctttaaatagagatggggtcatgatacattccctgggctggtctcaaacccctgggctcaagcaattctctcgcctcagcctcccaaagtgctgggattacaggcgtgacccactgggcccagccatttgtccctttttttttttttcaagacagagcctcactttgtcgcccaggctagagtgcactggtgcgatcttagctcactccagcctccctctctgggttccaagtgattctcgtgcctcagcctctcgagtagctgggattacaggcgcctgccaccacacctggctaatttttgtatttttagtagagacggggtttcgccatgttggccaggctggtcttgaactcctgacctcaggtgatccacccacctcagcctcccaaagtgctgggattacaggcgtgagccaccgttcctggcccactcatcccacttttaagcaggatgccccagaagctcaagccagaggtctttgagaccagagtatcacccaaacatacactccagccagctgagcaagccttgtggcctctgaccttggcctcatggatgctgcacatgttttgttgcagcccggaggaaccacccccgccctcctcagcctgatcctggaagagactcggggccccccagcctccgccaacccaggtcagtgccgagggtagccacgagcctctctctctgctctgaactaaccaacccgcccgcttggcagccaggcaggcacctgcttgtctaaccacttggggtttctcactgggcttgtgggatgatttcggaggtggcaggtggaggggtgtctgcaggtccagaatgttccaccctgctgctcagggaccatgtcagcccatctctcccactctctctccaccaccttcctctctcttttccaggccataggccccatgctagtcccagagatttccaccccccaagacagagaagggagcccacatttcctctatcctaccacgtgccagcagcctgctttacccgtgcacagtctctcaggcagagcccggcatgggcaattacccacctatctctgggacctccccacccatctactgcctacctgctgtgtgaccgagcaaattcactaccctctctggtctctgcatttactttctgtaaaggtggctctcaggtgaccaagagggtgcagggcacagtgacggatgtgctttggagcagtcggctattgctgcataacacagcatcccaaaacagtggtttacagccccagtaattaacctactcatgattctgcactttgggctgggctcagctgggtggttctgctgctgtccctggggctcacccatgtggtgctcatgggagctcagctgcacctgcatagtcagggggtcccttggccaggactgttggcagcaggggtcagattttcctcatggcctctccagcaggccagcccgggtttctcctggtggctgggagccaggagagcggctcccatgcagagtgctggtttcacatttgtgggtggcccatccgttgaggccagtcacgtggccaggcccaggaccagatgggagaggaccgcacaagtgcagcgtgagctgtgggaggtgtggctgaccacgcttagagagtgtggtgccaggaaagatctgatgtgtcaccattctatatctgtgatgggcagacgcaggcaggtcaaaggggccctggggacttaccgagcccctgcctattggccaggcactgtgattgtcctcggtgccatgtgccatggaagccctctcagaggtcgaggggaggcaggtggagacagagcctctgtaggcctttcaagctgtagccccagagcccagaggcagccgaattcatgtgtgcagtcagagagcacttagtgggcactgtagtcaatcagtgagcgcttactggacaccacaggcagcaagcatttactgagtacctctggcagttgatgcatacttcctgagtacctgttcatagcaggcttagctctggatgtggggtggtgaggaatcccacaggctgagaggtggcctgggagctttccagggggcctgaagcaggaggggctgcctgagtgggtcagcagcccagcccagtgccctacgcagccctgcccacacccccaacccagcctctgtctccccagtcccatcccccacaccctggtccctcctactttgtgcctcgaggacactgccccgctgccctcctcacttcccagcgtctgctgtcccctccgctgctgctgcccggcaggattgctctgtgtctcatccacgtttgtccctgcagagttcctcgcctctccccggaaccgccagcctcatgccgcatctcagaggctttttttttctctcttttttttttttttgagatggagtctcactctgtcacccaggctagagtgcggtggtgcgatctcggttcagtgtaacctctgcctgtcaggttcaagcgattatcccgcttcagcctcccgagtaggtgggactacaggtgcctgccacctcgcccggctaatttttgtatttttagtagagttggaatttcagcatgttggtcagtcaggtctcgaactcccgacctcaggtgatctgcccgcctcggcctcccaaagtcctgggattataggcatgagccactgcgcccggcctcagaggctttcattcccacttttcccccaaaactgcgcctctttggggtcatcagtgaccttcgcagggtcaagtcatccccctctcctgtcccaggaccttaagcactgccctgttttacagaagaggaaactgaggccccgagaggtaaggcagccagctcagggtcatcgcccacgcccagaaatgccaggattcccacccggacctctgaccaccaagctccaccttagtctggcccggggtcatccctcaggtgctgcctcatgccttgggtctgtctctcagaccaccctggcccttgcccctgctccccagcctgactgaagctgggccaggcagagactgaagactgaacgagtgtggccagcattcctcctgcacctgcccggagcctccaggcccagccgtccatgttcccagaagtccagaagtggctttgctgctcctggactctcactggccccccatcgacccttggaccaataactgccatcaaaataatcctgattatgcacctatcaagtccctggccctgggctaaagtcttcacaggggtcatctcatttcatcctcagccccaaaaggcaggtctcacccccaaatacatatggacaaaaagaggctctgccgggtgtgatggcgggcacctgtaatcccagctactcaggaggttgaggcatgagaatcgcttgaacccaggaggcagaggttccagtgagccaagatggcgccactgcactccagcctgcgcgacagagcgagacttcgcacccgccgcccccccaccaaaaaaaaaaagggcacagtcagagaagagcagagcccggcttggtttggtcccagccctgcctgcctctgatgtgctgtgtgacataggcctggtgctggccctctctgggtctccctttctttcttcctttcttttcttttcttttcttttcttttcttttcttttcttttcttttcttttcttctttccttccttccttccttccttccttccttccttccttccttctttctttctttcttttgacaggatctggctgtcatccaggctggagtgcagtggcacgatctcggctcactgcaacctctgcctcctgggctcaagtgatcctcctgtctcagcctcccaagtagctgggactacaggcgcacaccactacccccagctaattttttgtattttttgtagagacggggtttcaccatgttggctaggctggtctcaaactcctgagctcgtgatcctcccgcctcagcctcccaaagtgctgggattataggtgtgagccaccgcacccagccttggttctccctttcttcatctggataaggaaggctggactgcaccttctctacaggctgagttggacattcgcagatctaccctcccaacctgcattctgcctcaagcagcaacgcccaccccaggctcaggccacatggagaagccacccctagttccagtggtggatgtggcacctcggcctggccaatcagagctcccttgtcctaggttcctagtgattggtttgagatggacacgtgacccaatgagcggcctttcctgggagttctaccaggagcatcaggaaggttgagctgggtgtatgggaaccaggccggggcgaggggttccggggggacctgagaacattgcgtggagccctggatccaactgtacctgacactagccaatttcatttcttcagtttcatggacccctaaattatgatttttgccaaaatggctttgagtccgtttctgctgctgtttgcagaagggcctgcactgaccactgtgaatgccaagcctgggtgaccaggcctccacaagttatgcatctccaaggccagctgtgtgccaatgcagttaccccagaatcccttgttccagtacaatgtattagggaggtcagataagagttgtttggggtcgaggcaggttccagtcactgctctgggagggtccctcagcttggcactgtggggtggttgatggagacggatgggaagagcaggggtgtcccgaggggagacagagggcatcctgttaggacatcgggcctgtcaaggcatctgaaggcctggaaagggggttcagccctacctctcctccttctaggtcacactggggggcctctgtgccattatcccacctctccactgtcctactcagcttaggagtggggaggagcctaaagccaccccatttagggcactgattggtgtgtggcctccagagtccttctcccttcttacctgctctgaaggcacctctcaatgtccatctgtcctccgtgcgaccatttctccagcaaacactggtatttgtgagccagccctcttgctcagaccttcaggacaaactggcagcagaatgggattatcgcctgcctcccaggacctgcctaggatgtctggggcgctaggagctaggggtgagggaggcaggtgtggggggccccaccagacccttctagggctctgagtcactcatagcccctggatgcaacctcaaccagcgactaacagtcatctctctctcttttttttttgagctggagcctcactctcgcccaggctggagtgcagtggcgcgatctcggctcacaataacctctgccgcctgggttcaagccattctcctacctcagcctccagaatagctgggattataggcacctgccactgcgcccaactaatttttgtagttttagtagagacggggtttcaccatcttggccagactggtcttgaactcctgacctcgttctcccaaagtgctgagattacaggtgtgagccaccgtgcccagcccagtcatctcttaaaaggagtctaggccgggtgcggtggcacacgcttgtaatcccagcactttgggaagtcaagactagaggaacccctgagtccaggagttggagaccagcctggcaacatggagagaccctgtctctataaaaaaacaaaatagctgagcatggtggctcacgcctgtaatcccagcactttgggaggctgaggtgggcagatcacctgaggttaggggttcaagaccagcctgaccaatatggtgaaaccctgtctctaccaaaaatataaaaaattagccgggtgtggtggtgcgcgcctctaatcccagctacttgggaagctgaggcaggagaattgcttgaacccgggaggcagaggttgcagtgagccaagatggagccactacactctagcctgggtgacagagcgagactctgtctcaaaaaataataaataaataaatagataaaagggatctgatcaagactctgggttgtcagacacctcgtcaccccgagtccaagggcttgtgggggcgctggttaatttgcatctcatttgaatgctcgatagccctttttgcctggagggcgccccgcccactctagccgccagggggcgcaagaggcaaagcgttggcgggaagttcagcctccaagcggtcattgtctgcagtcctggctggccctggtgggcacactgtgaccctccaccctttttcaccctatatgccctcgctcccatttttcagagagcaaactgaggttctgagaggccagagggctctcagaacaagagctcgcagcctcccttgtcagggtggagagcaagggcactcctagagctcactcaatagcatttactggccaggcgcgggggctcacacctgtaatcccagcgctttcggaggccgaggtgggcggatcacttgacgtcaggagttggagaccagcctggccaacatgatgaaacctcgtctctactgaaaatacaaaaattagctgggtgtggtgcatgcctgtaatccccagctactctggaggctgaggcaggagaatcgcttgagcccgggaggtggaggttgcagtgagccgagatcacgccactgcactccagcgtgggcgacagaggtagactccatttcaaaaaacacccagctgggcatggtgggtcacgcctgtaatcccagcactttgggagcccgaggcgggtggattacgaggtcaggagattgagaccgtcgtggccaacatggtgaaaccccatctctactaaaaatacaaaaattagctggctgtggtgagcacctgtaatcctagctactcgggaggctgaggcagcagaatgacttgaacccgggaggtggagattgcagtgagccgagattgcgccactgcactccagcctggcgacagagccagactccgtctcaaaaaaaaaaaaaaaaaaaatttaactcccggcagaactccagagataggcagctagaagagagacagtgagctctccgtgccatggggcatccaaacagaagcatagtgctcacgaggctggagatcacccagaaaggatcccaaccctgatctgcagatggggtaaaaggagacccatacagggcagcgacctgccccctgctccgtccacagtggtcaggacaagaatcagacttccgctgggtttttgtccttagccattggtgtgagtcctggtttttatttcagacctgctcctctgggttcccggagagtcctgcacactcaggcccctggaaagcctttttttttttttttcttttccctacagtatccctgaacaaggcttctgggtgccccaggcttatcccccactccctttcactgcttagaccttctttgagattctccagttcttcaagaaacccatggaggctgtgcgcaatggctcatatccataatcctagcgcttttggaggccaaggcaggaggatcgcttaagcccaggagttcgagaccagcctgggcaacaagcgagacacccagtgcacctcaaaaaaaaatttaaaaattagccaggtgtggtagtgcattcctatagtcccagctacttggtagatggaagcgagaggatcacttgagcccaggagttcaaggctgcagtgagccatgattgtaccactgcactccagcctgggcaacagagcaactctgtctctaaaaaatgaaaagaaagaaacccgtggagacacccctttggtgccaccatgcactgggcccgggcccaaggaacccccaggctgggggacacagaaccagccacatactctaccccgccccctggatcagtgctaagctggaaggaagggtggggaggtggaaggatcctaagtggtaagaggataggaaggcttttggaggagggaacattggaggtgggccttaagggctcctattatccccacttcttctttttttttttttttttttcttttttgagacagagtcttgctcttgtcacccaggctggagtacagtggcgtgatcttggctcactgcaacctccacctcccgggttcaagcaattctcctgcctcagcctcctgagtagctgggattacaggtgtgtgccaccatgcctggcttttttttttgcttttttttttcgagacagagtctcgctctgtcgcccaggttggagtgcagtggcacgatcttggctcactgcaagctccgcctcccaggttcacgccattctcctgcctcagcctcccgagtagctgggactacaggcgcctgccaccacgcctggctaattttttgtattttcagtagagacggggtttcaccgtgttagtgaggatggtctcgatctcctgacctcgggatccacccacctcggcctcccaaagtgctgggattacaggcgtgagccaccgcgcccagcctatccacacttctcatatgagcaaagaggccccaaggggtgcagtgaccatcctgaggtcacacagtgagtgggcggcgcagctgggatggggactcagggttctttaacctcagggccctccctacctactgggtcacacatccttatcatggaaggtccttcaaagccttcccctgggagaggggagagaatctggaggagggagacagcgggggcagcttctccacctcccccagcctcccaccctagccttctcctccatcccccacccaccacctcccccatctcccagacctgcttcccaggtcactcttctccctcaccacccactctggacccttctatcccttcctcctcacaaccttcccttctaccttccaacctcttactctagcaactaagggtgtcccttcatctgagaagaatgaggttaagactcttggtgaccctgctaggggacacaattagtggttggggaaggtataggataggaacagaggcaaaaggacacgggacagaccatgaataacaagatggtgcccaccagaaggagggggctggggagttggggtgcataagggccagccccagccagcttcgctctgctgggctagcccttcccccagagctggcccagctgccggcctcacgtaaccagagcctgcctgttgcatcagaggtgggcgggtggcctccggtaaacagagcagccctccgggggcccagggctccccagccacctccacactccccaagccttgttctgcaccatggagtggaggcagaagcccccagcctggcccaggccctggcatgtccttggggcaccccagtgtatggcactgggcactggatggggacaggagggacccactgatgacacagtatgaactctatagttttcatgtccaaagagaaagttgtgctcagactagaggcccacactgcccatttcacagacgggtaaactgaggtgtggggagagacacaagcctcccaggccccctgttccctgtctcagtgtcccccacactccagcatctgccacatgcctccccctgagtttgggggaccagcccctctcttctctggaggagatggacaccaggcagctttgcagccccactgctctccacctgtatctgcccctcctcttcaccccctgcccgctatactggcttcaccttcctcatcttcccctggccagagaatgttctatgctcttcctctgcacttttgcaagtgcttttccctcttgaaaaagcccttctcgggtcttgtgtagtggctcacacctgtaatctcagcaccttgggaggccgaggaggaaggatctcttaagcccaggagtttgggaccagcctgggcaacatagtgagacatcctctcttaaaaaaaacaaaattagctggacctggtggtggcctgcctgtagtcccagctgctggggaggctaagttgggaggattgcttgagcctaggaggtcgaggctgcagtgagctatgatcatgccactgcactccagcctgggcaacaccgtgagatcctgccttgaagaaaaaaacaagaaaaacctttctcctagtggcaaactcctacacatacttgaaagcccagcacaaatgccctctcttctgagaaaccctccctgactcctctggcacagcccttgccccaattctggcctgtcccagcctcccatccctcctctggcccaagcctgaccccacagggttaggggagtgcatggatcccctgcctgccccagacgggccgggggcttctccagaagtgcccatcccagagccatctttatcctgtaattcttttcacattgatacattcaccaacccctgctctgatcttcctgtgggtctggcctgtgctgggatcccaggggaaggggtggatttagagttctgggctggggtccaatcctggaaggcccctcacagctgacctttgaagtttagaaaacagcctttagcggggagaggtaaggagagggaagtggttggtggaagcagtgtggttgtcttggactgtggagaggcaggcggtgcgggcttgagggaccagtagctgcggagggtctgtcactccctgtgggagcacatatctggccccaggaggcacagttgagtgaggccacacaggccacccgagagccccgtcttgcagtctttccattctagcgagcgcgagggtcagcgttgcctgcgagaagggcttggttcctcggggcgacggggtccgggatcggagtctatttcactcaggatggaatcaatccaggcaagttgggccgagttaggaaaaggtttagaattagggttagggtcacagtagggtcaggggtcggcagtaaggtcaagggcgcccagtgagggcggggaaagcctggccagtctgatccagccccctccctccgttctgcttcttccttatccgcgcccccacccatggcgccccagcatcctttcgcgtctgagtcccaggcccatgaactcccgggtcggggccacgcccaagtgcacgcccatcgccgcctccagggtgacgccctgtatgcaaataagcccgtcccgcccaatcagctcccgggggcaggaccgcccgctcccaaggcacctgcggccgcgggcccctgatcttcgtgcagccgccgcgggtccgtgcgcccagcgtcccagggcccaggccgagcaggtgcgtgtcatatcgggttgagactcctgtggtgtcctctgaacggcttctgcgggctgggtgggttttggaggtccgggtgtactgctgggcgtcccagggtggggtgtgtgtctaaaggggtgtgtgtcgtggggtggtgagtccccgaggttgtggcaggagggggttgtgtctccaaggggtgtgtgtctgaagggtgtgggtctggaagttgtgtgtccaagggctctgcgtctgagatttggtgtgagttggggagttggagagttagctgtgtgtccaaaatcatggtgctgtgaggccctattatgtgtctgtgagctctgtgatgtggcatgtgatgtccctctctcctggtgtgcactcctttagcattagcgcatcccctgtgcacaaccctatgccttcttgctgtgggtgtacactcgtttgtcacagcaggatggtaggcacaaaaccttggaacgggggagcaacagctgccggggccaactctcctccctttgcctcaatgggtacaggaacaagagtcacatccccgtgtggttgttagcacatgacaaggtggtggcagcattactttcacggtcacagtcctccctccctatctcttttggggtccagggctgcagatatgggtgacctgtgtccttggccaccctaacccctagttgcagacccaattagtcagaaatagctggccgggcactgtggctcatgcctgtaatcccagcactttggaggctgaggcaggaggatcacttgagcccagtagtttgagaccagcctgggcaacatagtgagacccccattttctttttcttttcttttctttctttgttttttttttgagacagggtctcatcctgtcgcccaggctggagtacagtggtgatctttgttcactgcaacctccagctcccaggctcaaacaattctcctccctcagccttctaagtagctgggattacaggcgcgtgccactaccgcctggctagtttttgtatttttagtagagatgggctttcaccatgttggccaggctggtcttgaactccagacctcaaatgattcacctgcctcaacctcccaaagtgctgggattacaggcgtgagcccctgcacctggctttaaaaaaaaattttttttgagacagagtctcactctgtcacccaggctggagcgcagtggctcaatcttggctcactgcaacctctgcctcccaggttcaagtgattgattttctgcctcagcctcccgagtatctgggactacaagcgtgtgccaccatgaccagctaatttttgcattttttgtagagacgttgtttcaccatgtttgccaggctggtctcatgtgatctgcctgcctcagcctcccaaagtgctaggattacaagagtaagccaccgcatctggccaaaaaaaattgtttttttaattaggcaggtgtggtggcttatgtgtatagtcccagctactcgggaggctgaggcaggaggatcacttgatccgaggagttcgagtctgcagtgagctatgactgagctactgcactgcagcctgggtgacagagcaagatcctgtctctaaaagaaaaacaaaaagaaagaaaagaaacaaaaaaatggccaggcgcggtggctcacacctgtaatccaagcactttgggaggctgaggcgggcggatcacctgaggtcaggagttcgagaccagcctgaccaacatggagaaaccccatctctactaaaaatacaaaattagccggccatgatggtacatgcttgtaatcccagcgactcaggaggctgaggcaggagaatcgcttgaacccaggaggcggaggttgtggtgagcgaagatcgtgtcattgcactccagcctgggcaacaagagtgaaactccatctcaaaaaaaaaaaaaaaaaaaaaagaagaaagaaacaaaacaataatcaaggcctcaggctagcctggccaagaatcatccctggggaagggcagggcccctggaccttgggcattcgggacaagaactctcagactcttggagtgaaggaaactggatacaaaaaagtatttcgacttcggagaaccagtgtgtgaggactgatttccagagatgaaaagggctttctaaaaaggcaggcttgttccctcatgtccccttcctgttgttcagtaaagggggaagcttggcctccagcaaacagaatttcaggacagttaggatcttgggatgtcatcttagagagcaggaagctggtttgcaggagggaaggctgaggccaggtagtaacactaggcccctcaaaaaaggatggagctcaaggccatgcctcagtcccccaagagaacagaggctggggtcacgaggcccagcttcctctccctcctctctgtgtgaccccccaacaggtggctgcccctctctgaactttgtggcagctcctgtgagcggagcaagctgaacccactcttggctttcccatcccaacgaatgatttatttggttaaactatgacccaaccaggtggacatctggaaaatgcaaattaagaagagaaggggaatttaaaacatttgctcaccccaacttgggtgcagtgagtgtagacatgttgggtgtttggccttctggaagaggtttctttctttctttctttctttttttgtttttgagacagcatcttgctctgttgcccaggctagagtaaagtggtgtgatctcagctcactgcaacctctgcctcctgggctcaagtgatccccctgcctcagcctcctgaggagctaggaatacgcgctcacaccagcacacccagtaattttttttttttttttttttgagacagagtctcactctgttgcccaggctggagtgcagtggcacaatctcagctcactgcaacctccacctcccaggttcaagcgattcttctgccttagcctcctgagtagctggaattacaggtgcgtgccaccattcccagctaatgtttgtatttttagtagagacagagtttcaccatgttggccaagctggtctcaaactcctgatcacaggtgatccacctgccttggcctcccaaagtcctgggattacaggcgtgagccactgtggccagcctgtgaccagctaattaaaaaaaaaaattataaatatggggtcttgtcatgttgcccaggctggtcgtgaattcctgtactcaagcactcagcccaccttggcatcccaaagttctgggattataggcgtgagccaccgcacctggcccacttatttatttatttatttatagagacaaggtctccctatgttgcccaagctggtctcgaactcctgggctcaagccatcagcccacctcggccttccaaagtgctgggattagaggcatgagccaccacgccctgcccttctggaagattcaaggcacagagtggtctagagacagatgtctttctgtctttccttgagtgttgcagtcacggctccctgtgaccttgaactcctgggctcaagccatcctgtcacctcagtctcccgagtagctgggattgtaggggagtgctaccttgcctggctttttttttttttttttaattagagatgggggggtctccctatgttgctcaggctggtcttgaactcctgagctcaaatggtcctcctgcctcggcctcccaaagtgctgggattacaggcatgagctcaaccagatgccatttttctgagacgacttagaaatgtgtctgggatcccttttggggtcagggaactcgccccagccctggcccatgattccccatggggtgggcaaggaagttaaatcccatttctcagcccccaaagggcctctctggggctgtatcttggggacttgtgtggttaccctgataccctgcggcccaggattgagtttcttggaccctgtgacggtgattctgggctggacaagcccaggcccacttcccagcctgggtgggggtggtgagattgaggtgccacgtgatggccctggggtacaagcccaggattgggtggggatctggaggtctcaccatgtggccctggaagaagcctgcccactcctgtgcaaaacagggcaactatcgctgcttccctggggtgtctgggggtcaggcaggtcttatatgtaaatgaggcggggtgtgggcccgggcagacagtaagggctcaataacagaaggtcccatctgggctgtgaccaagtggaggtgtttgtgagcccatccaggcccctttcctctctgccctctgccaggtgctgtttccctccaagcccagtttcacccaaggtcaaggtggggcctgaggaagggagaaatggaggtggattgtaataagagtcatggctgctgtgggcatgggcctgccttgcccactgttccaacctgtggcctgtgcctggtccaagccctaccatccctggctggatgctggcctggcttcctgctccaacaggccacagggtcttctgaaaattccaaatcagaccacagtcctccccctcctcacacaccttccatggctccctattgctctacagtccaccctctctctgtcccccaatgcctctctgaccttctctgtctctggccactcctggctcactccaccccagatgcgtggggtttgcctgctcctggaagccacctgtttagcacagtcccacctcagggcctttgcacctgccattgtgtccacctggctcccacctccctgagacacctcagagacagggtcttgctctgtcacccaggctggagtgcagtggtgcgatctcggctcactgcaatctccgcctcccgggttcaagcaattctcatacctcagcctcctgagtagccgggattacaggtgtggtaccctcctggatcctctgtccaaagcagctctctccctgccaccctccactgcctccccctgttgaatttcttccttgaaggccgtcttcccagatacggttatgtggctgctgttgcctcccccatcagactgggtgatggggggaggccttgctctgcccaccccctgctcctgcatccccagcacctgaggggctcctagacatttctgcgggaagatattggggactgacagtgtcctaaagccccatctcggggtccctgctggctgcatcttcgggctgccgggctgtgggcagggtcccttctgcccagcgctgacagatgtgctaatttcccaagcagggaggctggggcatctggggatccatttctgaggccccgcagggagagctttctctggaacaaagagaggaaaaccttgggctgtccctgcagccactactgtggcttaggggacatcactaggggcctgagagggccttagactctagcctgcatgggacagcagggtcaaattcagactgcggggtctgtcttggctccatgggctgggtgacctctgactcctgggttcaagtgattctcctgcctcagcctcctgagtagctgggattacaggcgcccgccatcatgcccggctaatttttgtattttcagtagagatggggtttcactatgttggccaggctggtctcaaactcctgacctcaagtgatctgcccacctcggtctcccaaagtagtgggattacaggcgtgagccaccgcacccggcctggaacaggccttcttggcaggtgagggtgcctgtgccaggtcaggtttgccatggatggtcacctggacgtggttttctcccaagctgggcagtgggaccttcagagggccagttccttggcctgagaggagcatcagcactgtccaattggctgttttgctgtgaaggttgtttagaggaagggccacaaactggcagcctgtgggctggatggggccttaaatttgttgtgtggaccatgaggtgtttcagtgagaagtgaacaagtagggccgggctcacggctgtaatcccagcactttgggaggctgaggtgggtggatcacctgaaggtcaggagttcgagaccattctgaccaacatggagaaaccctgtctctactaaaaataaaaaattagctgggcatggtgggggcgagcctgtaatcccagctactagggaggctgaggcaggagaatcgcttcaacccgggaggcagaggttgcggtgagctgagatcgcaccactgcacttcagcctgggcaacaagagcgaaacccatctcaagaaaaaacaagtagggctgggtgtggtggctcacctctataatcccagaactttgggaggccaaggcaggcagattgcttgagctcaagagttcaagaccagcttgggcaacctagtgagaccctgtctctacaaaaaataagatgtcaaaaaatcaaaaaattagccatgtggaggggcaggcgcctgcagccctagctactcgggaggctgaggcaagagattggcttgaacctgggaggcggaggttgcagtaggcccagattgtgccattacactccagtctaggtgacagaccaaggccccatctcaaaaaaagaaaaaagaaaaacagaaaactgagcaagttggcagtgtttcttctgtctgtgaagcagttgtttggtcgttgattcaaggaagggtgattgagggccttctatgtactaggcgctgggaagccggcagggcgagatgctcatcaaagaaagcaataaagaaacacacaccaaaaagtctgatagggctgaggtgctgcagaaagagttgaatttggccgggcgtggtggcttacacctgtaatcccagcactatggaagaccgaggcagcaggatcacttgagaccaggagtttgagaccagcctgggcaacacagggagaccccagctctaaaaaaatacaaaaattagctaggtgtggcgccgtgctactcccagctactccagaggctgaggtgggatgatcgcttgagtccgggagggccaggctgcagtgagtcgagaccacaccactgcactccagcccgggtgacagaatgagaccctgcctgaaaaaattaaaataaatattaaaaaagattgatgcctccagaaagagcgttttctgcaggtctttagaggacatggagacactcctggacttgggcaaacctagaagggtgtcccggggttggacacagtccgggcaaagggagagtgatgggcaagtagggaatcagtttggggctggtgttgcagatgcccccaaaggggcagaaggtgggctgggagtctgctggtagatgacaccttttcaagtgaggggagaggtgggtgggtacatggggagtttgtggggacccctgcaaacacaggaaaccgaggctcagaaagtatcacgcagtgggcaagtggcgggtttaggatttgaatcctggactgactggcctacagccccggccctggcctctctgtgcatggccaaaatgggatcctggagtgaagtagagggggcgtcccacagagggtcccactcaccgtggactcctgcccctcgaacaggagctgtccctcccaggagcaggcccagggagaggtgggaaggagggtctgagggctccccactgggcctcactttccccatgggtgccagagggacctatggaaaaaaggacccccatggggccttctccagctggaacattctaagaatcctggattcaaacactacccattcaaatctagcctcagatgcccccagcctgcctttcacccctggtgggtggagagcacccggccttgggaaggcagccaggcctgtgtggtggctcacacccgtaatcccagcacttagggaggctgaggcaggaggataacttgaggccggaagttcaagaccagccagtgtgataaaatgaagccccttctctaaaaaaataaaaaaaattagcctggcatagtctggttaaaaattaggtgtgcgcttgtagccccagctgctgggaaatctgaggtgggaggaatgcttaagcccaggaattggaggctgcagtgagctatgatggcaccactgcactccagcttgggcaacagagcgagaccccatctcaaaaaaaaataataataattaaaaagaggaaacccagccaggtatggtggcctgtaatcccagcactttgggaggccgaagtaggcagatcacatgaggccaggagttcaagaccagcctggccaacatggtgaaaccctgtctgtactaaaaatacaaacattagctgggtgtggtagcgcatggctgtaatcccagctactggggaggctgaggcaggagaatcgcttgaacccaggaggcaggggttgcagggagcagagaacacgccactgcactccagcctgggtgacaaagtgagactctgtctcacaaaaaaaaaaaacaaaaaagaagaaagctagagtgtgggtggtatcactgcagggatgggggggccctacctatgtaatgggggaccagcatggattggggggagtctgcatatgtttggaagagtctgcatgcgtctggcgggggtctccacattgttcaggggaaaggggtctgtgtgtatttgcgggacggccatgtgtttagggagatctgtatgtgtctgtgcatttgggggattggcatgtgttggggcatctgggtatgtctgagtgtttttggggtctgtctatgcagagggaataggatgtgttttggggatgtgtgtgtttggagagctgtgtgggttggggggtttggcgtatcgtgaactgcatgtattttggggactttcgcaggaggaatacttgtgtatttgggggatctgttgtttcgggcatctatggattttctgcggctctgtttgggggtctccgtgtgtggggaatatttctacctcccattatgcccatacaaggatggagtgacccccaaccccatccgcccctgtccctcagcactccaccagggactttttggggcccgcaatctgagctgggttcccccaggatggagaggtgaccccaaggccttctgagaggcatcaggacccatcgaccacaaatcctccccgcatctgtaaagcaccttactgtgaagcccctccccccagttcagcgaggtggcccctgctgccccctgactttctggaggaggaaactgagttccagagaagctcagcaacaggggagtcactgcccgagcccaccgtctcccctgagtccctgagggcaggtgcggggctccagggaccgctgtgaactgagccaggccgccaggtcacctacatgcccccccacctgggtaccacctccctaggcccccggggaggaggcgggcccagggctctggctggggagggagggtcgcctgcagctggggtcggagccgctggagcccccaggagaggggaggaggggtcctggctttccaaggggctcttcctgtcgcccataatgaggtacttggggagcaggtgatgaaaccacagcctgggttgcgtgaggcggggcggcaggcctgattcgctgcagggccgggagcagcgccccctccccgcttcaccgcctcccgcgggccctcacccccacccccacccaacccacctgcctctcacttctcctttcccggcctgggttcctctgccaagccgtggcctccctgcgggctcaggggtctggcgaagtgactctgcagctcatccccccagtaaagtcccgcaggggtgccaagaaagggaacttgacttgttcctaatcttttctcttaaacccctctgcaaagcctgtgaggttaggatcctgtgacccattttatgggggaggaagcaggtgactgatgacagtatttcaaggtggtcttgcaggatgctgtactgactcagcgcccccagttccaaggcccagaccttcttccttttggtttcccagaagccagaagaaaagttcaatagaggcccccgtgtggtggctcacacctgtaatcccagcactttgggaggccaaagcaggcggatcacttgaggtcaggagttcgagaccagcctggccaacatgctgaaaccccgcctctaccaaaaatataaaaaattagctgggtgtgatggtgtgcacctgtaatcccagctactcgggagtctgaggcaggacaatcgcttaaacctgggaagcagtggttgcagggagccgagatcacgccactgcactccagcctgggcaacagagcgagactccatctcaaaaaaaaaaaaaaaaaaagttcagtagacccctgctccctaccctcttcccagctggtgggagaaggattctcacccccaattaacaggtaagagaactgagtcctaccacgcagagaggccagaggggaagggtctgtggaagggtgggattccctccagcaccccatctccattactggggggctaaggggcctcgccaggctggggagatgataatctatggcttgaaggacttcagggtaatgtttgttgattgacttagtgaccacagatactgccagaaagtttctgatgcttccgcactcctgagctcttcttttgtcctcccaattccccctcacccccacatcgctcaggcctgggatcaccaggctcctcttctatcccaggtcaccagcacatcctgcaccctttggtcaccacttctgcccaggtgccacccctgtctccattcaaactctgtatttcccactggcccagcctcttcctgtcacctcactctagcctgaacagacactgctccccacagcagccataagcagcaaggagcttttttatttttagagacagggtcttactctgtcacccaggctggagtgcagtggcccactcatagctcactgcagcctccatctcctgggctcacgtgatcctcccgcctcagcctcccaagtagctgggactacaggcaggcaccaccatgccccgctagatttaattttttttttttttttttttttttaggccacgcactgtggctcacgcctgtaatcccagcactttgggaggccgagactggtggatcacctgaggtcaggaggtcgagaccagtctggccaacatggtgaaaccccatctctactgaaaatacagaaattagctgggtgtagtggtgtgtgcctgtaatcccagctactcaggaggctgaggcaggagaattgcttgaactggggaggaggaggttgcagtgagctgagattgcgccactgcactccagcctgggcgacaagagcaaaactctgtctcaaaaaaaagaaaaaaaaactttcgagtcagtctcacaatgttgcccgggctggagtgcagtgacaggatctcagttcactgcaacctctgcctccccctgctcaagtgatcctcccacttcagactcctgagtagctgggactaaggggtgcaccaccacgcctggctaaatttttttatttttgtttatttatttttctgagacagcgtctggctgtgtcacccaggctggagtggagtggtgtgatcttggctcactgcaacctccacctcctgggctcaagtgattctcccacctcagcctcctgagtagctgggaccacaggcatgccaccacacttagctaatttttttttttttttcctacagacagggctttgccatgttgcccaggctggtcttgaactcctgggctcaagtgatcctcccacctcagcctcccaaagcactgggattacaggcgtgagccaccgtgcctggcctggccctagtttgtttttttttttttttaggggcagggtctcactatgttgctctggctggaagctttttaagaaatcttccttttgggccgggcgccatggctcacgcctgtaatcccagcactttggcccctgaggtgggcagatcacctgaggccaggagtttaagaccagcctggccaacatggtgaaaacccatctctagtaaaaatgcaaaaattagccgggcacagtggcaggcacctgtaatcccagctacttaggaggctgagacaggagaatcgcttgaactcgggaagtggaggtttcaatgagctgagatcatgccactgcactccagtctgggtaacagagcgagactccacctcaaaaaaaaaaaagaaatcttccttttgaaataaatcacatgaagaaaaatgcacaaaccactagagttgagctcaacacatttgcacaaactgaacatatctgtgtacccaaaccttggatccaggaacaggacttccctagcccctgggacttcccccttgggccactgcctaatcacagcttctgcccagggtgaccaaagtgctgtctgatatccatcagcctcagtgagggttttttgttttttgttttttttgacacagagtctcgctctgtcgcccaggctggagtgcaatggcacaatcttggctcactgcaacctccgcctcctgggttcaagctattctcctgcctcagcctcccgagtagctaggattacaggcacatgccagcacgcccagctaatttttgtatttttagtagagatgggttttcgccatgttggccaggcttgtctcaaactcctgacctccagtgatctgcccgccttggcctcccaaagtgctgggattacaggcttgagcccctgcgcccagctgcatcagtgagttttgattgttctgaaacttcatgtaaataaaatcacacagtgcatcttctcgatggagtctgggatcgtcgaattggccaatggtctctgagattcatccacgtggttgtgtgcagcgagagtgcaccctttttctgtgctgtgctataactgatcatagaatcaacaagaaagtgttgaccagctctcccattaagggcttccaggttgattccagtttgaggcaatgatgtatgaagctgtagaaaacattcttgtctgtgtcctcaggtgtaacttggacccatttctcttgcgtgaatattgaacatcgaggagcggaattcctgggtcacagggtaggcatctgttcagatttagtagatgccagagaattatccaagtgcttgtccctttttcctctgccaccagcaatgcatgagagctggaagtggaagagcttacaagatcatcatcgctcactgtaaccttgaactcctgggctcacagaatcctcccgtctcaggctcccacatagccaggactacaggtgtgtgccacggcgtgcagctaatttttaccttttttgtagacaggttcttgctgtgttgcccaggctggtctccaatttctggcctcaagcaatcctcccacctcagcctctcaagtagctggaagtatctgggagtagccaggagtttgagaccagcctgggcaacacagcaaatcgccatctctataaaaagtttttaaaaatttgctgggtgtggtgacacatagctgtaatcccagctactcgggatgctgaggctggaggatcacttgagcccaggagttcaaggctacagtgagctataattgcaccactgaactccagcctgggcgacagaggaagaccccatctcaaaaacaaaaaaagtgactcggctagatcccgtctatttcaaagatctaagttcactgaaataatgctgcactttcctgttctgtgagatttgagaaaatagctgtaaaaccacctgggcctttaaacatgttttttagttattattttaattttgaaattattattcttttttagagacagagtctcactctgttgccctggctggagtgcagcagctcaaagctcactgcagccttgaactttattgcctttaaaaaaaaaatttttttttttagagataggggtctcgctatgttgcctaggttggtcttgaaccgctaggctcaagcaatcctcccacctcggcctcccaaagtgctgggattacaagtgtgaaccatcatgcccagcccactttattacctttttaatggtaggtcctgagtcacctttctaatcttctatggttgttggtctacttaagctttctacttcttctgaggtcagcttggctcagtgacttgcacaggttgatacttaataaacgctaagtatgagggtgcaatgaaaggagtaggaaggtactggactcttagcttcaaattcccacctccctccccttctactcaggctcccatccagcctctgcgtctacatccaactacatgcctcctcccccaagaagctctcctgggtttcttctcctgttctttcttctgtgctccattccttggtcaataggtccacctctgtgcttctgcgctgggcagatgccacagctctctgatttctggctggacaaagcagggagggtatgtgtgtgcggaagaggcctccccaaacctcagcttcccccctcgtgcctggcacattcagcctgtgctgccacctcccccagcagttccgatcacaccaacatctggagaatgggccaccagggtctgtctgcggctctgggcagggatttgcatgtgactacaaatatacatgcacactctggcctgccgcctccgcattctttgcctggcccttcacacctgggcccgagacaggtcaatgctgagtggctggatttgcatgtgcatgtatttctgggcagggtatcagctggggcagtctgagaggaagttgttgagggaagctgtagggttgtggagggggtcagtgacatctctgttgatctactctgctcaccaaaccttactgtccattcctggccctgatccagaggggcttttagtctggaggagacaaatctggatatatatacccccaatgccatggaatctgacctagaggaggatggtgactctgggagaccagaagaatggcagggaggacttcctagaggaatgggttttttgaactgggttttgacgtttggataggagttggcttggtgaaaaaggggaaagggtccttctagtcagagatatttatcgaagagagagaagtaggcaagagctgatttgggaagaagacttgaatgccaggctaggtgctagaactttctcataagggcagtggggagccatggagagtgtatgagcaggagggggccatgctcagagctgtgtttggttgggtagattccctcaggggctagagtggaggatggctttggttccaatgtcactggggttcaggagagtgaaactcctgcgtgagttcatctgcacctgtcaggcctgcctccagagttggtgtagggcctgctggcttctggaggactaacgcaccctggagtacagtgacttaaagtgcaaggcacaggcctagcacagagggggccctacccccagtctctgtcaagacggacacagcccttgccttctctccagccgcccatgatctccaccctggcctccaacagacctgctccccatggaagccatgagctgagtcttaaaataataaactaagccccatcccttctctgcttaaaaccttctcatagtggctcacgcctggaatcccagcactttgggaggctgaggccagcggatcccttgaggtcaggagttcaagatcagcctggccaacttggcaaaaccctgtctctactaaaaatacaaaaattagccaggtgtggtggtgcacacctgtaatctcagctacttgggaggctgaagcaggagaatcgcttgaacccgggaggtgaagactgtgccactgcactccagcctacatgacagagcaagactctgtctcaaaaaataaaataaaaggctgggcgcggtggctcatgcctgtaatcccagcactttgggaggccaaggcgggcggatcatgaggtcaggagtttgagaccaacctgaccaatatggtgaagcaccatctttactaaaactacaaaaattagctgggcatggtggcacatgcctgttgtcccaactacttgggaggctgaggcagaagaatcacttgaacctgggaggtggaggttgcagtaagccgcgatcacgccactgcacttcagccggggtgacacagcaaaactccatctcaaaaatatatatatattaaaaataaaaaataaaatacaataggaaataaaataaaatatgctctcatagctccacatcactcttagaccaaaatccacagccctcctccagctcagaaggcccacagtgggccaggtacagtggctcacatctggaatcccagcactttgggagggtgaggtaggaggatcacttccagccaggagtttgagaccaacctagacaacatagtgagactccatctctacaaaaagaaaataaaaactagcagggcgtggtggcactcacctgtagtcccagctattcaggaggctgaggtgggaggattactggagcctgggaggtcaaggctgcaatgagctgagatctcaccaccgcactccagcctgggcaacagagcaagactgtctcaaaaaaataaatatggccaggcgtggtggctcacgcctgtaatctcagcactttaggaggccaaggcgggcagatcacttgaggccaggagttcaagaccagcctggccaacatggtgaaaccccgtctctactaaaaatacaaaaattagcgaggtgtggtggtgcatgcccgtaatcgcagctacttgggaggctgaaacgggagaatcacttgaacccgggaggcagaggttgcagtgagccaagatcatgccactgtactccagcctgggcgacagagtgagactctgtctcaaaataatgataataataataaattaaattaaaagaaggaaacccaaaagaaggagtcctagaatggcccaacctctgtggcctcatccccaccctcccgctgtttcttgtccctcctcagggccctggcacctgctcttccttctgcctggaactcactttctatctcagctctcagggtctcagtgcagagagagacttcccagttctcccccatcacatgacctctgccctagccatggtgtctgtgtctaaaatggggacagacagagtgagaaggggcttgagtcaggtcttccaggcttaagagactcaggcctaagccccagccctgctgctgctctcgtgggaccctgggcatcaggggcatttccggagtcatcttggccctgggacctccggaccaaggcccccgtccaccccccagggacccatcagggtgggggcaacatatcccagccgtgggaacaggcccgattccggctggggattaaaattagccctggaggttaaatttagcaagtcaagccggagctgagggtctgggactgacagcttgggctctacatagttgtgggggctcagagacccagcccagagagggcagagggtgtgcctggggtcacacagcatgccatatctgccagccgaggtatctaacacttctgggccctgggataatggagggccttgcccagaccgcttgggcaggggtctgggaagccctgagaacactcccagagaacaatctggatttctttctttctgtttttgagacggagtctcgctctgttgcccagcctgtcaaaatctcgggatctcggctcactgcaacctccgcctcccaggttcaagggattctcctgcctcagcatcctgagtagctgggtctacaggtgcccaccactatgcctggctaatttttgtatttttagtagagacagggttttgccatgttggccaggctggtctcgaacgcctgacctcgtgatccacccacctcagcctcccaaaatactgggattacaggcatgagctaccacgccaagccagatttctttttctttttctttttctttttcttttttttttttgagacagagtcttgctctatcacccaggctggagtgcagtgacacacctgcctcagcctcccaagtggctgggactacaggtgtgcgccacgacagctggttaatttttgcatttttaatagagatggggtgggtaggatgcggtggtaatcccaacactttgggaggccaagatgggtggatcatgaggtcgggagtttgagaccagcctgaccaacatggtgaaacctcgtctctactaaaaatacaaaaattagctgggcatagtggagggcacctgtaatctcagctacttgggaggctgaggcaggagaatcacttgaacctgggaggcggaggttttagtgagccgagatcgcgccattgccctccagcctgggcaacaagagtgaaaactcgtctcaaaaaaaaaaaaaaaaaaaaatagagatggggttttagcatgttggccaggctggtctagaactcctgatctcaagtgatctgcctgcctcggcctcccaaagtgctgggattacaggcgtgagccaccgtgaccggcctgatctggatttcttgataacttgttgccaagcctggtggtgggtgctcagcatttcctaccagcccattcacagaagagcaaactgaggcctggggaaagggtcttctgtgctgagggctgccctgagggtcagagggaaggccaggcctgagcgtaggtccgcgtgaccctggagaggccccttgcctgaagcctcagtcacctgtgacatggtagaggctgggaggtggagtgtggtcacacagttggcggagcggggacgtcccctgtggtgtcaggggacgtctgtacagagggcggcggctgcaggacaggccacatgattcgattgttcccaggaacctcgagtgggggtctctggggaaggcctggaccccagcatagtccagcagtctcctccttctgggacccctaccagggcgatctcacatctccttgagtggggtacaggatttcttccaagtcaccaagtggatgccaggcccacaccctggcccaaggactctgagctggaggcctttccagagtgtgcctgcatcctcctgctagagcaggaggcgtttctattattctgttttctttttcctttaaagactgggtctctgttgcccacgctggagtgcagtggcaagatcatagttcactgcagcctcaacctccccagctcaagtgatcatcctacttcagccaccggagtacctgggactatagacgtgtgccaccatgcctggctaatttttgcattttttgtagagccggggtttcaacatgttgcccaggctggcctcaaactcccaggctcaagtgatcctcccgccttggcctcccaaagtgctagggatcacaggcatgagccaccatgccccatttggtctaaacatgttcattgagcctctactgcatcctaaggctggccgggggcggggtctgcgacagtgacccagcctgccttgattttccccatcatcttcctctcagtggctggcaggggcagacagaggagaggtgtgaggctggggtacccctccccactctccacccactcactctgtcctctccctcttctcctcctagacaaagatcattccactcagcctgggacgatggggaggaaaaaaatccagatctcccgcatcctggaccaaaggaatcggcaggtgagttcactgggtggaacagtggctgggaaagacattcctagcagggggcatggcctaggcaagggactgacctgaccaattgaactgcaggggaatgaggaggcatgaggagtcctgatgccatgtcagcctttcttttttttttttttttttgagatgaagtctcactctgttgcccagcctggagtgcaatggtgcaatctcagcttactgcaacctctgcctcccgggttcaaacgattcttcctcagcctcctgagtagctgggattacgggtgcgcaccaccaagcccagctaattttgcagttttagtagagacggggtttcaccatgtgggccaggctagtctcgaactcctgacctcgtgatctgcccgcctcggcctcccaaagtgctgggattacaggcgtgagccaccgcgcctggtctgtcagtgtttcttgtttcccctccctccctccttccctccttccttccttccttccttccttccctccctccctccttccctccctccctccttccctccctccttccctccttccttccatccctccttccatccttccttttttttttttttttttttttgagatggagttcactttgttgcccaggctggagtgcagtggagcgatctcggctcactgcaagctccgcctcctgggttcaagtgattctcctgcctcagctttccgaatagctgggattacaggcgcccaccaccacgcctggctaggctaatttttgtagttttagtagagtcgggggtctcaccatgttgcccaggctagcctcgaactcctgacctcaatcaatcctcctgcctgggcctcccaaagtgctgggacctcaggctgagccaccgcacctggcctgctcattttcatgatcatttattcatttattctccctgatgactggaaccccagccataggggagatggagcttgacacagccacacctaactcagagggccagaacagagggaggcccagaactgggaaagcccagagagagcatgtggactctgcctgggaagccaaggcacacttcccagacatttgggctgggttttgaagctccagtaggagtttgccaggttgtgacatgagaattaccagctcagccagaaagaatcctgaggcatgttcgaggaagggttaggccctgccaattcccctacaccaccccacattcatctcttcttcttctctcccctgcccctgtgggtcctgggtccaggtgacgttcaccaagcggaagttcgggctgatgaagaaggcctatgagctgagcgtgctctgtgactgtgagatagccctcatcatcttcaacagcgccaaccgcctcttccagtatgccagcacggacatggaccgtgtgctgctgaagtacacagagtacagcgagccccacgagagccgcaccaacactgacatcctcgaggtaccccaggtcctcctccccagccccacaaggccccgtgcacgctgctttctcagagcccagggactcttggtttgcacaaaagatgagtgtcttcatctggctttgtggctgacgtgctttatttctgctgtccctagaagggaccctccactcatccaaacatttgggagtgggggagcccttctggggacagcagaaataaagcacatcgggcagggcacggtggctcccacctgcaatcccagcactttgggaggccgaagtgggcagatcacttgaggtcagggattctagaccagcctggccaacatggcaaaacccagtctctactaaaaatacccaaattagccaggtgtggtggctcatgcctctaatcccagctacttgggaggctgaagtaggagaattgcttgaacccgggaggcggaggttgcagtgagccgagatcgagccactgcactccagcctgggcaacagagcaagactctgtctcaaaaaataaataaataaataaataaataaataaataaataaataaataagacagaggagtcttcactgggatgggaagctaaagcctaagggctgcagagagcagcgggctgggactaggcctgggagtccgcagtgttttggaagtgtggggcagaagttggcaaagaagaggttggggtccgggagcatgcggttctgtggccccaggagaaggcagctcaggaaatctgctggcgtttcttaagcagtttttttctttttttgagaatgagtcttgctttgtcgcccactctgcagtgcagtggcaaaatttcagctcaccgcaacctccgcctctcggattcaagtgattctcctgcctcagcctcccaaatagctctgaccacaggcatacgccaccatgcctggctaatttttatattttcagtagagatggaggtcttaccatgttggccaggctggtctcaaactcctgacctcaagcgatctgcctgcctcggcctcccaaagtgccgggattgtaggcgtgagccaccgcgcccggcctcttaagcagcttttgatgccaggctatgaggctgcaagtgggggcagaatggaggtcctggagtcatgtcaggagcagcattaggacagcgccaacaggcctgcatggatctcagctcctgctgtgttgatctgggcaggtccttgggcttttcggtcccaggggaggaaactgctagctggtaactcaccggggtttggtcagtggggtttggctagagcaggccatgcctgcattcctccccactcatggagctgggtggggatggtctgtcccctctcccatagaactgggttccctgggtggggtaggggtaagggtctaccctgttgtctcctgtccccatagacgctgaagcggaggggcattggcctcgatgggccagagctggagccggatgaagggcctgaggagccaggagagaagtttcggaggctggcaggcgaagggggtgatccggccttgccccgaccccggctgtatgtaagtgactccctggccctgtgaatgaggcattcctcctacttcctaggcccaagtcgttgaggctggtactgagagaggggcttagagccagggatcctagagtttggaggcaggtctctacctggttggtcaggaaaggcttctttgagaagtgggcactgtagctggggctttgaaggatgaataagagttcaacaggcaaacagttccttccttcatttcatctttgattcatcaaacactctgtgcagccccctcagtgccaactctacactaagtgagaggtcttggctctggacctacctgtcaaggacaggcagagccagacagaagctcccccagcctgtagggttagggcagggggaggagcaggtagggagcctggtgggaggtggagcaaaggcttcctgaaggtagagctgggcccctgaactcatcaggattttctcccttggacttggcacccccatctggcctggggtcctctgacccatcccttctctacccacagcctgcagctcctgctatgcccagcccagatgtggtatacggggccttaccgccaccaggctgtgaccccagtgggcttggggaagcactgcccgcccagagccgcccatctcccttccgaccagcagcccccaaagccgggcccccaggtgagcatgggacagtggggcaggggtgaggtcctgaggggctgtttgggtgcatcttggctctggcattgccaggctgcgtgcatcacctctaaacctcagacttcattagttgacatggcctgcctgtcctctctctctggggtctcctcttccccaggcctggtgcaccctctcttctcaccaagccacctcaccagcaagacaccacccccactgtacctgccgacggaagggcggaggtcagacctgcctggtggcctggctgggccccgagggggactaaacacctccgtgagtgaggggagggtgtggcagggctgatgagggcaggcagggcgacctgggtgtgggcctcagtttccccttcaccctctctccgcacagagaagcctctacagtggcctgcagaacccctgctccactgcaactcccggacccccactggggagcttccccttcctccccggaggccccccaggtacatcccctaacctgccctgccccacctgggaagcgtccgcactcctgccctctgggggttccacaccctcccacccaccagaactcaaaactgtcactgggggtggttaggtttgcagaaggcttaaggagatgtccaggcctcagcccccaattcctgcccaccagaatatggcctgggagaccctccaccgccccctggcttgttgcagccccccaccctggccccctggcagccctcgaggggtgatgggccccccgccgtgtcctcccagcccaggtaagtgccctgagacgacggcaagtcccagtcctccaaagccccggccgctgctgacccctggtggccatccctggtactgcgcacacttccggtacggatgggcagctattttgaggccccaagagggaccgccaccccctcctttcccagggtcctcctgccaagcctttgcccacgctgtgccatcccctggcttccttcccttccttgctgagctcacggcctccctctctctttccccctgcagtgggggccgaagcctgggcgaggagggtcccccaacccgcggcgcctccccgccgacccccccagtcagcatcaagtctgagcgcctctctccggcccccgggggccccggcgactttcctaagaccttcccctatcccttgctcctcgcccggtccctggcagagcctctgcggcctgggcccgccctgcgccggctgcccttggccgacggctggccccggtaggagatcacccggtggcaccagcccagagcgctcgccaggtacggcgagggcacgtggggaccccacctccctccaggcctcttcagagaagacccaacagtgacgcccccctccgcggtgggggcttggaggtgggcggctggactcaatccaccctggggggctcctttccttcttcctatttgtgtgtatatccacaaataaaacgcgcgtggcgtccgtggaccagactgactgtgactcgcctcattcttgcctagtcttggcttggggtgccccctccagaagccctgagacgaggactcaagagcccgtggggtgtccgggagggctgccaggtggagggttggggaggcaaggcgggaggagccctgcaggggacgcgcacaagcagagggtgcttagcccgcggggggttctggggacagcatagagtgagcgtgcacctagaatggtcccactccaggggtgagggccccggctctttccactccagggccaatggccagggctgctcccggcgctgtgggtcatgggctcaggggcaagccctagggctgggtcgtagggctcccaaaagcagcagctgggaatcctgaatgtcgggctcccagggcgctggaagcgcccctgaactgttcatcttcttattttttattttattattttaattttattttatttgagacagagactccctgtgtcacccaggctggattgcagtggtgcgatctcggctcactgcaacctccgcctcccgggttcaagggattctcccgcctcagcctcctgagtgcctgggactacaagcacctgccaccatgctaatttttgtatttttagtagagacgggtttccccatgttggtcaggctggtctcgaattcctgacctcaggtggtccgccctcctgggcctctcaaagttctgggattacaggtatgagccacccagcctcgccgactgctcatcttttgaatgggtgtatctcttgagcccttgacccagcaattgattctacccaggggacaagagagcagggtgtttatatacccactcctggggttgcaaactgcccccactctggcttgtcctgtgtgtgaagacagacttgggtgtcctgaggtcaggggtgctcccagaaaatagttgaggtgcagcagggtctatctggcctcacgcaccccaggtggtctcagtgggattttttttttttttttagttggggcctcactatgttgcccaggctgctctcaaactcctgggctcaagcaatcctctcacctcggcctccagagtagctggactacaggtgcaagccaccatacatggcattcagtgagatcttcataatacttaacatctgacttcttgccgggtgcggtggccaaagcctgtaatcctagcactttgggaagccaaagtggatggatggcttgggcccagcagtttgagaccagcctgggcaacatactgacaccctgatctctacaaaaaatttaaaaagaaattagctgggcatggctggcacattcctgtagtcccagctattcaggaggctgaggtgggagaattgcctgagcataggaagtcgaggctgcagcaagctgtgattgagccattgcactccaccgtgggcaacagagcgagaccctatctcaaaaataacatcaaaaacaacgacaacataaaaaactgacttctagccgggcacggtggctcacacctgtaatcctagcactttggggggccaaggcgggcagatcacttgaggccagaaatttgagaccatctctactaaaaatacaaaaattagctgggcctcatggcccatgcctgtaatcccagctacttgggaggccgaggcacgagaatcacttgaactcaagaggtggtggttgcagttagccgagatccagatcgtgccactgcattccagcctgcacaacagagcaagactccgtctcaaaaaaaaaaaaaaaaaaaaaattacttcttgcctgtaatcccagtcctttgggaggctgaggaggaaggatgccttgagcccaggagttggaggctgcagtgggctattaccagcccactacaatccagcctgagtgacagaacaagacattgtctctaaaaataacagtaataaaatttaaaagatctgcctctgccatgttctgctcatctctttgaagcttttcctcatccttagaaggaagttgggctcctcagctgccctacc

SEQ ID NO: 16244 - DNA, 13571 bp, Human
aacagcaccagcctcaaagtttgctacagagatgaatccaatgccatcaccagggtgactgctcaggagagagaacccaggcgtgtctgggagtcaaaggaggctaacacaagtctctccatctcaccactgtgccttgagtggcagagcccagcctgccacctccaaactgtgtgacctcttaccagataggcctcctcgctttgaatgtgagcataacggccaggggcggtggcccacgcctgtaattccagaactttgggaggccgaagcgggaggatcacctgaggttgggagttcgacaccagcctgaccaacgtggagaaaccccgtttctactgaaaatacaaaattagccaggcatggtggtgcatgcctgtaatcccagctattcgggaggctgaggcaggagaaacacttgaacccgggaggcggaggttgccgtgagccatgatcacgccattgcactccagccttggcaacaagagcaaaactccgtctcaaataaaaaaaaagaagaagaaaggtgagcataacagacaaggcacggtggctcatgcctcatactcatgccctccgttatccatggttcccgaatctgtggattcaaccaaccgtggatggaaaataggaaaaaaaaaattccacaaagtttcaaaaagcaaaacttcaatctgccctacacgaagcacttctttgaatccatgtgaatgaagtgatgtgtaggcctgtattatgtattctagatgtgagtaatctagggtgatttaaagtataggggattagctgggtgcagtggttcacacctgtaatcccagcactttgggaggccaaggtgggtggatcactcgaggtcaggagttcgagactagcctgagcaacaaggtgaaaccccgtctctactaaaaatacaaaaaaattagctgggcatgggggtgtgtgcctgtaatcctagctactcagggggctgaggttgcagtgagctgagatccccccacggcactccagcctgggtgacagagcgagactccgtcaaaaaaaaaaaaaattaaagaattagcctgatgtggtggtgtgcacttgtagtcccagctactggagaagctgaggcaagaggatcgcccgcgccagagagatcgaggctacagtgagccatgatcgcgccaccgcaccccagcctgggcgacagtgtgataccttgtctcaaaaaaaaaaaaaaaaaaggaaacaagacgcacagcgattactacgccccggggattcttccaatgcattacaaatatcaggttgttgagttttttttttttagacagggtctcacttgtcacccaggctgggggtgcagtggcacgaccgtagcccactgcagtgcagccttgacctcccgggctcaagcaatcctcccaccttagccgcccaagtagctgggaccacaggcgtgcgccaccacgcccggctaatttttgtatttttttagagacgagatctcactatgtcacctaggctggtctcgggctcaagcgatcctcccgcctaggcctcccaaagtgctgggattacaaagccaccactcccagcctcagctactgaattcttgaaacaatcctggggggaccggtaattaaagcagacacggagcctttctacaggtttcaaaactagtcagcggcagagctgggattggacggcagttcaatcactgctcctcgcacggtccctccgcgcccggcctttgtcaggccgcccctccacaagttaccggccccctctgtcccgcccgcaggcccgcaccacctttcttccccttgagctgcatctccggctcctccatagcgaccgcggccgagcgaaccgggaaacggcaccggaagcccggaggttgggacgcccgcctaagccttccctgctgaaaccggacgccgcacggctcctgttccggtgtcagagggcccgccctccccgctcctcagtctttgcggacaagaaaggggctgtgtgagacgcagggaaggaggcacacccgggggtggcgcagtgaggagggggcgcgacggccaggaggctggtggagcgacacccaggcaggagagggggaagaactctctccctttctgaacccccttttccttgagagacgagttgggggagtcctccacgcattacccactcgggccgcaaaaactcccttctttagccctctgcccccgcccttgcttataagcctttgagaccgcagaagggaccttgttgtggaacgggacggccaaggtacgctgcccctttaagttccagacgccccgcgtacttcccctacttcttcttcttgagatagccccgcccatctacccgaagccggagccaattggctccctctggaaaaatctgtgggcagggtaaaggtgagcgggcgcaggcgtagtgaaattctcagagccctttaggccccgcccattccctccgagtcggtgaggaggggaaaagaaggcgcaggcgcaactgccctcccaggaccccagcggaacccacgccctcccctaagtcttaaagggccagaggcagcacttactgcccgggcccttcctcacttttggggggcgggggtgcgcaagcgcagtgggggagctctggggtgggggtagcggtcgagtatcaagttgctttctgtcccggcagaggaagccagatcgctgagggtccggtctccagtttgcctcctgctatatccattggaagagaaaagtttgtgacttgggcccccaagttttgagagaactgggctttcggcgcggggggacagaggaggctcgtggggaggtgagtggacctcctggatcgatttaggaggctcgggtgggactgggaccaatcgcacctttgttgagccgtcactcattatggggagcccctcccaacaaccatagcgaatatttattgagctccacgcttagcagatcccccgataagctatgtacagacataattcgttgtaggtctcatttccacattttgtcgtggaggaaactgaggctcaaaggttaagtcacgtgcccaagttctcacggcctataaattgagggattcgaacccagacagctgaccccagagccccggcttttttttcctttcttttttttttttttttttttttttgagacagagtcttgctctgtcgccccagctacagtgcagtggtgcgatctctgctcaccgcaacctccacctcccgagttcaagcaattctgcctcagcctcccgagtagctgggatcacaggcgcccgccaccgcgcttggctaatttttgtatttttagtacagatggggtttcaccatggtggccagcctggtctcgaactcctgacctcatgatccaccctcctcggcctcccaaagtgctgggattacagccgtgagccactgtgccctgccagagcccaggctcttaaacattgcacattgtaggtgctttggtggtggggaatggtagacctcgaaagcagttggactctggttttcatttccctggctctggtaattaacctggacctcagtttacccaccctcacagtgcaaggctaggtatgcagtcggtgcctactttattataactgttgataattattgtcatctctccccttctgacacctccgccagctttccccatggagcttacccagcctgcagaagacctcatccagacccagcagacccctgcctcagaacttggggaccctgaagaccccggagaggaggctgcagatggctcagacactgtggtcctcagtctctttccctgcacccctgagcctgtgaatcctgaaccggatgccagtgtttcctctccacagggtaggatacctcctctgggattagccctctgggattccatgatgatggaatgtcaggcctcacatggaacctgtgtcttgctttcgtttttgttttgttttgttttgttgttttttgagatggagttttgctcttgttgcccatgctggagtgcaatggcgtgatctcagctcactgcaacctctgcctcctgggttcaactgattctcctgtctcagcctcctgagtagctgggattacaggcttccgccactacgcccagctaattttttgggtatttttagtagagacggggtttcaccatgttggccaggctggtcttgaactcctgacctcaggtgatccgcccacctcggcctcccaaagtgctgggattacaggcatgagccactgtgcccggcctgtttttgttttttgatacagggtctcgctctgttactaaggctggagtgcagtgatgcaatcatagttcactgcagcctcaacttcctgggctgaagccatcactcagcctccctaggagctgggactataggcatgcaaccacacctggctaattttttttttttttttgggaggctggtctccacctcctgggctcaagtgatctgcaggcctccacttccgaaagtgctgggattacaggtgtgagccacagtgcccggcccttcacacctgtttttaactctttgagggtagatagctaggagtgaaattactgggtcagatggtcatcctgttttacttactgaggaactgaggatttatttttgattggagtccaagaatatgcctaatttagttccctcccacgacctttgttgctgccactcctgtctggaatgctcttcctacacttcttcctatagctgactcccctcccctccctcccttcccgcctccgttttttttttctttctttctttctttttttgagatggagtctcgctctgtcgcccaggctggagtgcatggagtgcagtggcgcaatcttggctcactgcaagctccacctcccgtgttcacgccattctcctgcttcagcctcccgagtagctgggactacagtccgtttttttttttttttttaaatggaggtttgcttttgttgcccaggctccctcccctcccctcgcctcccctcccctcctttcccctctccccactctcgagacgcctcctggatcccctctcttcttgagacagaatcttgctctgttgtccagggtggagtgcagtggcactatcttgactcactgcaactccctctcctgggttaaggtgattctcctgcctcagcctcccaagtagctggcatgcaccaccacatccagctaatttttgtgtttttagtagagatggagttttgccatgttgcccaggctggtctcgaactcctgacctcaggtgattgcccgcctcggcctcccaaagtgctgggattacaggcgtgagccaccgcgcccagtccctgtagcggatttctttgacttcctaagatctcggtggtgtcaccttggggaggccctcctgttaccaccttgtctaagaaggacttattccttgtgctccgttcttttcatcctcttctacctgcttttaaatttttttttttttttttttttttgagatggagtctcactcttgttgcccaggctggagtgcagtggcgtgatctctctcactgcaacctccacctcctggattcaagcgattctcctgcctcagcctcccgagtagctgggattacaggcatctgccaccatgcatggctaattttgtgtttttagtagaggtggaatttcaccatgttagtcaggctggtctcaaactcctgacctcaggtgatccacccacctcagcctcccaaagtgctgggattacaggcatgagccactgtgcccggccttaagttcttttgaacacttatttcaacttgaagttttttattatttctctatgtctgatgcacctacttgacccccgactccctagagggcaaaaactatgtcttgtttgctcagaacattgccaggcagggaggagaaagatgcaccctgggtattcaagagagtagagtgagtgaatggtggagtcccaggcactgcctttggtagctccaagaccccagggagataccgaaggcagtagcatggtagctcatgcctgtaatcccagcactttgggaggccacggcaggagaattgcttgagcccaggagtttgagaccagcctgggcgacagagcaagactccatctctaccaatatatatatatttttaatttgctgggtatggtggcacctgtagtttcagctgctcaggaggctgaggtgggaggttggcttgagcccaggaggttgaggctgaagtgaactgtgatcacaccaccgcactccagcctggacaacagagcaagactctgtctcaaaaaaaaaaaaaaccccaatagctgggtgtggtggctcatgcctataatcccagcactttgggaggctgaggcaggtggatgatttgaggtcaggagtttgaaattagcctggccaacatagcgaaaccccgtctctacttaaaatacaaaaattagccaggtgtggtggtgggcgcctatgatcccagctactcgggaggctgaggcacaagaatcgcttgaacccaggaggcagaggttgcagtgagccgagatcacgccactgtactccagcctgggggacagacggagactccatctcaaacaacaacagcaacaaaaaaaaacagatgggcttctgtcctgaagcctcagagacatctactgaggggaaactgacgcctgttgtctgtttcccagcaggcagctccctgaagcactccaccactctcaccaaccggcagcgagggaacgaggtgtcagctctgccggccaccctagactgtgagtgggcccacggtccccaacaaggagaggagtaggagggtgggagggcctgtgaggagcaatcgtggacagagggtaaactgaggcacagagaagcaaggggatgagtgaggactctgcctctgtcctgccccagccctgtccatccaccagctcgcagcacagggggagctggaccagctgaaggagcatttgcggaaaggtgcgtgtccacacacatgtgctggcatgtctgcacctggctggtgtgtgcatatgggtgtccatacccactcatgacgtgacctgtgagtgtccacgtgtatgattgtatctaactgtgtgtgtgaccgtgttcatgtatgtccatcaacatacgctccccctcattcccctgtctaaccccagccccccacctcgtccccatttggcagcactggggatagggggcaggggtgcagcctggtggtattgcccgcctcctcctgccaggtgacaacctcgtcaacaagccagacgagcgcggcttcacccccctcatctgggcctccgcctttggagagattgagaccgttcgcttcctgctggagtgggtgcgtcccagcccagctgggcagctggggggttcccgggggccttagggtgggctggggttttggctgtgtctgctggcgccttgtctttgagatgcggctgctggctgggtgcagtggctcatgcctgtaatcccagcactttgggaggccgaggcgggtggatcacttgaggtcaggagttcaagaccagcccggccaacatgggtgaaaccctgtctctactaaaaaaatacaaaaattagccaggcgtcgtggtgggtgcctgtaatcccaggtactctggaggctgaggtgggagaactgtgtgaacctgggaggcggaggtagcagtgagccgagattgcgccactgcactccagcctgggcaacagagcaagactctatctccaaaaaaaaaaaaaaagatgcggctgctgtgggtaccccaggattcctggttatgccccaatccatcctaccactgtcccttcttctccctgcagggtgccgacccccacatcctggcaaaagagcgagagagcgccctgtcgctggccagcacaggcggctacacagacattgtggggctgctgctggagcgtgacgtggacatcaacatctatgattgggtgagggactgcccatccccaggacctctcagcctcctggccttcattcctgcctcaaatgttcacagagtacttgaaaggtgcaggcctgctctaggtgccgagaacacgagacagccccattcccagcctcacagagcagagctccccatgcagggaaggcagacatggaaacaggcagctgagatgcagtgaactgcgctgcgatggcagatgcacaggtggctacaagagccccatgtgggcaagggaaatcagagaggtcttcctggaggaaggtgtctaagcttgagaccccagaaagtgagatgggcccagtgatgagcaggaggaaccacgttcaactggaggccagagagtacaaggcattttgagaatgaggaagaggtaaacctttggtttctcctgcccctacccacgacagaatggagggacgccactgctgtacgctgtgcgcgggaaccacgtgaaatgcgttgaggccttgctgggtgagtgggagtcgggagtggccctgggggccccagcactccagcgggccctgcgggaatcctgagggcagggagacgcccaagtgttgcttgaagagttcttggagcaggtagtccctgcctgctcttctcggaggatggatcagaggggaggaggtggtaggaccacacgggagtcggggtctgggtttaggatctggccaagaggctaagcacctccatcctccatggttcagagacccttcagccacgttcttcagtggagaccaagatagcagaggttggacccttgtcaaaggccacatgggcaacgggcagacccacggctgcattgtggggaatgaggggtgccatgggatctcccaggtccccagaccccattctggactcccaggccccaccctccagcgccctcccctctcctttgcagcccgaggcgctgacctcaccaccgaagccgactctggctacaccccgatggaccttgccgtggccctgggataccggaaaggtcagcctgagacacacagagcaggggtggggtcccttccataggcagggtgaccataaaggggtacatgggacaccccttcagtggtcatacgccggcagcgagagtgtgttgacaggtgttgagcactgctgtgtatcccgcctgggaacatcccagtcctggctcctggggctccacatgtgctggggtagggaggacaatgggtgtcagtggctgtggccatgatgggggacacataggcatgagaggccgaaagaggggcctctcatcaaagagccccaaagtggccaacagaagtcagagaggcttcctggaggaaggtgtcttaaggttgagaccccgagaagtgaggtgggcccagccctgggatggggaggtcagggaaggattctgggggacctgaagggagggagaatggcatccaggtgggaggagtggcccctgcggaggcctggcagtgaggacaccaaggggtaggcgaccaggccatagtgcacagagccacagaggccatccctctccgtggcgggcagtgggtttgaacaggggccataggcagaccccagtttgactccattttctctgtcacaatgggaccccaacttccccatccataaaatggggagatcccaattgaaccgaccccctggggtcatggtagagatggggtgcttaggaaatatccccctccttccttcagagttttactgtgtttgggacagaaatcattcctcttccctcctcatgttttcggggggtttgtttttttgttcgaggcagaaagtcttgctctatcacccaggctggaatgaagtggtgcaggcacagcttactgcagcctcgatctcccaggctcaagtgatcctcccaccacagcctcccgagtagctgggaccacaggcattcgtcaccatgcctggctaattttttgttgttgctttttttttttttttttttggacatggagtctcgcgctgtcacccaggctggagtgcaatggcgccatctcggctcactgcaacttccacctcccaggttcaagcgattctcctgcctcagcctcctgagtagctgggaccacaggtgcacaccatgacgcccggctaatttttatatttttagtagagacggggtttcaccatgttggtcaggctggtcttgaactcctgaccttgtgatccgcctgtgttggcctcccaaagtgctgggattacaggtgtgagccaccacgcctggctgtgttgttgtttttttagaagagacagggtctcgctatgttgcccaggctggtctcaaactcctgggctcaagtgatccttcttccccagcctcctgagtagctgggactacaggcatgtaccactctacccagctaatttttaaaatcttttttatttattttttgagacagagtctcgctctgtcacccaggctggagtgcagtggcacaatctcggctcactgcaacctctgcctcccaggcaaacaattctcctgcctcagcctcctgaatagctgggattacaagtgcctgccaccacacctggctaattttttttttttttttttttgagatggagtttcgctcttgttgcccaggctggagtgctatggcgtgatctcggctcactgcaacttccgcctcccaggttcaagcaattctcctgcctcagcctcccaagtagctgggattacaggcatgcaccaccatgcccaactaattttttgcatttttagtagagtcagggtttctccatgttggtcaggtgatctcaaactcccgacctcaggtgatccacccgcctcagcttcccaaagtgctgggattacaggcatgagccaccacacccggctgcacctggctaatttttgtagttttagtagagatggggtttcatcatgttggtcaggctggcctttcctgacttcaagtgatccacctaccttggcctcccaaagtgctaggattacaggtgtgagccaccaagcccagcctaatttttaaatttttttggtagagacagcgttttgctctgttgcccaagctggcctcaaattcctgagctcaagcagtcctccccactggacctcccaaagtgctgggattataggtgtgagccaccatgcccaggctcatcttttcatgaaagtcacaattcacacattttgcttggtaggaaatatttttatattaattctgaaaagctacaaaagtgcatttttacaaacttaggggaagttgaggttcctggggtgagtcctcggttctcccagctttgctctgtaatgcaggtctctgcaagggtccctgtttgtcccctaaggggagagcgcaggttggcctgtgcctccaccccactcccgattcaagctcacagcccaccttttccctgccccatctcagtgcaacaggtgatcgagaaccacatcctcaagctcttccagagcaacctggtgcccgctgaccctgagtgaaggccgcctgccggggactcagacactcagggaacaaaatggtcagccagagctggggaaacccagaactgacttcaaaggcagcttctggacaggtggtgggaggggacccttcccaagaggaaccaataaaccttctgtgcagaatgagggactttgctgtgcttcccggagggcttcctggaggagacagcccctagaggtctcacaccttctccccaagcacccgcaggtggtagatgaccacacggccaaaaaagtcagtggcatcctcaaacgtcaccttcagccggtccacttcagcagctggtatggggaaagtgtgagcgtgggcagtcaagggaaactggtgatttctggtttcccacccgcaggcccccaccccttccagacccagctcacactccaccgatgtgggcaacctggggaagctgcaggtccctctaagcctctcacacagaacaggtggtcatcagcaccattttacagaaaaagtggagtcctagaggtcacgtgttcaagatcacacatcagggttcccattcgggtttgggtgagtccaaagcttccagaggcacagaccacccaccccagaagcaggggcaggatatctgaagcgagttgttgtcctcagggtagaaatctacaatcttgtggagagcctgagtgccctgtgaaccttcagcagagaaaggcaatgagtgtctggggtgacccctggaacccctgccacccagggccttctagtaccttccaggcagccccggcgactggagaagccaccctgaaactggatctgcagctgggagacacggatgagctggggaaactccagcgtcacccactgggaggggccctggaagcagacagggaaactgaggcgcaagctcactgcaggcacagagccctgctatgcctgtctcattcacatagttcttggaatggaggggaagaaggaaattcggcacatgttcctttcctggccacccatgagggccccctgacgttctcaaggcatgagatctgaatctgaatcaccctagagatggagggtcgagggaggcgcctcacctggtctgagttccaacatgtctcctcatcctggtcgaaaagatgtttttttccaaactgccgagtgttgcgattcagcactgaactcaccctggaggcaccaggatcaaggcgaagagaggggctgagaccagctctcagctccgcggagggcctgacccccagatctgtccactgagggctcgaccccaggcttagggcctcgccactgcctgtccccacagactcttacctgctcactgtctctggacaaaccaaagagtgggtcatgtcggttccacaagacctcgcagggcttaggattgggcacagccttggttcgaatcccggcgcctcctcaagctacagggcggcgcgatcttggctacgccttggcctgaacgtcctcacctgtaacttgggacgagaaccgccactccctcgcccaccccagtcctaaatgtcgcctcgatcaatcccctgccggaaaatttgggagagaggatcagggaaaccgccaatgcccggaggccaggcctttcacaggaaacagatttcccgcgggtttcgggggcggtggctttttgtgcgaggctgtttctctgcgaatagctcttggagccaaatcttgggacccggaaccgcgtgggcttggcgcatgcgtgttgtaattcaggcgccgaccgcggacgctccagaggtggggtttggttcgaccccgccccttcatgctcgcttcttaaagggcccgggttcgatgattgaatttaccttggttcccttgaagctgtagggaaaaggctggctgcgcgcacggggcgctgtccctcggcgcccgaaggtgtagagcactgattttgactgattttggaatccgaaagacttcctttttttttttttttttttgaggcggagtctcactgtcgcccaggctggagtgcagtggcgcgatctccgctcactgcaagctccgccccctgggttcacgccgttctcctgcctcagcctcccaagtagctgggaatacaggcgcccgccaccacgcccggctaatttttcgtatatttagtagagacggggtttcaccgtgttagc

SEQ ID NO: 16245 - DNA, 21361 bp, Human
ctgaaagcagcaacccacatatttgttcacccatgttcatagacatattatttaccatagccaaaggcagaagcaacctaggtgtccaggaaaggataaataaggccgggcgaggtggctcatgcggtaatcccagcactttgggaggccaaggtgggcagatctcttgaccccaggagtttgagaccagcctgggcaacatggcgaaaccccatctctgctaaaattacaaaaattagctgggcatagtggcacatgcctgtaaccccagctactcaggaggctgaggcacaaggattgcttgagcccaggaggtggagtgcagtgagccgagatcacgccattgcactccagtctgagcaacagagcaagactgtctcaaaaaaaaaaaaaagaaagaaagataaatagatccagaaaaatccagaaatttgatatctacatacaatagaatacaattctattctattgtatgtagatttaggaactgactaatttaggaactctttaaaaaatgtttaaataaagcattaaaaagaagtaaattggggacaggcgaggtggctcacacccccagcactttgggaggccaaagagggcagatcacctgaggtcaggcgttcgagaccagcctggccaacatggtgaaactctatctctactacaatacaaaaatcagccgggagtagtggtgggcgcctgtaatcctggctactcaggaagctgagtcaggagaatcacttgaacctgggaggcagaggttgcggtggctgagcgccactgcactccagcctgggcaacgagagcgagactccatctccaaaggaaaaaaaaagaagtaaattggccggtggcagtggctcacacctgtaatcccagcactttgagaggtcgaggcaggaggattgcttgaacctaggagttcgagaccagcctgggcaacagaaggagacacacatctctaccaaaaattaaaattaaaattaaaacaattagccaggcctggtagtgcgtgcgtgtagtcccagatacttaggaggctcaggttggaggcttgcttgaatccaggagttgaagcctgcagtgagcaatgatcacaccactgcacttcagcctgggctacagagcaaaaccctgtctcttaaaaaaaaaaaaaagaagaagaggccgggcgtggtggctcacgcctgtaatcccaacgctttgggaggccgaggccggcagatcacgaggtcaggagatcgagaccatcctgactaacacagtgaaaccccgtctctactaaaaaaatacaaaaaattagccgggcgtggtggcgggcgcctgtattcccagctactcgtgaggctgaggcaggagaatggcgtgaacccgggaggcggagcttgcagtgagccgagatgcgccactgcactccagcctgggcgacagagcgagactccgtctcaaaaaaaaaaaaaaaaagaagaaataaatcctaacacatactacaaggtgaagctcgaggacattatgctaagtgaaataagcacgtcaggaaaggacaaatactttatgacgccatttacatgagattcccacagtcaaattcacgaactcagacaatggaatggaggttgcaaaagaccctgagggaaggaggtgcacggggagttgtgcaacgagacagatttcagtgttgcaagatgaaaacaattctggaaattggcttcacaatgtgaatgtatttaacagtactgaagagaacacttaaaatggatgggaggcaaagaacacattcggtttaaacgcaaacgtcctggcggggacaagccggactgaagccaggccagctcaaccacgccccttcctgctccgctgtcactcagtgataaagaggcggggccattggatctgtccaatcaggacctcagctgaaaagatgtgagcggcgccacgctgggcctgcgcagtgcggacgtcgccattcctggcccatgggaagattgcgtttcacctgctcctgaaggccgaaggtggctctagcgcatcctttgtcgcgccgtgacctgcaggtactgacagatccgtagggaggacaccgtgacttcccggacgctgggaaatggtgagtgtgcggggccagtgtccgaggggaggtttctggttggaaccgtctgtggccgaggccggggacctccttgcagtcaactccggggtttgcagacccgggggccaccgcgggcgcagttcggccctcggtcctctctgtgggagctggacccgcagccgggagccccagcgtcctgtcccgtccccgcggggcgacctcggcccccggtcctggagccctctatgggcagctctgcgcccgcagccccgcgtctccccggattgttcggtgacagcgggagggtcctggggagatcccatctcggtctgtggggtttgtgcgtttaagaaaccacttggttggaaaccttacgatgaatccacgggtgcgtttcctcacttgtgagaaccgaagcctggctaggtccttgctgccggggtcaggttcctgtggctgttcaaacgcccctgccctcatcaccagggactgaccccctctagtgctcccagcactcaagtctgggggtgtttttgaccttctgaatgtgggctttcttttcgaactgcggggaaggggactccttatcttaactgatcagaaagtttgtgtttcttccctttggactccttgatcaaatattaattctagccacccttaattccagtttcccttcgctctgggtaattttgttcccttgcgtgaatgtgtgcgatttttagtttctttggtttctggatggaatttattgtgagcttgttcaggttcttttaaattttcttgtttgtgtgtgtttatctgtgtggtttctacccaagagatttcgcctatgttggagtgccatgatgatgcaaaatctctgtatgtcatttgttccgtatataagtggtaagcatttttttgtgtgtgtgacggagtctcgctctgtcgcccgggatggagtgcagtggcgcgatctccagctcactgcaagctccgcctcccaggttcaagccattctgcctcagccttcccagtagctgggactacaggcgcccgccaccacgcccagctaatttttttgtatttttagtagagacggggtttcaccgtgttagccaggatggtctcgatctcctgaccttgtgatctgcccgccttggcctcccaaagtgctgggattacaggcgtgagccaccgcgcccggctaagtggtaagctttgaggtgtttgtgagagtgatgtttatgacacacaccactttgatacattctgattgtaagtgtatgttgtgattttttctttcctcgtgtggttgtaataggtcagtgtgtttttctctgagcaattaaccagtggaaggttcctaagtctagagtcattgtgggtagttttgttgttgttttttttcttttttttgagatggaatctcactctgtcgcccaggctggagtgcaacggcatgatcacagctcactgcaacctctgcctccctggttcaagcagttctcctgcttcagcctcctgcatagctgggattacaggcacccaccaccacacccggctaattcttttattttttagcagagatggggtttcaccatgttggccaggctggtcttgaactcctgacctcaggtggtctgcctgcctcaacctcccaaagttctgggattacaggcatgagccaccgcgcctggctgattgtgggtattcttttgatgctgatatgtcagtttgggtaccatatctagtttgggtaccctatcctgaaaggtgtagtatatagtttttcagaattggaatactaattatttttgtataaaataatcaataaataatggtttttctaaggtggttatttgtagattatatcttttatctgtctgtgtacttgggtcaaaagctagttgtgagtctcctcatcttaattcaagtaggcttaatatacgtgaccttgaatcttcacatcctgatggtttggatgtatccagttgaactacagctgctttatgccagtgttttgtaaataattttcctgattgtattgggtttctttttttatattttctttcttcttttgagatggagtttcactcttgttgcccaggctggagtgcaatggggtgatctcggctcaccgcaacctccgccttccaggttcaagcgattctccttcctcagcctccctagtagctgggattacaggcatgcgccaccacgcccagctaattttgtatttttagtagagacagggtttctccatgttaatcaagctggtctcgaactcccaacctcaggtgatccgcccgcctcagcttcccaaagtgctgggattacaggcatgagccactgcgcccggcctgtattggatttcttatgttattccaagtctgagttagtataagtacttcgcttagtacattgggtttgcagtcagtctttcaccgtcaagtttattaatgtaaatagattggtttttaagatgcctaccttgtaattgatactgtaattaaacaccttttgatattctgtgaggtcatttatatgagtcatcattgattgtatttcattgtctgtgagatagaggagagtatgaaagtggtagttgacatgtgggagttaagtttgtgtttaaaatcaaaccctgcccttaaataaaactgcgggctgggcacggtgggtcacgcctgtaatcccagcactttgggaggccgaggcgggcggatcacctgaggtaaggagttcaagaccaccctgaccaacatagtgaaatccatctctactaaaaatacaaaaaaaaattagccgagcctggtggcacacacctgtaatctcagctactcaggaggttgaggcaggagaattagaattgcttgaacccaggaggcagaggttgcagtgagctaatgccactgcactccagccttgagactctgtctcaaaaaaaactaactaaataaataaaggtagtttgcatatattgtagccaagcttgccacgaatgtgaatttagtatgtgttgaattatgtcagattctgaatggtgctgtgtctgttcattcagtttgatttgtaaagcttatcggtctaggtatatgtagccattttagtaaattatattgaaaaatgggtgagggtaaggtttttcacctgtaggatgatgaaatacagctctaatatatgttaaggtggaagcatattaatgttggtcatcccttaaaatatgtgtctcattgggtgattctgtacatttttttttataagtttctcagttgtggtgtttaattggtacccttgaaaacaagtatatttaggacaactctgtctacataatcttctgttgttttagcatgtgtttcagaagtcgtgtgtgtaggcccaggtgtggtggctcatgcctgtaatcccagcactttgagaaaccgagatgagtgaatcacctgagtcaggagttcgagaccagcctggccaacgtggtgaaactttgtctctcctgaaaatacaaaaaattagctggatgtgggggctggcgcctataattccagctactcgggaggctgaggcaggagaattgcttgaacccaggaggctgaggttgcagcgagctgagattgcgccattgcactccagcctggatgacagaggaagactgcctcaaaaaaaaaaaaaaagttgtgtgtgtaaagtgatgaggatcagttaagattattgggtgggccaggcacaatggctcacacctgtaatcccagcactttgggaggccaaggtgggtggatcacgaggttaggagttccagaccagcctggccaacatggtaaaacactgtctctactaaaaaatacaaaaattagctgggtgtggtggtgggtgcctttaatcccagctacttgggaggctgaggcaggagaatcgcttgaacctgggaggcggaggttgcggcgagctgagatcacgccactgtactccagcctgggcaacagagcaagactccgtcttgtgggggggaaaagattactgggtgtaatctttgtttccaatctaattctactatgaggatttttttagttctgtcaaagaattgtggttctgtcaaataagtttgacttttggcataattataacaaggttggaaggcaattaatagaaaaagagggaatcctccctaactcattttatgaggccagcatcatcctgataccaaagcctggcagaaacacaacaaaaaaaagagaattttagaccaatatccctgacgaatattgaatcaaaaatcctaaataaaatactggcaaactgaatccagcagcacatcaaaaagcttatccaccatgatcaagttggcttcatccctgggatgcaaggctggttcaacatacacaaatcaataaatgtaatccatcatataaacagaaccaaagacaaaaaccacatgattatctcaatagatgcagaaaaggccttcaacaaaattcaacagcccttccttcatgctaaaaactcccaataaactaggtattgattggatgtatctcaaaataataagagctatctatgacaaacccacagccaatatcatactgaatgggcataaactggaagcattccctttgaaaactggcacaagacagggatgccctctctcaccactcctattcaatatagtgttggaagttctggccagggcaatcaggcaggagaaagaaataaagggtattcaattaggaaaagaggaagtcaaattgtccctgtttgcagattttatgtttagaaaacccatcgtctcagcccaaaatctccttaagctgataagcaacttcagcaaagtctcaggatacaaaatcaatgtgcaaaaatcacaagcattcctatataccaatatcaggcaaaagagagccaaatcatgagtgaactcccattcacaattgctacaaagagaataaaatacctaggaatccaacttacaagggatgtgaaggacctcttcaaggagaactattcaaggagaactacaaaccactgctcaatgaaataaaaggggacacaaacaaatggaagaacattccatgctcatggataggaagaatcaatatagtgaaaatggccatactgccgaaggtaatttatagattcaatgccatccccatcaagctaccaatgactttcttcacagaattggaaaaaactactttaaagttcatatggaaccaaaaaagagcccatatagcaaagacaatcctaagccaaaagaacaaagctggaggcatcacgctacctgacttcaaactatactacaaggctacagcaaccaaaacagcatggtactggtaccaaaacagagatacagaccagtggaacagaacggagcactcagaaataataccacacatctacgaccctgatctttgacaaacctgacaaaaacaagaaatggggaaaggattccctgtttaataaatggtgttgggaaaactggctagccatatgtagaataaggtgagacataggagatcttagaaaggctaaaggtgatcttggagaaactaagtctccatgctgggagtgcactgttgctgtcagtctgcaaattattaatcagatactgtgcttggcaagcagatggtgtaatttgtcatttgtctgcagtggtgtgtatgcttgtgttaccctggtttatgtggttggaatttaagtaataacaagacagtaaagtcactctgatgactagcagaggtgaatgagaaaggcggtaagaccaactgagaagctacacaaatttgtagccaggttgttctttttttttttttttttgagactgagtcttgctctgtcacccaggctggagtgcaatggcgcaatgttggctcactgcatactctgcctcctgggttcaagcaattctcctgcctctacctccctagtaggtgggattacaggtggctgccaccatacctggctaatttttgtattttttagtagagacagggtttcaccatgttgatcaggctggtcttgaactcctgacctcaggtgatccacccacctcggcctcccaaagtgctaggattacaggcatgagccaccacaccaagcccaggttgttgttcttaagcaagtaaacgagttattccagtgatggctacaggtgatgttgaagttaaaaatacgaggtgagtggcaagtaaaactggattgaagtataccttcaattattcttatggaaatattgatgcaatcagtgacttgaagaaaacagtgtagtgccactgttgtaaaaggtgtaacaaatctaggtctagtgagaatttggagaaaagttggagattttgcataattctaagtctcctcttttacctgtagtcaataagtattttcatatccatgggccaagatgtcctgctgggagatagagttggcatttagtcaaatgctccccttgtaaggtataatctttgtatcattgtcttccttatcctttgtgactattaaggttggttgattaaagtaagagtaggaagggccgggggtggtggctcatgcctgtaatcctagcactttgggaggccaaggcgggcagatcatgaggtcaggagttcaagaccagcctgactaacatggtgaaaccccgtctctactaaaaatacaaaaattagccgggcatggtggtgcgtgcctatagtcctagctacttgagagactgaggcaggaggatcacttgaacccgggaggtggaggttgcagtgagccaagatcgcgccactgcgctccaacctgagtgacagagcaagactctgtctcaaaaaaatcaataaataaataaagtaagagtaggaggttgttcttatgaatgctttctcttttatttaaattaaaacatgccgggttaagagcttcttgggatgtgctcactttgtctagggttttcaattctctttttagtagcctggttaatttctatatacatcttgctgctgtgggattatagggtaggtggaaattccattgtgtatctcattgatctgatgtcacttgtgtagtccttgatgtaaaatgagttccctgattatttttaattttaggggcttccaattattttaggagctcttagaaaattgagctgcccaatttcctggcagggcatggtggctcatgcctgtaatcccagcactttgggaggccgaggcggacagatcacttgaggtcaggaccttgagaccagcctggccaacatggcgaaaccccgtctctactaaaaatacaaaaaaattagccaggcatggtggcaggcgcctgttatttaagttactcggaaagctgaggcaggagaattacttgaacccaggaagcagaggttgcagtgacccgaggttgtgtcattgcactccagcctgggcaacaagagcgagactccatctcaaaaaaaaaaaaaaaagatatgttttatgttccagaatgtgggctaccttggtgaatgttccatgtgaacttgagaagaatgtatatcctgctattgctggtctaagtgttttgattttccgttcagtccagttgtttgatggtactgttcagttcaacaatgtccttcctcattttctgcctgctggatctgctattgctgatagacaggtattgaagtctccagctatacttcatggctccatgcagttctccctgccgttccatcagttttgcctcattattttgccactctgtttttatgcacatacacactaaggattgccttgtcttcttggtgaattgatcactttgttattacataatgcccctgtgtcactgagatttccaggatgtgaagtcagctttgtctgaaatgaacatagctgtgttacttttctttttcttagtgttagcatggcatatctttcttcattcctttatttttaatgtatctataactgtatatttaaaatgtgtttcttttcaacaccgtatatttgatccattattgacagtatctgtccaccatttgttgtatttagaccattgatgtttaacatgttattgatttagttgtattaatgtctccctttttctttttatgtttttctatttgttgttgttcttcctttcccatcttctattctttttctaccttatctgctttcattaagcattttacttgatgccatttttctccccacttagcacatcaattatagttttttgttgttttttaagttttactcattgcctttgagtttgtagtacatgcttacaagtaacccaagtcctcttgtaaagaacactgtactacctcactggttgtgcaagtacctcatgaaaaagtattcccaattcctcctttcctgtcctttgtaacattgctaccatacgtatcatttatccataagctggacttaccaaatatattgttcctgttagtgttttggacaaactcatctgtcagattacaaaaaagagattgtattttacttgtatttattttttctctaatacccttctttatcgtttttcttttttgtagggaattttttaacagttctttcaaggcaggtacgctagtgacagattatcttttcttatctcataaagctttcatttctcttccattttgagggatattcttgctctatacagaattctatgtggttgggggttttgtcttataatgttttaaacatttcactccagtctcttcttgctttcactttctgtaaagagtcttgggctggtcctggtggctcacgtctgtaatcccagccctttgggaggtcgaggtgggcagatcacttggggccaggagtttgacacccacctggccaacatggcaaaaccccatctctactgaaaatacaaaaaattagctggacatggtggtgcgtacctgtaatctcagctactcggaggctgaggcaggagaattgcttgaacccaggaagtggaggttgcagtgggccaggatcgtcccactgcactccagcctgggcaacagagtgtgacaatgtctcaaaaaaaagagtctgacttaattcttttatgtttttataacaaagatgttgtttgttccccctgtaacttctttcaaagtttttctttgtcttttaattttctccttgaatatgatacacccaggtgtggatttgggggtatttatgttgcttggcattcctggatatttcctttcatgtataacattaattttgggaaattatcagtcattattgcttcagttatttcttctgtttctttcttgtctttagttagtactattatgtgtatgttccactttttgtaattttctgacagtttttggatcttctgatgtcttgtttctccttttcagtttgacgggttatactgacagttcttcaagatcactcatcatctcttcagacatttccactgtattgatgaacctgtaaggctgttcttcatttctgttgcagtgtattttatgtccttcgttaccttttgattctttgttagaatttctatatatatgcttaaattgtctattttttctttcatattgttcaacatttccatgagaacccttagtatattaatcatatttggtttaaatttctgatctgacaattccaacatctcttctatacctaatctggttctggtgcttgacctctgtcttctaattctgttcttaaaacctttttgtatttcgtataatttttgttgaaaactcgacaagatgtactgggaaaaagaaactgaggtaaataggccttgagtgtgaggttttaggtttatcctactgggttttgtctctgtttactgttttcagtagccgtagatgtcagaggttaaaatttcctttgatgtccttgcttttctctctcctgtcatctttgggcttctctagacacttgttaaataaagtctgaaacatgcagaaagaaacagtgcaatattctttcattgcagtcacctgtttttaaacagaaaccctaatgacaatagtggtaaggtgtaggtggaagggaaacatgttatagtcctatgatttgatctcagtcttttagtgagcctgtgcccgagctgtgatgttttgtgatatgataagaaagatacttagtctttgtgtgtgattcctagcacagagctcctaaatcccttgaatttcacaagtgagaagggtgaaaggatcctccttgtttgcaaagcagcactcttaggagatcctagatgactttaggattaggattggtgaccagaaagacctgcccttgaactttcagccctagcccccagcctcacaagagaaaagaggagctggagattgaattaatcattagtgtgtaatgatttaatcaatcatatctgtgtgttgggaccttcataaatattggggttctgagaacttccatgttggtgaacatattgaggtgctgtgaggatggcacacccagggaatgcatggaaacatcccacctgctctgcataccgaccaatgggcctcttccacttggctgttcctgagttgtatgttttgtaattaaaccggtgatgctaagtatatcactctcctgacttctgagggaggccctagtgaattactgaactataaagggtggtgtgggaactccagatttgtagttggcgtgtagaagcatgggtggcctgggcaccctaccgtgtggcttgcatctgacatgggggcagtcttgtgggactgagtccttaacctgtggagtctgactaattctgggtacttagaattgaattaaattttagggcacagtcgatgtcagagatttggagaatggcgttggaaaagacaccttgtattggtgttgggaagacaaaaaacggttcaccttcacacatgcttctgtgtccctgcccccaggtcacataggctttggtaaaatcatagtaggttgggcttttgttgaaatggaattttttgagaacaggtcttcttaagaagaacattatgttctgggaatattacaaaactgttacttttcctattcatctctcaaattttagagagaaaactttgccttatgaccctcaattctttaatggatccaagaagggtaattgatttgatgtttattttttacttgcacggctgggattgacaatttctacgttccttacttgtgagaccagaaattggaagtctctgacttcatttttttgtgatgtttgatggatgatagctttaaaatctcattattgccaggcatggggactcacacctataatcccagcactttgggaggcggaggcaggcagatcgcttgagcccaggagttcaagcccagcctggccaacatggcaaaaccctgtctctactaaaaacacaaaaattagacgggtgtggtggtgcacatctgtaatcccagctattcaggaggctgaggcacaagaatcgcttgaacctgggaggcgaaggttgcagtgagccgagatcacgctacagcactccaacctgggcaacagcgaaactcggtctcaaaacaaatgaaataaaataaataaaataaaatctcattcctccttttctactatgtaccctacatccagatgtggtaggaagaaagcctgggtcaccctcatttggtgctggtgagacattcaatccacattagcccctgcttgtatgcttgaactcccacactagcccactccctaacctcagtgaaaacccctagccagcctacccgagtcttcccaaagtctcaagtaaacgcgtaataaaccctctcctggtatacaaattttgtagaggtgtaagttgccatacgttcctcctcaggcctgagctctaacttcctagtaatctcctagatccatgaaatgtgagagagagaaaaaggaagaactgagcctgtgataaatattacacaaacaagttgaaattaatacttctgcaaagaaatattttcattcagccagctggatttgagtacttatagtggaacaggaattaaaagaaattttaaaaatgtataagcaaaaactcagttgtatgtaagaaaaaccagttccccctgaggaagagaaagatctgaagtcctttaaaaattgactgcctatttttctgtagctagtgagccttatctctccctttcccaggcattgtgaagactgtttctctagctgtgcagctgcaaggtcactaaacagataatctcaagtcgtaaaacatgttgtcgttccttgaaaagtaagaagtaatgtaatgcgtgttttaattgaataactgtctttgtttctcgcttctgtaatacacttccccctgcacaaatctcctccccaccccacgaaatggttaaaaggtagcttgactctgtttggggctcagttctttggatgttaatccaactgggtcggtgcacctaaataattaaataattcctcctcaacccctcaatctctctgattccttaattactccactgcagtagtggcctggagtccttcaggacatggccagcagctccttgtgacaatttagctttccacaggcctcctggcctctcgtttgttgatgggaataaaagaaaagcctacagttcttgaaggtgtatttatttattaaaaccttatccagattgattccatgcgtaatgaaatgctgagtgatatggtacgtaataaggtaggaaatgagtttttctcacaagggattaatggtcttaaaatttgtttcatttgtatagcatttctcttacttttccagtgtgagcttgagtccacctttagagaacaataaggtttcacatgatcacagtaaaaatttagaagtaattgaccaggcacagtggctcacgcctgtaatcctagcactttgggaggccgaggcgggcaaattgcctgagctcaggagttcgagaccagcctggccaacatggtgaaaccccgtctctactaaaaatacaaaaaattagataggtatggtacacacctgtagtcccagctacttaggaggctggggcacgagaatcatttgagctccagaggcagaggttgcagtgagccaagatcgcaccactgaactccagcctgggcaataaagcaagactctgtctcaaaaaaaaaaaaaaaaaaaaagaaaaagaaaaaggaaaaagaaaaaaatagaagtaatttctgtgtgttcatgacagcatgaattttatgaggaagtcagtgtggacagtcgtagttctgacagctgagtcatacaccaaatgtttggagaacacagaattgtatgggaacttcttacaaatcaagtatagatccccagtactgccagtcttacccatcctctgtaaacatatgtggaatgtttcaggactcagtctcctttgaggatgtggccgtgaacttcaccctggaggagtgggctttgctggattcttcacagaaaaagctctatgaagatgtgatgcaggagaccttcaaaaacctggtttgtctaggtaaggatatcaacatttctttcctcagttaaatatagaacacagaacaagtgtttcttgctcaacagctgtgttccaagatttgaaatgtggaaagggaatctttcagtgattgaatcagacagtcacagctaatcatgaaactagactgtaacaattttctataatttctaataatttttaatggtctttctgggtatgcattttaggaaaaaagtgggaagaccaggacattgaagatgaccacagaaaccaggggaaaaatcgaaggtgagttgcatccacagaaaaatagtggcccgtgggggaatttcaaaagaaagcaagcaaaacaattaagcacagcttcaaatttatttattcctagaaaactttcactgaaaatgttttcttaaaaacatcatagatgttcaggatgtgaaaaataaatcacttcgaaatagcatttagaaaccccttttataaatattattattttggccaggcacaatagttcatgtaggtaatcccagcagtttgggaggctgaggtaggaggatcacttgaggcctggaattcaagaccagcctgggtaatatagcaagacctcatctggggaaaaaaaaaaaaaaaaaaaaaaggcctggcacagtggctcatgcctgtaatcctagcactttgggaggccaaggcgggcagatcatctgaggtcaggagttcaagaccagcctggccaacatggcaaaaccccatctctactaaaaatacaaaaattagccagctgtggtggtgtgctcctataatcccagctacccaggaggctgaggcaggaaaattgctggaacccaggaggcagaagctgcagtgagcctagatcgtgccactgtactccagcctgggcaacagagcaagactccatctcggaaaaaaaaaaaaaattagccaggcatggtggcactctctagtcccacctgctcaggaggctgagatgggaggattggttgagcccaggaattcaaggcttcagtgagctgtgatcatgccactgtactccagcctgggtgagagaatgagactccatctcttatttaaacaacaacaacaaaaaaattgactgttttgatcataactatggttgagtcttcttccagagcattgaatatattaactttaaaacaattcagacagggcagatatcctatactttttctgaaaatggttaaaatgtaattctcatacctactaataaatacaaaataattaaaaagccactaataatgtgctattcattttttacagatgtcatatggttgagagactctgtgaaagtagaagaggtagcaaatgtggagaaaccactagccagatgccaaatgttaatatcaacaaggaaacttttactggagcaaaaccacatgaatgcagcttttgtggaagagacttcattcatcattcgtcccttaataggcacatgagatctcacactggacagaaaccaaatgagtatcaggaatatgaaaagcaaccatgtaaatgtaaagcagttgggaaaaccttcagttatcaccactgctttcgcaaacatgaaagaactcacactggagtgaagccctatgaatgtaaacagtgtgggaaagcctttatatattaccagccatttcaaagacatgaaaggactcatgctggacagaaaccctatgaatgtaagcaatgtggaaaaacctttatatattaccagtcttttcaaaaacatgctcatactggaaagaaaccctatgaatgtaaacagtgtgggaaagcctttatatgttaccaatcttttcaaagacacaaaaggactcacactggagagaaaccctatgaatgtaagcaatgtggtaaggctttcagttgtcccacatactttcgaactcatgaaagaactcacactggagaaaaaccctacaaatgtaaagaatgtggtaaagccttcagttttctcagttcttttcgaaggcataaaaggactcatagtggagagaaaccctatgaatgtaaagaatgtggaaaagccttcttttattctgcaagctttcgagcacatgtaataatacacactggggctcgaccttataaatgtaaagaatgtgggaaagccttcaactcttctaattcctgtcgagtgcatgaaagaactcatattggagaaaaaccatatgaatgtaaacgatgtggcaaatcattcagttggtccatttctcttcgattgcatgaaagaactcatactggagagaaaccttatgagtgtaaacagtgtcataaaaccttcagtttttcaagttcccttcgagaacacgaaacaactcacactggagagaaaccctatgaatgtaaacaatgtggtaaaaccttcagtttttcaagttcccttcaaagacatgaaaggactcacaatgcagagaaaccctatgaatgtaaacagtgtgggaaagccttcaggtgttcaagttattttcgaattcatgaaaggtcacacactggagagaaaccctatgaatgtaaacagtgtggaaaagttttcattcgttccagttcctttcgactgcatgaaagaacacacactggagagaaaccctatgaatgtaaactatgcggtaaaaccttcagtttttcaagttcccttcgagaacatgaaaaaattcacactggaaataagccttttgagtgtaagcaatgtggtaaggccttccttcgttccagtcaaattcgattgcatgaaaggactcacactggagagaaaccgtatcaatgtaaacaatgtggaaaagccttcatttcttccagtaaatttcgaatgcatgagagaactcacacgggagagaaaccctatcgatgtaaacaatgtgggaaagccttcagattttcaagttctgttcgaattcatgaaaggtctcacactggagagaaaccttatgaatgcaaacaatgtggaaaagccttcatttcttccagtcactttcgactgcatgaaaggactcatatgggagagaaagtctaagaatataagcaacattctgaagccttcggttgttccagctccttctgaatacacaaaagagttcatactggacagaagctgtgtgaatacaaacattgttctaaagcccttaattgttccagtttcttttgagcacgaaagaattcccactggtgagaaacagtatgaatgtaaacattgtgattaagccttcagttgacctaattcatttcaaagacaggactcgtgctgcagtgaaatctgttttgttttttgttttttgtttttttaaaaaaggccaagcttgttggctcatgcctatagtcccagcactttgggaggccaaggtgcaaggcaggcagatcatttgaggtcagaaattcgagaccagcgtggtcaacatggtgtaaccccatctctactaaaaattaccaaaaaatgaaccaggcatggtagtgcatgcctctaatcccagctactcaggaggctaaggcaggagaatcacttgaacctggagacagaggttgcagtgagctgagatcacgccactgcattccagcctgtgcgacagaatgagacactgtctcaagaaaaaataaaagtgggaaaatcttccaactgtcctctagagtgtgaatatatgaaaggagtcagagtggggtgaaagtctataaatgtaagacatttgggaaagccttcacacagccttttgagcacacatgagaatgtatactggagagaaaccctataaatattaagaatgtgggaaattcttcatcctagttcttttgttgttgttgatgatacaaaaatattttcatttaataaagattgtcaggttatatttaataagaaagaaagtatcatgtaaacagcccagtaataaaattttacaatcttataaattataacatttttctttaaaactggaacatattctcattatgctttccaaaggacatattgatttagatgtgactcattcttcagtggattctacagaagaaaccatatgagagctaatttccaattcagcaacagcattttttacttctgtagttatttttttctatccaatctggctgagtcttggttgagtagttcatgctgctatttgaggtctctgggtatgaggtagggatccttaagttttctctcataatatgtcctctgttgagacctacactattaagattttcaacacaaggtaactcttggactggccttgtagtaaaaatggagagtaaacatttgacgcactttgtctgtagaagcttggtgcacactgctgctggtatctcattcgttctgtagatggacttctaatttttctctttcttgtcttgctctttcttcaatctctcatttaaacttctctacatattctatagcacgttcatttccatatgactttttagatttactacttctgttacaggcttgccaatgcaccacagtgtagcagttttttgttttctgaggtactatgtggagttatttgtcttacttccaagaagattaaggaatgcagacacaagggtgagattggagcaaaagtttaataagcaaaaaaagaaagctctgtgcagcagagagtggagcccaaatgggttgcccactatgaggctgggtctgggatttttatagactggaaaggggaagaaatgtgctgactagtctgaaggctgtcttggcaaagcatgattcagcctggcccaggaccttggcctgggaccaatcagaggctgaagtgatgattcatagaggctaaagaatgtttaaaaaaaggaagtgcccaccagaacccaccagagcccaccaggtatatgcccataaaaggagtagaggctatttcctggaagcccactaattatacaaaggactaaggcatttctatgttgggccttgttcctttatttaagtgggctaaaggtttgtgcaagtttccttatctgagtgggctaaaagttctatctgtgcagctgtgggcatatctctaggcatgactccctgtgctaattattattattttttaatccaatcagagaccttgttatatgtgggaataaggcactaaccagtgggtcgggggctctccaaaaacccttcccttgctgtttacctgaggcaagctagctaactcctctcacttcttgttccaacacctttttattcttctcaaattctttacatttctgttgtatcgttttcatagataataattcctgttgaagaacttgattgttttcagccagatacagacattttgaagatgcaccttccagttctgctataagattatcagtcttatgttttatctttttaatctgaatatccatttcaagttgactggtttttaaatatccgtggaatctaaactcttcagtttcatattcatttaacttttctgtcatttctgagtttcttgtgcatcctagttcattttgagaccatgaaaccatgcacacatttaagagcagcttcttgaatgtaagcaatatggaaatgtcttcaagtacatatgcaaccctttccactgccttaggacaaattgaaggactgaggagaaaggacttgggtcccaacaggcctttcttggaaccccgtctgaagttaagaaacactcccagcccttagcttacgtacgtgactgcacagaattgagagggctcccacaatctgcctttgaacttttcatcagtgtccttgggtcagatctttggggatgctgtggttctgaaaacaaaggtacatcccacagttctccagtgggatctgcctgtggacaccctaattcatggctgtcaacatcatgttattccaaggccgtctggaggtcatgtccagctccgtttcccatccaaacccacactgtggatt

SEQ ID NO: 16246 - DNA, 152655 bp, Human
  misc_feature (1)...(152655): n = A,T,C or G
agaacaatttcagtgcttttaaggaaatgtaaaatacagctctctggaattacacaaaaagtaatttggatgctaaggatttactactgaaatttactgtcatggtttgaaggagtacaaaaataatatcctctgtttcttacccaagcttagaaccactggagatataagcatatgagtcgtctgctagaatttaaaatatctgctttaaaattaataaagtctagagttaaggcctctatttgtagagtcacaatgggattactagtaatttactgctgaattatacatatttactcattttgtcactgtacacctggacagccacaggtgtagaacagaaaattcttgttgtttctaaaataacaggaatgcagaaggggttgagccatacatgtccagtagtcctcagccttaatcagataaatcagataaatctttcctcttctggaaaatggaagctttcatattgtttcggcttagcagggcaactaacctttaaggaactgccaggtgtccagttttagtatatcagtgaatatccgcaattatctgaaaaggctgttaaaatactcacgtgttttccaactacgtatatattgagactaaattttcttcatctattcaaaccaaaacagcatattaaccaagattgaatacagaagaagatacgagagtccagtcatcttctgttgaaccacattatggagattttttttttttccttttttttttttaagagatagggtcttgctctgccacccaggttagagtgcagtggagcaatcctagctccctgtagactcaaactcctcaggcttaagtgatcctcccactgcagcctcctgagtagctgggaatacaggcacatgccaccatatgcagttaatttttttatttttatttttcttagagaagaggactcactttgttgcccgggccggtatcaaactcctagcctcaagtgatccttccaccttggcctcccaaagtgatgggattacaggcatgagccaccgggcctggatgaaatttctaaaaatgtaaaacaatgccttatgtaagtgataggttgatgggtgcagcaaaccaccatggcacatgtttatgtaacaaaactgtatgttctgcagatgtaagccagaacttaaagtataataaaagaaaaaaaaaaaacaatgctattcttcttgctaaatttttttgttaggaaataatttttttcattaaaatgctaattatgttaatgtgcagtaggtttataattgttacatttaagtaaattactaaataattttaaaaagtctcagttttgattttgtagtatgttaaatgtctatagcaataatataaacaaaagctctttgggattctcaataacttttaatagtgtaaagaggttttgagaatctgtgatctagaggaattcacatataatttaggaagaaagcatagctttataatccaaaatatgcatgttagggcttaaagcagtactttgatgtgaagtatttttgaaatgacagtgtaagttttgtagttatcacactttgtattatttggaatcatattattttgaaatttttctaaaccttcattttttatgtctttaatgtacaacagaggaagtgaacaatgaaataaaatgtttgtaaaactatataattttttatgaacatttaatttttctaagccatagatgctttcctgaacaagctcaataagttataagaatatggaaaaaagatgttctttgataatatttggaatattcctggtatcttacacatagcagaatgaatatttcatatctgagttaagtgaacaaagtgcatttaaaatttttttaatagtacagtctaatgccattttggaatgtacgtggaggttaatttgctattataggaagctctccagtttagtggtaactgtttatccttttgtcatgtaacatatggtggtcataaggttgagtttctgatttttttttttctttaagcagataatctcagtgataccttgaagaagctgaagataacagctgttgacaagactgaggatagtttagaaggatgcttggattgtctgcttcaagccctggctcaaaatagtaagtttcattatgtttactcaaattccaaagaagaaaatcaaatcagtagtcattcagaaactggtatgtagttaagcacataactttgtattcatataacttgaattcttttgaatcatatccctgaatactgagattgttttacatgttctaccctcctacttccctccacgcccccgcaagatcctcaaagccaagctgataggcaaagaaaggaggaattgatgggtggtgatgacattaataccagtcccagagagaggccattgtttcatttctaacagtcaagcatcgtagttgtttttcttagcacctacatctgtgctttaaaaatagattgttttatatgtggggagagtggggagggagagagaggagaaacagagggggagcttaaaacacttaacatttttttggaatcttatcatattttaaaataattgtaccttaaaataatatgtatgcatagataaatttggaaggaaccattagaagtcatcaaaaatcttttgaaattggggtaggattttatctttgatgtgataaataatgctagagatagaaactgcacagttcttcattgaccattgtgttgcattttatttatcctatttctagtcactaatttctgtattatcaccattaatagatcagtatagagtgattttcatttgttatcttaattctgcttggttgtgctgtggttttttctgtacttgtttttaattatgctcttgtcctatcctgaaactaattatgtagctgacaaagaatggaggggaacgtatatattgttaaggttttaattgtaaggtttcaacacttattgatatatgttttttttattttttagtaaaccttgattagaaaaatctaaaataattgattgcagtacttttcatcaaaaaagcacattttagagctagcttttaaaattatttttcagtaattattttagattacaactgtcatgctgtttaatcatagagataacaggaagagatttgaaacaaggagttcaataagagcatccagataaggctcaaaatggtaaagaaaaaggacaggaaaggagaacgtctaagcctgctatccattttagtggacacatgtggctatttaaatttaatacaagtaaataaaatgtaaaaggaagttccttagtctcacttctcagtagttatatttggcagatgaccactctcttggggatcacagatataaaatattcccatgatcacagaaaattcttatggatagcactggtctagaaactaggaagaaccacacgatgacctgatttttttttacatgtgcctgtataggcagctttacacagtaacataattaacctaagtaaattgagtatctcaggtatatttttttgaacagttgttttattataaccttcgtctgttttcagcaacactttttttctctgttagacagtaaacttttaaatagaccatttgctttagatactgaaggacatgaagggtcatattcttggtcatctgtagaggttgcccatttgtctcctaggaagactggaagacaaagagatgaagttgaagggaaatgaagaaaaaagggagtaaaaagtgtatagcttttaaaagaacagatttaagaaacactgagaagttcataattattagattaaattagcttacattagaataagcccattgcggacttattcactgtaccttttgttgaaaatggtcttgtgaaattgtgtatcacaaaatgttaaggccacgtaaccacaaggtattaaaacaataaactctcaccaatttaactaatgatgccccaggaagggaacaaaaggaatgtcttgttaacaatctgaaacaaaatttataaatgccctcaagcctaagactactgacaaagaagaattggaaaaaggagttcatgcagatgttcagtctttgacacctgtcattggatcacttactgtatgtttagcactgggctggggattatagccactatctaatctttcctatagtcccatgaggtaggtattattatcaccatttaaaggatgaggtaacagattaataagcttatttgccttgctctggaagaagccagagtttggatttgaactcttgatttacaaaataaaaaattgtaatctgaataaagtgaagctttttgctgagttcatgtaatgtgaaatcattccaagaagctaggttttaacattgtgttttaaatttttgttttttctttaataaaaatagctctaaatttttattaaagtggataagcctgtttttcttgaactataaagtgatatatgtattttataggcatttattgatacactttataaagtcagcatatgcctttttaacaagaaaaagtaaaatatattagtgagatgttaattttctacagttcttccttgaataaggtgattgagccattgctacttctgtcctcctaaatgtaaaattataaaacatttaacttagaagaatctgtacttgctttttaaacaacaacaacaacaacaacaacaacaaaaacacagagagcttctcgtttcataattcttccttagtgtcaggtgttttaactaaaaataacaactgtaccataattgcacctgatcaggaaagaaagatttctccattctgtacaaatataagatggtaatgtatgtaatggaaatataaacaaaattttattttacagtctattaccctgttactggaaaggttatctctgaaaggaacaaaataatgcttttgaaatttttacactgtgtgatttagtgcatttgaattgcatattacaaatgactgtaatctgaaattagaatttttactttgatgtatggctttagagtggttttctttttttaccattggcagtatttctctctgtaacgtttatactatatgtgtctatcttaagagacaagaagatttgaatacttactagattttatgaaaacattttgtttaagcaagcattttgtgtaaatctatgatctaaattaatataaagtcattcattcactcatataaatacatcagatctcagttttaaaatgtttttagtaaatgtgtgaaggctaccagccaagaaatcagcttctgtttattttggtctcttttgattcagattatagttagaagattctcagtaaatgcttatttgattgtagtatggttactctattttatggttatttggaaatgtaaaacaataggccacctattttcatccccaaacattaagacaggaattgtctttggagaatgtggcatctaaatcaccttgcaagagaaactattagtttaaattaaagtcccaaaggcaagaaaaattaacattctatttgtaataaaaattctatccattttattccattttgaggatgaagaccattttgtgttgccggggggaccataaagtgtgccatacagctttaaactctctccctgaagaagtaagctgtcttcccctgcctcgttctcttttttttttttttgtatttaacttagtttcttgcttgatggcaattcccatttcatacgagagtcacgtaattgtttattttttatagaacaactctgtgagatactgcgtgtttacttgtctttaaagaaaaaaagcatttaatgtctagttccacatctctaatcttctatgataatattcactcacatgttgaattcttgctttattttctagccctaaggtaatttgctagcccttgttctttatttcatttgttgtattgatttttggctcccttctaggctacaatgctaagcatacgtaattataggcaaacttcattttattgtgctttactttattgagcttcacaaatactgtattttttacaaattgaaggtttatggcaaccctaagttgagcaagtctttcagtgccatttttccaacaccttgtgcttactttgtgtatctgtgtcacattatggtaattcttgcaacatttcagacattattattatatctactttggtaatctgtgtcaatgatctttgatgttactattgtgattgttttggggtgccgtgaaccatgcccatgtatgatggtaaacttaattgataaatattgtgtctgtctgactgccccaccaactagctatgccgtaccccctactccccatctctattcctctcctcaggcctccctattgcatgagacacaatgtttaatttagaccaattaataatcctacagtggcctgtaagtgttccagtgaaaggaagagtcacatctctctcactttatatcacaagctagaaatgattaagcttattgaggaaagcatgtcgaaagcggaggcaggttgaaagcaaagataggccaaaagctaggcttcttgagccagttagccaagttgtgaatgcaaaggaaaagttcttgaaggaaattaaaagttctactccactgaaaacatgaatgataagaagtctaaacagccttattactgataggaagaaactttgagcgctctggttagaggatcatactagccacaacattcccatgtcctaatccagagcagggctctgattgtcttcagttctgagaaggccgagaggtgaggagactgcattaagaaaagttggacactagcagaggttggttcatgaggtttaaggaaagaagtcatcttcacaacactgaaagtgaaagatgaagcagcagctgctgatggagaagctgaagcaagttacccacaagatctagctaaaatcattgatgaaggaggaggctgtgctaaacaacagattttcagtatagatgaaacagcttggtattggaagagatgccacctaggacttttataactagggtggagaggtcaatgcctggcttcaaaggacaggctgactctcttattaggggctaatgcagctggtgactttaagttgaagccagcattcatttaccattctgaaaatcctggggcccttcagaatgatgctaaatttctctgcctgttctctgaaaatggaaaacaaagtctggatgacagcacatctatttacagcatggtttactgaatgttttaagcccactgttgagacatactgctcagaaaaaaaagatccctttcaaaatattactgctcattgacaatgcacctggtcacccaagagctctgacgtacatggagataaatgttatttttgtgcctgttaacacaacatccgtggatgaaggaataatttcgaagccttattatacatttcataaggctatagctgccatagatagtgatttctttggtggatttgggcaaactaaattgaaaacctggaaaggatttaccattctagatgccattaagaatattcatgattcatgggagaaggtcaaaatatcaactttttttttattatactttaagttctagggtacatgtgcacaacatgcaggtttgttacataggtatacatgtgccatgttggtttgctgcacccattaacttgtcatttacattaggtatttctcctaatgctatcctttccccagccccctaccctacgacaggccctggtgtgtgatgttccccccgctgtgtccaagtgttctcattgttcaattcccacctatgagtgagaacatgcagtgtttggttttctgtccttgtgatagtttgctcagaatgatggtttctagcttcttctgtatccctgcaaaggagatgaactcatccttttttatgtctgcatagtattctatggtgtatatgtgccacattttctttatctagtctatcattgatggacattcagattggttccaagtctttgctattgtgaacagtgctgcaataaacatacgtgtgcatgtgtctttatagtagcatgaaaatatcaacattaacaggaatttggaacaagttaattccctctattatggatgactttgagtagttcaaaaccagtggatgaagtaactgtagatgtggtagaaatagcaggaaaactagaattagaagtggcacttcaagatgtgaccgaattgctataatctcacgataaaacttgggcagatgaggagtcacttcttatagatgagaaaagaaagtggtttttttttttatttgctttggtttttttttttgagacagagtctcactctgtcgcccaggctggaatgcagtggcacgatctcagctcagtgcaacctccacctcccaggttcaagtgattcttctgcttcagcctcccgagcagctgggactacaggcacgcgccaccatgcctggctgatttttgtgtttttagtaccatattggccaggttggtctcgaactcctgaccttgtgatccacctgcccctgcctcccaaagtactaagattacagacatgagccactgcgcctggcctcgaaagtggttttttgagatggaatctactcctggtgaagatgctgtgaacattgaaatgacacaaagaatttagaatattacataaacgtagttgataaaacattgacagggtttgaaagaattgactccaggttttaaagaagttctataggtgaaatgctatcgaacagcattgcatgctacgggtatcttttgtgaaaggaagagtcaatcaggatgataaactttgtcttattttaagaagttgacatagccacctaaccttcagcaaccagcaccctgattaggtggtggttagtcagcaacattcagcattgaggaaagatcatccagcagcaaaaagttatgacttactgaaggctcagatgatcgctagcatcttttagcaataaaatattttttaaagcaagctgtgtacattgtttctttagacataatgctcttgcacactcagtagactacagtatagtgtagacagaactttttttttttttttgaggcggagtcttgcactgtcacgcaggctggagtgcagtggcacgatcttggctcactgcaacctcctcctcccatgttcaaatgattctcctgcctcagcctcctgagtagctgggattacagatgcccaccaccacacccagctaattttttgtatttttagtagagatggtgtttccccatgttggccaggttggtcttaaactcctgacctcaggtgatccaccttccttggcctcccaaactgctaggattacaagcatgagccaccgtgcccagcctgtagacataacatttatatctattgggaaaccaaaaaacaaaaaacaaacaaacaaaaaaaactggtgtgatttgctttatagtcactttattgaagtgatttggaaccaaactcacaatatctctgaggtatgcctttatgtacagaaggtgttaatctagattactccatgagtcttgtctagcagtaaaaacttttgttgtcatttgctttagtcagctttatgcatttactatttttgaacagacttactttcaggtagcaaagttacttcctaagtaagagagttcttattatcaactgttttttttttcctgtatttgcaatctctgaacatactcctgctgttttagtagagatgaaaaattattattttattctttcatagtagtatcttgaagagatttttacctttttatctagtgttatcaaatgttccacagaagtgatgtatttcttttgcgaactgaattcattattattatttttttttaccttctttactttttttcatattgtatacctcttttagtgattgtgttcattgtccatgagggcttagcactggtgctccttatgaagtagtgaagattcagtttttaccaaataaagacagcatttggagaatataggagattctcaactaaagtgtcaactaaaaagacattgacaattcctgatgggttgagactcctggattgccataggatggtggtggcctcctaaatctgtatctttccatgcattctctaaaagtccacacagatccacaaagagataaaaccaactaacaatattctttgtctccagcataactaggagacagacttcaaattattacagagataaataaatatccaaatctagcctactcagcttcagagaccactgcagggagagttaagactccagagaccacatggacaagaggagagggaaatggggaaccaggagcccaagggtaatagcacacaatgaaaattacctttagaaagaaaaaaattcctaccctagtaggaaaatagtgcgatctggtcttagattagattctaacattggctacttaaaagtgcatggactccaggtgacaggtcaggaaagcaccactttggggatggagttgttcacctttatatacttggtgatgaaaagaaagaagcaagagggagaaatgaagtgttctgtagaaataaggaaaccacaaaatcagaagacatactaattaccccactttggtctcagttcagaagagggagcatttgaactaaaaatcctggatatttatcccaaattgttgcccttactgcattcaatttttattactagtcaaggaaaataaaaaattatacactgaataggaaatttcagataagatacatacataggtgctacaaaaaagaaagcagaaaataagaataaaaacattttagctattaaaaattttccatctaagccatctgtgttgcagttatcattaacagaacaccatgacctatattaaatattcttaaataagcctttgcagatatgaagagaagaaaccttcaagttataaattcagaaacttagaaccaaagtgaacaccaggaagatgtgaaactagagttgaccagaagaaattgaagaaaatgacaaaattgctttaaaaattaagactaaatttcaaggtgcccaaggaagaatagaggtgattgaaaatttaaaaaggggcattgaggaaagagatgcaaacaggcaactgagaagacaaaggatcagagaaaagattataatacagaagatagtcaaaaagatccaacatacatgcaattggaattcagaagaaggaaaacaaaatggtgaaacagagatagtatttaaaagtacaaagtttctaaaagtaaaggaagaccagaatctgttttttgaaagggcccaccatatacttgtgaaaattgacctgaaacagtcaactgaaagacatagtgtaggaaaacttttagactttaaagataaaaacaaatacagaggaaaaaatcctcaaggcctccatgcaaaaatattatttacaaaggaaagaaaggccaggcatggtgacccacacctgtaatcccagcactttgggaggccaaggtgggcggatcacttgaggtcaggagttggagaccagcctggccaatatggcaaaacctcgtctctactaaaaatacaaaaattagccgagtctggtcatgcatgcctgtaatcctagctacctgggaggctgaggcatgagaattgcttgagcccgggagacggaggttgcagtgagcagagattgcgtgactgcactctagcctgggcggtagagcaagactcagtctcaaataaaaaaaaaaaaaaagaggaaagaaagtcagattagcatcagacgtccacatagcaatacagaattcaatagtggtgcagtattttcaggtaactgaaggaataagaattttatattgaaccaagctgcccagtaaaaatcaaagctgtagaagaatcctgttaaagatagaagaatcaagggaatactgtactctttgccttctagaagaatcttcttaaacttgcactgtttaatacagtagtcactcttcaacatggctgttgagcatttgaaatgaagctagtctaaattgagatgtgttgtacatctaaaaaacatacaaaatttcaaagacttagtacaaattaaaaaatgtaaaatagtcattaatagttttagaaatattgattatatattaaatcttattttaaaaattttgtgaaatatttacaaatgctttgtttctgctgaagctttataggccagcatttcttggattgtgggtagtagctgatcaaagtgcttataagacttgggccagtcagtgtgatatgatggaaaatgcaggttagaagaaaataataagtaaattaataataatataatataatataatataatataatataatataatataattggggtattcagtataggaagagaactttttaaaaaaaattattttaagttctggaatacatgtgcagggcatgcaggtttgttacataggtgaatgtgtgccatggtagtttgctgcacctatcaacccttcacctaggtattaagccccacatgcattagctgtttatcctgatgctctccctccccataaccccctctacagaccccattgtgtggtgttccccttcctgtgtccatgtgttttctttgttcagctcccacttataagtaagaacatgcagtgtttgggctgctgttcctgtgatagtttgttgaggataatggcttccagctccatccatgtccctacaaaggacatgatctaattcctttttatggctgcatagtattccatggtgtatatctaccacatttccagtctatcattgatgggcatttgggttggttccatgtctttgctattgtgaacagtgctgcagtgaatgtacacgtgcatgtatctttataatagaatgacttatattcctttgggtatatacccagtaatgggattgctgggtcaaatggtatttctggttccagatctttgaggaatcagcaccctgtcttccacaatggttgaactaattcacattcccaccaacagtgtaaaagtgttcctatttctccacagccttgccagcatctgttgttccttgactttttagtaatcaccattctgactggcttgagatggtatctcattgtggttttgatttgcatttctctaatgatcagtgatgttgagcttttttttcctgtttgttggccgcataagtgtcttcttttgagaagtatatgttcatgtcctttgcccacttttaaatggggttgtttttttcttgtaaattcgtttgtagttccttgtaaattctggatattagacctttgtcagatggatagattttgaaaatgttttcccattctgtaggtggtcagttcactccgatggtagtttcttttgctgcgcaaaagctctttagtttaattagatcccatttgtcaatttttgcttttgttgcaattgcttttgatgtttttgttatgaaatctttccccttgtctatgttctgaatgatgttgcgtagattttcttctagggtttcatagtttggggttttacatttttaagtctttattccatcttgagttaatttttgtatagggtgtaaggaaggggtccaggttcaattttttgcatatagctagccagttttcccagcacgatttattaaatagggaatccttgtcgaagagcagatggttctagatgtgtggtcttatttctgagatctctgttctgtcttattggtctgtgtgtctgtttttgtaccagtaccatgctgttttggttactgtagccttgtagtatagtttgaatttgggtagcatgacgcctctagctttgttctttttgcttaggattgtcttggctatacaggctcttttttgattccatatgaattttaaagtagtttttttctaattctgtgaagaatgtcaaatggtagtttaatgggaatagcactgaatttataaattactttgggcagtatggccgttttcatgctaattgattcttcctatccatgagcatgcaatgtttttccatttgtttatgtcttctctgatttccttgagcagtcatttgtagtttggtagagaacatttttaaaggaaccttaggttcattattctagggttacattctaaggagaaggctgtatatagggtctaaaatatgtcctatgtgcttaatctaaaagcagagattaaaaggagagaacagtgtgtatccaaatatattcttacctaggagtttatagaaaagggagcatggaaaggcttgaatctgggagagtgagaaagaccatcttaaaatcaatctctcacaagccatgagattagtaacagaaacaagatgtataacagtgatactgggtgctgtttgccttccgatatgctctgaagcactgtactttataaaaggcaaaaaaggactctcatgttgtgcagttgccagaaggatataaatctccattggtatttgtagttggtgattgaagccttggcagaagatctgggtttgctaacattagctaatgaatgttaccatttttgcttcttaagtttgctacatttgaaaaactttttatgttcctaacacagagaaaatgtgtaagagagaaatgtgatttgaaatgatgctgtatgccaaatacatactgaagaagatttgccagtctcagtatttatagtaccagtactgatttactataactaaggactacactttaaattatacttggggaaaaagagatgaatttgttctgctgtgtctttctaacattatttttcatcagggttccatgtcactgcacctatagccagctgtgggagtagtctgtggacatataattgattgaagttaactgtcttctctaatcgtataagcagtaacccaatgtgtccatccatttgtgctgttataacagaataccacacaccggctatattacaaatagtagagatttatatttctccctgttatggaggctgagaagtccaagatcaaggtgctggtaggttcagagtccggtgacatgccatacctcattgatggtacctttttgatggcaccttgttactgcattctcacatgacagaaggtggaagggaaggagagcgagagagcgaggcagctctctgaagcctcttttataatggcattaatccattataaagtcctcacctcatactactgtcatattggggattaagttttaatacatgacttttgggtgggacacaacatttaaaccacagcacccactatgtcctgaatgtgttcaagaatataagacatgtaaattggcattttaattgatacaatgaattggaaatgaattaatattagtatctgaataagaattatgtattctcaacagaaagctagtttgatacaaagaaaatagctttaagtaataaatagattagataaatgtgttttcattatctttactgtgattgtagatgtttgaatttgaaattaaaggcaagggtagtatcatgctactttttacttcagtagtgcttgaaagtccaagtgggttctattcgctctagaaagctttcttacatcgtctaaatgctttcatttttacctcttttcagattttctgaatacccacttggcattgtaaaacagagaagattaaggtttcatcattaggtttcatcattaggtatacattggaatctataatgagacattttttggaaataataaaatttagtgaatcatttttttctaatggaagcttctttgtaaaatatatgtcttcttattataattaatttatttgtactgtatttaaaaatttattttaacatatggtacatgtgaggacttaattgtattttttttttagataatcaattttcctaatacaatgtgttgtttaatctgttccttatacatatttctatcatggaataaccatttagtttaatataattgcatcagtgtctgagtttttttctgtcccattaatctgtttgtctaatattgtgctgttaccttaccatgctattttaattatggtagctttatggaggaagtttcctattataaatttatttttgaaaaattgttattgttttcatgggtttgttatatcagaaattttgtaaatactttgtcatgtttctgaaaaatcctattggaattgtaataagtcataaattaatttggggagaattgaaaacttctcaatattttgtctgccaatctaagggcatagattgtatcttctcttattctaatcttctttttatgtctcagtaagattaggtagtttggttcatatgctttccatacattactttttaaaaatattcctttgtattttgcatttttgttgttgcgtatggattttttctgtataacttctaagtgattattgttagagattattgtgaaagatgtcttgatttttatatttttgtatgtattcagccaccttctgttcttcattaaaatgaatttttagctaattctcttaggttttgcaatcagaacatctacaaagtgatacttttgtttcctcttgcccttataactaaagccgacttactgtattgggttaagcttccagtgaaatagtaaataacagtgatatggttagcaccatattttagtttccgatactgatggtatggcccttctgatgtttcaccattaaatataacatctcttgatttttatgtaaaagttctttttcagtttaagaaaataataaggccgggcacagtggctcatacctgtaatccctgcattttgggaggctcacgcaggaggattgcttgaagtgaggagtttgagactagcctgggcagtaaataaagacagcatctctatcaaagaatatatatatgtgtgtatatatgtgtgtgtgtgtgtgtatgtatgtgtatgggtgtgtgtatatgtgtgcgtgtatataggtatatacatatatgtgcatatatgtgtatatacatgtatatatacacacacacccacacacatatatatacacacacacactatatatatatatatatatatatatatatatatatgcgccaggcatggtggtgtgtctctctattcccagctatgtggaaggctgatgctcaagcatagaagtttgaggctgcagtgagccatgattgtgccactgcactctagcctacgtgacagaacaagaccctgtctcagaaagaaaggaaaataaagaacaatttctttaaaaacaaaaagattttaaaccacaaattttttgccgaattaatgtgttgaaagtagtctctaccattttattgctataaagcttgtttataataaaattatttgttgagagcattaataataagggaaccttttcataagaaggaaaatacaacaaagttttataatctttgaatcaaggtcatgcagtatactagtgaagttcagtataatttacatcctcctttgtgtattcagggacaaatatttatctaatgagaattagtatgtaaagaatgattggaattaatgacatgaatgtgtatatcttagaaaaaatgactattaaaacatctgacaaacataggagatttcttaatctagtaatgtatagtttcaaaagttttcaaagctacattcaataaagcattgcttttaccaccagaaaattgtttacacttacaaggtcgtattatatcagcctttaaagtatatctgtgtgcctttaaattaataagtattcatttatttgtttatattattcagccctgaaaatgtgaacttaattgcttatgatttcagttactttaaaaaatgtagttttacacagattcacatattgagtgcgtgatgccaaatgaattttggtgtttcaagatttaataatatatgaatagaaatttttaataaattagaacaaaatttttaaaatacttggccttaaagactgtttttgtggccctagaggaaaagagaaacacatttaaccggaaaaagaggtaattgaagtaaattcttctcctttgggaagaattttgtatgaatcttaattcacacaaatctgtaatttatccattatgttaaattggaagagatattacaccatgggaatttgttttataccaaatttataaatctgttatttcattttttatttttactcatttatgtactgtaattttcactttttgaattatgaatatatgtgaatatgcatgaccaaatgtaaaattgttgaaataggaagaataatggaaatattaaatacaaaatagagagtaaaagattagctcttggctctaagtagtcaaggtaagggaaggatagccaagaaatggaaatgatcccaaatttaaaaagaatttgtagaagcacattaaaaatatatagattctagttgaagaaatatagttgtcagaaatatatcttcttaattgaatataaaatactacgttgttttctatttgctatacaagagtatcttgaaaatgccatattcttaattttgtgtggttcatggtcattttattctctcttaaatctctaataattgaagaaatgtgaatatttcatgtttttagtaaggtagggttcaggtataattttctagggtaatatatgtatatacatatatatataatgggttatataattaagagtctttatttgagttaactttttaaaaaagaagttcacttactaaatgtaggtcgactcattagaatagttggtgagtattcaaacagaattgagctcatactgttgtgctatgtcatactgctgttaaatacttagtttaacgtataacataaatgttaaatacttcatttaatcatagattgggagcattttatacagttatatcatgctttgatgaggtaagatttagactatacacccctccatcttcaggtctcattcattcatttattccacacttagtatttatttagtatgtgccaaacattgtgctatctcacaataatgacagaagcttatttcttttgtggagtagagactgatagataaatgttaaattataatttatcataataagtgctatcataggggaatgttcagtgtctacactagatcttagccagagggctgagaagcaatgaggtatgttcagtacctagtgggactacatatttactgaccttaaagtaaaaattgcaatgtcaaatcaaaagggaataatcataaaataatgaaggacaaaaggaaatgatctgattccagtacttaattcagcttattaaaagttcaaatctttgatttttgattgaattcgttctttaaaaaattgttttagaagacaccagaagtactgcatgtaaagcagaatgaactaatttatattgtattatactctgaattactctgataatatgcatgctgatgttcttggatcatgtaccagtctttgaataacaagttctagatgtatgccatccagtctagtagccaccaagccacatatggttattgagcacttgaacggcaaagttgaaattgagataaactataatctcaaagacttattgctaaaaaaaaaagatttaatttttatattgatcaaaacttaattttatctgtttctttttacctttttaaatattgctgctagaaaatataaagttatatgtgtggctcactttatatttcccttggacagccatggctcacacaaatgcttctcaaattttaggctgcataaaattatttggaaagattgttaaatcgtaaatacttaggccctatccccagagactctgattcagtagttttggggtggggctcaggaatttgcatttctaataattttctagaggatgccaatatgctaatttatggatggcactttaaaccataaggttttaatgtagacagtatcttttcagtgggttgaaaagaatgctgcctgggatgaatcaaaagcaataccagttttcacacaatttgttatcgggtctaatctgtaaataagatactgtcatactgtctagaggaatataaatgtaagcattttgctaggcctctgaagaaaaaatgtggaattttgtcaaagactcttaagtattttttaaaataagtatgtgtttgttgtttttacttcttgtaaagagaaaagaaaataactctgtaaaatgggaaagtaagacctagtttgtcatttccaagacaacagaatttacttacattctaaacaaaggagggggagaacaccgtaggaaaaatcttacatacctatgaaggtcccatcgtgtgtgacattggagagagatcttttacttaaagtatttgctttttcttattttcttgtcacagatacatatgataagaaatatatatgtatatttatgtgtgtgtgcacatgtatgtgtgtgttttgagacagggttttgctttgtcacccaggctggagtgcagtagtgggatccatgctcacggcagcgttgaacccccgcactcaagcagtcctcccacctcagcttcctgaatagctaggattgcaggcatacttcaccatgtccaactaatttatttttactttttgtatacatggggtctcactatgttgtccaggctggtctcaaacttctggcctcaagcagtccttctgcttcagcctcccaaaccgtagggttagcaggcatgagccactgcagttagcttcatttttatgttcttaaaaacaattaggcaggggacaatgaaattggaatgaggagtaagataaggcagcaagaaatcagagtgacaggaggaagaagatagaggatggtaaataatggaaagcagtgaggagatagatgattttactaaagttggggaacaaggcttatggtttcttctactatgatacttgtagacctgtttagctcactattctcagggccaggggaagcattttaataatagtatcatctaattttgcaattcatgaacaccttagtaacccagtctccagctaataattctgtttcatccttaccaaatagcccttatgaagagggaatctttcatcattctttatgaggggatctgtttcattttttcatagccctaagactggaagacactttttaatgttgatccctaatcatctttctgtcagctgctgctcattggtcctatttctagctcctagataaacatacaatgtgctttctccctaacaaatcctctgtatttggtgataactgtcatattccttatttcctgagctggccctcatatgatgacaaggagacagtagattgtagggcagaggttgatactatttttttctaatatttgtgtggtacgtttgtgttcttacttggaaatctttgttgggagggctaagatgatcctcttttctaggagcagtggtatattagggttcttcagagatatagaaccaatggaatgtgtgtgtgcatgtgtgtatgtgtatgtttgtgtagctatacatagatgtatagatatatatatatagagagagaaataggtatgggcggggggagagagatttatttaagggctggtcacggtggctcacgcctgtaatcccagcactttgggaggctgaggcgggtggatcgcaaggtcaggagatcgagaccatcctggctaacatggggaaaccccgtctctagtaaaagtacaaaaaattagtcgggcgaggtggcaggcgcctgtagtcccagctgctctggagactgaggcaggagaatggcatgaacttgggaggtggaacttgcagtgagccgagatcacaccactgcactccagcctgggtgacagagcaagactctgtctcaaaaaaaaaaaaaaaaaaaaaaaaaaaaagaaattggctcatgcaattatgggggttgcaagtccaaatctgcaatgtgggttgtcaggttggagacctagggaagggctgatgctgcagttcaactctgaagactgtctgttagcagaatttcttcttatttgggtaaggtgtgttgtttattctgttcagttcttcaactgatagggcacaatgtcccacataaagagcaaatctgctttactgaaaacctactgatttaaatgttcatcttatccaaaaacaccttcacagacagagacatccaaaataatgtttggccaaatgcctgggcactgtagcccagctaattgatagaaaattaaccatcagaagtggaatatacatttctaggtatcaagatggattgtattgtacaatagttatatgttgggataactgctagtgaggaataccttagcattagaactttacacacaagaagctacagttgggcctggtgtggtagctcacagctgtaatcccagcactttgggaggctgaggccaggaggatcatttgagcccaggagttcaagatcagcctgggcaacatagtgagacctcatcgccacaaaaaaatttaaaacattggccaggcatggtggcaggtgcctgtggtcccatctacttgggaggccgaggtgagaggatcacttcggcccaggaggtcgagggtgtagtaagccatgatcatgccactgcactccatcctgagcaacagagcaagaccgtgtctcaagaaaaagtaagaatcacgatcatgtcctactttttaatattcattgaaataaacctcacaaggaggctccaaaaggcagagaaattgggtcgttgttttgtttcttaaagagacataaggattcatagtctagattttagcacacaatgttctgtgaggtgagtccattttagatgcttgtaattttcttttccatggttaagtgttatacaccttttcattgtactaaaggagcaagcagaatgtttttatttggctcgtaataacttagttatggattgatcatattttcattctgatgtgtgcatgtgggagggataatataaaggcaaggtaattttctgcagtgatttctgaaagcttaaagaacatttttgcatacatttgcttatgaaaaaactataatccaagacctgattagcttaatgcaaagtgaaaagtttagtctctgcatgagctagtgactggtaattatatgaaaaacttcgttcttaacttcaaaagaaatcaagtttccttggtgagagaatcttatcaagattcttaatgagagaatcttaaaatataagacaatctctttgtaaactcaatcctcttttctcttaggagtaattataactactgcaacatcaatacatgtaacttgcttcatctttagtattcccatagcagtttatacatccctccagttgaacttatgtcagtgtgtattcattgtttgtataagcctctttcatttattctgttataactctgtaagaggagggatgcagttctattcaactagcattaattgtgtaccactatgcattagttggtaatcttgccctggagagtttagtggtctacatagataagtaatatataagttttaatacagtataatatattatataatggagctgattacgaagtgttgtagaaacagagatatggattcaactcacatttttaagtctttcaaagtgtcacagaggggatgacattttatccgggtcctgatgggtaaatagacattttataggtataccgttgttttttccttctatctagcttttcttcaaatcttggataataccagtcatctactttttacagcttctcaatactggtagccttcagctgttggtcagaaaattactcagtggtagagaatgttgcttttagaaatgtagtgtctgtagtttcagctggtagtgcttttacatattccttccttgtagaatgtatttttctttttggcttagaatatgctttattgtccttaataactccactcaaatgttaccttatttgcaaacttcatgatatttatacatctttgattgtttctcattatagcttgtacataacctccatagtggtatcaatcacattgaattgtggtaatttattaacctctctctgtctcttactggacagttagctctctgaggatatgatttgtgtcctctttattttatattcccaagatagtagcgactcagtaaaaatacactttccttggatgatctcatccactccatgtctttgactaccaaatatgctctaacaacttggaaacaattacagtgctgtgtgtgagtattgaagtaggggtaagtttgataagcagaaccaaggaatgctgaattttgaaaacaaaatgtattttaaccagctaaaatgtgggggcctgaggattatgggaagaacatcctaagcaaagggagagtatatacaaagtcatagtggtgagtaaagaatctagtccattaagaaactgaaaagcttggtatggctagcaaaaagggtacatgcaaggaagggtcaagaggtgaaaagtggaaagggcataagggatcatattatcaaaggacttttatatcatgctaaacatgatttttacttgaaaagcaagtaaaaatcagattggtgttttaaaaagatcagtgtggagacagtgtgaaaggaaaaaaatgttggcacacctaattaccaagaaaggtggtgtgttgacagtgctggagaatatggcatatagagagagtaataaatgtttacattataggaatatggcatacatagggaataataaatctttagagttccagggcctaggaaatgtgaaagggaaatgactaagggtgaaaggataactgaacaatgttgaagggtccagttaagattataaattatgaatttgtagtgataccaggtaacatacttaataacataatttactgttttaaaatcagggaacaggcaaagtatatggctagattcatccagtgctaggatttaatagcaaggtgagataaatagatagggtttagggtactgcagtaatactagagttgttgaaatcattggtctttttttcttccagtgtaggtaagcatgacatgaattatggaaagagggctgatagggaaagaaggaggagttgaaagaatagaggtttcaatgaggtttaaaaaatgtttaataagtataaaagacatggtagaagagaagactgatcagaaagtgatttccaaatataagctttcaatcatagggtagttctacctatgatgataggccttgggtgtcatattgtggtggattgttaaagagcagtggaaattattaaagtcagggagtgtgaggccaagttattaaccactgtatgtagattcagagttgttcaggatgatggcaggagttgaaggggagaggcaaactgggagtaagctccagtgtactggagggttgttgtggtactaatgatgagaatgggggaaatacaatgttaccagatggcagaggctgaaaagagagaagctgtttttgaatgaaggcagaagacaaaatgtctcagatatttttgagctaagaaaatacaactttagctccaagcctgggtcttggggtagaaaatgaagaaaagagagttgagaagttctgcatgagagtacttcaagggaagtctcctgagaataatctagctaaaagtgaaagataggagctagagttttgtgagtgtctgaatttaagagattcaaagggtacggtaaaaagtgttcaaaactaggtctgagggggaaattccagtgtaaggatgccgctatgggatgggaaagtctttaattggctgtcgtgcagttaatcttttcccagttgctttgctctgtccatatggtttgggagattgtgatccattttgtcattataatcttttcttttcctctctgcttgagagggtgaattctggtttgactaatattatttccctctttgttcccctgaattaggtactgttaaggggcctccatcacacttttttacccttatcatttaaataaggccagcttgtgataccatgcattccctcttatcttagaacatcttgccttggcctttccccatgccagattgtaggatttttataatttcagcatttgtcgtaggtattagggagatctaagcaattactctagtgccatgatatttagtaaatccagaatcaatctgaaaacctttccgcactcatgttaggctgctatgtattactgtatccccacagtctacaaagaacattatatgtttttagaacacaaacatctccaaattcggggctaaggtcatattgccagtctggcttctactgtcatggggtaatcacatgttaaggtgatagggttggaggaggaggaagtatgggaatgtagtgaagcacgagaactaaatgcagtttttgaagacgagactgaactgatagataattgtgaaatattgcatgtgggaagagtttttgacatctgaaagattctgcaagccacactaagtgtctttattccctaagctatcatggaaccttaagtggccacaggagtcgtgccttagtgtggggtatggagagggagatagttttttggtgagcatcctagtggtgttaacagacgcgatgctctatgctgttacctcagccctgatatttgactatatatatatatatttttttttcttttcttctctttttttttttttgagacagaatcttgctctgtcgcccaggccggagtgcagtggtgtgatcttggcttactgcaaccctctgcctcctgggttcaactgattctcgtgcctcagcttcctcagtagctggaattacaagtgcacaccaccacgcccggctaatttttgtatttttagtagagacggggtttcaccatgttggtcaggctgatcttgaactcctgatctcaagtgatttgcccgccttggcctcctaaagtgttgggattacaggcgtgagccaccgcgtccagtgatatctgactatattcttgaacactgaatctagccactctggataaatatcttgcttagtctagcttagtctcttaatacctttcattttaacatgggacctacaaaaggatagagtacagagatcctcaggggatgcgttcctagacccacagtagatgcctgaaactgtgggtggttctgaaccctctgtatacaatgttttttccggtacatacatacttgtgataaagtttaattattaaattaggcacagttaaaagagtaacaacaataactaatgataaaatattattagaacaatatactgtaataaaagttacgtgaatgtgtactcgctctcctccccatctcaaaatactttattgtactgtacttaaccttcttgtgatgtgagatgataaaataccttcttgatgagatgaagtgagatgaataatgtaggcattgtgaggtagcagtaggctgctattgaccttctggggatatgtcaggacaaagatcatttgcttcaggtgatctgagactgttgagccatgatgatgttgatggttggagttcaggagcagataatgttgatgtctgtgtcaacaactaatgggcaggtagcatatacagcgtggataaaggacaaagggatgagtcacattctgaatcagatggaagtgtgagatttcattatgcaactcagaacggcatgcaatttaaaacttacaaattgtttatttccagaactttccatttaatattctcagaccacagttgactgtgaaaatttccaaaaccgtggaaatgaaattatggaaagtaaaactgctgataaggggcaactgctgtagttctctggggggggaaatgaggttctggaaccatggctgatcatcatgaaggttagactgatagaaacctagaatggattaggtgcctctgtacattaagtatgttgtggaatttttgtcaaaatattaaaactgcttctatacatatctgtctcctttactaaactataaactctttcagagcagagtctgtgtcttgttagccatttgcttagcatgttctaggcacttacctaagtatttaatgatgagtcattgcatgaatctagtaactttcttttgagtggctaacctctcaaaattaatagtgtaacttaaatgtatgtgtaatggtgataatatcgtactcccttattagcatatatttctttgaaaaagcaaggaattttctcaagatatatggtataggtttcctcatactttttatgatgtaatatgtattggtttactgatattttttcagtctcatgtgtattttaagagccattatagttgactgttggaaaattgggttttgtggctgggcatggtggctcacacctgtaatcccagcactttgggaggccggggtgagcagatcacttgaggtcaggagttcaagaccagactggccaacgtggtgaaaccctgtctctactaaaagtacaaaaatcagcccaacatggtggtgcacacctataatcccagctactcgggaggttgaggcacaggaatcgcttgaactcggtaggcgaaggtttcagtgagccaaaatcatgccactgccctccagcctgggcaacagagtgagaatgtctcaaaaaaaaaaaaaaaaaaaaagagagaaattggcgtttgaactacacaggtcctcttataagcagattcttttcaataaaagttacaccaagtgtgcctgcctctccttccgtcttctccacctcttccatccctgctacctctgaggcggcaagaccaaaccctcctcttcatcttcctccacagcctactcagtgcaaagaccgtgaggatgaagacttttatgatgatccacttccacttaatgaatagtaaaatattttgtcttctgtatgattttcttaataacatttgtttttctgtagcttactttactgcaagaatatagtatgtaatacatataacatactgaatatgtgttaattgttatgggtaaggcttctggtcagcaataggctattagttaagttttgggggagtcaaaagatatttgcgggttttcgacttactttatttattcttttatcagcaataattaaatccaacacatatacttactcatttttattggttgatttggtggcctaaagtatgtttctctttttagattagtgttgataggttttgtgttttttgtagccagagtatctggagaagagctgtttgaaaatgtccccgttacgtgattctcttttcagaatgattcagtgtaggggggaggagccaagatggccgaataggaacagctccggtctacagctcccagcgtgagcaacgcagaagacgggtgatttctgcatttccatctgagctttgaagagagcagtggttctcccagcacgcagctggagatctgagaacgggcagactgcctcctcaagtgggtccctgacccctgacccccgagcagcctaactgggaggcaccccccagcaggggcacactgacacctcacacggcagggtattccaacagacctgcagctgagggacctgtctgttagaaggaaaactaacaaacagaaaggacatccacaccaaaaacccatctgtacatcaccatcatcaaagaccaaaagtagataaaaccacaaagatggggaaaaaacagaacagaaaaactggaaactctaaaacgcagagcgcctctcctcctccaaaggaacgcagttcctcaccagcaacggaacaaagctggatggagaatgattttgacgagctgagagaagaaggcttcagacgatcaaattactctgagctacgggaggacattcaaaccaaaggcaaagaagttgaaaactttgaaaaaaatttagaagaatatataactagaataaccaatacagagaagtgcttaaaggagctgatggagctgaaaaccaaggctcgagaactacgtgaagaatgcagaagcctcaggagccgatgcgatcaactggaagaaaggatatcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgaggcggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcggatctctcggcagaaaccctacaagccagaagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagcgctaaacatggaaaggaacaaccggtaccacccgctgcaaaatcatgccaaaatgtaaagaccatcgagactaggaagaaactgcatcaactaacgagcaaaatcaccagctaacatcataatgacaggatcaaattcacacataacaatattaactttaaatgtaaatggactaaattctccaattaaaagacacagactggcaagttggataaagagtcaagacccatcagtgtgctgtattcaggaaacccatctcacgtgcagagacacacataggctcaaaataaaaggatggaggaagatctaccaagcaaatggaaaacaaaaaaaggcagggattgcaatcctagtctctgataaaacagactttaaaccaacaaagatcaaaagagacaaagaaggccattacataatggtaaagggatcaattcaacaagaggagctaactatcctaaatatatatgcacccaatacaggagcacccagattcataaagcaagtcctgagtgacctacaaagagacttagactcccacacattaataatgggagactttaacaccccactgtcaacattagacagatcaccgagacagaaagtcaacaaggatacccaggaattgaactcagctctgcaccaagcagacctaatagacatctacagaactctccaccccaaatcagcagaatatacatttttttcagcaccacaccacacctattccaaaattgaccacatagttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacacaacataccagaatctctgggacgcattcaaagcagtgtgtagagggaaatttatagcactaaatgcccacaagagaaaggaggaaagatccaaaattgacaccctaacatcacaattaaaagaactagaaaagcaagagcaaacacattcaaaagctagcagaaggcaagaaataactaaaatcagagcagaactgaagtgaaatagagacacaaaaaacccttcaaaaagtcaatgaatccaggagctggttttttgaaaggatcaacaaaattgatagaccgctagcaagactaataaggaaaaaaagagagaagaatcaagtagacacaataaaaaatgataaaggggatatcaccaccgatcccacagaaatacaaactaccatcagagaatactacaaacacctctatgcaaataaactagaaaatctagaagaaatggatacattccttgacacatacactctcccaagactaaaccaggaagaagttgaatctctgaatagaccaataacaggagctgaaattgtggcaataatcaatagtttaccaaccaaaaagagtccaggaccagatggattcgcagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagtagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggaggtattttaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccgtactacccaaggtaatttacagattcaatggcatccccataaagctaccaatgactttcttcacagaattggaaaaaactactttaaagttcatatggaaccaagaaagagcccgcatcgccaagtcaatcctaagccaaaagaacaaagctggagacatcacactacctgacttcaaactatactacaaggctacagtaaccaaaacagcatggtactggtaccaaaacagagatatagatcaatggaacagaacagagccctcagaaataacgccgcatacctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcagtacataagcgtgggcaaggacttcatgtccaaaacaccaaaagcaatggcaacaaaagccaaaattgacaaatgggatctcataaaactaaagagcttgtgcacagcaaaagaaactaccatcagagtgaacaggcaacctacaaaatgggagaaaattttcgcaacctactcatctgacaaagggctaatatccagaatctacaatgaactcaaacaaatttacaagaaaaagacaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactaggtcaaccattgtggaagtcagtgtggcgattcctcagggatctagaactagaaataccatttgacccagccatcccattactgggtatatacccaaatgactataaatcatgctgctataaagacacatgcacatgtatgtttattgtggcattattcacaatagcaaagacttggaaccaacccaaatgtccaacagtgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgaatattctcactcataggtgggaattgaacaatgagatcacatggacacaggaaggggaatatcacactctggggactgtggtggggtggggggaggggggagggatagcattgggcgatatacctaatgctagatgacgagttagtgggtgcagcgcaccagcatggcacatgtatacatatgtaactaacgtgcacaatatgcacatgtaccctaaaacttaaagtattaaaaaaaaaaaagattcagtgtagttgtagtgctagatatattatatggaattatcagcagtttaccagttggttctttattagtactcctgatgtcttaaacaaaaatgaataattgtttatcttttctcaaagtgtctcatctgttcagtaacaatcacagttttctccgacagtcttgcatattacttttttttaaagtgctttggtttgatatttctttcattcatttctcagaatagaacttaattcttccctcttccaaacatatgctttttaaatattgaatttcctcaaaatatttcatagttaacgcagccaatatcttagccatcttccccaataaatcaaaaacctctaccaaaagttacataaaattattcattgtcatttcagcattaggccatcttttaacctttgggtaattaatatcaaatttctacttggtcagcaatatctcccttttttcttccccattctcaacccctttcttgaacctcattcgataactgctgaatttcttttctttctaggattatacttgaaaggaaattgtgatttattcccattaaactttaaaaacattttggctttatttaagccaacatgattctatttggatttgctttctttttcactacagatcttaatcacttctgtttcttttatgccctgtgtttctacatttatttattttttctttattaatgcttaaattctttccctcctcagctccagcacccatttcccttccttttcttgcttcacaacccttctcctttggggaagttataagattagagtgagatgaccctcagctccactcactaggttacaggattcattattaatcctacagattagttttagtcatgtgagccatggtgattttggtctctttttcttttttggaaggtaggtggaagaaaagacttttgtgttgctctgaattgtgtggtgtgtgcctgtaagagctagaattagtatagtcgtttttctactctgatacaagctagtctgatgacagtgccacacacagacgaggagaaagttgaggagatctcagagaaatgaagcaggagccttgattaacctgtttatgaagctcattctacttccagactttacaatgatgtgatctctgagctgataaattcttctactggagtacagtacagtagtttctattacttccagtatatcctaactgatatatacaaattgtaacatttttttaaaaatctaaagtacagtaagcatattgttggtcagcctaaataacagagagaggctctcttaacagaaatgatatttaggaatagggcattgccatgggaatacatgtgccatgataaactatgcatgtttcagggaagtacaggaaaacaaaggtttttaatagaaaaaaatgagaaggattacataattgttttgagataattatccttggctacaaggatcacactggtctgaggttggacagacagttgctgggcagatgtctttccagaagtattttttgtgtaaggttgtgacagcctttgtgtaaggttgtagtttttgaagaatgttttgtgatagtttttgtcaggcatttattcatgagaaccctattttcatagcctttcctgactctgtttgttaggatttttttgtttttgtttttaacacgagtgactcttgatttcaacagctttaattttctcccttttgatcaagatctttctctgaaggcattgatgatcagtcttcctgtaattaggttttgattgtcccttggtgctgggatggactggtttggtcccacattggagagggtgattggtgaccaggaatcagtgttaaaatttttctagccacatttgagcaacaagggagattgaaggtgagtggttcttggtctaagcctatctggagaccatcattaagtttaattttctctgttttgtaggtgcttgctgtcatctcaaagtgctgagctagtattattttgttaggagttgtacttctgcaaaaatttaacaagtaacagatacaaagtttaagaaaggaaaatacaaagtaaaattcataataatatggcaatcccagtttgcataatggttttgagccatgaaacctagcgtaaagacaactaattaaataattccagtggccatagagaatttggtgagacctattgtaaccatgtggcctgttttcttattttatgtatatggggtctcaactttcccataggaatttatccagttacagcatgtggtattagcaatagcacaggcattttcttatttaaccagttgatacaaaaagatctcttaggtttcattctttcaaactaccagcagaagccactgattgttaaatttcagttatggcattctcctatcaagtgaaaaaaagtagcattgaggtgcgtaagagtcttactattatataaaagtcttgttccaacaccttgggaaaaaccgtctaccatgtaaaaatgtcacctccttgtcttggtttgcagtttgaatgtctctagttagggcatcgggtggtttggtgaactttccgtgtgattcgtacatcaggcccaggacttgttccttcagatccatctagtttcagtttataaagctttaggaaaatttaggattcgttctagtctacaggtagataagaactattttaaaacaatgcacagagctacaatctaataaggatgtgttttatagttttttttaataaacataactttctctgtatagtcatcgtgatttatttatttaattttttgagacagagtctctctctgttgcccaggctggagtgcactggtgcgatctgagctcactgcaacctccacgtcctgggttcaagtgattctccaagtcatcctgatttttatcaaagataatcagagtaagacaaacttgtttgtaaaataagttttatcaataattgcctgtaagaagtgatttgatcacacggtattcccagatttaaaaactcttaaggctgcaaagccaaaccaaggcagattttagattttacctacactcttaaggttcctgagcttgtgggaagtgacactttttactcactcactgtgaggctgggaacccttgaaaccaagcatcgtatgcacattctcaaatatgatatttcagtcaaagccttggtaacacaaccagtgtattttattgtatcttgatagaaaaacaatagatttttattgaacctttcagttaaccatattgccataagaatactcacaaataatttttgaattgggggggcagtcaaataaggagaaaatgcaactatttctacctttgttcataaaagtatactttattaaattgcctaaagagaaagtttccttaaatctggaaaacagaacatttaagtaaataactaatagtgtttcatataaaagtcatggaaacattatctttatcatttatttaatctcatctgttttatttttgcttcatcttaacagtcttttgaacccatcagtttattagtgttctagaaaaaaaagatttagtccattaatcttaaagttattagaaacctgcatttaaaaggacccattagggcaaggtgtggtggctcatgcctgtaatcccaacactttgggaggccaaggcaggcagatcacgaggtcagaagttcgagaccagcctggccaacatagtgaaacctcatctctactaaaaatacaaaaaattagctgggcatggtggcagacacctgtaatcccagctactcgggaggctgaggcaggagaatcacttgaacccaggaggcagaggttgcagtgagccaagatcatgccattgcattccagcccgggtgacagtgtgagactccatctcaaaaaaaaaaaaaaaaaaaaaaagtgcccattagggccttttctgttaatctgattgtaaatactttttttttattccagtatttattgtgcacaagtgaccagatacatatatatttccttatattctcctcttttttttaaatttttttagtatttattgatcattcttgggtgtttctcggagagggggatttggcagggtcataggacaatagtggagagaaggtcagcagataaacatgtgaacaaaggtctctggttttcctaggcagcacatcctgcactgcccttaatccatttaaccctgagttgacacagcacatgtttcagaaagcacagggttggggataaggttatagattaacagcatcccaaggcagaagaatttttcttagtacagaacaaaatggagtctcctatgtctacttctttctacacagacacagtaacaatctgatctctctttcttttccccacatttcccccttttctattcgacaaaaccggtatcgtcatcatggcccgttctcaatgagctgttgggtacacctcccagacggggtggcggccgggcagaggggctcctcacttctcacacggggcggccgggcagaggcactcctcagttcccagatggggtcgcggccgggcagaggcactcctcacttcccagacggggtggcggctgggcagaggcgctcctcacctcccagacggggtggtggccgggtaaaggcgctcctcacctcccagacggggcggccggacagaggcgctcctcacatcccagacggggcggccgggcagaggcgctccccacatcccagacgatgggcggccgggcagagacgctcctcacttcctagacgggatgacggccgggaagaggcgctcctcacttcccagactgggtggctgggcagaggggctcctcacatcccagacgatgggcggccaggcagagacactcctcacttcctagatggggtggtggctgggaagaagcgctcctcacttcccagactgggtggccgggcagaggggctcctcacatcccagacgatgggcggccaggcagagatgctcctcacttcctagatgggctggcagctgggcagaggctgcaatctcagcactttgggaagccaaggcaggcggctgggaggtggaggttgtagcgagccgagatcacgccactgcactccagcctgggcaacattgagcactgagtgagcgagactccgtctgcaatcccagcacctcgggaggccaaggcgggcagatactcgaggtcaggagctggagaccagccccgccaacagggcaaaaccccgtctccaccaaaaaatacaaaaaccagtcaggcgtggcggcatgtgcctgcaatcccaggcactcggcaggctgaggcaggagaatcaggcagggaggttgcagtgagccgagatcacggcagtacagtccagcctcggcaacagagggagaccatggaaagcgggagacggagacgaaggagagggggagaccgtggaaagcgggagacagagaccacggagagggagagggagagagagagggagagggagagagagagggagagggagaaggtaaatacttttataaaaattcaaaacagtaactgtggatgtcagagacttaagagtggctatggttaaaaatccaatggaagtttattatcaacaattgacaagaaaatttagttatatttgtggcatatgacatattatctagaattctgactgattacattagatttctgcattttatataattttggaacattcattatctgtaacatacacatacatgtaactgaaagatctagtatcacctaccatttgacaatgtttcttattcaatttatccaataaccctaatcacttaatatctctacaagatgagagatacattctttgatgctctctaggagcccagtggggaaatcccaaagttaattctaggtcaaaaaatcttaatttagaattttgagcttgggaaagcctgccaaagatgtcaaaaggttcaaaacacttgaacaaaacagtagcacaggtcactgtgaaatcagtcttttttattattattatttattttaaccagagtaataatcaaaagacttcaaaagcaatacagaaagttacatggattttaaaaatcttaacccttacaaagctcagtttccccaaccaatcaaaaatctaataaagaccacatgaagttatcttgataaaatgcaaagtctttgtttctttggccagttaccaaaaaggtaaagagaatttttctgcagtgtaattgcttcttcttatggtaaacccatttagatagcctggaagttgaacctgatgaaaaaggtacttcaggttaatcagacaaaggagaagtgtgtctaaggttatgactctacaccttattatagaggaatgtaaacaataaaattagtaccttgagcaggggaacacgtggatcttagcagcagcctgagaaatttcctggttacatggaataattgagatacatcaggacaagacaagagtgcagaatcaagttttactaggaaacattgcttttctagtccttcaagacagaacatttcagtttcaggtcacaaaaacagagttagaactggagaaaaaaggaactgatgaaaaagttaaaaagagagagtcccagttattgtcccagctaaacaaaaagatgtatttttcaagaggagaaaggaggagagcagaaggcaatgatgcatgacctgcaaatcatgtgcagtgagacacagcagaatttaaacttctgagctatgaatatgagaagctttaagaggaaaactatacctcaagaaatgaaattaccattctaaatgaaaaagacagcatttccaacttgaaactagggaaattagatggaatctgttagaagatggctaagagattttagaattaaaaatcaaaatctcagtacttccaagaaaaccttgttctaacacaggggaccaaatttttagttttgtatcagtgtatttttagtatcaaagctcaatctttagaaagacttgtaaataattcccttctaattatagccaacttgatcacacacaatttctttcctaaattcatctttctcaaacctttcgtgagctgcatagacctttgacaacatgcttagactttttgttttgtcctatatgtcctctttcttaaataacgcaccatctttaggttgaaaatttaccacaagattctttctcatacaaaattattctctttttctttttaacctttcttaccaaaaatacaatttcatacctgtaatttttttaatatctctctttcctacttattttacttattggttccttttcttatttccttcttaaatcatattttgaaacaacctttaacctctgaattagacaaaatgattatctcaatagcgaatacatttttatgctttcatcgaaaacacatttttgtgtactttgtttacaaaattatatatattagaattttaattcttagtaacaatttttagtgaaaacataggaagcaagaaattttgaactgttcattgtatatcagtacttttatagatgagaatcattttgtaatttcagaaaatgtttccccataatttttatgttaaaaatagacccaaacatatttaggctttttataaaatttaagaagctaagagcaaacttacaattatgttcagcaatttatgttttaatgttttttaagaatcttaattggaaagacccagacatttaatgaatatctattacttaatttaacataacagtgggaatttagattgcctgaaaagttcatgggtaaacatttatcctgcctacatttacctggtttatctttaacaattatacctagattacttatgaaagttgagatactgggtaaaactagtcatcatttcaagttatttttcttttaaccatttatatagactgaatatcaggcattcacctaagtaagaaactaaaatatattggtattttgccaataactcagaacacacagctgtttttattaaactaaacagtgttacattagtcttaccaaagaattataccaacaaagattattctgttttaggttgggtttatagtgttatggccttaaaacatctagcagagacaaatataatcctgtctgaccagtaaacttaggcaaaaatgtatgctgataattttgaatacatttttattaagttttaaaaccagcttatttatcaaagtttttttaagtcacgtgaactaaaagacatttggcttaattactatgtatttcatgtaagcgctcatttatttaagccaatctgaatagaattccttaagggatttctggccaagtacatcagattttactatgtagacataacatacaacataaaatatgtgcatgtgcataaacacacctaagcatatatacatacacacaaaaattttggggtaaaactgtttctatagcagtttaaaaaaacaaaaaaaacctcttttacccttcccccacctttgactcagtttcacatgagtttagggttaaatattcaatgtttacatttttagctaggactggctgaattgtatgagaaaaacaaaatttctaagtggcattgaattttcggtaacaagtctgtcttttgtttgccagtctgatttgcttgactagtcagcgtagcagggaaatcgtttagtgtgtttttggttttttgtttttcacccccgcatggcagaaaaaggaatttttatgctagacagagatactttatattgtttctttgagctcaagactttcaagtgtttgatctgagatcctaacttttgtgagcactatatagttctttttcttttagactatgaatccttcagttaactgtttctttaccctaagcaattgttagtcaggcaaacctaaatttacatttccaaaagatacttaagtcgttagttgtcatcgagctgttatactttgtaaagctattaatttgaaagtcctttaatacttttttttttttaatcttggctggaattccataagcagtgagttttatatcaacaccagtaggaaaatcagcagaatcaaagtaagcaaaaaaaaaaaaaaaaagagatggggaaggtagaaggctttacatgtcagcttaatatttgcaggttttttgtttttttaaaaagagagtttgaataatgactgtttgagctctggattttcctcgatatacttggtccatcagttaaaaaatgagaataggccataagatgtagcctgctgaagtcccctagaacctgacatgccttaatgtttgagaattccattccttttcttattaatctctcaaaagtacggaaaatcccataaattctgtcagggtatgtcaggactgttgttttaggtgctggtgactgtcctactggcttttaattaatcattctgtgtccatcaggctacaaggatcaataataagagtgaggccagtctcaggttggtcatgcagttgctgggcagatgtcctcactgaggttgtaagtttgtgatggtctttgtggtttttgcagtcttctgtgatagtttttgttatcagggatttatgcatgagaacactctcttcatgaccttttctggctctattagggttgtttgtttgtttgtttttaaacacaggtgactccattttgatttggacaactttcaaattgtatagaatgtggaaaatatgaaaaagttttttttttattttacaagtttgaattatttcacataaatgtagcttctttttaaaaaaacttatctttgaatgtttatcatattaaatattcttttaaaatgatattattaatgactatataatgttcttttagaatgctagaccgtagtgatagttgtcttttaagatgatactgtgagccacttcactctttcctttggccaagattaatgttgattttaagtgacttcttacctttttttttttttttaacttttctgtgtacctttctgttgttttattttcctgggaaagtggagtaaattttatatcatacttgtataaagtagtatttccttaaatagattccttggattactcattttcttagatgccctattaagaagtgacttacttgataaacagtgtatactcctattggctcacagtaaacattagcaaattgacgacttcaaaaaatcttgcagatgctaaatctctttatctttatttacttcatattttcccccagggtatctgacaatagaatggagatagatcttttgctgaaaatattttttcactatgttttattgtgtcctcattctcttagtctgcagtaagaaatctgtatttcttataggtaaatattcatatcttcagtaattcaacttcttggtgaacaatctagttatatactctgcttataccacagtcattaacacatttcctcatggtgtttacattctcaataaatatatcttattttttaaccatgtaactcttaaattttttagcaactgctttatgacctacttagtggtaattttaaagaaaatagtcaaactagcagatctccctgcttattctagtgatgatttccacacacataacttctcccactcccacatcctacattatccctggaattgaaatgagtacaagactatcaaaatcatttactgtaattttataaaatgagtctcacaacttagttttttagtgagatctgtttctgatggtgaatcacggtataaatgggtttttgttctgctatctttcttttcatgacttcatatatcctttttttaaactcttgcatttcatgttccttttgtttatttaagatcctcaatcagttttcttcactaggggaagaaagtgaaagaattcactttcttgtcgtcagtgaaagaattgccatttttttttattcccatccctgccacctccactgcaaacactttcattttcttttagaaacattaatttctcatttttctggcccttacattaagctacttatattcagcatatttctcttctgtgttttcattctgggttttttttgttttgttttgttttgtttttgttttttcttgaggcagagtctcgctttgttgcccaggctagagtgcagtggcatgatctcagctcactgcaaactctgcctcccaggttcaagcgattcttatgcctcagcctcccgagtagctgggattacaggcatccaccaccatgcccagctaatttttgtatttttagtagagatgaggtttcaccatgttggccaggcttgcctccaactcctggcctcaactgatccgcccaccttggcctcccaaagtgctgagattacaggtgtgagccactgcacccgtccttcagtctgtttcagcctgcttcattctttgtatatgcagttgcttttctctcatttaatcactgcctcagtttagctatcccaaaatactatacatctctttctcactcagttgtcttactttagttcttactcttgtaaaatgtgttaaataacaatatttttcacataatgatttggcaaatcaggtcaaaatatagtcatcaacatataacttctaaatgacagttgtagtaggaagagctttggagaagaaatcacaaaagctggtttcttattccttttccagtgtaatcttattatatggccttatttgtaatatgaagaacatgacctatcatccctatctcagatgactttttaaatgaagagattaatgtgtttgaaagagctttgaaatttttacaaatgctcttaataaaaaattaagacacagtgtttatggaagtcagataacattaaaaagattgaatagctttcagtcaggtaccttttaatgaggacagtgtgagtctaatgagtaggaattagctaaaatggtagggtgaggggggtggcatttcagagagggaacatcatgtgcagaaaggagttatgaaataagatgattagtatggattactataagtaatttagtatggctagagtgtaggatgtccatggaggagtatcaagagataggattaggaaatatggatgtgcttgaatgtttaatgaaaagatgtggaggattgcttaaaaatttaaaggaatgacataaactttgcattttcagaagtttattcttatactattgtagatgaaagatgcggacagggcaggggaggcaaaccggagttagggagacttgaggaggctattgcatttaacaagggtctgaactgagaacttgaagtaatatgaatgtagaaaggaaaaagatagatgcaaaagacaatagtgaaatggaatctatgggacctatgttctgattaaatgtgggggtaggaagctatttactaaaagagaaaattttataattattctagggcttctggcttaaatgggtttcctaccattcactgagttagagaccaaaatgaatttaaaggaaagagggtaaatttgattttgattttgttaaatttgaggtatttagcatatacccaagtgcaaatgctttgttttctgttgcataaaaggagagaggattggggacttgtctctttggtaattgaagccttgggtttagatcagatcacccaaagcagcatagggctaagtctctttgttacaccctatttttaaaatctaccccttgagaaatatacaattccccagaaaccttgatatccatggcccccctttgattcatatttgtggtccttaatcccaagtctgagccttcagtgaaaacctgtcttctcacaatctgccgtaaggatccctaggccactattttaccacttttttattgttctcataactctaagtaaaacttaaaatgttttttattactctaaagctatattaccaatctaatccaaatacacttttaacctaatagagtcttagtaatagcagtcattatttttatttttttaacttggagtttactataaattggtcaattgcttttcattagtttatcctcatgaaacctatatgataatataacatcataaattcagtttattgtagtagcatacctggaaattccctcttggtatttaactgtaaaggcaattattttaatatgtttacttggcagctttgtttggaacttgagcctttctcaagctataaccttaaattatgagttccctcccattctccttactccctcctttgtaatactttgtattgaccttgacgatttgtgtgagttgtgctttaaactctgctcatatgacattataggctggcttcttgatttactcttattccaagtttctctggcctgattgcccaattttccttttctttcctatatctggcagtgtcataactaagctgcctccttgctaccaggaggtcaggtggagtgaggacatagggcttcagggacagaatgagtgctggaagaacttcaggggctattgtgatggatatgactcctgcctcagctcacacagatactattttaaagtagcaattgcccgtcttatatgggtcctcaaaattcaaaaactgccagttgcctataatttgtaggcattctcaaacatttttgtcactgcacctagatgtgaaggaggagaaagatgttgaattgattcctgcaaacattaaaaaggagtgtagttaaaatgtcaatagtagtctggctacagatagtgaagagtctaccttttttttttaaacaagacttctgatcacagtgcatcgtttttgatttttttttttaacaagtagccattcatttggacatggaatcatcaacccctgactactccttagtgccattttaaaattgtttcaagggttttcacagatatctgagaacatcctcagttcacaggtcaatatacattttgagatacagtgtaatgccagtgcaaaaagtatatatgaaatgaagttaaaactttgtagtttatacaagctggaatagctattattaaaaagtcaaaaaataacaggtggtggtgaggttgcagagaaaagggaatgcttatacaatgctggtgggaatgtaaatagttcagccattgtggaaattagcttggccattttacaaagaacttaaaatagaactaccattctacccaacagttgtattattgggcatgtacccaaaggaatagaaatcattctacaagttggaatagctgttattaaaaagtcaaaaaataaaagatggtggtgaggttgcagagaaaagggaatgcttatacactgctggtgggaatgtaaatagttcagccattgtggaaattagcttggccattttacaaagaacttaaaacagaactaccattctacccaacaattgtattattggtcatgtacccaaaggaatagaaatcattctacgataaagacacacacatcgcagcactattcacagtaacaaagacatggaatcaacttaagcccatcgatggtatactggataaagaaaatgtggtatatatacaccatggaatactacatagtcataaaatgagtgagattatgtcctttgcagcaacatggatgaagctgtaggtcattatcctaagcaaactaacacagaaacaaaaatcaaagaccacacattctcacttaagtgggagctgccaggcatggtggctcacacctgtaatcccagcacttggggaagcacttaaggtagatcacttgaggcagatcacttgaggccagtagttcaagaccagcctggccaacatagcaaaaccccatctctactaaaaaatacaaaaattagctaggcattggggtgcacacctgtaatctcagctgcttgggaggctgaggcatgagaatcacttgaacccaagaggcagagtttgcagtgagctgagatcacaccacttcactccagcctagttgaaagagcaagactccgtctcaaaaaagaaaaaatatatattcacatatatgtatatatgtaaatatatatataaaaagtgggagctaaacattgagtacatatggatacaatgaagggaacagcagacactgggacctacttgaggagggagggtgggaggaagatgagtattgaaaaactacctatcgggtactatgcttattacctaagtgactaaataatctttacaccaaacccccatgacatgcaatttacctatataagaaacctacccatgtaccctaaacctaaaataaaagtttaaaaaataaaaaaatacactttgtagttatttattggacagtggtgtttgagtgataaagtacaaatttgttctttacttttttatgtcacagaaaaatggtagttcccagacgtttacattctaaacctatatagaaatctacatgctagcaggtaaaaataattcctgttagatttttctaaatcgtaaatcagatttatgtgaaaaaccaggttatgtttttcccttttatttctttgacaatagcagtgaaaatactattttcaaattctggattcctgtttagtacagctattctcccagttcactggatttaatctgtggaaagtgtcattggagtgcaagagttagcattgttttgttttgttttccccttgcccctgacattccactatgatattaagccactcttttagttacagttaaatgagacatgcatgggtgatttgcagttaactgctcgcctccacacataacaaatgcttcggcttcatatctaatcatgattcatgccttatgccagactcttgctgtcatcccagtaccagcagatggtggggctagacccctggggcagtatgacccagtgttctaaggttatatttcttctggtagcaatggtcagaaaaggaaagattttaacatggcaaattaagtttagttctttatggctttttgcttaaaaaaaaaaaaatcttaggtgtcacattttcacgtggttccttaaaaacttactttttagtccagtaaaataaactggagtgttatcattccttaactccaaatcctggtagtcaaggggtacaaggagcagtggtttttcactttcctcaaacccatgattggaaatacattttacatacagtacatatatacttacaggcacatatgcatatgcatatacataattcaaaccaaaatttcaatcataatgtttgaccttaccatgtgcaatatttttctcttcttttttgttgtagatgttgttaattcttttattttaaccagtttctagtcttcattccccaagtagattttagcgctcataatggattgggacccacagtttgaaaaactgtattaaacaatcagcacttattataaagaaatatgttacgtacttttttgtggactttctcaaattataaaaaatgattttcctcctctttactgatcacatcagctgccatttagttaacaagaaatttttagggttctctattatttgtatgtatatccaagaatctaaaggacatagaggagctacatatagaaacaaatttcaattgaatgttttaatgagccttataacctctagctttaaacacatgccatttctcttcattgttcacaaataataattttatttctttgagcttttctttatttttaacatattttaataggtcattctttcagtaacatacatgaagtagcttgtttttataggcccattatttgtattttaacaaggaaaggaaagaagtgggggcctcttgaatttctgtatcaccaaatagagttcagaatactatgggtttttgcagtgtactatttctcttcttcattaatggtgatgtgaatgagttgcatgaaaaacataggagtcataggaaccatgtaatcccttgactatcacttttcattccgtataaaatgataggaggtgagttttttgcctaattgccattttttaaagttgctatggcattatagggaaccatagagtttatataaagtgatagctcttagaattcagaagagatgtagaaaaaaagcatttatattctgaatagacagggttagaactaacattgagagtaagtttggtatgcaaatgatatattcagaaagaacttctttatagtctgactgtaaataaacaaaatattatattatcaagtgttttgtgccgattaaaactcaaaataaaagcagcttgtggagcagaaggtaattttgtataaagacatatatttgaatgtataccgaaactaatttctattatgggtgggaaaaattcttgaagaatttattgtagataatggttgtcagtgttagcattaaagattttcactgaagctctttgtatgtatctcttttagatacggaaacaagtgaaaaaatccaagcaagtggaatacttcagctgtttgcaagtctgttgactccacagtcttcctgcaaagccaaagtagctaacatcatagcagaagtagccaaaaatggtgaggtttacctcaagaacttttctgctgggaacgtcttcagttttacatcttacttgtcagtatgctttattaatttatgttttaattttgtagattagacattttttatttctatttatcttttgtttgactcttcatgtaattgttttaaatggctatagttacagtcattcatacctgtcccatctgataacccattccttctcagtagaattatgggaaagctctgctgccctcagctatacctgtgttatttattactttgggtataagattcttgaacttgccactgagtcattcatctttattgccataagagataatatatttttaaatatttatgtttgtttgtgttatacccacataaactcactgttcttttttagtttggcctattgttccgacattggcacttcaacagtatagttggaatatacgttctattttctacactcaccatatatttcttaagtttccatgtaagaatactctggaaaaacaataatgacaacaaagtttagattgtgtactatttatacactgagagattctttggatgaattatatcatagcataaatatttgcatgtggttttaattcagtccgtttgagaaaaacactgaattcctaaagcaatgtttaagcatataagaaggccgtactatatataatacctttagtttgcctcagtttgtcagttttacattattttttagccttttattgtagtatgtttcatatattattctttaaagtgaaggaatttgcgtaatcatcatggcaggtggctttgtaaagtaccagtatatgttggtttgggctggtaaaacaatgtatttttagatgtgttgccaaaaagaaaattgtttgaagctgtgtcatttgtgtagaggttctcaaaatgcatttcaagttccagttagattctatattggtatatgattttttggtggttgttagaaaattggccacttatcactcttatatgtcacatctaagaagcagatctagtttgaaaatgaattctttccagacattgcttgttaacctggaccaacccctatctgaattttcttagatacccagcatcttggtttttaagaacaagtcttttatttttaactttgttagagtcatagtatagatttccagaaatcaaggtagagactccacaatttttatcttaaaatcttttttcttaagcattcttatagtataaaatctgaaattttggataacagatttttgtgaaatggattgccattcctatattctcttacttaataatattcctcataatgctctgtcacaatttcatgacaactctgctttgaagagtttcttacagtaatactctagtagatgacagctatgttcgaaagacataatagaatttttaatgtttatacttttaatcagaggctgataaagggcatatcactaacctccactggttaaaataaataggatacattggtatggtgtttattactccatgaccacattacttttttaagtgattggctgagaaagtggaccagagtcttgttgagtgtttttgtttgtttgtttgtttttgagacagggtcttactgtgtcgcccaggctgaagtgtagtggcaggatcacggttcactgcagccttgacctcccagggtcaagcaatcctcctatctcagcctcctgagtagctggaccataggcatgtgccaccatgcctggctaatttttaaattattattattttttgtaaagacaaggtctccctatgttgcccaggcttgtctcgaactcctggattcaagggatcctcccgccttggcctcacaaagggctgggattacaggcatgagccactgattctggcctttgagtgttcttttcaaaagaaatacgtaacttcagaaatgcaacctgacacaacatagtacactgattgggcatatatttctttttagaaattgacgatgaaaaagattgtatgaaccagagaatatgaggttggaagttaatttgttcatctttactctgctgtgcacagaggagaaatattagcatatacttcttccattcaaataaaccccaaataggtttttgtacgcacaaaaagaatctttaaaaattaacacacctttgtgctgacattcaaaatttagaggatttgtaagaagttccgtgggcgagtttaatgtgggagggtagctttgaccataaattatagtaaaagattttttagaccttttaaatgtattattcccttatataatagacttaagactgatatgaggcaaaggacaaataagatatgacatatctgtgaatatttcagaattgggctctcaaagtatttaataataatagtaatacttcttaatgccagctatgattttgtgctaacataatttaagtgttgtgtacattatttcaatcccatatgagatagagttattttatacagataagaaaacatagaggctaaatatcttacctgtcatcacacttaagtgatgatagttggattttatgcactagtttgtttctctcctttcatttcttttcagtaaatgagaatttatgatggcagtggaatgtgtagaggtggtctgagtacagcggtagcagcatgtaacctgaaagattgggctggtaactgatgtgaaaatgtataaaaaccagcaaaagttgaactgctttatgtctgttcctctaaagtagttccctgcctttgacctgtagcagcaacagactcacccgggaacttgttacatgcaaattcttggatccactcacccagacttactgaatcagggactcaagagtgggcccaaccatctgttttaacaagtcctctaggtaatgctgatgagtataaagcttgagaaccacgtttcagtataaagcagtacagaatcagtacttttgattaacattatgctttttttgttcttctgtgtactttatcatattgcaaagtgtttatcaaaacttccgcctgagtgctcttaacaacaaaagagtgaaaatgtacacccaagaggacctggtgagagcattaaccagaaatacagaagtctcctgttctgttttatttattttaattttgccctctattccataacaggtacatgtagtacatgtttattttagtataaaatgcatgtgtgccctagaaaaatcattgaataaagttgagactccagaaaaatgcactatattgtcaggtagcttaaagtatacctcgagacctcagtgttggaagcttaacctccgtcattttgtaagaatgattatttattttttttttttttgagagggagtcgcccaggctggagtgcaatggtgcgatctcagctcactgcaagctccacctcccgggttcaagcaattctcctgcctcagccccctgagtaggtggaattacaggcacgtaccaccacacccggctaattttttgtatctttagtagagacggggtttcaccatgttagccaggctggtctcgaactcctgacctcgtgatctgcccaccttggtctcccaaagtgctgggattacaggcgtgagccactgcgcccggccagtactttctttaaaaacaagggcagtacaaagagtgagtgaaaaatataaatgtcagtttgacaacccacatataaaagtcactcattcttttatattcatgcctcatagttttccttgtttttcaaaagaaaaatataaaaagctaagagttaatacagggaagttattagagaaaattcaaacatgaatatgttatgatttagtctaataaacactgaggtggactctactactcagtgtttttatttggcttgaaaattttggtttaaaagagagttttaataaaatagtttcttcaggtaggtaaaagtggagaaagtagatgttaggttttttaatatttgaggatatgtgagggggatataaatcttggtgtatataaaaagaaaataattttcatcacagcctgtactttatgatgctgctgaaagaatatgtaattcaagtaggtttgagaaagtaaaagaaagaaagtaaagcgttaacactctaaatttacaaaagaataaaaaataatcgacaattatttaatgaatgtattactacagtcaaagggaaaaacattagtcttaggtggaaatcaactttttatttttattgatattgaaatagagcagtacctattccttaaacctctgtattgaatttctacattaacctatacatgttttgcaaagaaaaaaaagtgaattctatgttgtgtaggcaaatacacatatacagaaacacttaatggctcctgctttctacagcataatggcatccactaacgttgatttctattcactgtcattctgcatgtatcttggtttcagcctctttcccttgcagtactgcccctttccccgaaccaaaattttcagttctccgagttcaaattgcctagagagagaatctgattttttgcctgtttctttttaagttcatcgccattgttctttttaggaaatctttcaaagtagaccatcttttaggctattgagtcagaatccagccagctgtgaaagatagcaggtgtgaatgtagaggtataggtagtaggaacccctttgaagaaggacgactgtcagccattctgaagcctctccaacataatatgtataacattttaaacatattcttttttattattattattctttaagttctagggtacatgtgcacaacgtgcaggtttgttacatatgtacacatgtgccatgttggtgtgctgcacccattaactcgtcatttacattaggtatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctgttccattggtctagctctctgttttggtaccagtaccatgctgttttggttactgtagccttgtagtatagtttgaagtcaggtagtgtgatgcctccagctttgttcttttggcttaggattgacttggcaatgtgggctcttttttggttccatatgaactttaaggtagttttttccaattctgtgaaggaagtcattggtagcttgatggggatggcattgaatctataaattactttgggcagtatggccattttcacgatactgattcgtcctatccacgagcatagaatgttcttccatttgtttgtgtcctcttttatttcgttgagcagtggtttgtaattctccttgaagaggtcattcacatcccttgtaagttggattcctaggtattttattctctttgaagcaattgtgaatgggagttcactcatgatttggctctctgtttgtctgttattggtgtataagaatgcttatgatttttgcacattttaaacagattcttaaacatccctgtttttttttttaatatatctgcctgaagcatgataactttatgtctttaaaattagctagcgaggactaccactctttgtttaaaaaagtaaattagctgaaaagcaaatgagttttagaagaaattcttttttactttatccagagactgacagtgactgaaagctgaggaatatattagctttgttttatctttatatgtttttgagtaaaaaatggttccaaagagttttgattccacaatttttctgtaattatttaccctctattattccaagaatacttgaagctattgattgtagagtccaaattttgaaagattggtatcatataggcaaaacataaaagaaacacagtaattcttcaatgttgccattgcctgaatagcaataacaaaacaagcaaaataataagataaacaagttttatttatgaatgagtacaaatcagaccgttcctaaatttcttgttttagtagtcaatgaaatcatcttactgttgggaaccaggcatagttcagtgaaaaggataatgaacatctgtgtttaatatgagttagtagcatgttaatttaagatttgaaatctagtccaggcctggtggttctcacctataatcctagcattttgggaggccacaatgggaggatcacttgagcctagaagttcgacaccagccagggcagcatagtgaaactctgtctataaaaaaataaaaaattggccgggcgtggtggctcacggctgtaatctcagcactttgggaggccaaggcaggtggatcacgaggtcaggagttcaagaccagcgtggccaacatagtgaatccccatctctactaaaaatacaaaaattagctggctgtggtggcacttgcctgtagtcccagctactcgggaggctgaggcagaagaatcatttgaacccagggggcagaggttgcagtgagccgagactgtgccattgcactccagcctgggtgacaaagcaaggctccgtctcaaaaataaatacataaataaaattatctaggcctggtggtacacacctgtagctccagctatgcaggaggctgaggtcagggaggatcccttaagctcaggagttcgaggctacagtgagccattatcatgccattacattccagtctgggtgatagggtgacaccttgtctcaagaagaaaaagatttgaaatctatgaagggtctaaagtaaccattaactaaagaggtagataagcagattgatgtgtcatctcctatagatggtcattgaattcatgaacatgtacagcataattcattttcttaacatgagtagtaggatacttagtactactgagtttgataacgtcaatgataagctcaaaggttagttgttgagataggaaataatctgagtcttagaagtttacattacaggggatttttagtggtagagtaataagtaagaaagagatgataggaattaattcatttatttcgggacagaggaatacctctgtgatttacagctatcttaggaggaaaagaagttgtctcagaggtgacagctgacagaataacctatatggtatgctctaagaatttgaaaatgaagggaaagagagggaggattgctcatgagggtacctgtggaacaaaccaaggggtagaccatcttgatagagtgaaaagatagtgatttttttagtaggacaggttatagatggataaattagttctttgttaactaactttattgaccagaacatccttatggtgagttgtgatgtccaaaaaggtaattcagttattggttattggagaaatttcatcagttacatacttccttatgttttgtagtggtccatcatgagacactgaaaaaaaaaaaaagtttatgtccaatcatgactgtggtggtatcatggtgagttaatacataaagaatggcataccataaaaataaggaaaaaatgggtttgaaatttaagaaatcttaagatttgactctttagacctgtaaatgtatgggtatagcagcagatatgagtgagccataaaatggattttaataaaggacaggagtgaagataagaagaggatgattccaccacatcttaccaatcaaaaaggacatattattttttaatggttcactgaaacctttatacatatgtatatacttatatttatatatatatttatatttataggcttttttagaaaacaaagtgaaaaattaggcaatatgatggcttagtttataactgtagtactttaattatcaggcttatagaaatacatcgccattgtttccatcatcacacatattgcttccaaagcatatcgttattacgagaagatagtgataaattagttgtgatgtaagttaattaaaatccctttggtttatggtagagactgtcagcaaacaaaaatatgaccccactcagttttgtgtattttatgaagcttttagtagggctgtaacagggtacttttgtacagaaatgtactcttcaaatattcagccaccttttcaaggtggcttttaaataccacatattaaaagtaggtatttattttattaggggagatgatttatgtaaattgtgaatcgttagatttttaattaaacatgtctcttattttcagagtttatgcgaattccatgtgtggatgctggattgatttcaccactggtgcagctgctaaatagcaaagaccaggaagtgctgcttcaaacgggcagggctctaggaaacatatgttacgatagccgtaagtgttgacatctcaataatacacatacatttttaagaattatgatattcagactaatctgcttttgtgttagcagtgacttttctaggctaaaacactaacatgggccggcatgattcagcactgcttatttagcagaatttatggagattcaggtcgttgtattcttatcaaagaaatcataggaaatgaaatgttttcctctgttatcacaaatgatattttcagaggaaattaagtcagtttctaagaaattggggctgtaagtttagaaaaaatacatatgtgcatcttctcaattaggtttcattgaaatattatctctgaatgggaatgcttatggacacagttttttaaagtttctgcgtctgtccaaatacatttttaattatttgcagttcggtaaaaccaatcataaaaaccattctcttctcaaaagctagattggcccattacatttgcattgactccattcctgtttgtcattatatcattgtcatcctcaccacattctataatatactgttctactaggcaaaaagaaagcaagaactggggtatgggtatattgtaacagcgttaacaatttctacttcccctttctacatataaacaaaatacagaaaagaattttaagtatatttagcttaactaggcttattctgattttccttagagttttatttgctgagccaaaacacgtattttatcattcacctgtaatgcctcctaggaatttagttttatttctataactaggataacttttagtgcttattttccccattgagtgtttaactcggatgagttatattttgttataacacaaaagatatggcccttttataataggcagtccttcaaaaagtgatttatgcatataagccagaaagaaaggacataaatatattcatttatgataaagaagtaggaaaaaagattgaaactatagttataactcatatatagcagtagtcgtaaagctagcctcatttattctccttttcttactttttctgaaataggagctacaatagccataagtattgaaatgtcagtaatgaatctgaggacatagatgtcttaatatgaattttaacttcagttttcagtccccagtatagcctgtaaatctgcttatctgctccttcaatccagttctttttatcatagggtattagctttatttacaaaattctgttgctttatgtttataattttgtgttttcatatttaggatttttattaagcaccatagtttataatatcaactttcaagactgaatcatttattatatatttatatgattaattttagcaacatatattagacctcagctgagtaatagtcaaaagattagtggcatgtacttggagagtactgattattactgtttttattcttacttttctgtgtttgttactggaatttaagggtaccaaaagtattcttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccagcccaaaagtattctttaaaccttgttcattttagttgttcttgaattatacattgtttgaacatagagaatattacctgttttgagaacttttgtcctggagtttttcctattaataaaatagaaatacacacagtgatattttgtctcatattgccttggtttttatgggcatagagtaattttatttcctgtgtattctaaagaaccttgaagttagggtaataaatgtctagttaacaagattattcttttgatgaaactgaagtccattattatagtatttatcatatctatttatcttatgggatatacaatataaagttctatggatatcctttaagttatgaagttaatttttttcattttattatgaatatttataaccaacttatcctcatttagttcaatggaagtcatagctaaatgattaagcatagtaaatacagcccatatttttatacttttaaactttagttcaggaaaatgaagtttgaagtcttaaaagtgaataaatgtaagaagtgattcattacttaatataaatcatgtgatgaaaatgtatttattgtgccatgctttcatatgcatataatttccatagactgcatgctttcttacccttttattcaaaattaaattctgtcaacttctttgtgatttttctagaatgattgcaggacaattacagtgtttatacttgaattacaagaataatataaaagccttgtaaatgtgatgttgtgtggttgatttgggaatttacttgaaatgcatttctcattttattttctgacaactggaaatttttcctttttaaacaagtttttagtggcttctattttaattcatcaaccttcttcactctcgggaatgtaatgcttcatttttaaaaggagtatagaaaactacatgatagccttgtgatcaatacaaagaatcttcttctttcaaataaagtatgttctaaagagttcatatatttgtgttttatctaacttacctatggggctaatcagttgatttccattttattaatgtactccaaatgaataatttttttaacataggtttattcaggatgatagtaggcttacagtagatagtaaagttgatgtaaatagaaagtagtataaagacttcactattggatcacttctcggcctgttggctaagatcaagtgtagaattcactattggagataaaaatttgagaaattcatacatgttctatagatttttactttgacacatgaaaagtaaagcatttgctagcatatttcagttagcatagtgtatttgaaaggaggtgagctccaactgtagaaagaattaccataaaatccgtggaaatctttggagaaaaactaggtcagatttcagttttaccagccttgacagtgcccattttaggaacttttcctaatggaagaaaacggccttatataatcctgacatgaggtaacagactggcataccgctaaatgggacggagtaaagctttgttgctgatgaactttttgaatcccagtctccttcttgcatatagagatgaaagaatcactcactggctgggaacgtttttcatttaaaatgcttggtctcttttcttccagagagctgcaaggcacttcatttatgtatttctctttcgaagtatccgaacagacttctgatataagcaatattttaaaatgcttctgccctttaactttgccaaaataactctttttatgagaaatttgacatctttcagatcagagaagaaaggaaagttgtatttcaatttggaaagaaataatcaaaatatgtgcgattgatgggatacaccagggaatgtggttttaaagcgcagtagtattatatttcagaaatgcatgcctttggcctatttacacttccttttcaaaggttttataaaaaagaggattatgttcttatatagctgtctttgtggcattcctcattttattgatttgtttatataactgtacacattttaaattgctgatatacttaaatggccttatagttttaaaaagctttatgttaaattcccatcctgtatttataattcctggggataaattggtgatttgagactagtgttctgttttgtggatattactgcctgaggtcagaaaataattgttacttgatctactggttaaaagatattagtagaggctagaagaaaatgattacgtgaaattaaatatttgtgcctttttatacaccgaggaagaataatgtacaaatcaaataaaaatgttttaaaattaaacaaatatacctctttatagaaataaaatgtatgcttattatataactggtactattattggaaagatatgtacacttaagcttatatgatatgctatcatacataagataaaaagttgtattcttccttgctgatgagtaaatattaaaatgaggtagtaatcagtcttgccaaagccagtgtttatgaagtgaaatattgtttattcattgacatcaagtataaatgggaaggatgctgaaacatatgcatgtatccgtttgtatattggcgattcttgtgctacactattttaatataaagtctttatttttatgtaaaaattctttatataaaaatagtgtagaaggaattatagttcttactgcaaatactgaaaaatagttaccaataattgtacaatattttatcatgtaagttggtcagaaaagtatatattaatatgatacagacatactttgaaattgccaaagtaatcaaaatatatttgcaacagttatattcaaaagggaactatttatatccagcatttaaaataaatgtttatttcagtgataccaattaggttatttgatgagttatattaggtatgttattaaagtctcatgcaagtctttgtatttaccctattttctgtgttattcagttttagaataaaatagaattatcagtcagtaagtagcgtaaaaataagattcttcagttttcatcaatctgttgtattttatgagtttattattaaagtacatcatgtgtataagaataaacaacaatatgttactgctacttttagagatagtagttatgactattatcacatgaaagcattccactataaagacattctaaatatagattgaagtagatgttgttttgtaacactatcataagctctaaacacaagcatatgccattaaagagctttttaaatggtagagaaaataaaatgaacaaaggaacacaacctgaggacaattacagagcacacactaaatatgtttttttatcagaatgaaaattaataagaatattaactgtagctgttttttaagaaattaaccaaatagtgcattgcttagaaaagaatttgtttacaaattaatataattataaatgtataaaattttaatataacccctagaaagttggtattgcaaatgaatgtgatttccagctccaccattcactaagttgtcatttaatttttctgattttaatttcctccttggtaaagtaagcttgtgtggattaagtatgtttatataaaaagtgtgtgtgactcagtgtaatacatacaataacatacaaaaggtatttccataaagatataaaagccagaagccatataaagagaggcaaagataaatctggtgggaagcagggataatgtgcttaactgtgtataagcactgatttcacttgagcttcttggcagcctatgtgaaaaaacaacttgatatgccttgtaatttttattttatgataaaaaggaatattttagttctttaatcaaacaacttttgagacaaaatagtaggagggacttatcaggatgtcattaattccctagatgattctgtgcacatacctagttacaatatgtaaggatatttactggcattatagtgtacctagtgacggttctacaaaagttgcccagatgttttccatgtgattgtttcttgtactaatcttcaacagaatctgggaaataatactgaggactttacagaaggtagttttatttgggtagtatatcccgagtgtgttgttttttggtggttaaacttgcttaaaggattcagtttaaaaatttgaaaaagttttgacttgaatatatttcctagtttagtttaaaaccagaatacaattctggtttccattcattgtactttatccttttctctgtgttgtgtgatatatccaagttctatttcttgagaccaaaaaccatgtttatctctgatttttgagcccattatcagtttgatggaaacctgactagcatgaaagtgagtattttaaaataccactttagttgtggtacacaaatctgtacatatgttagaattgcttagaaccatacatgcccatacacatacactaatgcatgtaaaaactgatgaaatatgaataaggtctgacattgtaccaatgtcagtgtcctggttatgctattgtgtagtagagttatgcaatgttaccattggaggaggctggataaagggtacatgagacctttctgtgctttttttttttaaataacttcttgtgagcctctaattacttctaaataaaaagttttaaaacctcacctatccagaaagcatatatattctcttccctatgggaaatgaccttgttgtttcagcagtacctgaggtgggaggtgggggcagcaggcatacacataaaattttacagcatagctcacagcagtaattttaatgagtttgtgcaattaatgtgaaagacaaaaatgcctgtaattttttctccctccaaattggacttttatggaaaaaaatcaacaaaaacctaacagccctaaaataagatttacggagtgggaattcgtatttgttgggttaggacctagggacaaaagcagagtaaatttcctagaaagggaataactgatagggaaatattatagaccaaaaaaagtgaaattatgaactcaagtaaacaggttgatattaaaatgagaaaggacatttctgccatagagaataaaagacagaagataaatgaaagtataaaaaaacctttaagtagtaaagagggcactcaaaagtgtatttctgggtatagttctgtcttcccagtaaggtagatgtcaggctcatctgttaataaaagtcaacaccaaaatgatggtaggaagtttgtggttttgggggaaagttcaaaattggggctgtaggacatgtaaatcatgaagatacgattttttaaaatagccaaatagtaatataggtatgctatggtagagatcttgattgtgcatccattaatgtatagtgtgcttaaaatgtctataggctaaggaattattttgactttgatatgtggacaggaaggagcctctgaaagtaacttgaagaaattgatattttcagttttgtagcatcatatagtctaattggaatggacagagatgtgaggcagagatatcaggaagccattacaggaggccgggtgtggtgtggtaaatagtgactgcggcagagagaacgaaattatattgtaaagtgagagacagtactcagatagtttattatcagtttggctggtttttgcgtagcactgcaccaggtttatttaagcaatgtaaagtactctatctcttcagatagtttacactttgagaaactatgatctttccatttttgtacttggtattaaatttaaatccctcttttattaaatggtgtttggaaatccaagattctataaagtttaccttaaaattgtaggacaaagaacacatattactgcttttttccccatgcttgattactttccaaatactatgttataaaaagctaatgtcttagggaagacatgaaatagtaatttcgagtaattgttcttaattttatagatacgaaagtagaggcaacctgtgagagagtattgcacgtggcaaaaatattagatgatttttcttgggttcaataagaagtcatatatggttgccttcccccccaaccccacccccattctctgagtcagaagtctgaatggctttagaactttcctttcctcattaagaggacttaggtagggtgggaaaagtctaattatagaggcctacttgggggtttaaaaacattttttgtctaaatctgttttttccccttacctttaccactctcatttcacctgttaaagtcaaagtttagatatgtgaaacataagatttccagtctgcttattgaaaccctgtcaacacatattatcctctgctctttttaatagggttttgtttacatttttaaaattttcttatttgtaaccaagttgaagtactgagaactttctcaacttttaatcagccttttccttgctacaagtagggtgcattttccttggcggtgaggaaatatgaaaaataaatgctacgtaaaagtgaataattcagggccaggcatagtggctcacgcttgtaatcccatcattttgggagggcgaggcaggtggatcacttgaggtcaggagttcaagagcagtctggtcaacatggtgaaaccccatctctactttttaaaaagaaaacaaaacaaaacaaaactagccaggcatggtggcatatacctgtaattccagctttgggaggctggggcatgagaattgcttgaacccaggaggcagtgatttaagatcacagcactgtactccagcctaggtgacggagtgagactctgtctcaaaaaaaaaaaaaaaaagagtgaataatttacatttttcctgctgagtaaaatgtttttacccgttgagaaactatgctgtcatcagttcagattaaattctaaataactatatatgcatttgctctcacacacacacatatatatatacatatatatatagtctagcataatttaagtatgaaatagtttggtacaaaaacaccttttatatttaaaatatttataaaacgttttgatcttgaacaattggagtaataaattggaacaataaattacatacattattatctaaatgctatgtaaaagtaacttttatggaaataattgagttaaatgactttataatttgtgtataaagatattcagtcttttgctaataaaatgatacagaaatataaaaatatagggagtaaagaaagctttagtaatttctttaggaaatgtattgccatttatggagcctttattagataaagggtttttgaaaaagtagaattattgaacaattttaactaatgtgagaaatctgttggacaacagaaattaatactagtatcagcaggcacaccaaaaactgtgtccatcaaatgctgggccataacctcattttatgctgtgcccttggtactagtgctttgggaaatgaaagatttaattcatttacttttcctgatctggcattacaagtgtaaatgtatatacaccttgaaattttcccacctaaatgcagatttttaaacctgaatataatgtcacaaaattgcaaattgcatgcttctcttttgatatgtgtgcacttaacagtcatggtggctttttcttcatgactcatttttgtgattttacttatgtaatatgttatagcttttgcttttatatctagtctttcagggattttgcctgaatctggaaggtgaataaattgcgttttgagttttagaaacgatattcatgagcttttttatttgaatgctgaaaacattcgattatgtctaaggtacataatagaaattcactgttggcaaaattatagggggaaatgtaagcattagaatttaattttctttcctagtagacttcataaatacattttaactttatcttgaaaaacaatgtagggtctgcatgtggtggctcacagctgtgatcctaacattttcagaggctaaggtgagaggatcacttgagcccaggagtgcaagattagcctgggcgtcatagcaagatcgcatctctacaaaaaataaatttagctgtgcatgatggagcacttctgtagtcctgctactcaggaggctgaggtaggatgacacgagcctgggagttcaaggctgcagggagacatgattgtgctaccacactccagcctgggtgacagagcaagaccttgtctgaaaacagacaacaactaacacaatgtaggtatgtctattaccatttccctgctccaggaaattaaaatagaacttggcaaaattaaaagcagtatatttaataggaatgggaaaaaaaaagccttcataatcatgcagatcagaatggccagtatttcagacttagaaaaatacgttgctgctcatgatttacatccctgacttctaatctctttgagtgtgaaaacttcctttttaacaccacaaattattgttctctccctttgaggatataggtcacatatttttatagtaatgattgtacttacaaaatgtatgtactgagaagatatgaaataatgagtaaatgccaggaaattctcactctatgtctttgtattctttggtgtatacatactacaattaaatccacacatattgattgaaccaactatgtttaggggacactgcctgtgatggggattataggggaaagaatgagcaagaagtctctatccttgtgaggctttcacaggaggaggtagataataaacaagtaaatactacagaaaagatatttatagattgtgatgactgacatcaagggaataaagaaggtgatgtataataatggagtgtatttgagggtgaagaaagttctctctgtggatgttatttaagctgaggtctggaaaatgagaatgagccagctaagagaagaggaagaatattccttatagaagtagagtaattgagctaagtgtggtggctcacatctgtaatcccagaattttgggatggcaaggctcaagggctgcttgaggccaggagtttgagaccagcctgggcaacacagcaagactctgtctctacaaaataaaaaatgagccattatggtggcacgtgtctgtaatcccagctactctggaggctgaggtgggaggatcacttgagcccaggagttctaggctgcagtgagccatcacaccacagcactccagcctaaataacagtgagaccctgtctcaaaaaaaaaaaaaaaaaaaaaaaaaaagtgtagtaattgtaaagccctgagagggcaagggatttggtagaaattcagaaaggaaaccaggttatgcaagatactgtgaacagggagtattgtgtgataaagttcaagaaacaaacaaaagtgttgatgatagaaagcctcatgaatcatcttgaagtagtgagaagttgttgaaggcaagaagtgacatgatctgatttggattctaaaaacatcactcttggagctgcatggaaaaggagttgagaagcatggaaattaagagttaagaagggaagcattgagactaattgaaagacttttgtgattgtccagtcacaacataatggtaacttggattaagttatggtagtgtggaaggaggaggaacttagaaagtatttggagtgatggattggattgggaaagtgcgaaagggagaaatcaagagtgatttctaggacttgagtacctggacagaagatggggcaatttgccgatgtaggaaagaacagaggttgttttttgtttctgggtttttccgtcattgctgcttgtttttattttgttttgctgcaggcattattaagtctgagattcttcatagagacacaagaagaaatggcacataggcgatttctatatctttatattcttttacctttggggaataaatattcaaaaagttaaaataatctcctgcatttagcaaaatgttgttaactgtttcttagatggaatatgtagattcagggaaccaagagaaattagaaagcttaagtgaataaaactaccttgaaatcatagttttttacgtaggagggaatttaaaagtcatctcagccacccctgccaaattttacagataaaaaaactgagacctgaaaattcaagtgacttatcagaatcaacagctaaattggtgatagtgttgatctgaaaaccagatctcaggttcattgtttccgtaaatatatctgaggaagttatcactgtcaaatacataaatgcactgtcattaaatacatttatgcttcagtgtgaataattctgagcacgcaggttttggaatatgttttaaggattttactaaaagctgttcttaagccaacattttgtttaatttgtttaaagaacacaaaaataaaatttacctaattgaaagaacatagagtagaaccaagtgatggaggaaaaactttttacatttttccaagtataaaagctttatttaaaaaaaaaaaagtatgatgtgagggctgggtgcagtggctcacacctgtaatcccagcattttggggaggctaaggctggaggatcactggagtccaggagttcaagacccaccagagcaacatagggagatcccatctctacaaaaaagtaaaagaattagcctggcgtggtggcacacacctgtaatcccagctactccagaggctgagacttgagcccagaaagtcaaggctgcagtgaactctgatcaggccactgcattccagcctgggtgacagagcaagaagaccctgtctcaaaaaaagaaaaaaaaagtatgtatgtgaataaacattctttattatatttgatttattcttgacattttctctgtagagaagtgtgtgaaatactgacttcccttttaaactcattgggaataaaggatgttcagatttgattggattcttagtaatacctaaggaaacccaattaaaaatttgagagtttgactcttcccagtaaaccagctagacaaatacaggtatgttcttcaagtttgcagacaagtatctattgctttgtattgttttctttacacacaaggtgtataaagaaaaattaaaattgagccaggcatcatggctcacacctgtaatcccagcactttgggaggctgaggtgagcagatcctttgagctcaggagtttgaaaccagcctgggcaacatggcggaaccccctatcccctctctacaaaaaagtgcaataattggcctgttgtggtggcatgcacctatagaccctgctacttgggaggctgatgtgggaggatcgcttgagcctgggagatcgaggctgcagtgagtggagattgtgccactgcattccagcctgggcaacagagcaagaccctgtctcaaaaaaataaaataatactgtccttctaattgttctgaataaattcactttttcctgcaataatgatataaggaatttatacacatctaactttttttaaatgttactttttatcacttttgttcgatttttactgattgttaatatacccttttaaatatctctattggcacagcaaagtaagcttttcagtttagtagctctctaacaaaatattttctaattctgtgctttaagtgaaataaaacggggatgaaagtggcaaaaccatattatcatgtccatgagcagccaaaaagaagtctttagtgaccagagaaaccttaacgtaaacagtaagaagcaagtaataggacagaaacaaacagattctttactcagaatgtttgtcatttgaagtaaatacaagtggtggttctctttctctcactctcttttcaacataatatgggtgagttaataagtatttaatatatatgtgatatggtttggctacatcctcacccaaatctcatcttgaattcccatgtattgtgggagggacccagtgggaggtaattgaatcatgggggcaggtctttcccatgctattttcgtgatagtaagtctcatgagatctgatggttattataagggggagttttcgtgcacaagctctctttgcctgctgccatccattgaagacatgacttgcttctccttgcctttgaagccatgattgtgaggctttcccaaccacgtggaactgtaagtccaattacacctctttcttttgtaaattgctcagtcttgggtatgtctttatcagcagcatgaaaacaaactaatacagtaaattggtaccaggagtggggcactgctgaaaagatacccgaaaatgtggaagcgactttggaactgggtagtaggaagagattggagcagtttagagggctcagaagaagacaggaaaatgtaggcaagtttagacccctacaggcttgaatggctttgcccaaaatgctgatagtgatatggacaataaagtgcaggctgaggtggtctcagatagaaatgaaaaacttgttggaaactggagcaaaggtgattcttgttatgttttagcaaagagactggcagcattttgcccctgccctagagatttgtggaactttggacttgagagagatgatttaaggtatctggcagaagaaatttctaagcagcaaagcattcaagaggtgacttgggtgctgttaaaagcattcagttttaaaaggaaaacagagcataaaagtttggaaatatgcagcctgactatgtgacagaaaagaaaattctatttttctgaggagaatttcaagccatctgcagaaatctgcgtaaggaggaaccgaatgttaatccccaagacagtggggaaaacgtctccagagcatgtcagaggtcttcacagcagcccctcccatcacaggcctggaggcctaggaagaaaagatggttttgtgggccgggcctagggcctgcctactctgtgcagcctaggaacttagtactctgccttccagccactccagctatggtgagcaggggccaaggtacagctcaggctgtggcttcagagggtggaagccccaagccttggcagcttctatgtggtgttgatcctgcgagtgcacagaagtcaagaattgagtttgggaacctccacctacattgcaggaaatgtatggaaacacctggttggccaggcagaagtttgcttcaggggtgggaccctcatggagaacctctgctaaggcagtgcagaagggaaatgtggggttggacccccgcacagagtccctactggggcatcacataatggagctgtgagaagagggccaccatcctccagaccccaggacggtagatccatcaacagcttgcaccaggcacctggaaaagctgcagacactcaacaccagcccatgaaagtaaccaggatgggggctataccctgcaaacaagagggcagagctgcccaagaccatgggaacctacctcttgcatcagcgtgacttggatgtgagacatggagtcaaaagagatcattttgaagctttaagatttgactgccctgctggatttcagacttgcatgcagcctgtagctcctttgttttggccagtgcctcccatttggaatggttgtgtttatccaatgcctatagccccattgtatctaggaagtaactaacttgcttttgattttacaggttcataggcagaagggatttgctttgtctcacatgagactttggactgtggacttttgagttaatgctgaaataagaatttgggggaatgttgggaaggcatgattggttttgaaatgtgaggacatgagatttgggaggggccgggggtggaatgatatgatttggctgtgtccccacccaaatctcatttttaattcccatgtattgtgggagggacccagtgggagataattgaatcatgggggcagatctttcctgtgctgttctcatgatagtaagtctcatgagatctgatagttactgtaagggggagttttcctgcacaagctctgtttgcctgctgccatccatgtaagatgtgacttgctcctccttgccttctgccatgattgtgaggcttcccctgccatgcggaactataagaccaattaaacctcttccttttgtaaattgcctagtcttgtgtatgtctttatcagcagcgtgaaaacaaactaatactgtatgtattacctcatcttggttaactgagatccatattatgcactgctttttaataaaaagagaaaggaatggagatatgccagattatttgttttgagttggtatatatttcaggaagtcataaataaatgagaatgatgagcagttttcttaaaggtgactttatgttaaaattgattgactaacaaccaagcctccaggtaaaatatttaattttttatgagtgagatcaattgcattatttttacatgaagatctatatttaacaatccttatttcctttagccttgaacttttttcatcattttatgatttgtatgattatgttattattaaattaattagaaaagttatacatttaaaatttgtttcatagaatagggcttattcttttctgtagctctgttgattttggagaaggagaagccctatatttacctatataaatcagctaaagttccacttcagtttgatatgcatgtactgaagtcctcttattcactcaggaatacattcattcttttaagaatttttcatttttacagtttattagtctgtttcacatgctagtcaagacatacccaagtctgggtaatttataaagaaaaagaagtttaatggactcacagtttcacatgactgggaaggtctcacaatcatggtgaaaggtgaaggaggagtaaaggcttacatggtggcaggcaagagagcttgtgcaggggaactgccctttataaaaccatctgatctcatgagactcattcactgtcacaagaacagcataggaaaaacaatccgccatgattcagttacctccaactgagtccctcccatgacacgtggggattgtgggagctataattcaagatgagatttgggtggggacacagccagaccatatcatacagtatatgaaaacttcttaaatataatgtttcagtggctcatcattcttttaatgcttaataaccatatactcacaaatacacacctatgatatgatctagctgttttattcctagatacttgcccaaagacttatgcgtgaatgttcaatgcagcattattcacagtagcctaaaactagaaacaacccaatgtcaatcagtatatttgagtggataaaagatatagcggtatatccaaacaatggaatactatttagcaatgaaaaaatacttctatacatgatgacatggatgaatctcaaaatcattagagtgaaaatagacacataaaagaatacttactgcatgaagccatttctataaaatgcaaagtaatctatactgacagaaaacagtggttacctgggaccagaggtggagggaaagatggcttacgaaaggacttgaggattcttttggttgtgatgaaaatgctcagtatgttgattgtggtgatggttgctaaggtatgtagagctgtcagcactcatcagttaaacacactttaaatctgtgtagtttattttacctacatttttccttaatagagctaataaggaagggaatccaattagaatctaaacaaaaaggtacacaatttttgtttctttttatatacatgttaaattgcagtaagggcttgaaagacgttctggaaaacatggctatgaatctctttctgactcctccaggtaaaagtaatttccttatttgtgcttccattttactctgaacacttaattttgtttgctgcttaaattatatgttttccctcacacttccctctttttcccctcacccaagtaaaactgtgaattatctgtctttgtattctcaggacctagttcaatgtatgaaacatagtgagcattcagaaaagtgataaaggagggagagaatgctaatttagttgcagattttgagatatattgatgaaactgactgtgtaatacatttcattaatcagtatttaaaataaggaaattttactcctattaagtaggatttaacttaggttataagtgaactagagaaaacatgttaatgttaccatgtaaatctacctattgtggattcattatttatagatattaggtgaatgtattcatgtttattatgaacattttattcctttttattcctgtgcagttttatataaacctcctttctccttttttctccagtcattcctccaaaagaggtatattctcttctctatgcttctgtaacacaccataaaaaaattgcattaaagctttttttttttttttaacagagtctcgctctgtcaccctggctggagtgcagtggcgcgatctctgctcccagctcattgcaacttccacctcctgggttcaagcgattctcctgcctcagcctcccgagtagctgggactacaggcgcgtgccaacacacctggctaatttttgtatttttagtagagatggggttttgccatgttggccaggctggtctcgaactcctgacctcaggtaatccacctgccccagcctcccaaagtgctgggattacaggtgtgagccatcgcgcccagctgtattgaggcttttattctgtttactactctgtcttcctcattggaatagaaactctttgaaagcaaagtcttgtgttgctgtttgtgtctactgtacctgacacaaagcctaagttaaaacttaataagcatctgttctgtgattgtgaatgtgtggatttatccctagttttatcagtttttgttttatatattctgaagctctgtttgtaggcatttatacatcatttaggattgttatatctttttttttttttttttgagacgaagtctctctgtcacacaggctggagtgcaggagcaggatctcggcttactgcaggcttcatctcccgggttcaagtgattctcctgcctcagcctcctgagtagctaggattacaggcgtgtaccaccatccccagctaatttttttttgtatttttagtagaggcaggatttcaccttgtcgggccaggctggtcttgaactcctgacttcaaatgatccacctcagcctccccaaatcctgggattccaggtgtaggattgttgtatcttcttgttgaattaacccttttgttgttatgtaatgtccccctttatccctgataatactgcttattttttatgttttatttttttagatggagtcttgctctgttgcccaggctggagtgcagtggtgcgatcttggctcactgcaacctctacctcccaggtttaagtgattttcatgcctcagcctcccgagtagctgggattatagacacacgccaccatgcctggctagtttttgtatttttagtagagatgagatttcactgtgttggccaggctggtctcaaactcccgccttggcttcccaaagtgctgggattacaggtacgagcctccgcccctggccaataccgctttttctgatgtctactatgtctgacaatgtagacacaccagttttcctttgatcagtgtttgcatggtatatcttttaccaaccttttaatattatttaatattcttaaagtgggttaattatagacagcatggttgggtcttgcttttttacccaatctgaccatctctcccttttaagtgacatttagattatatgtatttaatatgatctttctgtggttggcttcaaatctaccatcttcctagttgtttctttttttctcccacaaaggcgggtttatttccgaacctagttgttttctgattgtctgaactgttctttgttcctctttccctctttgtccgcctttttttggattcttcacatttagctccattactggcttcttgtgtttttttattgtttgtttttgaggtggagtcttgctctgccacccaggttagcgtgctgtggcgcgatctcggctcactgcaacctccgcctcctaggttcaagcaattcttctgcctcagcatcatgaatagctgggactataggtgcacgccaccatgcccagctaatttttgtatgttttttaaatagagatggggtttcaccatgttggccaggctgacctcgaactcctgacctgaagtgatctgcctgccttggcctgccaaagtgctgagattacagacatgagccctcgtgcccagcccattactggcttctgatgccactttgtaagtttttagtggttgccctgtggcttgcaatatttattcttagcttatcacagtttatcttcaaatattatgtcacattaatttaatcaatcaccttactgtacagttccacttcctcccttaaatcttttatgcttctgttttctatttcatttttacatatgttagaaatcccaaatatattgatgttatttttacttaaaaatttgagacacggtcttgctgtgttgcccaggctggtgtgtagtagtgcaatcatggctcactgtaaccttgaactcctaggctcaggtgattctcttaccgcagcctcctgagtagctaggactacaagtgcatgccacaatgcctggctaatttctttttttccttttgagtagagacaggttctcactgtgttgcccaggctgatctcaacctcctggccacaagagaccttcctgccttggcctcccaaagtgctgagattataggcgtgagccactgtacctggcctgtttttactttagacagtcaattatcttttaaaaataggagaaaaactgtcttaacatacttttatcattttcagtgcactacattctttgggtagatccaaatttttgtctagtatacctctaactgaaaaacttttactaacattttttgcataacaggtttattgcaatgaattatctcttttatttgcttgaaacaattttacttaaccttacttactggaagatattttcactgggtgtagaattctaggttggactttaaagatgttacttcattgtcttctagcttgcatagtttttgatgagaagtctgctttatttcttattttttctgtttttttcccccttccggctgcctttaagagattctctctctttccctctctctccctccctccctctccctctctctccctccctccctcttgtttgtttttcaacagcttgggtatgataggtctaggtatgtttaattgttttcctttgcttggggttctctaagctttaatagatttgtagcatgatggctttcatttttggaaaatttttcagtcattaactcttaaaatatttttctaccctgttctctagcacttcattctctgagattccaggtacagtagtgcccccttatccacaagggatacattctgagaccctcagtggacacttgaaaccaaaggtagtaccaaacctgtatatatcatgtctttttaaatatattttcacacctgtaataaagttaaaccatgaattaggcatggtaagagattaatacaataactaatagaacagttatagccatatgtcagcatcactgctcttacactttgaggccattaagtaaaataagcattacttgaacacaagcactgcgataccgtgacagctgatctgacagttacttaagtgactaatgggcaggtagtgtatctagcatgaatacaccgggcaaagagggagttcatgatttgaatgggatggtgtaaaattttatgttactcagaacagcgtgcaatttaaaactttattttttttatttctggaattttttttattattttcatgctaccattgaccatgggtaacaaactgcagaaagtaaaaccatggatgaagggggactactgactactgtacacttaggttagaccatttgctattttctttccttcagctcttgggtgctctgggttatcccactcccacttgtttagtttgttcatgttttagtttgtgtaatttctattgatctatgagttcgctgagtcttttcttggtttgttgagtctgctattcagcctgttgaaataattctttgtgttgctcctttctagcatttccatttaactctttcttacagtctccattttctccaaaatttcacatctattcatggatattattcagtttttccactagatcctgtaacgtagtcattatcgttaaagtccctgtatgatagttttaacatctggatcacctgtgagttttgttggtttcatcttttgacagtgagtaatttttttcttaaaatgcatctcaactttttattgcagctggatattattgtaggaaaacagattaacagtatttaatctctggaattgagcgcacttccttttaatttagggtgttcgcatagggtagaggtcaagccagtctagtcaggagtcgaactaggttcatgttttgttgttgctcaccttacttgagtgcagtatgttcttcaaattcctttagtagtcggccgttcttactttatgcttagagtatgggtgctggaggactttccttagtgttcttgctttgacttcaggcttggacccgttcccgcacagctgtgggctttttctgtgctcttgctcctctcccagtggtaaattgttgttaacaaggaacattcctattacagttagcctgtagagcaaaatcccatttctaaacaatactcacacacacaaaaaagaaacttaaatatttcacagtgttgtattatattctattatatggagtggtgtgttagtttcctagggctgctgtaacaaagtaccacaaactagttggcttaaaataagagaagtttattgtttcacagttccagagatttttaagtctgaaatcaaggtgctcaccagggcatgcctctctctgaaacctgtaggggaggaggacatttttgcctctttgtagcttctggtggtcccaggtgttctttggcttatggtagcataattctaatccctgcctctgtcttcacatggcattctcctctgtgcatccccctcctcttataaggatacaagtcatattggattaaaaatctgccctactccagtaggacctcaccttaactaattatatctacaatgaccctgtgtccaaataaggtcacattctgaagtgctagggattagaacttaaacatagattgaaggagggcacacaatttaacccatgataagtagaaatgacatttatgtctcaaaaacattactcatatcagtaacattatctcctatagaaaaagatactaaaccacagaatattaaaagccaggctaagaatacactaacatattagaaagatttttgatacttgcttccttttcaattcagataaatttaaagatgcaagtgacagtttttaaaaatcacattttaatatgaaatgtacaaagtccaacgtatgtgtgtgtgtcactctcacaatcatccatcctcaaggtgaatagtaatttatcaatatctgtcaaaaggccccattcattaaaaaattcttgagtacctactatatactaggcatttgccatacacaaggaggaaacgtagtaaaatccaaagttaggatgcactgtacgacatgccacaatagttagattcagtggctgtattttaggtcttttcctcacccttagtgtataacttgtacctgataatagtgtttaacttgataacattttttttttctcatttgtgagacatgataaccatgacacaaattttattgctgcttgcttttgattacagaagggtaatggaagtgcagtaactctttagatttaaagccctgctcttagctaatgtgaagaatgatcatacttgtgctggaaactgctttgtgtgaaagatcatcattaaaggatttaataggactttaaagagtgggctgcactttttccagtggttggatgcttcataattaaatgaggaaaattgagatgtaaattatatttttagaagtgacagctcaggatgcttcataggttagctgttacttatgagaagagtgaaagatgagcttacacttagggatacacaagtttaggatagggaaccttttgagaattatttttaagtgaacaataatactcattatgataatgtaacatgaaggtatagagttaactatggaaaaccaatttatatggacttgtgcaatgatagctgttgtatttaaaatgatttgttttctaaatactactggaaaaataagtcagttgtaagatacttctaaagatgacttatgtcactggttttgctaaaggaacacattattatcatttattcctttgaatccttaaattctattaaatatttttaaaaaaatgcttttactgtgtttctcaggctgacttgtccaaagaaagaaaaaagctgtataatcaatcattcctatagtggtggttaatattttttgaacccagatcactattattgtaatacatgctttgcttttcttctcatatttggtaataatgtaatttctagtatacagattgtgtttatgccttgcaaacaattctcaataacacatgagcaaaaagctgtgttatagacaattcagaggaggggggtggaaggagaggaggagaagaaaagcactgtggctctgaaacacaaataggtaatttgcttttaattgtattgtgtttttattgcatcaaatttgttgaataagtttgtattttaatttattgaattatggaatttttgaacatttactagcttagtgtggataagaagccagctttcattcacagttcattgcaaataggtgccacatagtttctaagccctagtttcctagtatatgaaattcctaatatatgaatacaaggcttagtttagctattctctaagatgtcttcttctaagtaagtcctaagcatacatgatttatatttcaaaagcccagtttactcaggaattagaatcaaatactattcgagctttgcaatttaggatgggatgtactataccttcatattattgaaggtctgaacatttagatttgtaatcctaatgttcagttttctgagacatcatccacatagaaattgcccagtaatttagataatttacatctatgttatggaaaacaaaaatttggaaattagatttctaaatgagatttgaccaattgttcttggctggttcatctagctagttactctggcagtataagaattttctgtgatctgatgagctgattagcatacagtcctgttttccatctttataacaatacagtaaaactaagtggataaaactgttttgtttcattttagtgtggatttcctcaaaaattttcaaaattatgaacatagtatttctgaggtcttactatataattgtgtgtgtgtgtgtgtgtgtgtataccataagaaattacatattttaagttgtatcatctaatatgattcagcaacagtaataaagatgtgaccttagtttcagttcttatatttggaaaatgaaaatctttcaaattgtaactaacttcgtagctgtaattcctttgtgagtcatttattttgctgatctttgtgctatatttctgtagctgaatagtacagtgtggtagctactagccaaatttagctactgagcaatttaaatgtggctagtctgagttgagatgtaactgtaagggtataaaacacttggattttgaagatatattgtgaagatgataatacaaaatattttgttaatttattgatttgcatatcagagtgatatatattgaattgaataaaatattactaaaattaattttcacctgttttttaatgtgtctattagtaaatttaaattacacatgtggttcacatttatggctcacacatttctcttggacctcttctagagggtggttatattttatctaaggtgtcagatttagaatgacacgtattcttcttttaatttattttcattcttatgttcaaaagttagaaagtagtctaaagctgtttgtatgttctgacagttaagtaacatctgttttatgcaatgtagatggacacataatggaagttatgtttgaccatcacttgaccactttttgtaatgttgaattatattggtgtgccctagaagagagggaataaggaaaaaagaaacaaatcaagaatgaaaaaagggaacatgcttctggactataggaaatgccattaacaaagaccatagtaccaatattcaggaattacctattatgatttagagttacaccatatggttttctttaataagagctattatcaaagacataataacgttcccatatggttttcttcgataatagctgattttgaaaaccaatgacaaaaagttatatttagtgattttttcaacctgagggacaaaaacttatatcaatagaatatcacttagtttctgtttttttctcttacacagcattgtcatttgtgaaagagggagtgaaagttttcatattgtaaacttctaggacacagggaagttctgtaagctcctatatgatgccaatgagaataatcttggtttgcttaaaaagtgattgtctcttttccccatcccacccccatttccatgtttatttcttttgtttttttctgaaaagacatatttaatgtcctgcctaggtttattttctatttattcacaaaataaagaataacactgttatgttttgtatttgaaattgtaaggtacatttcttttttcttttatttttaatttaactctttgttttacagatgagggcagaagtgcagttgaccaagcaggtggtgcacagattgtaattgaccatttaaggtcactgtgcagtataacagatcccgccaatgagaagctcttgactgtcttttgtggcatgctgatgaactatagcaatgagaatggtaaacaaaactgaaaacttgctttatctctgggggaaaaattaaaaattatctttactatagtgcaaaacaaaaatatttgaaaaatgatgaacaaagaattcgtaagtggcatataaaattaataattagccaacattaaatttcaatgtttcaaaaatgtaaaatggttaatttactaaatgggactaatttttgaagggctgccagttttgatcagtatcaaaaacaaaaactccacagccctatagtatgatttaagcattcttactgtgaacattttaaaaataaacaatattaaaatagttttatcttcgttatatatataccaggagtagctttaaaatatgaacactgtttgcagaagtaaaattattttatctagatgctaggtttacttcgaataattttttaaaactctaataaaatctggctttagaaacaagttcagagcaactgtagagatctcattttagaaatttaattattgtaaacagcagtttcttttctctgtaaaacatttttagaccctagaaacaagtgatgtatcaataattttcagatagcctatatggttaattaaatgcatataaatctgtgatattaaggcttcacaatacgtttgtgtcacaaaatatccatttgtttctttatcatcttatgtgaatcactgtgtggatcagacattcaaattttggtatgttcctggtatgtaacacaaataaggtctttctgtggtttgtttcataatggcattttaagttgtgatattttggcagagacattttatttgcatattagacatgcagtattattctttactttcgtgtgttgtagaaacacgtggcccttttggcatactttttattttttttcacattttatagttgtgggtccaaagaaatattctcaataattcaaaaaaaaaaaaaaagataaaccttggcaataaatggctactgatatttggcccttgttgttagtgacaacagtgaatggtggggactgtggtaagttgaagagcccttgtcctattgaaaggggaaaaccactactcttctctagccagttgtttctgtatgacggtttggccaaatactgcccaatctttatattttggggatgggaggtgggggagaaagctgaaatgtctagtttgttatgtgacatctgagttttaaatgttggattacatatttttaatactatagaagctaaacagaaagtatcttcaggcctcatcctgtccaagggctaccagttttaagcctttgaattaagataatagagtttttattgatcaaatggcttacatattaaacttgagctaataataaatggtagtcttcataggataagttacatctgtttttccttccttctggtggaatcaattttgaagaacaaatgccctaaatataaatatgagaaacagaaaggacagagcctgagaaatccacaaaataaatacatatttcctaaataattgaaatttaaccacaatacataggtgtctgaattgcattaagaaatcattggtcagattttcatattgttttctttgcttttaactgcatttgggcttggacatttgaggaagtaggaagaacactaaatgggaaaaagttttagaaatataaatgaaagaaattttaagaagttattccagttttggaagtagtagaattagtcttgttatgcatctaacctagctgttagttctttgaggaagctgttaaaaaaaaatctgtatagaggtattaatatatcagatggctggtcttcaaaagcatcactatttccaatccaaagcagtgattgagtcccataatattatagggtatcccagtgtgtagagaagtgttctgagaaagaagattataattaacagcatgtggagtgcacagtctaactgtataatatatatattttttgaagagtaggcttttttctagagctcaggcattcccaagaaataacttagagactttagaaagctatattaacttttctctgaatattattagacaaatggtctttttcttcctttatttcaaaagctgcagtttgcagcttttaaaacttatcgaataaaaaagacataatcttgagtatttttaagaaacaaatgcgaaacttgtaactatcatcatctttcctctacttcctttttacattttgtctgtcacgagtgtcttaatttgtgaagtgattctttttcttctaatgttcactgaaattatatccttttatgtatgtttggcataattattaaagcgtctttattgttttgtccattatttgctttctcttttccttaaaatttatgtttgaagacttaaatattacatcatctttactgactcagattgtttggtattgatcatgtgtacctagataagtccctgaaacaaaaaataacagctttttgaaactcaggaggcactttctattagcactaataagtgaagtttctttttatatgtatttactatgtagaacatcagtatacaagactctgctaatttataagtaaaatattgagtgacaaatagctttttcctgctgtagtagaaaagttaactgccttggacccaataacttaagccgtatctgtagttaggaagttattgttctttagctgtatgtataaaatgtttaaagtatgcttataaaaaaaaagtactgagagtggtcacaaaaatccaccaacatagtttccctgaagagaatattttcaaattatttattagtctcaaaattgaaacttagaatgtcttgattcagaagcttcctgttcatacagtaaaactcagagcatatccactttttaaacccattaaataaggaataaaacaagtttcctaaacacatgcaagtcatatatgttatgaaaatattcagtaaagtcatttttgtaccatttgctaaagctgtatataattcataatttatcagtttcaaaagttttaaactagctcaagactctatacctctaagctatgagctggatatatacttttgtttccctattggtgaagcagttaatactcaggtaagtgtagaataatctgaatagcaaaagttataattgcttagccaaagaagttgtatcaataatgcataaataaaataatatttaaataacacaaaactttagtaaaaattgttttaaatttatccattttggaaaaaatatacatgtttttcacatggtgaaaaagcactctttgattctgtggctcatgaaaatagcctgaatatttgacaattatggctgtagaaaagcttgttgacactttgacattcagtttgagggaatgtgttgaacttgctatttttttttcttcattttgttacaactttagttattctataatccaaggaactcaaacctttaattgtaggtattttaatctcattagtttgttatctgtttcctagctttggttacccaatgccaaaacattgcagtgatgactgaaaattttgttcagtcatccagctgttttcaaatataacactgttttagcacataggagtttggaaaattttcattgattgactttttctggatacttattattgtctaaaattttcattagcaaattcaatacttggaagagaaacatgttattggaatgcatttgcttcattaaataagttagaaccattacaaactctttcccactatgttagttgatgttccttatctacgtatgatacatggtggcagcagtaaggggcattgaaaacacactggtagtaacaagtaccagatctgtaattaaaaatttcccataggtgatccacaagcgtgttgagtctgcatttgtacacttgaattaattgcacgtttgaatagaaacaaaccagtgatctaaagcaaagcactaaagaccagaacaccaccttgttgacaaatctattggtagtcaccattgttgtaagtagatgtaattaatcaataaatatctcatggaaggtgtaattgagggtttaactttttctcctagtattgttgtgctagagacacaaatagagggaaaattctattataactcttaaagaaagtggtaaatgataagcattaaacactaaagttactattttacgtaagctatgccataagagagaaaagtagaggcaattgaaagatgccatcaggaaaggaaaaagtatcttctaaaattattaacatatgcagtctaggcttcttcatctgacctatattttatatatacatgtatgatatgtgtatatatgatttctacaaatacagccgatttttctaatattttaattactcctcattattgaaaaactaatttctctttttttgtagttcctgaaatctctctgagatacctacatgataattcttatatttatttgtcgcatgggctgatgataattaagctatggttgaagggaggccatgtatgtaatttaggaagtgtaacacctgtggcatattattgaagcatgacaactgagtttaaatattaagctcattgtttaaattcacttgtttaaaaaaggcctatactacttctccccatattaaagattatttaatgtgtaattaatcttagctgctactttcagtcaatagcaacaatttcttagttcataattaaaaactaaaaagcatgttggcctgagctgcatgtttatccttatgtttcagtattacaatactttattacgggtgaaaaagagcatttcctagatgtgttagatgtttagaaaaatgatttgcttcacatgagtgaagaactatttttaaactttacttactgtggttacaagctagttaataatttatatatttcctaaatagtaaattatttttaccttactctaaggaaaaagaacaaaacaatatgtaaaaggtaaaattgtatctttgcaatttattatcttttttaaagtttttcttctttctcagagatccttgttctgatactgtcttttttaatgaaactaattttccatcatactaccttacatgtattttatttttcctctatttatgaagacatgggagatgtacatttaagttaacatcttttgaagcccagtttgtcactttttactccagtgagttaaatgaagtgtgttgaagacttattgggcagctgaaaagtacttaggcttttttattctttctttattatactaactgttgttctttatttactgttgttctcttttttaaaaattcctgaatttttgctgtttgtccaacagctttctagtcagtttgctgaaaaaggttgctttcataaagttctaccacaagtgttattttaaacaaattgtttcactaaagaatagagcagttagttagtctggtgcctcttgctaattcaacctattaaatttgaccaattagaccaggttagcttttagtgataatcttcctagactatttctatgataatgctgttacttaatgaacaggctgagagcttgattttcagtagaggtgtatcagatacacattttggtctaattccacatgatcaagtattggcatttatattcagctttggccattagagaatgaacttctgaatgtaagaagctgaaattttatcttagaaaaataaaattattatagtctttttgtcagtaattttagcagtctaatacttaaaatttggcattatattattacaggaataatactttctcagcattgttagcttctagattgctactgcgattatgataatgcatttaatatcataataccacatagatgcccacttagttgagggcagtgaaagggcaaaatatgtttggagttgctcattctttagtatggttttctcatttttatttgctttatgtctggattgaagattaatcatagccgttatcaaatattattttcaagatttttctcattgtgaaaatttgaagtggaaaaattggttttctgattttgatttcatccttacaagatgtatatcaccattaattattggtgcattttaatataataatatgcatttacatttcaactgatagaatttcaacatataaagcatataggcaaattttctctttacatgaaatgcttacctatatttaaaaataaatattcagatagtaacaagtctgaaagaccaggtctttactgtaagtgttcctatactagttgaaatatgatgatatgaggcacataatcattgatcatgcacaaatttttaggttccagaaatgatgttgaagtaagcattgagctgtttggcctttcaaaagctgaggctaaaatcagaggtaaataataggttttagccagatatctgtatttgcgtgtctaatttaggccatttacaaagtccattcagagaggcgctgaacccagaaaagcatcatgtgtaaattaacttttatgaagattattaatcctgtttttttaactataagtaaaatccagttaatactgtactgcctatattgttttatttactaaaaaatttttaagtcctacttgaaaaactagaaagtgaaatgcttttgaatatgcagatgtatcttgttaacagaatttttgccttgcaaataacttctgtgcaattttaaactgtaaaaactaaattacaataatgccccatggtaactagaaaagttttttttaagctaatatattcttttgtaaaagaagggatttctatgtttttaagcatatgtttgtaagatacacgttggaatataaattaatttggcattagcttaacttgctgtacaaaaattcaggcttaaatttatacttactgtagatgtggtctttatctcagcagtgctgtatgaaagcagagactgaattggtttctcttaataaatgctgcttaagcaacagctggcagtagtcctctttaaaaaaaaaaaagacatttaacttaaaagaccagtttttttctgagatgaaagcgtagagttttctttaatcagaataaacatatctatagaatttttttgtagcagtattcattgtaacaaaagttgatctgtaacaaataattaacctgtagtaaatatggggaaaaattatctactagattaaggcataatcactctagttgtcattatattgagaacagtaaatgaataagtttcttaagaataataaaatatttttactatctgttgatttttgctttggcatttttttgttgttgcttctgttttacatcaatctcacacatataattttgccatttatatttaaaacttttacaaaagggaaattttgccatgtagagacaatttttattttcagaacccagaaagaaccttagaattatcttttctagttttttatttgttagcgactaggaagaaatgtataaatgtattgttttaaacctccaatattgtcaatattaatgaatgttggctttttttttttttgaaatttctatgtatcattgaaatgtataatggggcttaaagcgacaatctgggtgcaaaacacatgcatgtttgatataaagaaggctttaaaataattgaattttaaacacatgtaagtaatctagtttttatatcctcaacactaggcttagaataaagttctccactttataaacatttgagtatataaagtttttaaccactaatcatcctcttggtagccatatttaagtcagtttactttgcagtgttataatagagctaaaacttgcttgaacttgaagctctacttcagttgtatcgtttctaatttttaattttcatatccttttttggaaatacagatatgtcattaaatcaaaggtagttttcttcagtctttattatgcccaaatgatttttagccaatttgtattagaacttttcatcaagagttttatttgcttctttcactgtttcaactatgctcaactcatttgactgtagatgggatttttaatgcaagcctgtaaatggcaatatcatatcattatactgtgaataatatatctacgtactaatgtacagactgtattttgaattgtgtcttgtcttgtttttacaagttcattcttaagttctatttaccaaaaagcttaatcttataacattgtctataaggccttaggaataaggtaaacctgttataatcttcttaacaaacttatttttagtaacttcagttgaatcactggaattctcagcatacttttctggacctataatctagttataccaatgttttaaacattaaacttaaaactcaggggggaaaaggttcctcaacttgagatcttctctccagatctccattctttggagtttccatgagtgtgacctgaagaacttggaaccattgaaattcaaatgtaggtaggtaagtgttcacaccagcgcatgcgttgattgccttatatctctttgtatatgcatctgtattgcaccccctcagtgcctttcttcctcttcctccccatagatcatgtagggcctgtgtcattttgatattatgtaatttcgtaaatctgtatttggtcagtgtttgtctgtgatgtgtgtcaggagcagttaaaacagagtcttcggacatttatgacattgtgctgtctaaagactgtctttcacacataagtgtttgctatgtatgggcctgggttacatttttgtgaattgctgtgtttgttgagctctgataacattctcctggaggtgctgatattcactgagggaggcagaagtagtagtcttgcagttgcttcacttaatctgcctaatgtatctagagaacaagaactatttctagttctcagaatttcttcctgtttgtctttcgcttaaaagtcatactcctgataacattcatgataccatggatgtcagctattatcctttgaaaaacatttgcaagttttctttgggcaataaaaaagatgatcaaatgaatcatttgtttatgtcaataagaatatcaacttatcctacacaaacaggacccctacttaatcttttcaaaaaacagcaccgccacctactgaattgtaacatctacatagtaactgaaataggtagactcaatctggaatgatctcttaggcttaagtagagtttcttctcaaataagcgtgatgagatgttaggagctttattagtgttatttctctgaaaatatcagagtgccaaaatctaggattcctaccaagcttttatctaatttttttcctgttatcacttctgctaagcacatcattgaacttcagaatatttaccatgtttcccactcacctcccaatctcttataaaaatgagatagccctggtgggcgctgtagctcacacctgtaatcccagcactttgggaggccgaggcggatggatcgcctgaggtcaggagttcgagaccaacctgtccaacatggtgaaaccctgtctctactaaaaatacaaaaattagctaggtgtggtggcaggggcctataatcccagctactcgggaggctgaggcaagagaagtgcttgaccctgggaggcggaggttgcagtgaactgagatcacaccaccgcactccagcctgagcaacagagtgagacttcgtctcaaaaatttttttttttaaaattaggtagtcctttgacactggttcttaaattttggtcttatgattttagatgtctaaaaattatagaagacctagaagactttttttatgtatttgggttatgtctgtcaatatttactgaattagaaatttaaatgaagaaaatatttaaaattatttagtatttcattttaaaataagaaacctattatatgttaacagaaataacatttttatgaaaaatattttcccaaaaaaattgctgcaaagaatagcagtttgttttactatttgtgatggtgaagaaaacaatggctactaatacaatttggtgccattgctggtgttcatgctaaaatgccagcagttttacctaccattgctttcgtaccattggtacaaatgtcaacacagtggcaagagcaaataaaatcttgggatttttatgaaaatagctttgactttgtgatcctctgaaagggttccagggacactttttgagaaccatattctaggaggcctctttctttgtccatgaagtggaaatttatatcaacctgtttctgtaaaagtgtgttttttttttctctctctctcctcctctggaccttcattatacaagtagaatggcaggcctgccagtcggtgtgaacaaattttagaattatttgagtatgattattgttttagttagcatcatagaagtagatagatataaaagagagcacccagttggtccacagtgagttcatccaactggatggctatatatttttctcttttgtgtggtatgtgtgttgtatgtgagtatataatgaatttggctcctgggtagttagacacattttcacgaagcaacatgattttcatgaattatggcaatacctacaatgtgccatttggctatgctaactttttctcccaatctgccataatttcaaatattactgcttcaatttgtatgccaaagattgtattaagcgctataacatttctttacttttcacccctcttttacctggaaccaaaatttgtaacattgtaaaagcagtccagaaaagtgatagatatgccaagttagcagaacatgaagagcattatcttctaagtggtattcttctgttatcttctccataaaatgtgttattcctctgatgtccctggactgttggatttttcatagtttgtaccaacagaactgagggggtgtgtgatgcttacatatatgcagacatatagtggagtttgactcacattcaatgcatgcgctagtgctcacgcttacatacctgaaatttaatgattcatcagctctgcagtatttgacaaagtagtgaaaatgaatacatatataaataaaaatactgctaaagaacaaggatcttcagaggtgaccctctagtaaagagccctatctactggtaagtaacctaaataatttctaacttggaaagctccttggtgcatgattattacaaatactataaccataatgcaactattctgccaatataatatagatataacactattgtgtaagtattttacctttaagtgttgtgaattattgctaaatttcatattcagaaaaaaatttaacatcaaaagtataaatacagattacttagttgagtatattttaattcttatctccttttagatttcataacttcattacaaaatttgaaattgttttattagagtatttgaactctaaacataaacttccatttttccatgtttattttttattcttattttggtaataggcccctttctattatagatgggctcccacaaccaaaccagataattatctgtaattagccagtcatcagttttcagggacactaagcctctgttgactatctcctcatacttcactctaaaagcaggaagaattaacaacaaagaccaccaggcaataatgaactggcatgtgagatagctcaactctgtatgttcttttctgaaaatcacccacctgcttccttatctatagattaagaactataaagagtaataaaaaaaattagcaggccaaccctgccaagggattggaactatgaggaacgtgtttttgtaagaaagttttgtctttagattgcaaagagaaataaaagaatttggggaaaattattagcttgaaaatggcatatcattttaaagagaaaaaaatttgtttagtctttagattgcaaagagaaataacttaaaagaatttggggaaaattattagcttgaaaatggcatatcattttaatgagaaaaaaatttttgaagagcatttctgtatcattggatgaaccagttatggacagttatagtgttttgcataaacatatgattttttgtatgtctttcttagcttattctaagaggcagtacttttggtgttcatttttggttcatttatcttcaactttgctacaggtattctattattattgtccatgaagaacccttgtggaaatccaaggcatgtttagtacttcaaaatcaattagtttcttagaaaatgaaggcaagcaatgatgacaaggccatgttaacctcattctcttcacctctctaagccagactttcctctctcttactgagatgatctgtcactataattaaataaaactttaaaaagaaaaatattttaggtaacttttttttctggtacatctcttcctagcagtcatcaagaacactctggttgcaaatattcagaaccaatcatttttgtgtatttattaaatatttttaattttgtattatgaaaagtgtttttaaaggattctaagatttttttctttcttggtcttcattaaacttgctacttttctcatgcttttcatattctgtgatttcctgtaatgcaaatgttactctaaatttttcactcaaaaactaatggtaatgtttgtttatacttattaaaagcctgctttttaatggtataagaccccatttagaaaactaatgatttgatatagtcttcaaactatttttatttctaaatgccttttggttattcaaaggattcaaaactaaactcttctgaactaatgtttaaaatgttcaacacaatcatatgaatggacttcattttctattactgtaatttaaataactttgagtttccaatagggaaaataagaggtgttttcttcttataatgttcatttgacatgtcaacactttcttttctgttgttgttttttttttgtttttacagattcgcttcaagctcagcttatcaatatgggtgttattcctaccttagtgaaattactgggcatccactgccaaaatgcagctcttacagaaatgtgtcttgttgcatttggtaatttagcagaacttggtaagtcttagtcatgaaccacaaatgtaattaacttattaatgtgcttacaataaatttttctgtagatattaagaagctagaaatccatttagattgtattagtttattttttgaagcatttgagatatttccatcaatattttaaaaagtaaatccaattagatcttatgattgcattgtttatgagagcgttttatttccctaataattaattttacatattaatgtttaaagctcacattgtacattatgtaacagagttgaatatttacacttgtctccacttgactttaatctttttacatgagggatggcaattgtatgtccacgggtaaaaataagattgaaatgtattgcatagtggcttgtgcctgtggttccagcacttcggaaggccgaggtgggtggattgcttgagctcaggaattcgagaccagtctgggcccatctttacaaaaaatacaaaaattagctgggtgtggtggctagtgccagtagtcctagctactcaggagaccgaggcaggaggatcacttgagcccaggaggcagaggttgcagtgatccgacatcatgccactgcactccagcctgggtggcagagccagaccctgtctcaagaaaaaaaaagaaatttattacatttcatataaattgcatttttctcaggtaaagaggaatctaacgttagactaaggttcttcatcctcttttcatgaaatctcaaaacatggcagaggacttttttctatgaatatatgtgttatagtattagaaaacaaaatctgtggaatccttgaaattcagaaggcaaacaaaaccagaccaatgctggaaacacatcctagtcataacacagaggaggatgatggcctcagcacctccacctcttcatttttctctttgttatggattaccctttcttcttccccacgcccccaccttcttgtcttccttcacaacccacaatcatgttaataataaattattatgggcatagtgaaatgaaatggtgttttgtcatagctaaataccgtagttacaacaaacaaatatatcaattctgttacgtaccacattctataaataaaagcatgaagtcactagtcttggtttttctaactgaaagctcatcttgattttaacattttacttttattttgtcttccaagcaaagggaatagaaattattaaagttatttttagtaaaagtcattcttactcaatgggtcatatcccagtatttgtgaatgtttctcatcttctctcttcatctgctttttcttttttatactagcctaattaacacattttttctgtcattcattcaagtgagaccaagaataaaagtacattcatttagtatttgacaaagttattcttttccgtgattaaaatggaatgtaggagtttgtgttcagtatggttggcagaaataaaacagaaattgtgttataatccgatactgaaagtgtaacagaaacatgattggttcaaatctttcttcacttgccttcagttttatgaaaatcaaagagtgcaggtactttgctgttacattttaatgtgagcagtttctagaacagcactgtccaatacagtagctaccagccatgtggcttaatgggcattgaaatatgaagtctcaattgagatgtgttcagtataaaatacacaatcgatttcaaacactatatatgaaaaatataaaatctcatcaatatttcatatgttgattgcatgttgacatgataatttgaatatattgggtgaaataaaatattaaaatgtttactttttaacttttttagcacatcttactagaaaatctaaaattatatatatggttccatttttgctctcattatatttctgttggacagtggtgctctagaaaatgaagtgcaacagaatcatccttcactctgttaaggccctcccttttgaagttttaggagagtacatagaagaaagcaaagattaatgaaatttatctcatctaactttaaggaaaagtcagtacaaagtaaggaaattacaataatccttggataggctgtgctgaataagaacttatataattgtagttgtttgctgaggagtatttcatccctttatggttttgtgtctaaatcttgtaaatgcttcaacattaggaactgtgcagaactcctgcttgacctcatgagaggagagttgtttgttaccccaagaaatagtcatcatccacttctcaaatgagagtcaaggaaaagtattagtcattattaccgcctcttatgaaaagagcataacaagaactgtggtaatggaagagggtgggctttgagtttagtcacaggagttacaggagtctttttttttaaactttaagaaacttattccatgtagtatgtccatataaggagtcttatgttttacagtaaaagaagatcctggatctgtatcaaaccttactcacctttacagcacccgtatgaagtaaactgggcctaatccttacagttaacccaaccctgtgatttatttagtaatactaatttaggatcatacatacagtcaagagcttctgtgagaggaaaattcatttatctaagttacgaacacatgaatattgaagtattttagagttctaagacaaataacttacatatttgaacccaaatacttcaatatgtaaatattggtataactcttgctgtgtgtttaagacattataataatataaatatattaacatttctccaaaagtgccttgcataaacccagattccaaattgttcacgttagggcaatagttttcaaactttttgactatggcccataataagaaatacatgttcttatcaccacttattgtattacacacctgaaactaaacaatacttattatccttaacatattcagtgtactctgatcctaaactgatcacatgacttagtggatctctggcttttgaaaaatacagcattataggatttctattattcataaatcatttggaaggcagtcttttgtattagagaaaaataattcttgatgtacattctttttaaaagagaacttgaattctgacacaaagcatctttaagtgatagttcaaatagtttaatttctgattttagtatctatagttatttttactatatatataataggcatagcttgtctcacaagtttaattaaaacatttggtttattcaacttttaaaagtcattaggcaattaaaaattttaatggatatgtcagaaattctcagtgattatgtttgctttgctgagtataaaagaagtttttcttacataataaatatatacttgctaactgatgttttaaagtttccataatgtataccatgccagcctgtgctttctcactaagcagtgtttttactgagccctgtgaactccagagatacctgcaaaagtattgttggaagagtcaaaggcagggaatggtttaatatttaatccagtcattttctcatttgggaaaaaagtgaaaggtttttcaaaagctaaaaccccagaaataagcagaagtatttgccctatagctctgtcggtcagctctgttaaccaaccctttttaaacatagatactctttaggatagccaaagttatcaaccatccacctcttatactttccattctgtgcgtcttttgagtatctcaatggatagtgcttgccacatattattaaatgaataataatatgaatgacccaatcaatactgtaatatcaatgacatttgggaaatgggagtgtatgaatccatttgcactaccataaaggaatgcccaagactgggtaatttataaagaaaagaggtttaattggctcatggttctgcagggtgtacaggaagtgtggtgcctgcatctgcttctggtgagggactcaggaagcttacaatcatggcagaaggtgaagagggagcaggcgtgtcacatggtgagacagggagcgagagagagagacaaaggggaagtcacagactcttaaccagatctcgtatgaactaactcacttatcacgaaggggatggtactaaccattcatgagggacctgcccccattatctaattacctcctgcctggcctcacctccaatattggaaattacgtttcaacatgagatttggaagggacaaacagccaaaccacatcagggagttttcattggacaaataaggaaaaataatatgaggacaaaagcagagcacagtatactgagggagccctggcctggtaggagagaaaagaggtaagtaaagagttgcaaagacaaccttgtctaccttgctgatttctctggtatacagggaaaataagccattgaaaacagtttgatacaagttgctgtgctaagatagcagatttgtttgagaggctgcgtagaccacctctattcagcctagtctcccccagtctatgttaaaagataaatatgcagctaatttagttcagcccaggttcatactataatttcagtggttactgccctaccccatttggaggaagaaaggataagagaaaaatatgtgtatctaagacttctcgagtttatataatgagtcagttatgcccatgtaatagctaggttgtatacatcaacacgggagtggaacatgtatgcaccagaataatgtttctcctttcagagtgagctttcttgcctgttaacaagtaatgtatttttattgattcgtgtaaatatcaagtgtttaaaattcatgtcacatacttctgaatatgacatattactaaatgctacagttactttttgtcaaaatgtttttaataaaagtgttaaataacaaatttgtgtatttttgctgactagtgatgagatgtaatagcttaaagatgaaatggaaataatttaacaagtgcaatctatttcagaattgggacagaaaggaaaatacagctctgctttattaagtttcataaattttacaggattaaagatgttttcattttttcccaataatgaaaaaaagattgttttcctcctgattgttatttatgcacaataatattaaagagaaattggcctttaacccaacactctttaatataaccatggaatttttttttgttcccttcgagtcccaatgaatgtgtttacataatttttcatacttaaaatcatagcatgaatatggttttaaagtatgcattcttatttaacatggaataaacagaatgagactttgcctcttttaaaattttagttggaaactaactaaaacccttcagtaaagagatttcttcttaaaggcttaagacctcaaggattgggagcccaaggcaggaagattgattgcagcaggaatttcaagaccagcctgcgtaacatagtgagacctccccccgacccactctctaaaaacaaaaagcaaacaaataagaacaacctcaagggaagggaataaaaaagaaaagcaggagagaggattgtacgagaatattttgggacctgggaagaaaggcaataacttacatagcaaacctttgacatctgaatcctggataagaaaccaagaactaaccagtttgcatttcacagtcttcaaaaggcttgggatttgatggcatcaagatttctagaccctctttcccctttcacaccttgtgatgactaccccttgcctatccaaggagaatgctatgcttcttgtcaggatggacgaaaaagagggtttcttgatggaggatatgacactaaattgaagtaaaaggtaccacagtaccaatccataaacagattaagtgaaatctgaatgccgagaaccacagttttattgccccatttgtctcccagaacgtagacttaaagttatttatattgagggttctctacaaaaggccagcagatgaccctatagggaatcttgcagtcaacaagactactcgtactcatagctcctaatcagtttattattattattatttttagttcctaacttcatcaatggcagacagctcaagaggtgagggcaatctctaacatggaagataaatagagaaaagcaacagtacacttttcttaaggagaacagaaaagagcttgagcattaagaataattgctaagatgaaagacaaaaattggagaaatagttgtacgagtaaaggaaaaaaaaaaggagatagaaaataaaagagaaaatataagaagatcagaccaagagtattagaaaagttaacagagaggaggaaattgccaaataagtatcacagaactgaaatacaaaatttcctacattgcaaatatctgtcaaataaatgtcctaaggaatgaaaatacacccagaccatagcgcatcaatgtgaaattttacaatgctgaggacaaagaacatcttacaagcttctagagaggatgggggaagtaaagttgaatacaaaagatcatgagtccgtggacatatgtctcaaaacaacattggcagccagaagaaaatgcaatgttgccttcaaaatttttagggaagccagatcaattaggcaaggaagaaataaagggtgtcaaagttggaaaggaaaaagtcaaattgtgcctgcaaacatgatcttatatcaagaaaaacctacagactccaccaaaaacctcttagaaccaaaaaatgaattcagtaatgttgcaggatacaaaatcaacatgcaaaaatcagtagcatttctacacactaacagtaaactagctgaaaaggagatcaagaaggcaatcctatttacaatagctataaaacatataggaataaacttaaccaaggaggtgaaagacctacaaggaaaactacaaaacactgatgagggaaactgaagagaataccagcaactagaaggacatcccatgcttatggattggaagagttaatattgttaaaacggtcatactattcaaagcaatctgcagattcaatgcaatccctgtcaaaataccaatgactttttttttgtggagatagaaaaaagtagcttaaagttttcatggaaccacatgtaaaacccaaactataaaactagtaggcaaaaacaaaagagaaatgcttcaggacattggtctaagaaatgtttatgtataagacgtcagaacacaggcaacgaaagcaaaaataaataggatcatatcaaatgaaaaagcttttgcaaagcacagaaaacaacagagtgaaaagagaggctacagaatgggagaaaatatttgcaaattattcatccaactggggatttattccagaatatccaaggaactcaaacatctcaacagcagggtctcactctgtcacacaggctagagtgcagtggccaccttagcctcccaagtagctgggactacaggcgtgcaccatcatgccccatttgtttttgtattttttgtagagacagggttttaccatgcttcccaggctggtcttgaactcctgggctcaagcagtccacctgccttagcttcccaaaatgctgggactataggcgtgaaccactgtgtctgccccagtcccatttttaaaatgggcaaattatctaaacagatacatctcaaaagaagatacaaaaatggctaaccaatgtatgataaaatgttcagtatcactaatcttcagggaaatgcaaatcgaaaccacaatgacatattatctcaccccagttaggatggctattattaaaaagacaaaagttaacaaatcctggtgaggatgtggagaaaaaagaactcacactgggagtgtcaactagcacagccactagggaggttcctcaaaaaccataaataggccagatgtggtggctcacacctgtaatcccaacactttgggaggctgaagcaggaggatcacttgatgccaggagtttgagaccagcctgggtgacatagggaaaccatctctgcaaaaaatttaaaaattagcctggcatggtggcacaggtgtatagtcccagctacctgggaagctggggtgggaggatcgcttcagcacaggatgttgagtcaggttgcagtgagccatgatcacaccactgcactccagcttgggtgacagagcaagactccatctcagtttaaaaaaaaacacaaatagaactactgtatgagccagctgtctccttactgggtatttatcaaaaggaaaggaagtcagtattgaagaaacattacacacccatgtttactgcagcactgttcacaatagatatgggatcaacctagatgcctaaatacatgaagaggtaaaatgtgatgtatatgtatatacacacacacacacaatggaatactattcagccaccgaaaagaatgaaatcctgttttcttgcaacaacatggatggaactggaagacattatgttaagtgaaataaaccaggaatagaaagttaaacactgtatgttctcacacatgtggaagcttaaagttgattttatagaagtaaaaaaaaaaaaaaaaaaacggatactagaggttgggaaaggtagcaggaagagggataatagggaaagattagatacagaagatacaaaattacagctagataggaggagtaagctttagtgttctgtaccattgtaggataactatcgttgacaataattattacatagtttcagatagctagggggaggatattgaatgtttccaacacaaagtacttgagatgatgaataagctaattaccctgatctgcttactattcattatatgtaacaccacagtgtaccccatatacaattattatttgtcaaataattacacttttttattttttgagggaaaatgacttccaacatagaatcctatactctgtcatactatcagttaagtgtgagattataataaggatattgtcacacatgaacatctcagaaaatttcttaaatactttatctctggaagccactggaagttgggttccaccaaaacaagggatttaaatgaagaaaaactacataggagctgaaaacgaaatccaacaagaatcccaagtattacagtgatgttatcgtcccatgtggcatgctttcaagaagcaaccaatccaggttgggttaggtcaaaaaactggtgggatggtgcttaggagagttcttacaggaaatgaaattgattaatatctaaagtgaatgcattaagattagaaaactgctggagtgtttggagttgcattaataacaagcacatagctaagcaaatgaggaaaacattattccaggaaaaatgaattagtgtattactgaaacacaactagtgatataaacaaaattacatataattagaaagatgatggagagtatggtgaacacaggaaagaaagaaaactagtgtttcatctttcatagtagaaatttgatcagaaatgccaaataaactagcagtacaaatatgtagtttagataatacgtaagtaaacagtatgaattagctaaaagagcttcatgtatttgtgaggaagaagaaatggaggagaggaaactggagtctgctgataatattaggctaactctttaaattcatagagttgtaataaaaataaaaccttagtaaatgaggcttcttgccaaaggcctgttgaggatccatggcacttaattgatagatataatgtccaaattatacttcatgctgtcttttcactctgttcacctgcaggttaagtacagattttgttctataattcctatattaataatggtgcataatttccttatactggcaaacagagcctgagttacatagcaacagtgatttggtttccttttattaagtgtttggaggaaaagaatgtggattggaaggaatagagtaccaatactattattttaaagaagagtaagaacatgtaactagatgaatgatgatgtctatatactttacctatgattttatgtttttgaaatccatctcacttggacaattctctgaagcagagggataaccaacaaagttccagggataaatcatctctacttactttttatttattttttttctttttgggacagagtctcactgtgtcacccagactggagtgcagtggcatgatctctgctcactgcacctctgcctctcaggtttaagtgattgttgtgcctcagcctcctgagtagctgggactataggtgtatgccatcacgcccagctaatttttgtatttttagtagagacagagttttgccatgttggccaggctggtctcaaactcctgggctcaagggatctgcccaccccagactccggaagtgttgggattgcagggatgagccaccatgcccggcctcatctctaaatgaaacctcctttttgggtggagtgtgctgacatttgctgaatgtggtctctgagggtttcagtatcttattggaaaagacaccctacccttactttttttcccccttggcatgtgaagtaagagctaaagccgtagttttttgtgacattaaagaatcatacttaaagtcttggagtggatttttgtcattttggaatagatccgttgacaatgtgcaccaaagcagtgtaataaaatgttgatcaaaactgtatttaaccatattaatgtgtgtctctcctgttaaatttgcaaatttcttacttgatagtaacacaagagatttaccagagactagcgagcagaatgtaaccctgataattcatttacatgttcatttactcataaataacttcattttggacacctgctttataccagggactattctgtgcactatgtttctggtggttgaagcagtatgtactgcccctgccctcaaggagcttatagtttagtgtgtaagatggacatttattttaaaatagtttgcaaataaactaacatataattacaagttattataattgctagtatgagaaagtaatagagtaaggtaagggattaatttaaattagaagcatcaactctaggtgggaaagagcattttcagacaatcagtattttcaaaatgtctacctcctacatacacattatacagtagctttctcacgacactgctggaggatgctgccatcaaaacaaaacaaatgaaagagaaaaggcatagataacagggtatctagtacaggaaggagagataatgataaagataacccaggaggccagctgtgctaccagagagaccagtatatattagattaggtcagaattcactgaaagaaacttgtagaaaaattaataggatacttaatgcaaccaaagacattgagaggagaattggagagaaatggaatggatttgggttggattttggaggtagattgacagaccttggtgatttattagatgtggaagttgagtgataataaatgagcagtgactcctagatttctgcctgtgcagatagacagagtgttcatatactgagttgaggaaccctggaggaggaagatttcacagtatgtcaaaagcccctttttggtattgagtttagaatgctagagagatactcaagtagaggtgtcaaatgggcagttaaatagcctgatgtccagaagagggttatgaatatttatgttgtataaatatcaacacagagatgctgtttggtgctatggaagagcattggatagcctcaggtgagaataaggactgagaaggtaaagcaaaggatgaatcctaaggaactagaatttatacaggtcttgtggaaaaggaggaacaattataggagattgctaagtgtagaggcaggtaggccaaaactagtagatttagtaatgcatgtgagttgagagagtagaggcagtgtatgtaagcaatgttatcagaaacttatttgtaaaagcaaaaatgagcttgaatggtagttgatagaggtggactagggggaggatgtttgtttttaatattgttttatgtgagaaataccaaagtatatataaatgctgatcaatggtgaggctctaggagaggttggagatgctgagaggcaggaatgaatgaaaccccaattactcatgcagaattagtcttcaatagtagatatgtcaggaccagtgtagaaaacattccactttaatgatactaaagataagtcacctttaattcatccatataaaatatgttatgagaaatttttctttgactaaaatccttaaaactatgaatttatgacttagtaattttgttgttgctgtggttactagagaacctttttttatagctcaaatataattgggtcagaacattttctctaaagccttagatatttttccttttcagggacattaaaaatggatttgattgttcccatatttgaagagtatttgtatttatcagtaatggtacaaaataactaagtattgaaagtattagaaaacagtttctggactttatttggtttaagtttttcttttttattttacagagtcaagtaaagaacagtttgccagtacaaacattgctgaagagctagtaaaactcttcaagaaacaaatagaacatgataagagagaaatgatttttgaagttcttgctccattggcagaaaatggtgagaaacttaaatgcacctttggatttttgatcatgtatgctttaaacttttttcctaatattatttaattgccagccatttgactcaaaaccattctttattagtgatatgttttattttgcatatctctaactttagctatgttatctactccatagctatatctacattggccaaagcaactttccaggttcctttgattttaaaatcttagaaaagatacttctgtagctaacacattcttgtgccattctggaaaaggcagctgagaggctgagctctacttctacacacttgtaaggcaaaggggataaaagttggagtctcaggcctgccaacagtgaagatactggttaatcactcccttctttgggcagaaaaatcttaagagatgcatcgtagaaataagaatgaatcagaagaaacaaactattccatattagtaatttttcaaatataatgtctaacacgtactcaaagaggatcagatattaatacataagacaaaacacactgtaagcaagagtaggcagcaaatcttcagatactggaattattagacactgattcaaaacaggtgtgcttattgtgttcaaagaggtaaaagctagcttaaataatttagaaggaaactaaaaactatttttaaaaagtggcatagcagatttaagaatgaaataaatggaaatttctgaattgaaaaatacaaccaaaattaagaattcagtgggtggtttaatagcagatttaatagatactgttgaattaaagaaccagtgaactggaaaacgggttggaaagaaatccaatatgaactaaaaggaaagaagaacacatttacataaaagagaataagaggtcagaggaaaaaatgagacattctcatatgcattttttggagtcccaaaaggagagtagagaaggtggggaggggagtgtgcagaggcaatatttgaagaaattttggcagagaatttatcagaaattatgaaaaatgcaaagatccaagaagccctttgaacccaaaatatgataaacaaaaatccacatctagatgcctcatactgaaaatgtagaaaaccaatgaccaaaattattatcttcaaagtaacaacagtttggctgacagctaccttctcaacagcaacaatgaaagccagatgttataaatgtggtttgtcagaaggaaaatgatatagatgcaggggagaataaagaccaaaaaaaacggtagatatataggtaaatcttataaacattgaatatatcaaaaaaataacttattgtgaagtttacaatgtacatttatgtgatttaaaatataccacaaactgagcttataaataagaagaaaggtaaaaggagttagagtcctaagacacttgtgttatctggaagactctggttatttagtcacttttaacttttaaggtgactactaaagtaattttttaaaatgatatatagctgcagaacaaatggaagcgacttatggaaaggttttttaataccctagtaatgcaaaacaagaaaaaagaggaaagaaaaaggaacacgaatcatagaggacaaatgaagcataaaaatacagttttaagacacagtatttcagtaattacgttaaatgtggcctaaatgctctaattaaaagaccatttgtcacttgtgttttaaaataaataactatactacttaagcaatacttattaaatatgagatttaaaagattgagaataatagggtagaaaaaatataccagtgaaacctaaggaaggctggggtagttatattaatatcaagtaaaatagattttaagatgaaaagacttgctagagataaagagggtgactttagtaataaaaggtccaatttacctagaaaaaaaataaccgttatacattatcccaaaacatacggagcaaaaacattcagaactatgaagagaaacagacaaatccacaaatattgtgagaaattttaatacctctttcaataatttatagaataagatagaagaataaggttatagaaaatttgaaaatgattaagacaattgatttaatggacctattttagaacacttcaactacagagctctttcaagtacatatgaaacatttaagaacatgtatacttgtcatgaaagaaagaaatttcaaaagattgctatcatacaaagtatttctttgacctaagtgagttgtctagtaaccaattataaaaagaaaaccaggaaatcgctgtatgtttacatggtaagaaatatacttccagtacctcagaggtcaaaaaagaattgtaatggaaattagaaatttttctagtagtgaaaatgaaaatgctatatctcagatcttacgtgttacaagtaaagacctattcagagggaaattttttgctctaaatgcttatattagaaaaggaaaagaactaaaatcaatgagcccagtattcatctcaggaatttaggggaaagaaaatataaacccaaaaaaccacaaggtaatttttcaaccctcaccttccaatttgtgtgaatatgctcatagtagtctctgataatcttttgtatttctgtggtagcagctataatgtcacctttattgtttctgattgtacttatttgaatcttctctctttttttttgttaatctagctagtggtctattaattttgttaatctgcacttgtactccctaaatctacaaaaaaaaattttttaagtagttaactggaataaaatacaacaatgttaacaaaatccaagagtaatatatattcttttaaaaagcagaagaaaagatagggtatcaacctaagtgtccatcagtggatgagtggataaagaaaatggggtgtgtatacacacacacacacacacacacaacatggaatactactcagctataaaaaagaatgaaataatgtcttttgcagcaacttaaatggaactagagggcattaattctaagtgaagtaaccaaatgccacctattctcacaagtggcagctacgctatgtgtacacaaaggcatagagagtggatagaatggactttggagacagagggaggtagtgagatgagggggtgaggggtaaaaaactacttattaggtacagtgtacactattcagatgacagatgacctaaaatcctagactttgccactatacaattcatccatgtaaccaaaaaccacttgtaccactaaagctattgaaattttaaaaaaaataataataagcagaaggaaggaaatgtaaagagctgaaataaaatggaaaacatacagtgcaacacaaacatataattactacagttgagtctgaaaagacagtggaattggtaaacccgtagtgagattaatgatgaaaagagagagaaagcataattaaccaaaattaagaatgcaagaggaggagaccttaccgcaggtcttacagctattaagaggatattatgaacaatttgatgcccatatattttatatatatatatatttttttttttccctcccccgcaagatggagtctcactctgtcacccaggctggagtgcagtggcaccatctcggctcactgcagcctccacctgggatgcagcctccatctccgaggttcaagcaattctcctgcctcggcttctcaagtaggtgggattacaggcgcctcctaccacgcctggctaatttttttatttttatttttagtagacacggggtttcaccatgttgcccaggctgatctcaaactcctgacctcaggtgatccacctgccttggcctcccaaaatactgggattacaggcatgagccaccgtgcctggcctgatgccaatatattttaaagtatgactgatacaagaatagaaaagctgagtaatcttaccttaagaattcttccagagaataggaaaaggaaatatacttaccaatttattttaatgaggctaatgaaacctttataccaaatcccaacaaagacaatacatgaatgaaaattaaaggctagtctcaccatgaacatagatccaaaattcctcctaaaattttagcaaatttactctagtaatatattaaaaaaattaatcacaccaaattgcatttattctgaaagtgtaacacaatttaatatttgaaatgcaactagtataattcatcaccttaaaatatttaaggggagaaaccatgatcttctcagattttaaaaaaagcttttcataaaattaagtgttcattcattatttttaaaaacttaggaaaacaggactaggaaggtcttcaatctgaaaaagatatctatgagaaggctgaagaaaacatcacaatcaatggtgaaataaaaaagcatttgctttgagattgggacaagaaggatcatccccgcttccatttaacattgtattgtaagaagtatccagtgcattaaagagaataaaagaaaaaaaattaagataaagcaataaaactctcattcatttatgatgtgattatgcatatttaattcaaaagaatctatagatcagttttatagatctttttttaaatcagaattttgttaggttactgccaaaaaacaaacaagaatttctatataccaaaaaagaaaaaacagaaaataaaatgtgaaaaatacgttggatagcccttttagctggaactgccaccttccagtaatttaacaaaataatgaacacaaagggaaagagaagcatctgatatgtattctgtaggccttttagaaaatacggagttgttcctttagccacatacattcaaatctacaggaaaggtgatattgtagacatcagaggaatgcatcctgttcaaaaagggaatgccccacaaattttaccatggaaaaccaagagtctatggtgttacccggcatggtactagtgttgttgtaaacaaacaagggcaagattgttgccaaaataattaatgtgtataatgagcatattaagcactcaagagccaagatacctccccgaaacacatgaaggaaagataggaaaagaaaaagaagggagccaaagagaaatgtacctgagttcaactgaagcaacagtctgttccacctagagaagcgcactttgtgagaacaaacggaaggggcctgagctgctggaacctcttccctatgaattcatggcataataggtgttttcaagataaaaggcttctagactattaaaaagtatataaaaaattaattccagatagattgacctaaatgtgaaagttaaaacttcagagggtttatcttaaaatgtaagctaggagaatatcatcatggccttgaaatacttttcttagatcacaaaaagctctaatcataaaggaaaaaattgagacattggttactttaaaagtaaaacttctggctagcctggtggctcatgactgcaatcctaatggctttgggagggcaagacgaggatcacttgagaccaggagttcgagaccagcctgagcaacatagtgaggcctcatctctaccaaaaacaaataaataaaagttaaaactctttttttaaagacaccgttaagagtgaaaagcaagactggatgagagaatataattataacatataactgacagagggcttgtgtatacagtgtataaaaactcttaaaaatcattaagaaaaatgtgaaaaacattttaataagcacttgacaaaagatttatattaagtccaacagacttaatatagatatgaaaatgttcactcttaggtaacacaaaataaaaccacaataaaataccactatacacccactggaaagtctcataaaccaactgttgatgagggtgtggaacagtgggagtgtaaattggtacaattgggaagtagtatctattgaagttgaagcaatagatccaacaattctgctcttagaaatatacccagaagcttgtgcacatgtataccaggaactgttacaggaatgttcaaagcagcattatttataatgaaaaattggaaacaaccaaaatccattaacagtagaatgaataaatcataggatattaatataatggaaaaatatagagttatgaaaaggaatgaagacagctgtaaccattactgtggatgaatctcataatgttgaaaggaaaaagccaacactgaaaaatacatattgtatgattcaatttatataaagttaaaaacaaaaagtaaaactaaactgtagtttttaggaatgattatttacttggtaaaatgatgaaagtatagaagtgattaccataataaccaggatgatttgagacaaatgaaggaaggggtttgttatcagaaacagaaatgcagagataggcttcctgagttgttggcaatgaatttcttgatctaggtgatagatacatggttatttgctttctaataatatattaaacttaacttggatattttatgcacttctctgcatttgtggttttctttcactctttaaaaaaagttttaaaatacctatatatgatgcatacatgatacatacaagtgtacattcatacatatgtgtgtaaacagtggtgataaagatacttgtccttggacagaatggttttggtaaatgtgctgggctgtctgctttggcagaatgtcttgctaatcctaattaaggtagtttaagcctcctatatatttgttttcaggtatttgatttcagtcaaattgtgagaagagattatctgtaaactttaacattgagacatttaggctgggagtgatggcttacgcctgtaattccagcactttcagaggccaaggcagaaggattgcttgagccaggagttcaagaccaacctgggcaacacagcaagaccctgtctcaaaaaaaaaaattaattaaaattttaaaactacaatattgacacatttaaaatttcttaaatgtcttaggtcctatttcttagggagaaatttgttttttatctcattggtgttttggcaaagtaaaaattttactgtgaccttcagtcaattttaggccataaaataacctataactttccttgcagtatttcaaaataacaatgtgttgatatttattactgttttcccctctgccttcacatctgttttataattgcacaatggataggatgataccattgaaggcttgtttttggactaattctttgcatgtatcatccttcattttcccagtacacgaaggagagtgatttcagcattagaagttgggatttgtatagttcaaggattttagtatttttaaggctttttcatcatagtttttaattctagtcaccacacatctctagccctagcattctgtaaccaaggaaacgccctacttttagcatggcacagtacaagtgtaccttttaaagaaatattccaggttgaatactctgtgtattctgagataatattcaaaagaagatcagtgatcctagtgattcaaaaaagccaaattttaacacattaaaattgcctgaaagtcttaagtatttatttttaaaagtctttatttttcctaaatgataagctgaagctgccattgccatatatggatgcatatacagcttagggaaaccaatgactaaaataaaatccaactgaaaaaataaagtttaaatttaaaaatttctggccaggtacagtggctcatgcctgtaatcctagcactttgggaggccaaggcaggaagattgcttgaggccatgagttcaagaccagcctaggcaacatagtgagaccctgtctctacaaaaaaagtttaaaaattagccaggcatggtggcatgcacttttagtcccagctactcaggaggctgagataggaggattgcttgagcccaggagttcaaggatgcagtgagctatgatcataccactgcgctccagcctgggcaacggagcgagacactgtctcttaaacaaaaaatctgtgttgcaaatgtatttttcaggtgagttgactagcatttatcttaaggagtatcaactacactcaaagcatttagataggccagtttaggttaagatacaaagatgagtaaggtgtatctattgggggaaccagcccccaatatttcaatgtatgttctattttccctaaatgtcggcccatctgagaaatagagaaagagtacaaaaagaggaattctacagctgggcctccaggggtgacatcacatatcggtaggtccgtgatgtcccctgagccacaaaaccaggaagtttttattagggatttcaaaaggggagggagtgtacagggagtaggtcacaaagatcacgtgctttacagggcaataaagatcacaaggcaagggcaaagcaaagatcacaaggcaaagggcaaaattagaattactgatgagggtctatgtttggctgtgcacgtattatcttgataaacaccttaaacaacagaaaacagcgttcgagagcagagaaccggtctgacctcaaacttaccagggcgggatcttttccgcaccctaataagcctgagggtactgcaggagaccagggcgtatttcagtccttatctcaaccgcataagacagatactcccagagcggccatttatagacctccccccaggaatgcaattccttccccagggtattactatttttttttttattatactttaagttttagggtacatgtacacattgtgcaggttagttacatatgtatacatgtgccatgctggtgcgctgcacccactaactcgtcatctagcattaggtatatctcccaatgctatccctccccgctccccccaccccaccacagtccccagagtgtgatattccccttccagtgtccatgtgatctcatcgttcaattcccacctatgagtgagaatatgcagtgtttggtttttgttcttgcgatagtttactgagaatgatgatttccaatttcatccatgtcactacaaaggacatgaactcatcattttttatggctgcatagtattccatggtgtatatgtgccacattttcttaatccagtctatcattgttggacatttgggttggttccaagtctttgctattgtgaataatgccgcaataaacatacatgtgcatgtgtctttatagcagcatgatttatagtcatttgggtatatacccagtaatgggatggctgggtcaaatggaatttctagttctagatccctgaggaatcgccacactgacttccacaatggtggaactagtttacagtcccaccaacagtgtaaaagtgttcctatttctccacatcctctccagcacctgttgtttcctgactttttaatgattgccattctaactggtgtgagatggtatctcatgtggttttgatttgcatttctctgatggccagtgatgatgagcattttttcatgtgttttttggctgcataaatgtcttcttttgagaagtgtgtgttcatgtccttcgcccactttttgatggggttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttgtcttttgttgccattgcttttggtgttttggacatgaagtccttgcccatgcctatgtcctgaatggtaatgcctaggttttcttctagggtttttatggttttaggtctaacatttaaatctttaatccatcttgaattgatttttgtctaaggtgtaaggaagggatccagtttcagctttctacatatggctagccagttttcccagcaccatttattaagtagggaatcctttccccattgcttgtttttctcaggtttgtcaaagatcagatagttgtagatatgcggcattatttctgagggctctgttctgttccaatgatctatatctctgttttggtaccagtaccatgctgttttggttactgtagccttgtagtatagtttgaagtcaggtagtgtgatgcctccagctttgttcttttggcttaggattgacttggcgatgcgggctctttcttggttccatatgaactttaaagtagttttttccaattctgtgaagaaagtcattggtagctttatggggatggcattgaatctgtaaattaccttgggtagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaataggaattcactcatgatttggctctctgtttgtctgttgttggtgtataagaatgcttgtgatttttgtacattgattttgtattccccagggtattattaatattccttgctgagaaaagaattcagtgatatctctcctacttgcacatccgtttataggctctctgcaagaagaagaatatggctctattctgcctgaccctgcaggcagtcagacctttggttgtcttctcttgttctgtaaaatcactgttattctgtttgttttcaaggtgcactgatttcatattgttcaaacacccatgttttacaatcagacttcatatttttcaagcacacatgttctacaatcagtttgtacaatagtgatcctgaggtgatgtacattctcagcttacaaagataacaggattaagagattaaagtaaagacaggcataagaaattatgagtattatttgggaactgataaatgtccatgaaatcttcacaatttatgtttttctgccacggtgccagccagtcccaccatttggggtccctgacttcccacaacatatatctgctcaggagatagatggagacagatatggaggcaaatataagctcttcagtgaaataagtgttataatgaaagaatacttaaagatattagaagtataataaaaagtgttgatgtgggggtggagtttcctatgaagatcagttttaaaaatgtaattgggatgtaaattctgtctctaaaataccttatgttatgtttagccatcagaaaggttcaaggttatttttttcttttaacttttattatgaacattttgaaatgtattcagaaatagcatttagtaaaccaccatgtacccatcactcaagaaagctttaaatcaatgaaaacctgaagccctttttaaaaacacgactttatttatttatttatttaatttttatagacagggtctcactctgttgcccagactggagtgcagtggcacagtcatagcttactgtaaccttgaactcctggcctcaagcaatcttcctgccttggcctcccaaagcactgggattacaagtgtaagccaccatgcccagccctattttatagtattttatagcttgccctttaaacatgagcatgatatctagagtaatagtggagtgatactagttgctttcagagctgagtatcaatttgtttagatgctgcaagacatcctgaaaaatttggcaatttcaaatggaaatatgaaataaagcttttttgtatatttaaatgaactgtcaagatagtttactttgaagatttgagtttcaaaaatgtattatctaaatcatgcattttcttagttttttttttttttttttttttttttttttgagacagagtctcgctctattgcccaggctggagtgcagtgttgcaatcttggctcactgcaagttccgcctcccaggttcacgccattctcctgcctcagcctcctgagtagctgtgactacaggcgcctgccactgcacctggctaatttttttttgtattttttagtagagacggggtttcatggtgttagccaggatggtctcgatctcctgaccttgtgatccgcccatctcggcctcccaaagtgctgggattacaggcgtgagccaccgcacctggccctcttagtttcttataattctttataatggactgcttataccagagctcctattttatctcaaagtttgattattttgttcacgttgttctttagatgctattaaactacagctggttgaagcaggcctagtagagtgtctactagagattgttcagcaaaaagtggatagtgacaaagaagatgatattactgagctcaaaactggttcagatctcatggttttattacttcttggaggtgagttgtaatttatgccagccaaagaatgtggttgtcagatgtttttaaaatttattgtctcttctgtaaatactaccctagacattttctcatattcctatctcacctgctattgaggtgatgattttgacatcttaaacatgccattgatacaaccagacataatgaacctgaaaaagaagtgtcttcactatcttccagtatttgaagagctgtcacatagaagagatagctttggcaccaagggactaaagaaaagctagatggctccctgggacttggactagaaaaaatgctagactctattgtctagtatctattaaatgtttattataaaaagaatcattacttttcccattatgaatgtaacagtttgtgaggtgtgagtttccagttggatattcacctaagaatgtgaatttgttactcctagttatttttctcttgcttaactattcgtttcatttacctccagatgaatccatgcagaagttatttgaaggaggaaaaggtagtgtatttcaaagggtactctcttggatcccatcaaataaccaccagctacagcttgctggagcattggcaattgcaaattttgccagaaatggtaagcatattagttcctcctttgttagtcaaatactctatatttgtttatttttgctttgctaccacatatactaaaactggaacagtttagaagttgtgtaatatgtgtatatgctgctaacttaatttttcagaaatctgaaatacttagtgacattcctaacaaattacatattttatgcaattcaactaaattctaatagtttaaatatcatgaagtgcttcttttgaatacttggcacttcagagcttagtaagtttgaatcccattctagtatacatctgctttcttttgcctagtgattttattttggatctaattatctgagtattcattctaggattattgtgcctcaacttatatacttttatgcccataaaacttaagtatgaataatcccctggcatcgtgtagaatgtttaatttagtttaataatgtttcagggggcgccagacttctatgtttatgaaatctggcactaccaaaaaactcaaatacagtctagaaactcattcttacgttcctcatgaaatataccgtgtctaggaaatacagtttatttttctttttagtttaatcatcttccagtacaaactgttggtatatattatatcataatggcttacttgctccatttttactccttctttttgggagtgacttcctaattatggaggtaagagtggcataatatggataattattgaaactagatatggggtaaatagtggttcattataatattctctccgctttgtaagtgtttgaaaaataatttaggtatcagccatgatagcaaaaggtagagtactatcactgtaacattgggagaacacaagcatacatcacaataaatgaaaaatattggacattctaaccatgtgtttctacttctgatatattatctggctctaaactaaagatttttctggtaattttctgattttaaaacttttatctagtttaagaattttttttaacacttctcactcagtaaacagaaaaacctataaatctgatgggagaaagatttggaattcattttattgtatagctccattttccctaatgtagataatagccagacatcagtattataaagtatttatagatattttaaagaggaagaaaaagatgtgtgttttttttttcagatgcaaattgtattcatatggtagacaatgggattgtagaaaaacttatggatttactggacagacatgtagaagatggaaatgtaacagtacagcatgcagcactaagtgccctcagaaacctggccattccaggtaagacttaagaatagaaggcagctgtgtacaaaataaaatccatcatttggggaagctattaactgtatgtgatttgtgaacctgctctgatgaagaaaatttaaaaaaaaatagtcttcacattgttcacattttttcatgctaataaatggagatcatatgttaaataagttttgtgagactgtacaagaataatctttgccttcattcagatatcctgttaccttttgcgaactgttagattttcatcatgttttatagttaagcttttttaagtttgagatggggtctcactctgtcagccaggctagagtgcagtgacgcagtcctggctcaccacagcctctaccttctgagctcaagttatcctcccacctcagcctcctgaggaacagggactacaggcatgtgccaccatgcccagctgattttttttttttgtagaaacaggatctcactatgttgcctaggctggtcttgaactcctgggctcaagcagtccacccacctttgcctcctaaagtgctgggattacaggtgagagctactgcaccaggccttaggcatctttagttgaggtagaataatgacatcaattaacagagtccactcaagaatgactttcagttgttgtttttctataagcagatgtacaatttttttaaaatagccttaatgtgcctttggaagtcatgaaatcactgtattatggaaaatacaacaaaagatagttaaaactattcttttatcctactttctaaaaataaatttctgattagatgaaatagtacaattacatgatgatccaatccatttgaattcatttggtttacataggatagtaacatttattaatgtctataacatttatattaacacagttggatcaaaaacggaattgtgctttttgttgtaagagggtaacattttcagatttcctttacaaactatgtaagtaagtgttttggattggatctaaaaagccatgatactgtcataaaaattattatattgtctgttatccgcttatacacaaataggatacggacacacacataaacaactgaattccattcttaaaattgacaaaaaagtgacaagattgtttctaaatggaaaaataaaacatggatcttaaagatacttaataaacctgtattgaattgaatgtttatcaacaggaatgctaataccattttaaccatagtctctctttttctccagttataaataaagcaaagatgttatcagctggggtcacagaggcagttttgaaatttcttaaatctgaaatgcctcctgttcagttcaaacttctgggaacattaagaatgttaatagatgcacaaggtaaaagaaatgttttccccaacttgcatttttcatatgatagtcttaatgtgcctctagttgaaaaaggacttgtttttagcttttaggattatgtaatcataaaaaatagcaaataaaagatttaaaagttggttttggaactccatttgttaatttttatgcttgttataattatttatttatacatattatttatttatttatttatttatttatttgtttatttatttatttttgagacagagtcttgttctgtcacccaggctggagtgcagtggtgcgacctcagctcaccgcaacttccgcctcctgggttcaagcaattttcctgcctcagcctcctgagtagctaggattacaggcatgctccacaactcctggctaattgttttggaatttcactagacatggggcttgttgctcaggctgctcttgaactcctggcctcaagcgatccacccacttcagcctcccaaagtgctgggattacaggtgtgagccaccatgtccagcctataattgactttaaatagaaattataccatatctctccttattagtacttatagtcctggttttaggttgctttattcatcagtttcggcagggggtgttgtgttttggcattctatacccatttttaccttggctttgaaatcaaatttcattattgtgacagtcaaaaattttttaaatttgtcttccagacagggagagcatttttctgtttgcagaaacagcagtcagaaccactcctaggaatgaattatgtttatttacttatttctaaattttaaacccttttctatattgattgcatagagtctttctaagaaccctgcattatagtccgccagagcactaacagactagcaggcttaaccaaaagagtatgaagtcatttgttgttgtattttctataaaatttcacagtgttacagaagaaggcaaatagcccatcacataaggaatatttgcagttctagctttaatgaaattgtcgtgctgtgtttttttagacgtccttcacactctcaaatctgtacgaattatttcaactgattgtctgttagtgattcattccttggtttgccttctttcctatagcagaagctgctgaacaattgggaaagaatgttaagttagtggagcgtttggtggaatggtgtgaagccaaagatcatgctggtgtgatgggggagtcaaacagactgctgtctgcccttatacgacacagtaaatcaaaagtaagttccagaggaaactgttcactagaaaacttcagagtgtctttttcagaaacccagcattgtaggtcctaacaactgggataatatttacctgaaagtattgtgaagattcagtgagatcatgtatataatgtgcttagctgatacatgggatataggaaacactcggtaaatgggggttgctgttgttgctgctgctattgttgttattacttttaccaccaccgttatcagcatcagtgtcaaacattctttgtgccaggcattgaccatgcagcctactgatatttagaaattaaatggtacctagatagtatatgatgtccagagctcacagagttagaaaaaaatccattcttgtggctggctgtgccgctgtctggcacatggtagataaccaataaatgaacaaatgagctattttaaagatcacaatagtgagtacccaggccagcagttcagcagctgatttagtatctagattatatgatttttaaattttttaaatactgttttcttgtcgggcgtggtggctgacacctgtaatcccagcactttgggagactgaggtgggcagatcatgaggtcaggagatcaagaccatcctggataacatagtgaaaccccgggtctactaaaaatacaaaaaaaaattagctgggcgtggtggcgggcacctgtagtcccagctactcgggaggctgaggcaggagaatggcgtgaacccgggaggcggagcttgcagagagccgagattgcaccactgcactccagcctgggtgacagagcaagactccgtctcaaaataaaataaaatactgttttctttttcttttttgagactgagtcttgctctctcgctcaggctggagtacagtggcacaatctcagctcattgcaacctccacctcctgggttcaagcaattctcctgcctcagcctccagagtagctgggattacaggcaggcgccaccacactcggctaatttttgtatttttagtagagatggggtttcaccatgttggccaggctggcctcaaactcctgacctcatgatcctcccaccttggcctcccaaagtgctgggattacaggcatgagccaccatgcccagcctttaatactgttttctaaggtgaccctttcagtcatttctcttgtacaacttcagtagtgattatatatgaggagaaagtttagaactcaaatccaccagctgttttcatttatttttagaacagataagaagaagatgccaagagaaaaaacgtaaaactaaagctgttcttgtataaatctctttcatataaataattggcttcaccataatagctgtcccagctggtaagcctcaggagtgttcttctccatcagatgctaaatcttgagaactttccctggggaaaagcagctgttaactaggaccttcctattacctgtctcacccagaccaccctaaaagctcatacatttttcctgacacaggaccaagcagtatgttggcaaggtggaagttgtcaggagagaatagcaaaatggcttccttggtacccctttgaccccttctccatcataactgctctctcacgcccatttgttcatttaacagttaatatttgagttcttgcagtgtaaatactaaaaaatagtgtttctataaaggaattaactatccgttgaggggacagaaataaaaacagctagcttaagtacagctttaaagctacgtatgctattcgggtgtaacagaggaaagaaagactaacacactgtctgggtaatctgggatggtgccatagaaggagtgctattttaggcgttaactaggaatctcaggaggaaagggaaagagaatgaaggaaagggccttttcaggcaaagacagcaggatgtacaaaagcacagagatgtaaaacagcataattttttaaagaaactgcaaataaagcagtattgctagaacacagagtgtagaaagagacagtagccagagaggttgaaaactgggaattaagtgaattatataccaagttaagatatatggacttgattctgtagagaattcgggagcacttaaagggttttaagcagcaagttgccattatttgagggtttttttgttttctttattttttgtttttttgttttttcggggtttttttgagacagagtttcgctcttgttgcccgggctggaatgcaatggtgcgatctccactcactgtaacctccgcctcccgggatcaagtgattctcctgcctcagcctcctgagtagctaggatcacaggcgtgcaccaccatgcccggctaattttgtatttttagtagagacggggtttctccattttggtcaggctggtctcaaactgccgacctcaggtgatccgcctacctcggcctcccaaagtgttgggattacaagcgtgagccaccacacccagccatttagttttcatttagaaagatgtctctagggtttaatgggggtagaaaggacagttattgcaaaaatatatatgagagttgataaaggactgaattaaggttttgagttgagcaatttgaaattgctgatattcagccatttttgaaacaaatttcatatgggttattcaactagaagcagcgaggatggaaaagaagagacagacctgagaaaaatatgggtggtagaattgacagattcaacagtagaattaaaggaggaggtagttttagagctaattccaagtttggggtttaccaccagattgggttatcatgccattcaacaaaataaaacactataggaagaggtgcagctaacactccctaaacttgcccactcgcccatgctctttggagtcattacccttaatctttttgctctactccaagagaatctccaccattggtttgcaggggtatacaatcatttggatttccctgggccatattggaaaacgaattgtcttgggccacacataaaatgcactaacactaacaatagctgatgagcttaaaaaaacaaaaatcacaaaaaaaactcaaacacctgtggcatttgaagaagaagagaaatctaaaagtttagaaaaccagctgagtgcggtggctcacgcctgtaatcccagtactttgggaggccaaggtaggtggatcattgtggtcaggagttccagaccagcctggccaacatggtgaaaccccatctctactaaaaatgcaaaaattagccaggcatggtggcgtgcgcctgtaatcccagctactggggaggctgaggcaggagaattgcttgaacctgggaagcggaggttgcagtgagccaagatcgtgccactgcactccatcctgggtgacagagcaagactcccaagactctgtctccaaaaaaaaaaaaaaaacaaagaaaacttttggaaaacatatttgggagaataatcaaggaagacttctccagtcttgctagagacctagacgtccaaatacaagaagctcaaagaatacctgggaaattcattgcaaaaagatcattgcctaggcatattgtcatcaggttatctaaagttaagacaaaggaaagaatcttcagagctgtgaagcaaaagcacgaggtaacctataaaggaaaacctatcaacttaacagtggatttctcagcagaacccctacaagctagaaaggattggggccctatcttcagtctccttaaagaaagcaattatcagccaagaattctgtatccagtgaaactaagcttcataaatgaaggaaagatacagtgtgtttcagacaaacaaatactgagagaattcaccactaccaagccagcactacaagagctgccaaaaggagccctaaatcttaaatcctggaaacacatcaaaacagaacctctttaaagaataaatctcacaggacctacaaaacaaaaatacaattaaaaaaaaagtggggggtatacaggcaacagatagcatgatgaatggaatagtacctcacatctcaatactaagattgaatgtaaatggcctaaatgttccactaaaagatacagaattgcagaatagataagaattcattaactatctgctgcctttaagagacttacccaacacataaggactcacttaaggtagaggggtggaaaaagacattctatgtaaatggataccaaaagtcagcaggaatagctatcttgtatcaggcaaaacaaactttaaagaaacagcagttcaaaaagacagagggacattatataatgataaaaggccttgtccaacaggaaaatatcacaatcctgaatatatatgcaccaaacactggagcttccaaatttataaaacaattgccaatagacctaagaaacaagatagacagtaacacaatagtgggagacttcaatactccactgacagcattaaagaggttatcaagacagaaagtcaacaaagaaacaatggatttaaactataccctagaacaaatggacttaacagatatttacagaacattctacccaaaactgcaaaatatacattctattcattagcaaatggaacttttctccaagatagaccatataatagaccacaaaacaagcctcaataaattttaagaaaattgaaattatggcaagtactctctcaaaccacagtggaataaaactggaaatcaactccaaaaggaaccttcaaagccatgcaaatacatggaaattaaataacctgctcctgaatgatcactgggtcaataacaaaatcaagatgggaatttaaaaattctttgaactgaacaataaatgatacaacctatcaatacctctgggatacaacaaaggcgttgctaagaggaaagtttatagcctgaaataggcatttcaaaaagtctgaaagagcacaaagagacaatctaaggtcacatttcaaggaactagagaaacaagaacaaaccaaacccatacccagcagaagaaaggaaataaccaagatcagagcagaactaaatgaaattgaaacaaaaaagacaatacaaaagataaatgaaacaaaaagctgattatttgagaagatgaataagattgatagaccataaccaagaaaagaagagagaaaattcaaataagctcacttagaaaagaaatgggaaatactacaactgacaccacagaaatacaaaaggtcattcacagctactatgaacacctttacatgcaaaaactagaaaacctagaggagatggataaattcctggaaaaatacaaccttgctagcttaaatcaggaagaattatttagataccctgaacagaccaataacaagcaaccagattgaaatggtaatttaaaaattaccaacaaaaaaaagtccaggaccagacagattcacagctgaattccaccagacattcaaagaataattggtaccaatcctattgacactattccaaaagatagagaaagagggaatcctccccaaatcattctgtgaagccaatatcaccctaataccaaaaccaggaaaggacataacaaaaaaagaaaactacagaccaaaatccctgatgaacatagatacaaaaatccttaacaaaatactagctaaccaaatccaacaacatatcaagaagataactcaccatgatcaaatgggtttcataccagggatgcagggatggtttaacatacccaagtcaataaatgtgacacaccacataaacagaattaaaacaaaaatcacatgatcatctcaatagatgcagaaaaagcattccacaaagtccagcatctctttataattaaaactcagcaaaattaacataccagtgacatacctcaatataataaaagccgtctatgagaaactcatatccaacataatactgaatgggaaaaagttgaaagcattccctctgagaactggaacaagataaggatgcccactctcaccacttctgttcaacaggactggaagtcctagccagagcaatcagacaagagaaagaaataaaggtcatccacatcggtaaagaggaagttaaactgttgctatttgctgatgatatgactgtatacctagaaaaccctaaagactcctccaaaaagctcctagaactgataaaagaattcagcaaagtttccagatacaaaattaatgtacacaaattagctctcctatcaccaagagcaactaagctgagaatccaatcaagaactcaacccttttacaatagctgcaaaaaataaaataaaataaaatacttaggaatattcctaaccatggagatgtagttttacaaggaaaactacaaaacactgctaaagaaaatcatagatgacacaaatgaaaacacatccaatgctcaccgatgggtagaatcaatattgtgaaaatgaccatactgccaaaagcaatctacaaattcgatgtaggtcccattaaaataccaccatcattcttcacagaactagaaaaaacaattctaaaattcatatggaaccaagaaagagcctgcatagccaaggcaagactaaacaaaacaaatctggaggcatcacattacctgatttcaaagtatactataaggccacagtcatcaaaacaacatggtagtggtacaaaaataggcacacagaccaattgaacagaatagagaaccgagtaataaccccaaatacttacagccaactgatctttgacaaagcaaacaaaaacaaaatggggaaagggcaccatattcaacaaatggtgctgtgattattggcatggaagaataaaactgttgcctcatttccaacttaatacaaaaaaaaaatcaacttgagatggatcaaggacttaaatctaagacctgaaactaaaaattctagaagataatatcagaaaaagccccttctagatgttggcttaggcaaggatttcatgatcaagaacccaaagcaaatgcaataaaaacaaaggtaaatagctgggacttaattaaactaaagagcttttgcatggcaaaaggaacagtcggcagagtaaacagacaacccacagagtggaagaaaatcttcacaatctatacatctgacagaggactaatatccagaatctacaataaactcaaacaaactagcaagaaaaaaactaataatcccatcagaaaataggctaagcacatgaatagacagtaatgaagatatacaaatggccaacttatgaaaaaatgctcagcatcactaatgatcagggaaatgcacatcaaaaccacaatgccataacaccttacccatgcaagaatgtccataatcaaataaaaaaataatagatgttggcatggatgcagtgaatagggaatacttctacactgctggtgggaatgtaaactaatacaaccactatggaaaacagtgtggagattccttgaagaactaaaagtagatttaccatttgatccagcaatcccactactgggtatctgcccagtagaaaagaagtcattatacaaaaaatatacttgcacacatgtttatagcagcacaattcacaattggaaaaatgtggaaccaacccaatgcccatcagttaacgagtgaataaagaaactatggggccaggcatggtggctcacgcctgtaatcccaacactatgggaggacgaggcaggcagatcaccaagtcaggagatcaagaccatcctggctaacatggtgaaacctcgtctctactaaaaatacaaaaaattagccaggcatggtggcgggcgcctgtagtcccagctacgctggaggcttaggcaggaggatggcgtgaacccgggaggtggagcttgcagtgagccgagatggcaccactgcactccagcctgggtaacagtgcaagacgtgtctcaaaaaaaaaaaaaaaaagaaaagaaactatgatgtgtatatatatatatgatggaatgctactcagccataaaaaggaatgaattaatggcattcgcagcaacctggatgagattggagactattattctgactcaggggtggaaacccaaacatcatatgttcttacttataagtaggagctaagctatcaggatgcaaagacataagaatgacacaacagactttggggacttaggggtaaagggtgggaagggggtgagggataaaagactacaaatatggtgcagtgtatactgctcgggtgatgggtccaccaaaatctcacaaatcaccactaaagaacttacttatgtaaccaaacaccacctgttccccagtaacctatggaaataattttttttaatcacaaaagaatttcataatgttttaagaaagctacgaatttgtgttgggccacgttcaaaatcatcctgggctgcaggttggacacgcttggtttagagttttggcaaaccataattgtattaactaatttacagacatgatcctggcatctgaatttggaactctcagataaattcctgttacatgtagtagtaaggctcgtggaaaccttgattaatctagtatcttcagtatcaactaacagaattacataaccaaaccattcatggacacaaaaatatgtccacaggaagatacatcccagcttcttagaaacatctgaatttaggagccagaactacttaaatgctataatatttaataaatttaaagattttgaggcttttctgtgaattttgttcatagatccccctttccctcatctaacctcccacttctcgcccatccccgaaaagaagagttcaaatacccatcaccacgcaggttctttgaatgatgagaactgtggcatggtacccttttaggaaaaggtggatgggggtgtgtgtagcagaaaacaacttgaaattatataggattgtaactttatagttacatattacaactttaggattacaattcaatacctttacatatctttcctacaattgagagtatactgctgctaagcagccaaggagccttgattctcacactttaatgagcagaactataaagtgtgttaattgcatgagttctatgtcagagctgttattttctaacttaaccagtgttacagtagacatgactgcttttgagcagcagttcaagtttgtttcatcaaattataatcccaagaaatcttctacaaagaaagagttgcataggtagattagttatgcaaatagtaattatttttttctttgcctttgagattcacagcacacattaatactaaagaaacctctttaattttatttgaatccactgattgccaaactgtttgaccatggatcctttctgcaggtggcatctgttattacactggacgtactttggaaaaatgctgttctagaataagtttttaaaataattaaacaccaggttcaaatgtattacattcctgtagatccttagccagctgtgtgaatcacagctctctccttgtgttgttcttaaactttgaagatcatacctcaccctgaattccgtcttggagttcaacccttcaaaagtttgcactgactcacaaggtttcatgctgcttagtcatctcagcactttgcagtgtattcctgtgctgatgctcttaggtaaagtcacacctttctttgaaagagtgccctagtctaggactgctgaccaactagctgaatcttccaattatagacatcaaaaatgtaaagagaaatataggttgcctttataccaggaatataaaaactccctgctatcaaagccagcacttttctttaacctttaagagtagagaattctttatcagttaccaggctaaaaacttgtttaaacaaatgtatttagtcatttgctcattcatccaacaaacatttatttaaatcccgtactgaaaaggctttgatgatacaatcttgaaaaagaaaatttttgttaagtggctcaccaactcaatggctataccaaccggcaatcttataaaattacctcaaatcaaagcctatctgaaaatattccgttgtgatcaacatgatacagttttcaacagtcttaacctgggttgatttcactaatcaagggcaaattgactaaatgctaaatagatgaaattgttagcatggataatttgccttggttttatatataccaaaatttagctttctataagaatagaactatgaaataaaacatgtttcagactgcataaagcatctccagaatttttaagaacaaagacccactaatcagccaaactgcctaggttttagccttggctttaccacttatttattgtctgaacttgggcaaatgacttcatctgagcttcagttccttcatctatatgaacaggagatgatatctagctaatgagattttctgcaggataaaaatttgctaatatctataagctactcagtacaatgtccagcttatagttattgctccataaagggttgccatcaatattattctgtcacatgtgacgaatacgatgttttatctattttttaatcccatattctataaggcaaaatgatttcatagaatagctattcaataaacatttgttgaagtagttggtgagagggcaggaatttttttttttaattatactttaagttctagggtacatgtgcacaacgtgcagatttgttacataggtatacatgtgccgtgttggtgtgctgcacccattaactcatcatttacattaggtatttctcctaatgctatccctccccgctccccccatcccacgacaggccccagtgtgtgatgttccccagagggcagaaattttaaaaaggactcaggtatctgttccggaaaagtgagatgaaagtatacctggccaaagagaggacactgttcatttctgatgtacacatttccttagttcattccctactcttccttctactacactggtcttttaagtgtgattagaaacatagaggacaaaatgacagttcaaacatcttccctaaatgattgcatatgtatctgttcatctcttatggtcttctttactcaagctcttttgtgatttttataaaattttttactaagaattctgtgtctgtttcaaataaactgttgctgagtaaacagtaaattggggaggttagaaaaagctttctaaaacagattgatggggaaaaatgtattagatgccagaacacagctaccataaaaacttagttcttggactctatttagcaagtttgatcactaaacaagtttgggctcaaagcaaagatactttctaaaaatagttttctcaaaaaatttttatgaaatggaagcataaagcaaaccctttaaaaatattttagcaaatttggaaaatatttccaactacaattaattttgaagctgactcaggctttttaaaatgtccagaccttcaaattattaaaaatattgaaaatagagaaaattatttttaaaatattattgagacctcctactaaatcagatttagttcaagagttctaagacaacggaacccttggtggaatgaagaccaaaaagggtactagaaataaaggtgaacattttttttttcatctaacttttgccagatggtcttatatgttttctgtgtaataactttgtaataacaaaaacctatgagatatatacttacatcattccagtgacatggagatagtactgaggtaagagaggttcagtaatttgctcagtcagtgggatttattgaatccagagcttgatgtctcctctgtcatggagagaagacagagctctaagcaccatgagaaatgagggcagatggagaattttaagttctgctcagtctttttgcatgtaattcagttttcatatttgtaagattaaatcaaggggtaaaaagtacttaaaattttttcataaaagctttacctggaacatctgcagaacaactacctggcactatcatgaaaatttaaaagcaacttttttttttttaagaggcaggttctcactctgtcacccaggctggagtgcagtggtgtgatcatagttcactgcagccttgagctccctggctcaagcagtctcccacctcagcaccctgagtagctgggactgcagatgtgtgccaccatgactggctaatttttttattttttgtagagatggggtctcgctatgttgccaggctggtctcaagcgatcctcctgttttggcctgtcagagcactgggattaacgtcctgagccaccgtgcccagctgagaacttttttaaattccaagttttattcttgtttgtcaatcctaaggtaggtcaacatttaaggcagtgacatttttacttctttggctttggtagcttctaagccttctgttttttaatatgaactgcagtggtcttttctacttaggcaatttaagttgtcatcttttgatgaatgtatttaaagctaaaagctttttccttttcttctgtggagaaaaaaactatgattaaatcaaatgattcatacaggacactgtcgcaaaaccactcaacaatgagttgactgattttaatgcatgttccttatgtttaaaattaaagtctataattctctgatattatttattgtaggatgtaattaaaaccattgtgcagagtggtggcatcaagcatctagttaccatggcaactagtgaacatgtaataatgcagaatgaagctcttgttgctttggcattaatagcagctttagaattgggtaagtaccccagtgacaaacttattttcttctatttttatcttggatgaaaggaagtatagaagtggagttgaagtcagacagaaccttgactggaagcattttgctagtgtctgtaccgttctctgaatctatggaaaatcattctatatagattgttacagctgtcccctttggctgtgtttttggtaacatttttagggcaatgcattaaggtaagtttaacttttaaataatgtctcaagttacagccacttagagaatagagaaaacgttttcagcaggcttcacagagaaaccaaacaatatttagaatatgacagcatatgaagagtctgctactctcccagtgacccatactttctcttccatctctgctggttctctctactaccgattctttcttgctgttctccttctccatcaccgtgacttctattgccttactctaatgtcttgtcttctgtgttacccttctgtgtgttttgcattcagaactcccccaaagcagaggctaaataggctaaataatttcattagtttcagtttaacatagcttttttttttttttttttgaaacagtcttgctttgtcacccaggaggctagagtgcagtggcgcaatctcagctcactgcaacgtccgcgtcctgggttcaagcaattctcgtgcctcagcctcctgagtagctgggattacaggtgcatgccactgtgcctgactaatttttgtatgttttgtagagacagggtttcaccatgttggtcaggctggtcttgaactcctgacctcaagtgatccacccacctcagccctcccaaagcgctgggattacaggcgtgatccaccatgcccggccctaatatagcatttctgttgggcagaattcatcacgagaagctaatccgtagacatctagtttatgaatagcataagctggatggctttggagccaacccaagacagtcagccagggatggtgtaatagagtcacgtggcctgtggttaaggcctaaggctgcttaacacaaaggaggactttacacttagtagggatgtcctatccaattcaaagccatttgggtaaatactgttaactgatagcctcttaattcccactgacaacttagatccataattctcacactggggcgaatggaccctccaaccccagttccaggaagaggaaacactcatgtgagtatttttttatgtgcatagtgtgtaatgatcaagtcaaggtgtataggatatctgtctccttgaatggtctgttggtgactggaagccttaccaataacagtcagtgaacatatattttgtatatgaattatatactatattcttataataaagccagagaaaagaaaatgttaagaaaattgtagggaagagaaaatatatttactatttattaagtagaagtggattatcaagaaggtcttgaatccttgtcttcacactgagtaggctgaggaaggggaagaacagaaggggcttaggcttgctctctcagggatggcagaagagaagaaaatccaggtataattggacccacacagttcaaacttacgttgttcaagggtcaactgtatattctttggtgaaatgctgatttttgtcttttaaccattttttttttgactgttgagttttgagagttctttatatattctaaaaattttgtagttctatattttacatttaagtctgtaatccattttgagttaatatcggtataagtcacgcctgtaatcccagcactttgggaggccgaggcgggtggatcatgaggtcaggagatcgagaccatcctggctaacacagtgaaaccccgtctctactaaaaatacaaaaaattagccgggagcggtggcgggctcctgtagtcccagctacttgagaggctgaggcaggagaatggcgtgaacccaggaggcggagcttgcagtgagccgagatcgcgccactgcactccagcctgggcgacagagccagacgctgtctcaaaaaaaaaatatatatatatatatatatatcggtataaggtacgagggttaggttagggttcattttctttgtcccatggatgtctaattgtactagcacctttcgttgaaaagctgtctttcctccactgcactgattttgtaccattgtcaaaagtcagttgagcatatatgtgtgagtctatttctgggtcttccattcagtgcctttgacataagtgcctatgttgccaccagtaatatgctatcttgattactgtagctatagagtaagccttaatactggatggaggaattcctcacactttattcttctttatcaagatggttttagctattttagggcctgtggctttccatgtaagttttagtataagcttgtatattttctacagaaaatcttgctaggattttgattgaaattccactgagtccttatcttttatttgtggagggaattatgtgatttataggatttgctccaaaataatttgagatggatgacagcaggtgaatgagagagatcggccataattctttaaggtgataagtgcataaggtatattattataccatcttttctgattttgcatatgtttaacattttccataataaaaagtttaattgtctcatattaaaagaaatgtgttagtattaaatagtaagcttaaacacctgaagtgtctactaaaatctaattctatttactcttttcacatggtctgaatttaatattatttttctaggtcattattatttatcagttccatttagaaggtttcgtatggtcaatttcttcaaaatgaagcagtgtttatcctgaggatactgggttcgtacgcagtagatatactttgttttatttgtaggcactgctgagaaagatctagaaagtgctaaacttgtacagattttacatagactgctagcagatgagagaagtgctcctgaaatcaaatataattccatggtcctgatatgtgctcttatgggatctggtaagtattcttctatcatttgatgtccataaacatatggttcacattaaatattaaatatagagtaatagtaaatgatggttttgggttttaaagccgttagaaattagtttatggaggttataagataacttttttcccctattactgtaaacactcatttcttcatggtgatgacattgaaaatcttctcttctagctgtcttgaaatatacactacattggtattttctagccatccaactgtataatagatagaattacttttcactgaagacattcccaaaagattctcactacaatagaaagtatcatatagcaaatctagacaacattcagtattgcaaaatcagtaagtctcatgaaccctaaaatgttattttatagcaggcacaggttctgattttgtatgccataatattaactaaggaatttgtttaggaggccaggcacggtggctcatgcctgtactcccagcactttgggaggctgaggtggtggatcacttgaggccaggagttcgagaccagcctggcgaacatggtgaaaccctgtctctactaaaaacacaaaaattagccgggagtggtggcacacgcctgtagtcccagctactcagaaggctgaggcaagacaatcgcttgaacctggaaggcagaggttgtagctgagagattgtgccactgtacttccagactaggcaacagaacaagactctgtctcaaaaaaaaaaaaaaaattttttttttcaacaaatcattggtatatcttctatggacattggcatatcttggtatatgttctatggacacctgaaaagagtgtgtattatgcagttattgggtactgttgtataaatgtgaatttgattctgttggtactagtgtcaagtttcctttattcttgctggttttgcagttaattgttctgtcaattgtcgagaggaagggtgttgaagtctcccactgtagatttacctatttctcctttcagttctgtcaatttttgcttaacataattttcagctctgttgttaggtacctacacctttaggattgctgtgctttcttaagggattgacccttttatcattatatagtgtacctctctctggtatttttctttgctctcgtcaactttatctgactttaacatagctacttctgcttgtttttttattattactattttattttctttcatgtgccactacaagaagccatcctactttcttttgaataacattcacatgatcttttctcactcttttagtttcaatctgctgtatttgaagtgagtttcctgtatacagcacaaagttgtcattttctaatctactctaccagtcccttttgtgtatttagaccatttacatttaatggatgactgatatggcttaagtgtgcaatcttatttttgttttctgtttgtcacatttcttctttatttctgacttcctatgggttaaacattttttaatcatttacatttattcttccatatatatatatatatatatatcttttttttttttttttttttgagacagagtcttactctgtcacccaggctggagtgcagtggcgtgattttggcacactgcaacttcttcctccagggttcaagtgattctcatgcctcagcctcccgagtagctgggattacagatgcctgccacatcacacctggctaatttttgtatttttagtacaggcggggtttcactatgttgcccaggctgatactgaactcctgaccacccgtcagggtgatccacctgccttggcctcccaaagtgctgggattacaggtgtgagccaccacgcccagcctctcacgtatatcattcttaaatatttcttctacatatatttagaatcacgttagacagtgttacaacttttctttcaaccaccaaacatatttcagaaaactctttgaaagagaagggaagtctatcgtatttacgcacatttttagatttcttatttttgttataatcattccctttctgtttagagaacttcctttagccatactgctagcaacagatttttagccaaaaaaaatttttttcattcataatgaaagggaaatgacattgtcaaatgacagaaaatgggtataggattctgggttcacagttcttttctttctttacttgaaaactattgtgccacttttttctagcctccctggtttctgatgagaaatccattgtgttcttatgtgttttattcccctgtaggtaaggtttcatttttgtctctcaagactttctttgcgtttagtattcagaagtttaactatgatgtgtcttggcatggatttctttgggtttatcctgtttgagtttgctcagcttcttgaattgataggtttatgtcttttgctaaatttgagaagttttgactgttacttcttcaggtacttttcagccccattctatccactctttccagacctttgttgacactaatgtgagatctttaattatagtcttgtaggtccctgaggttttgttcttttttacccacagattattttctttctgttgtacagactgagtaatttctattgttttatcttggaagttctctgattatttcccttgtcccctctattctgatgttgaacctgtttttatttcagttatatattttagttaaaaatttccatttgcttcttctttatatcttttatttccttgcagagactttgagtctcttccatttgtttaagcatttttagaattgtggtaaaacatacaaaacataaaatttactgttttaaccatttttaagtatacagtttaatggcattaaggacattcacattgctgtgcaatcatcaccagcatccatctccagaaccaccttcattttcccaaactgaaactctgtactcattaaccaataactccccatttacccctccccacagcctctggcaatcaccatttattttgtgtctccatcatctgacaactctagtcaccacatatatgtggaataagaaactcctgtccttttttgtctagcttattttacttaggtctttaaggcttatctgcattgtaggcgtgtcagaatttcatttccttttaaagctgaataattttccatcatatgtatatatcacattttgtttatccattcatcaatccatggacatttgggccatttccaccttttggcttttgtgaataatgctgctgtgaacattggtatgcaaatatctctgagcctctgcttttaattatttttgatatatactcagaagtggaattactagatcatatggtcattcaatgtttaatttttttattaaatactgtttttactaattaaatactgtcatactctttttcacagtggctggaccattgtacatttcttccagcagtacacatggattatcatttctcaacatcctcaccaatatttgctgtgttttagtaatggccaaactaatgagtgtgaggtggcatcttactgtggtttttatttgcgtttccctaatgattactgatgggaatctttttatgtgtttgtgggccatttgtatatcttctttggagaaatgtctattcaagtctttgcccatttttagaattgaagggtgttgttgttgttgttgttgaattgtaagagttttgttttttttgagacggagtttcgcacttgttgcccaggctgcagtgcaatggtgcaatctcggctcaccgtaacttccacctcccaggttcaagcgattctcctgcctcagcctcctgagtagctgggattataggcatgcaccacctgtagagatggggtttctccatgttggtcaggctggtctcaaactcccgacctcaggtgatccacccaccttggcctcccaaagtgctgggataacaggcgtgagccaccacgcctggcccaagttgtaggattttgtaccagtaccccactatcttgattattgtagctttgtagtaagttttgatatcagttagtatgagaactccagctttgttcattttcaagattgttttggagatttagggtcccttgagattccatatgaattttaggatggatttttctattactactaaaaacactggttcattggtttatgtcagtcatatcaaaataaacacatcagtttcagtagtactgattacattaagcttattagacttcactcatcccatataacagttctcagagtcctaacaggaatcctatattttcttgtaattgaagttaaatagagaaagcaagtcagaaagaagaggacaaaaaatctaaaagggagtccagtgtcacagaaatttgttgaaggatatgaagtataaacttttcttttgccacaaaattaatttgaaacatatcctaagctttttggtaagtcattggacttcatatttgaactggtgatagggttgtatgtaaccaaaccttgagatcatacagtgagctgtgtttaattataactcattattgtaattaatcttacattgtagaacttgacgtctcgtttttctttttaaaaattgggcaagtagctgtgcagtggctcatgactgtcatcccagctacttgggagactgagcaggatgaatcccttgaggctaggagtttgaggctgcagtaagctgtgaccatgccactgtactcaaacctgggcagcagagcaagtccccatctttaaaattttttcctttaatttaaaaaaaagtaaagtttttatgatttttttaaattataatacatttctaagaaagacattgctaggctactgctatgtctttttccagaattgtttctagttttataagcttagtcttgtcaaaataaacattttggtatatgttttggatagacttagaacaacctaacagaatcatatctgttatttttttgtcttccagaatgtctacacaaggaagtacaggatttggcttttctagatgtcgtatccaaacttcgcagtcatgagaacaaaagtgttgcccagcaggcctctctcacagagcagagacttactgtggaaagctgagaactgcccgatacacggcatcatcccatctctaatttcccctctgtcctccatccagcggcttcttccgcttcattctctaccataccacttgtgcatgcatgtgatgttctaataccaattgaagaaccgctgtaggtacctccctaataagatttctaaacctatagttagtgtgatcatgactttgtcaaaggcaagtctccacccataaccgttctcttgtattcctgttgcttgagctacattaagtagaatgtgcatgttgtagtcctatgatgatgtaaacttggtactacataatgacttgctccacacatgcagtaaactacataatgatgtactggtaaactagaaacaaagaatgcagcaggatctgtctagcttattaaagatgaaactgaattggaaaaatagctccattttttggtgcttgggaagcacagtgaccaaaaaagttgtatggctgcttattcattagtctttcctactgatgtcaaatccatggtacctagagttaaataaaattccaatgctcttactctttaacttctggtttctcctttttcctttttagactattgaaactgccacaaacttggcaagactttctgaggtttctgattccatatttaattgactattatcaatagcctgatattgaaaaacatttgtagttttcagtgtgaaactaaggggttgaagaatcactattacaatccctattacagagcatttcgggttttgcttgtattttagattctgatacatacgctgtttcactcaggaactacttctaccagttaatcagcattatccagcacttgtctttaaaattcatttggcgcttgtttgttttcaactgaggaaattgagtatagttcattgaagaatggaattttttttttttttttttttttttgctgtttttcatcattcagctagaaagtgagaagttttatcttccatagtccttttaaatcttatgttagaactagcaggacgtaggtggaaagatgaagaaataagcttgtctagactaaagaaaggaaagcaggttataaaagccatagtagccagtccagttcattctgcagatggccccataccaatcgctgttagagtttgccacctccactttcccactgagaactgcagcaattttaaaggatatgagaaagccaagactcaagagatgagaagacccccttggcgaaatatagtgtactcttcactgccactgccaccaccaaatgggtttttagagctttgaaacacaatctttgtaaattaatcaaaacctccctgtgacccacctgccttctccccatacccaaatttgaccactactggcctaaaaggcaagatgggcttcgatatagaaggactgcaagacagtagaaagggctgccacggaggtgacagtagctccttcctctccaacatgtgatgctacacatctctgtggataatctaagttggacttttgactctaaaacagctataatccaagaaagttaaattctaatggaggtaaagaatcttgactgattgttccctttgatgtccaaataagggaactattgtgagtacgtatgctacacttactataagaatgatactgtttgttgtctttctcctgggctggatagtggactatattttattacaggctttgaaagacatctgtaatgttgcatatctgttcatattaataacttaataaatagtatatgaagctataatggcatcatttggtttgtttgtatattttgtctctatttccagctcctagaataaggcttgctattgatgttcaacaaatatttgttgactgaatgaatgaatcctgcatccatgaagtttccagactgcctgaactaattccagaaagatagactgactgactgatagaaagtttgagatttgatagtttgtctgactttagggaaaaaattttaacaaaagcatcctaaaatcgtaaatgtgagagaagttacc

SEQ ID NO: 16247 - DNA, 25175 bp, Human
ggccaagtgctgattccaccatttcttagctgtgtgagtctgggcagcccagtcatccatctgagcctcggttttgtcatctgcaaaatggagacataattcttacttacccatcctaggaaagttgtgaggctcagagaattgtgtgtgccacagctaagccctgggcaaagcagaaagatgagtctggttgacagctatgaccccatccactctactggtctacaacactctgaccgcttgttccagaagagggcacatcttttcatatgtacacccctccccatcttttacagctgctcctgctcccaggatgtgtatctgactggagtttctggattaaaggccagtcgtggcttcattccacatccctgggtgcccttcggctcctcctaggagcatctcctgcacccaccccccagggccccacctccaggctgcagagctaagacctaggggcccctcctcagggaaccctcgccgtctttggaagcagccagcagagacgctgctgttaaggtccatgcctgtttctgcccccatcctgctgctctgggccatgggaataaccagtggggaaggagttctggcccctgggtgttaggaatgtcgtcctccaagaaattgcattaaccctctgagagaccagcagggcgcagccatgaggaagactgggcatcaagatggcacttgggctggctgccctgtgatgtgcaccagcccggagacccacgtgcctgcttgccaaagaggctcctttggggaatgaggagcccctgattcctatttccctaccccaaattcctcggaagcctccgcctctgggggatgagaaagggaagcaggtgggtggaggtgaagggggcagggagcaggtgggaggagacccgaagaaacttcaaggaccttatttaagagccttgccattgctgtgaagaaaaatgacttgaaacctctctagagaagagtgtggctaattggcatgtatgttggaggttaaagagcggaaggaagaatctgattgtttttttaagttactgagaaagtgagaatgtcactctgggcagagagaaattctttttttctagagtgtgcctttctttgtactgcagaccacagtgggccgctgagacttgcaaaaaagatttcttttaatccaccttcctttttcgcaggcagcagtagaagggcctttaaatcaaatgcaatcaccaagcttgtctcttgctcttattcctcacttcactccctggaatttggcatttgatggattctggatctgacttaaggctttttctaaatccaagacttggggaattttgttaacagtgcaataaaaataacttcatagtgttacaggaggcacattaaagacggtgtgtgtgtatgtgtgtgtgtgctgctctctttccttaaaaaaaaaatacagacaatgtttctttaaaagtctccatctgcaaatcccattagatgtgcatataaggtttctgatgattaatagttgcctgctagggttttggttggaggggatcttgtgtgtgtgggttaacccctccctctcctctctcacatttcacttcagaaatttgtcactctctccccaccgcaggatttaaaagtgtgtcccagcagccctggtccagccctctgcaggcatttgctctgggctccaggacgaactcctcgtcagctggtgcgtctgggttgggacagtgaaaatgtttagtgtcattggcgacaaatacacatacaggggatcccagtaggtaggctggtgcattggaggggcaggagcaagcccgacataggtgtgtgcacacacataggagtagctggccacatgtgtgtgtactttaaggagagactttagttttgggtttttttttttttttggttcctggggtaaattttctgttgaacatttttccctcctatttagttttttttcttttgcatttttaaaaatttgaacataaaaagtataaagaatcaaatctttgaaaggaccgaggcgtgcagcggacagcagatggatcccgcggccagcagctgcatgaggagcctccagcccccagcccctgtctggggctgccttcgaaacccccactcggaaggcaatggggcctcagggctaccccactacccgcccaccccgttctccttccaccagaaaccagacttcctggcgacagcgacggcagcgtaccctgacttctcagcctcctgcctggcagccaccccacacagcctgccccaggaggagcacatcttcactgagcagcaccccgctttcccacagtcccccaactggcacttccctgtctcagacgcccggcgcaggcccaactcaggcccggcagggggttccaaggaaatggggaccagcagcctgggcctggtggacaccacaggaggcccaggcgatgactacggggtgcttgggagcactgccaatgagacagagaagaaatcatccaggcggagaaaggagagttcaggtaggtggctcaggagcagctgatcattcctttactgtgtgaccctggggaagttactcaccctctctgtgcctaggtgctctgagcatgaatttctgtctagtccatccaaatgcaggagactggaccagttacctttggggtttcttccactgagagttctaggattctctggtgatggggaccatgtctgtgtcccagcactcctgggccccagaaagggtgtccagcaagagaatgaaacaggatcagccaggatttggaggacacgtgaaatggatcctctgggtgcagactggcgagggctggtgaggggctttcctgaatcaggctgccattgagtcatcctcctccccaccatgctttggccagccccaagtggtcctagagccacagggctcgcttaccagggaagttcagctgaggttaaggctctgagagctaagactgaagctgggaccctgggtggccacccaaagccaagaccctatgtgtccaggagcctagaggcagagaagcaggcctgcggctgggatgggagaatcaaggggtgagggggagatggagggctgaggtttggggcagactgcccaccagatatcaccctgcggagctgggccatgtccaggccaaggggacagacaactcagcatgctgagatctggctgaccccccaggaaggcagccccgcaaggagctgcaagggatgggcagcctctgagagagtcagggaggcaggcagccaagggagtccgtgctggagtcccagaggctggaggatgagattggcctatttgttaagattccagctaaagcccttctcttccccagggtggggacctgctgcttcctcacctccccaccaggccctccctggttgctcactatacctgtccaccttttgtctggttccttgtcccggcctcgttcagaacaaagcagtgaccaagcctcctgcccgtgctgccctgttttcctcctgacagccgccctcaggggcacgcctgtctgtcggagcctgtagaggaccttcccatggggctaaccagggcaggacagaaaagaaggacaccaaccaacaggtgggaatgctttgtgctttgctttataagcacagctttcccgagtttctgctcttagccaagcccaggaatgctctgagatgaataaaggggtctcacccaagaaagctcaaactgagaggaagaagaggcctgcagaggtgtgtcagcagtgggatgtgccctgatggggaggcttaaggtgccatgggatactgacgtcagctcttttgagtcccacgggtttgggagatggggacagcaggttttattagtaccttgattctctcaatctgcaaaatgaaagactgaaagttggtgagaacacagaaagaatggggtcaaactagagtgagcagctcatctccatttgcccaggacttttccagttttagcactgaaaatcctgtcgtaggaaaccccacagtcccaggcaaacagaagaattggtcaccctagaagtgagctcaaaccccaggcttcaggcccccggtatcacccccttcagtagatttcaaatgcagtcctcattttgaaatgatgtttggtctgtctgcttgaagaagccccttcttcaatgggagataggaactctagcagccctcatggctgctaaatagaagggccctttaaaccgccagccagttagatccccatcccgaaaattaactcatcctgcccctggtaggaaatgtgctaaggatgagaagcaactctcagcgacttggctctgaacctggttgaagagctttccccttggtggcggcacgcagcactgtggctccttcctctctgccactttccagagaactgacagccaagggcattgggaagggatagcaaagccaagagcctgctgggctcaggcagaatcttccagcattccgagtctcagcaaaacccaaatgcaccagctctctttttggcgagtggccgatggccctgcaatgcagagagaccattcacactaagcagctggccacccaggagtacagggacaccctcggctgaacggcctgcatgcttcagggtcagactttggtggagggaggttcccatccgcaggggccctgggcttccctaagggtcccctcaggagcaccagcagcagatgaggcagggcccagtgagctgactctcactcatccccctgtgattccagacaaactcactgttcagcatggaaatctttattgccgcaatgcttgcatcctcctttggaatttaactgaaggggaggaaggaggcaagaaagatcagctttgtaagagcccaaagaagggggaaagtgacgcaaggctcatgacctactccaggaatctggaattcagctcagaaaaggcaaacccacagagagccccccacccaaccctgccaatcctgagtctataattggatcccctctccaaaattgtgatattttgttcattatcaattttttgcattacttttgatttttacaaatattgccttaaaatattcttttttttttttttttgagatggagtctcactctaacgcccatgctggagtgcagtggcatagtttcaattcactgcaacctctgccccttgggttcaagcaattctcctgtctcagcctcctgagtagctgggattataggcgcacgccccctctcccggctaatttttgtatttttagtagagtcggggttttaccatgttggtcaggatggtctcaaactcctgacctcgtgatcagcccacctcggcctcccaaagtgctggcatgcgccaccgtgcccggccttccttaaaatattattgatcttgactacagaggggttgggcatgcccttgcatttgggcctccccaagtccaggctgagtggtccctggaaggttaaccagcattgatcagaaacgcgttttccatagttcttcccagccagacagacaggctgcagtgtcagcacggcaacttttggctgcatgactttggaaaagttcataacttcttccagcctttgtttccctggctgtaaaatgggcatatagcagtagccccttccatagagagtctctctgtgaaggttagatgcagtgatccatgagattaactctgtgcctggcacatagtaagagttcaataaatagcagctgtaaatggtattaggcccatatttcctgaaccagccttcagaatataaggtctgacaaatatttctatatttatggggatggtggaattgaatatttcaattatgctgtctcagaaattcctgagtctagagaacttctggcaatcattttgttccagttgtcatcaggagcatggagctcagagacctgccggagaggttatggggtgagttgggcctggcaaatgcaccccatattgagtggctgagaagcctccagaaatggaaagtttattgtaagaggaatgttctctgcgcttccttcctcctttgccatctccttcaactgctccccgctcactcccagtagaatctggagctgatctactcaaagaaattatcaagaaagcaagggttggccgggcgcggtggctcatgcctataatcccagcactttgggaggctgagccaggcggatcacctgaggccaggagttcaagactgacctggccaacatggtgaaaccctatctctactaaaaatacaaaaaaaaaaaaaaaaaattagccaggtgtggtggcaggcacctgtaaatcccagctacttgggaagctgaggcaggagaatagcttgaacttgggaggtggagattgcagtgagcagagatcacgccactgcacttcattcagcctgggtgacagagcgggactacatcaaaaaaaaaaaaaaaaagaaagaaagaaagaaagagagagagaaaggaagaaaggaaggaaggaaggagacagagagaaaaagagagaaagaaaaagaaagaaagaaaagaaagaaagaaggaaggaaggaaagaaagaaagaaagaaagaaagaaagaaagaaagaaagaaagagaaagaaagaaagaaaaagaaagaaagaaaatgaacaaacggggagaaagaaagaaagcagggttcctggcctttggcacttccccaccctggagaccagcatggtgttatcttacccaaaccactcccagccccaggccaatggggattaaagacccctgctggcagggacagctgtgaggccactgttgttttcccccaaactgtccttgctactgtggttgtctttaatttatgggaatgaaggattttgcggtggtttcctcatggggttcaagggaaggttgcgtgtgattagagtggctacaggtgaatccgatcgcccgcctgggaaagccatggtgctagaactcagcactgctccctcctgctctcacgtcctcactctgctgagacatgcctttaatcagacgtgatttgtctcatccttcttcagctccaacacgtgtgttcccagagctgtcctgccccaatttctctttgcaagacctgctctatgcctgcctccgcccaaccacaaatttgcctaaggtataaaactccacaaataggcctctctcctcttttccctcctgatgcccctttacaggccacctccccgccccaggtcccctccactacccctgccacgaagccacacccagggactgaccttgcaaacacatcctgcattttcttccccctctctgactgtgctctggtggtttctccttgcctagagcactctccccttccccgtacttctgcctgttgaagtcctacttaaaaaccacccagctcaaaaacaaccccttccaagaatatttttgttcttctttttcaaaaatttatagctacatttgcatataacatagtatcaaagaaagctacagttaagaaatgtcgaagtctagtatctgctagaatctgtgttgattttctcactttagcttgcagttgtttcataaaggaactcttctgaggtttcttacctgggacatcttatatttgaaatctccttttttaaaaattggggtcaaatacacataacataaaagttaccgtcttaacagtttttaagtgatacagtacagtagttgtgcaatcgatttctagaacttttaatcttgcaaaaccgaaactctatctccattaaacaacgaccttttttcccttcccccaccccctagcaatcaccattctttctcttgctaaacatttgactattttagataccttacataagtgaaatcatgcaatgtttgtcatttttgtgactggcttatgtcacttggcataatgtcctcaagtttcaaccaggttgtagcaagtgacaggattttcttcttttttttttttttttttttttttagaaagacagggtcttgctatgctgccgaggcaggtgttgaactcagggcttctagcagtcctcccaccttggcctcccaaagtgctggaattataggtgtgagccaccatgcctggcctccttctttctgaagacaataacattccattgtatggatataccaaatttctttcttcttttttttttttttgagacggagtctcactctgttgccaggctggagtgcagtggcgcgatctcggctcactgcaacctccgcctcccgtattcaagtgattctcctgcctcagcctcccaagtagctgggactacaggcacacgccaccacgcccggctaatttttgtatttttaatagagacggggtttcaccatgttggccaggatagtctcaatttcttgaccttgtgatctgcctgcctcagcctcccaaagtgctgggactacaggcgtgagccactgtgcccggccaccaaatttctttatccattcatctgttgatgaacatgtaggttgcttccacctcttggcagttgtgaataatgctgcaatgaacatgagtgtgcaaatacctcctggagagtgtattttctttttctttttcttttttgagacggagtctcactctgtcacccaggctagagtgcagtggcgcgatctcagctcactgcaagctccgcctcccgggttcatgccattctcctacctcagcctcccgagtagctgggactacaggcgcccaccaccacgtctggctaattttttgtatttttagtagagacggggtttcactgtgttagccaggatggtctcaatctcctgacctcgtgatccactggcctcagcctcccaaagcactgggattacaggtgtgagtcactgcgcccggctggagagtgtattttcaattcttttgagtgtatacctagaagggaaattgctatattatgtagtaattatatttttaattttccaaaaaaattatttattattagaataaaatatagagacaggggtctcgctatgttggccagattggtcttgaactcttggcctcaaacaatcctcctgcctcggccttccaaagtgctaggattacaggtgtgaaccactacacctgaccatatttttaatttttcctttttctttttttttgagacaagagtcttgctgttgctctggctagagcacaatggcgtgatcacggctcactgcaatctctgcctcccaggttcaagtgattctcttgcctcagtctcccaagtagctgggattacaggcgtgtgccaccacacctggctaatttttgcatttttagtagacaggggttttaccatgttggccaggctggtctcgaactcctgacctcaggtgatccgcccgccttggcctcccaaagtgctgggattacaggcatgagcccctaatctccccttcttataagcatatcaggcagattggattgggacccaccctaacagcctcattttaacttaatcccttctttaaaggccctatgtccaaatacagacacactctaaggtactggggttagggcttcaacataggaattggggagggaagcacaattctgcccttatagggactgtacaggactgtacggggacaggaacaagggacaaggttcaaactgtggcacagacccttcagttgaaaacccctttagtgaaagcagcacccagatgtgtgcctgaccccagagctttcctagctcagggtcctgtcggctggtagagcttttccactgagacaggaagttgtttctagccacaagcagatccctgatttcctatcttacaccaacaagtacagacataaaaagtggaggcagttggccgggtgcggtggctcacgcctgtaatcccagcactttgggaggccgaggtgggcggatcatgagctcaagaaatcaaaaccatcctggccaaaatggtgaaatcccatttctactaaaaatacaaaaattagctgggcgtggtggcatgcgcctacagtcccagctactcaggaggctgaggcaggagaatcgcttgaacctgggaagtggaggttgcagtgagctggatcacaccattgcactccagcctgggtgacagagccagactctgtctcaaaaaaaaaaaaaaaaagtggaggcagttttaggagtgaatctctaaagaagggagctgtttgacagaggaaaggagaaaagaggcatgggctggatgcggtggctcacgcctgtaatcccagctatttgggaggccaaggtgggtggatcacttgaggtcaggagtttgagaccagcctgaccaacatgatgaaaccctgtctctactaaaaatacaaaaattagctgggcgtgttggctcacacctgtagtcccagctaatcaggaggctgaggcaggaaaatcgcttgaaccagggaggtagaggttgctgtgagccaagatcgtgccactgcactccagctggggagacagagtgagattccgtctcaaaaaaaaaaaaaaaaggcaatggtaggctgggcacggtggctcacacctgtaatcccagcactttgggaggctgaggctggtgaatcacgatgtcagaagatcgagaccatcctggctaacacggtgaaatgccatctctactaaaaatataaaaaaattagccaagcgtggtggcaggcgccagtagtcccagctacttgggaggctgaggcaggaaaatggcgtgaacctgggaggcacagcttgcagtgagccgagatcacaccactgcactccagcctgggcgacagagtgagactccgtctcaaaaaaaaaaaaaaaaaaaaaaaagcaatagtagagatgagaatgaaataaatggacaaccccaataagtgtcacctgggtcgccagagtgatgccaagtcccatacaagtgacctcatgcccatgctcaccttcttgctgggccacggtacagtaataggaggaagggtggtcagagactaaggtcaagcgaattaacaaggtagccctggttcaggtccctgatccacaacttcctggctgtgtggacgtgggtgagtcctaaccctccctgagtctcttctgagaaatgagggtaacagtacctacttcataaggtgggtagctgtgagactaaatgatatcagagatgtagagtccacagccaacacttggtaacccctggctccagttttcccaaacccacatatgagcacccctctctctttaaagtcctcccctgatgctggctggctgcatcaggtttcccacgttcaaaaacaggccaaagtgtcctgagctctgctgaagtctttgccccctgctgtcagccgggcctgcctgactctgacgatgctactggcttagggttgtggcagtgctgggtggggtgtggtttgaggggtgcaccgctgcagcagctcctcttgtcccgagtccatgtccagaacccctagtgaggaagaagttttatggtccagagtggccagcgtgggaggggagacagcaactccacactcagccagtatccctctgggcatccccggcctcctgattagagctcctgacctcctcttctgacaagcaaagaaagctcagagcccaaagcaggacccaggcctcggccaccatctgaactcagaggctccagcacaaatcccacgcctgggcctgctcaggcccctgatcaggtatagtcggaaactctggagaaagtccgtttctgctgaggcagcaggatcctgaccaacatcgaagagggaaagatccaatgagcccgtgagctgtaagaaggtcagcccaggggtcacctcagctctgctccgccactctcccatgctagggactcaggattcctgcccgctcacctatttctctggcttgaataaatcacgggcacttgggcccagggaggggggataactcagaggcagagaatcctttctgcctgagagacaggactcacagcccctgcagacctccagagctggcccttttccccaactccctctctgcccataacttgggcttctcacccaatttggctccctggcctctggccaggacccacccccttccttttcttttctttttttttcccccttgtttttcttgcatgcagaggtacaggaacagcgtgagcagtgggcctgggtctcaagcccacacttcctttggtgacagctgagggtgacatatggaacttataaacaaaacccagaactacccatgcctctccccatcccctcttgaaagctgctgcgcttccccctcaccaacccaccccgcctgggactctcagcaaagactatagcaccagacttttttttctgagacggagtctcactctgtcgcccaggctggagtgcagtggcacgatctaggcttcctgcaagctcggcctcccagtttcatgccattctcctgcctcagcctcccgagtagctgggactacaggcacccgccaccacacccggctaatttttttgtatttttagtggagatggggtttcaccatattagccaggatggtctcgatctcctgatctcgtgatccacccgcctcggcctcccaaagtgctgggattacaggtgtgagccaccgcgcccagccagcattacgcattttcattccagaagaacctgcctctctcccatgaaatatcccttgaattccctggccccagagaggctgggagccctgccgatgtctctttaggcacctacaggagaggaaaagggcctggacactggggtggggcagggctcagtgagacagtcaggccaaccccaggaagccagggagatcctggatgtgaacatccaaccagtctcgggctggctccatcccagtcttgtctatttcgacgggctttgacccctccttctgaggctgaaagtaggagagcttacggggacatcaaagtgtctatgctgtgacagtgcaggaagccacagacaccgttttccgaggatttgccaaggtttcacctactgatgtcatgctccaaatattcccttctttttccctctctggggagtcccagggagagagatctgaacccagactcagacaatgtccctaagataggcacagcctccatactcatcctcccccgagggcagcgtgacatgaggctatagccctagactggtcccaggggccttgggcaagtcatttagtctctggatcttaattgctcatatgttcaacgggctaatgtgtaccttacctacctaatggaataattaagaggataaaataggagacagcccaatagggtggaaagagcttcctaacaagaaaatctgggttctaggcccaattctgcccctaacttgccgtgtgtccttacaggagttccttaccttctctaagctcacctataaaatgaaaaggtgacattgatcatctctaagtccctcccacctctactttctatgattctgtagtatctgtgaaagcctaaaagaagttctctttggaggaaagaaatcccttgtcaactgcacagtgctatttgaatgtgaggcatttggcatcctgtctgatttggatattaatttatgtaaactggtgccctcagagttggactgtagagtacagaactccagaaatgttcagacagggatgggtctgtctgaacctccctgtagctctgataaagctgtctgctcactttacgaaggcctgccaaatgtggcagctacatatgaaataatttgccctggatggtgtggaagctcatggtggaaaccgcaatcacatgcacaccgtttgcatttctctgggcatttgactgttccctcacagccctgctccagcagagggtgagggctatgcaggggctggggtggggcaactccttcctaatcacagaggcagcccactgagggccagcatcctccctccgcagttctggaagaggcatctgcggcccccaagagagaagcagcgcaggagtgatgtggattgccatgtgacacatctagttgttgtgcctggaattgtggaactctgaaggctgcagcaatagtggcctaggccaggtgcagtggctcatgcctgtaatctcagcactttgggaggccgaggcaggtggatcacctgaggtcaggagttcgagacgagcctggccaacgtggagaaaccccatctctactaaaaatacaaaaattagcctagtgtggcggcaggcacccataatcccagctactccagaggctgaggcaggagaatcgcttgaacccaggaggcagaggttgcggtgagccgagatcccgccattgcagtgaccaatctccagcctgggtgaccaaagtgagactcagcctcaaaaaaaaaaaaaaaaaaaaaaaaaaagctgaaaggccagacatttaaaagataaccctttcacacaggtctggagatgtggtgccttaaggagcatagtgctctaactctgcccgtgagtcatctcagatataatctccaatagaactctttctgatggttcttgtgaacagagcttcagtgacatgccaggcactgtgctaggtgttaacgcccgctatccagctcctgttacttctcagcctgataagcacagcgggtgtagctattcctgctttgcaaatgaggaaattgaagctccaagaacctaaaggacttgcccaagatccaaaagctcttcctcggtgcctcactcacctatgagtgctaaggcccaggttcaccaacaggtcctccgacacgtctgcatatataacttccctccacacagctcaaggcagggagagagaaacggcccagcagagccctgatcattgagctgtgggaaggctggggagggctttggaacagagcacacagcaagacctcagatctgactgaagggaggaactaggagctgagacaagaatacgtgaagttggaagagcctcagacttcatcaaggctaagggttctcaatggaagagagagtagggagtgtagggcatcaaggcttatgttccaggaaggaattctgacaccagctccctggcagaaacagaatccggtccaatcccatacttctacacatggggaaactgaggcccacagaggagaggaagcctccctaacaaagttgtactatcctgggaacagaccatcttgggaagcatgagttagtttctttttcttttctttttttttttttttttgagacagagtctttctctgttgcccaggctggagtgcagtggtactcgtggctcactgcaagctccgcctcccaggttcatgccattctcctgcctcagccttcccagtagctgggactacaggcgcccgccaccacgcctggctaattttttgtatttttagtagagacggggtttcaccatgttagccaggatggtctcgatctcctgaccttatgatccgcccgcctcggcctcccaaagtgctgggattacaggcctgagccacctgcgccccacccagcatgagttactttcatgtggcagggtgcacaggaactgtgcccatgagcagggtgaccgaacagctcccagaaacggcatgcaagtgctcatagtgtttccatcttgctgaatatattgcaatttgtaatactgttgcagaacaaagagagcgtaacttccacttcaactttcatagcttgcttcccatacttctggtcccttcatcatttccaacagtggtgaacgttgatcccactctgggaagttgacaagggacaaccgccctcccagagccaatatccatcccacccaccattagtaggtattgcccccaggttcacacagggagttagctgagaccgtcagttcccaacccagacttcttcttcctgtttcctctgctggaaatcggcactggaaccccagaggctaaatcagggcaataagagacaggagaggagaggtggccagggatggggcatagcttggctggcagtagtcagctgccctatttgcagaactggggtgggggaagttatttgggggacatcatggggcacctgtgcacacctaagcaggtcttggaggagggtagatgtgggtagcaaacagggtggtgaccccaggacctctggaaggggtgacaagcccagctgccatggtccagctccaggccccaacctgagccagccagccaggagatatggagagccttggctctaatcagatggatctgggttcaaatctcccttctgtcacctaaaagctgtcaggcacactgggcaatttcctgggcctgtctgaggctggctcttctgtataacaggattatttagcaaatacttagcaagtactttttcctcttctctctaggagaattatgtgcagaactggttgggggcgcggtaggggtcagttgtgccaggtacagaagcaactatggctagatgctagggtgagaaaaagtgtttccctggggagacagctattaatcaaattatcacacaaacccatgttaagagtgctaaagggggtaagaacagtatccactcataggccgctgtgtggtgaggttaaagccgcagatgcctctgggcacacacagaaaccttcaagaagtgcatctgtttctatcccagcccttcaatggcatctcgtggagctgataaattggagaatatatttgtccagcacttttagatttttcttttttttgagacggagttttgctctcgttgcccaggctggagagcaatggcgcaatctcggctcaccgcaacctccgcctcccaggttcaaacgattctcctgcctcagcctcccgagtagctgggattacaggcatgagccaccacgcccagctaattttttgttgttgtttgtatttttagtagagacggtgtttctccatgttggtcaggctggtcgcgaactcccgatctcaggtgatccgcccgcctcagcttcccaaagtgctgggattacaggcgtgagccaccttgcctggccacttttagattttaatagcatgttgcacacacatattaactcgttcggtcttccaataaccctaggaggtaggtgaaatttcctcaatttcttgatgaggagactgacgcccagagaggctaagtgacttcctcaaagtctccagcatggagattcaggattcaagcctctgcggtcctctgggctatccactccccgcaaccgtggaaaggaagggctgggaaacactaagcctcgggacgggagaagattgggaaaccagtccccgaccgcgcccgtcgtctaagcccgggtttcctgcctctctccgggcccgtgggccgggctgtgctccgggaagcccgtcatccgctcgtgaccgaccctccccggcccgctgccaggagggggcgcggcgctggcggcggccaaggccggagggctcctcggggaccccggcccggggctgcgcgtccttccctgctgcccacgctcccgcttccggaggggtctggacctgccttctccggcctggagccagaggccgccgggcaggcagcccgcgccaggaactcggccccctgccctgctccccgggcgcgccccgcgggcggccaacccggatcggacgcggacccccgggccagggtgccacgacacccctgacccgggcaccgggactatcgggcccctcccccgccttctcgagttcccggaacggtggcacccactccccttccatcccccggcggaggccacggacgcgcagcgcgaggtgggccaggcgcccaaatcactttaccgtgcgcctcctgctagagagtcgcccagcccaaggcagtggggcgcggaggcggaggacggggaaactgaaatacaaagggattgagtggaaagcaatagaggggggtgctgggaggggaaccagctaggctcaaagctccaaagtggatcgccgggttaatgtggggttcctgcctcgccacccactcccaatgcggctgcttagccgactgcataggcggcttctctgctttacactagggggtctgaattccccagcccagtcccccaggtagcttagacccggcctctgaaaacagaagatccctccttccaacactcctcgccggcaaggcagagatgggtctttcagggagcaggacgttgggccgcaggtttcggtaaagcacctcactcggagccacagcctccatgtctataaaatgaggaaaatggaccgggcgcagtggctcacgcctgtaatcccagcactttgggaggccaaggcgggcagatcacgaggtcaggagatcgagatcatcctggctatcacagtgaaacgtcgtctctactaaaaatacaaaaaaatttgccgggcgtggtggcgggcgcctgtagtcccagctactcgggaggcggaggcaggagaatggtgtgaacccgggaggcggagcttgcagtgagccgagatcgcaccactgcactctagccttggcgacagagcgagactccatctcaaaaaaaaaaaaaaaaaaaaaaagataattaatgaagcaaacgtcttttaaatgttagagccccgggctcctgcagccattccctggccacgtggcatgcattgcgagttaattgtgtaagtgtgtggtcttcttcccacctcctctccacccaccacctccattcattaaagtgaaggtagagctgcctcccacccgtctgctcaagagataaccattcagccccttttatttgttcaggactttaccgtttgtaagcccttcctaaatttttttttcaagacgtagtcttgctctgtcgcccaggctggagtgcaatggcgtgatctccgctcactgtagcctccgcctcctgggttcaagcgattctcctgcctcagcctcccaagtagttgggattacaggggcgtgccaccgcgcccagctaattttttgtatttttagtagagacgggggtttcgccatgttggccaggctggtctcgagctcctgacctcgtgatccgcccgccttggcctcccaaagtgctgggatgagccaccgcgcctggcccctacatacttttcatttgaacagtatgtgtgtgtcaaatcgcctgaatttaattcttgtctcccacaccccctggctgaataaacttgggcaatttgcttaacttctctgtgttcgttttctggtccataaagtgatactaatactagaaccacttggttgggctattgaggaataagaggctaatatatgtcaggtacagcacctggcacagagtgtgtcccctgaccctgttggcagttatgactgagccccgctgaatctaacatgcagcctgcttcagagggctccagatggctttccagacttggccctctggggcagattctgattccgtaggtaggtctggggcaggcctgagatccttcaggtctgaacagctccctggtgctactgatgctgctggcacccaggcactcctttgagtggtgaggtcttagagcagcggacttgactgtgcaccagacgcatctggagggtttgtaaaaatagattgctgagtgccatccccagagtttctgacttagtaggtctggaatgaggctaggatttgcatttgtaacaagctctcaggtaatgctgatgctgctgatctggggaccatagtttgaggctttgttttagagcatctcacccctcaagcttatggccaccagtaatgtcatgctggggggtgggctggggagtagaggtcattaaacagccaagagtagcttcttatgctttgggaataaaagaaagtttggggtggggggagggtgggaggcaggtacctgagattggaaaccaaaaataaaaaatcttcccaattctaatatgggtaagacaccagaaggaataaaaaggacagtgtagcttttttctcagcatcctgtaaaaataagggagactggtaaagactgcctagttgctcaagggcaaaagaaagggaatggagtctccctcagcccatgtcttcctgtttggggtcctctctccccagacaaccaggagaacagagggaagccggagggcagcagcaaagcccgcaaggagaggacggccttcaccaaggagcagctgcgagagctggaggcagagtttgcccatcataactacctgactcggctccgcagatatgagattgcggtaaacctggacctctctgagcgccaggtgcgcccccggtgggcccctcctcttctttgctctctcatctccctcccttccctcctttcccaccacccctccctggaccttctcctttttcttcctccagccagtccagcggttttcaactgtggccacacctgagaatagcctggggagttttgggtttttttgttttttgttttttgagacggagtctcgttctgtcgcccaggctggagtgcagtggcgcgatcttactgtaacctccacctcctgggttcaagcaattctcctgccttagcctcccaagtagctgggctactggcgtgcgccaccacgcccggctaatttttgtttttttttttagtagaggcggggtttcaccatgttggccaggatggtctcaaactcctgacctcaggtgatccgcccgcctcggcctcccaaagtgctgggattacaggcgtgagccactgcgcccggcccctggggagattttaatagtgctgatgtctgggctccacccctagggatgattttaattggcctaggatgggatacaggcctcagaatttttcaaaggccccctaggtgattctcacatgcagctaggttgggacctacggtctggctattcccaaatttgagtatatgttggaatcccccaaggcacttgttcaaaatgtggattctggaggtccggagagagattttaccataatgagtgggcctgagaatctgtatttctagtacattctccaggtgatctggatatgcagctggttcctgggcacactttgagaaaaacttccctggccctttgttttggactttcccttcagccaccccacacccccacacccatgctctgatacggaataatagtaataataaccgtaatatttgatagcagatttcagttgacagagcactctgccagagggctggatattgaatcagaagacttagattcaaatcctgcctctatcacttttcctagccctgggacctctgggtctccatctgtaaaatgggatcataatcctgcaggtaatactcaagctcagatgagaaaatgtgcttaccagagctatctaaaccaaaaagtgctctataaatgtgcctaaggataaggctgatgacctctgctcccagacccttggggaatggaggtagggggcagggggacctggcacaggcagggcagggcatgtgaagggggtggggccaatgcagagtgcttttagaacatgttcccccgtctggggctttatccgaagccacaagacagacctctgggcagattggtatgtcctctcttcggtcctagttcctggggcctttgagggagtagggagtggtaagtgatggtttcaagctggggtccctggagttacaccctggctagcctaagcattgacatggggaggaggtcacaccggccctggagtgaccaggctcctttgcttcctcccccaggtcaaagtgtggttccagaaccgaaggatgaagtggaagcgtgtgaagggaggtcagcccatctcccccaatgggcaggaccctgaggatggggactccacagcctctccaagttcagagtgagattctgcatggaggaaaaatgactaaggactgagccccctacccaactacccccaccccaatcccaccttcaccctcttccttccccagccagggcagcctctccacatctttccctgactcttggatatgaaactgcccagcattcctgggagtcttaggattttctaggaagttctgtccagcctcttagcagcctcttccctagggcctttgctcccacactctcatggaatcagacagagatcctaccgggccggatgaatctggaaacagcttcagagatactgcttctcagcgtctcttggctgccacccatgcctcctcctaccgctgttctcctaggtcagccaggcctcctcctggtctggacaccacctggcctggtgggagaggagctttggaaccagctggcgactcggaaagtaaatgcttcaaaaggaaggaaatgacagagacacacgcccttgcccaccttcctctgtaggctgcacatctgaggctttggggccccttagttgtcccgaaaccccaagaaaaatcagaatgaggagagtcaaggacagcaactcagctgctgcaagccagaaacacatccctgtctccaaatttgttggctaagtggagacacttctgagaactgactagagaagacagaaaaatagcccgatgtaggtttcggtgtccccatataggcccgtccacacaggcttgactgggtggacaagaatgaacccatgacagcacctgctgcttcaaaatcaaaatcaatttagggatacagcaggggctgttgggctgtgctccagagaaaaggagcagctactccttttaaatccacgatttctggattgaaaacctgtccagatgctgagttgttgggctgaacaactaggagctgaaaacaacgtagaggctggaaagtgtcccctgcattctggaggggaggggagataataaggagggctgctgggtgagggcctggagatgtggaaccctggagtggaaggttctccagtgacagtgtcctgtgactgcaaaaggggacaagaaaatccctcttcctccatgggatggatttaagctcttgctgtgtgttctacaaatgctgttattgtgggaggaaatgctaggtttttgtgtgtggactgcccagacctcagccaggtcttctggagatgacatttgaggactgatggccaaagagcatgggggactgaagccctggctgcctcagcgctctgtctcccaacaccagctggtgttgcagagggaggtcaacgtgagtttggatctcttgtacgcagatgtaatcattcacatgtaaaaataaccccacctccccaccccaaaaagggcaagagctgtggaaaatgattgccaaatgagatggctggttagagcatgattttttctaaagcatacttcatatattttcttaagattacatcaagctaattgtgcgagctcaattcactttgtaagaaaactctcggagaaataaaatcaataaaaagcaaagttcccaggcctttttctttgcagagcgaacaaccacagctcttgtgtgcaaccttctgattgaccagacaatgtctagaagcaagagaaaaagggaagaaatgatctagacagagctgtccccctttagtttttcaaaaggtgggtacaaaatataattggtgccaaaaaaaaatttttctccaatgcaaatgcatggtcttcatttctcattgtaaaagtttagctttcagtttccctaaactatgacctatcaaatagtcaatgttttataaacaaaagatgaactcttttgttaataaaggaatcttgaccacaaagtaaccatccctaatgtttaaattcaaagtttggagattttatttttcaaggtagaaaaatgtatattaatagtagtaaaaaatgacataagaaaaaatatcccatattttgtcttttttttttttttttttttgagacagagtttcgctcttgttgcccaggctggagagcaatgtcttggctcactgcaacctccacctcttgggttctcctgcctcagcctcctgagtagctgggattacggccatgtgccaccacgcccagctaatttttgtatttttagtagagatggggtttctccatgttggccaggctggtctccagctcctgacctcaggtgatccacccgctttggcctcccaaagagctgaggttacaggcctgagccaccacgcctggcctctatgtctttttaactaaaaaacaatttgtctcaccaagatgtcaacaatggacaaaacaggactggctacggtgaggggagagagggaggcaggaggggagacctggccaggatcttgcattgaggcagcctgggccaggtgtgggcagtgcctggaagtgacatcaccaggacctggaatcaggcagacccaccaaaatgaaggtgccaaatggaagtgggttcagtggctcaggttcaggttcacagccaagcaacatggacacgctcagtcacccccgtccaccctcctgctggaaactcaactctgtggcttcaggggacatcaccctcttctggctttcctcatctgtcctagatgttccttctctgtcccccatgcaagcccctttctcgatgcttctgctctcacagctggttctcaaggttttctctttcttccgccaccttccctatttttcaatctctccccagatgatcccatccacctactttttttgtttgtttgttttttgggacagtctcgctctgtcgcccaggctggagtgcagtggcgtgatcttggctcaccacaaactctgcctcccgggttcaagcgattctcctgcctcagcctcctgagtagctgggatatggctgatttttgtatttttagtagagatggggtttcaccatgttggccaggttggtctcaaactcctgacctcaggtgatcctcccgcctcagcctcccaaagcgctgggattacaggcatgagccaccacgcccggcctatgtttttttaaattgttgtaaaatactctaacataaaataaaagttatcattttaaccgttttgaagtgcacggtcccgtggcattaaacattttctcattgttgtgcagccattgccactatccatctccagaacgttttcatcttcccaaactgagaccctttgcctatggaacactaacccctatcccctcccctccattcacctgcatttacatagtgtttgcgccatattgagcactgttccgctttacatgtacaaactaagtgaattctcttagccatcctaagaggtagtactaccgtcattcccatttcacacatgaggtaaccaaggcggagagaagctgagtaaactcccaaggttttatggtggttagtgtttggggtggattgtattattgggcctggttatcttcttccctctccactggggaacatgcctccctgatcattgccatatgatgcacctgccgcggtaagggcacacttcctcaccta

SEQ ID NO: 16248 - DNA, 25175 bp, Human; identical to SEQ ID NO: 16247

SEQ ID NO: 16249 - DNA, 14705 bp, Human
agttggagaaggtaaggatcctccccaaagatctcgagagagtgtatggccccactgatgcctccatgctgaatttctggcctccagaagtgtaagagaattaattcctgttgtttcaagccacccaatttgtggtaatgtgttatggccatcaaaggaaattaataaaacacctcagggcctttgcatgtgccatcttctctacctggattactctttctccagatccttgtggggcccatgtcctcacttcctcctggtctctctgctcaactgtcacctccttagagagtccttctgcttgtcctaagagaggcccttactgtatccctctaactcaataatttgttgcacttctctttaaatttcgatcaatttagatacatggtatttgtttcctcccctgccccacaaccacccctttttttttagagacagggtcttgctctgttgccccagctggagtgcagtggcacgatcacagctcactgtagacacaacctcttgggttcaagcaatcctcccttctcaacctcccaagcaaaagggataacaagcacgtgccaccatactcagctaattttttttctttttaaaaaaaatttttttagacagagtcttgctctgtttcccaggctggagtgcaatggtgtgatctcagctcaccgcaacctccacctcccgggttcaagcgattctcctggctaagtttgtttgtttgtttgttttttggagagactgggtctcactttttggccccggttggtctcaaattcctggcctcaagcgatcctcctgtcttggcctcccaaagtgctgggattacacacatggaccaccatgccaggcttgtttccctttttaaaaaaatcacttgtcctctgtgtatatttgtttcagggactgttgaataatccagctttcggctgagaagctttttggacatttgcctagtgacaatctttctttatctggggagagattggtcagataattagtcttggagcatgttaaagctttgtctcccaagaaagaatttacatctattacaacatctttctctctctctggaaaattgtatccttgttattaagacttttttttttcttttttagctttacagaaaagctgcaaagatagcaagataatttttgtctactctttatccagcttccctgaatgctaacatcttatataaccataatacatttactgaaacaaaaagattaacactggttcattactactaactcaactccaaactttatttggatttcaccaactttatccacaaatttgtcctttttttgattcctggatccagtccagggtactatattgaatttagttgtcacagctcctttccctcctctagtctgtggcagtgcctcagtctttgtttttcatgaccttgacagttttgtagaggtctggttaggcattttgtagaatgtgactcaatgtgaatttcctttgcttactactatacctattatacaaaaaatatacacatatatatatatacatgcacaaatatttatttatagtgtggaaaatacacataacataaaatttaccattttttaagtattattattattttgtgagacatggtcttgctctggtacggccccgctggtgtggaaagcgagctgtgttcggagggcctgaacctacgggcttccaccgtggggccaatggaaagctgcggaaggtgggcccccaaaggtctgggctcctgaagccgctgaggggcgtggcctcctggttttaaaacataaaatgggtgtgaggtctgcagtgcgagccaatgaaaggcaaggggaggcggggtctatgagggaggcggccagtagaggcaaggctctttcgggtggccccggagcggggctccgactgtgcgcatgcgcatcgggccggactacggggcgccgctgagccaagtgggccacccgggcacggccacgctcccgggtcacgtgacacggagggggccgaattctgctggaggcagcgccatatcctggaggtgaaggtgaatagcgtcgggggtcgagctggtgtgggagaaccacatcctgatgcgatgtgacctcgacccagcctggcccggggtcggggatcaggctcgggcccgtgcgctctttaagggagaggcgtgggttgcgtggagggtcgcgcccgctaacccgggggcgtgacctcgtgcctcttggtgacgtaacatggggcgggctcactactggggctgagatttggggtccggttgtggaaagagaggcggggcttccgcctgtccattgacaagtaggtaagtggaagataactgtgtggtgctgtcgtcgccaccttgacttgtggtggctagtttgggtgggagtggtggtgatgtaaaggactggggctagccccgcgaggggcgtgaccttgtcacggagaggcatggcttcaccccgagcctaggcgcacaaagggcgtggtctggcagggttgggggcgtggccgcacagaaactggcggcaagggtcgtggccctggatcctgctgcgagaaggggcgcgatttcttccggagaggttccctgtcgcgcccaagtctgggaagtgccctttctctcttaggtaccacctcatggagacccccgcggccgccgcccccgctgggagcttattcccctccttcctgctcctggcctgcgggacgctggtggccgccttgctgggcgccgctcaccgcctggggctcttctatcagctgctgcacaaggtgcggggcacagaatgggaggtgggctgggggcagtcaaagagggaggggcctcgtggtgctgcttccagctcactcattgtgcagggtgggaaagcgagccccgactagtccagagggactggtaagaggttctgtccagggccctgtctccattgccacgctgtgtatggaggcctggactttgccactggtaagagagaacacggaagctgccgctgccggggcactcgcaccccacctacctccttccccagtgactcttttcacagaacagatggacagcactctgtgctccctaacctggatgggataaatggggcagagggcaggctccagcgagggggtggcagtgacagtttcataacagttgccctctgctgagctcagtactgtagactttcttacctaccccttaccttttccttgaaagtaggtgctgttctttctgtcttcattttctgcaagaggaagctgaggctcagagagattgtgtggtggtttgccctaggtgacatgtttggagagagctgaccccacaggcgtccccctaaactccttgcacctctgtttgaaatttaccccttccccagaccccctcctcaaccctttctctcctagcagggaccaagcttgacctctccctccccaaacccttctctactgcttcctctgctagccaggagtgatgccactgaccttcaggacttaggagatttaaagcaagccttggatgtgtagggctgtgaggcagctggagttgggaggcctcggcacagtctgtgccagcagctcactcccgtgccaggcacatggtggctggcagcctgtcaactaagccctgggcctgtttagcgtccatcaggagggcatcagggaggctgggatcaggagcccagctgccaggctctgcaaggatactggagggcagggaggagtcacagcagatggctccctgccatctgctctgcgtgcgttgtgcccctggccaaaccccctgggttatataaccctctcctctctccctgattgccctgccatcctggagacaggcagtgtaacagtggggcacttaagagcgtgggttctattgaactttcagtcttacttgggcaagccttgatgtcctcagctgtaagagggatgtaatgacaagaggatctgataagatgttatgccttggtttgagcctggcatgtagtataatatatgcctaaccaagaccaagcttctcttgacctctcaccctgctcctgcccccttacctggggcagggggattgccccctttcccagctgccctctgccctggcctttaactttattgctccacctgtccttgggcccaggtggacaaggcaagcgtccggcatggcggagagaacgtggccgctgtgctgagggcccatggtgtgcggttcatcttcacgctggtcggtgggcacatttccccgctgctggtggcctgtgagaaactgggcatccgtgtggtggacacacgccatgaggtcacggccgtctttgctgctgatgctatggcccgcctgtccggtgagggcattgcagagagggctggggactggttggactgtgggctagagtgtctgtgagggtaggggtttttcagaggtggaagaatggccaagagagtgggcatggctgtgatgggctctgtgttccagggacggtgggcgtggcggcagtgacagcaggccctggcctcaccaacacggtgactgcggtgaagaatgctcagatggctcagtccccaatcctgcttctgggtggggctgccagcactctgctgcaggtacccagtccttgggggccagtgggggcctaggggggcttgaagggctcatgcgataaccctgccacacctctgtctttgccagaaccggggtgcgctccaggctgttgatcagctgtcccttttccggccactctgtaagttttgtgtgtctgtgcggagggtgcgggacattgtgcccaccctgagggccgcgatggctgccgcccagtcgggcaccccaggtaggtggaggatggtgatgctgagcagtgctggggccgaggggctggggacatgttatggactcagcgtcctccctgtccctgcaggtccggtgtttgtggagctgcccgttgacgtgctgtacccctacttcatggtccagaaggagatggtgccagccaagccacccaagggcctcgtgggccgagtggtctcctggtgaatagccccacccctgccattccctcctttatcccccgttctctcctgcagcttccagcccacacccatcctcctttgattcacatgtggactgggaggagacagctggggggagagcattccaggtagaaggaacagcatgtgcaaaggtcctgaggcaggaatgaactgggtgggtagggaaagcaaggcggccctcgtggaggcagcaaaggggagaggctcaggacagccctcctcctcctccttttccctttcttctcctcctccatcatctcttcttcctcctcttcctcctccctcttccttcctcttctcctccctttcccccaccacctttcccatcgtcctctccgttttcctcctcctaaaggatgatccttgaacctcggaagggaggttcattcttacatttacagaggaggaagctcagaaaggtgaagtcacttgcccaaagtcacacagctaagaagtggcagagcccaggccgggtgcggtggctctcacttgtaatcccagcacattgggaggccgaggtgggcagatcacgaggtcaggagatcgagaccatcctggctaacatggtgaaaccccatctctactaaaaatacaaaaaaaaaaaaaattagccgggcgtggtggcgggcgcctgtagtcccagctacttgggaggctgcggcaggagaatggcgtgaacccaggaggtggagcttgcagtgagccaagatcgtgctactgcactccagcctgggtgacagagcaagactccgtctcaaaaaaaaaaaaaaaagtggcagagcccagactcgagccctctccttcctcctcctttccttccctcacatctttgtccttttctttctttttttttttttttgaaacagattcttcgttctgttgcctaggcttgagtgcagtggcgtgatctcggctcactgcaacctccgcctccccctgggttcaagtgattttcctgcctcagccttctgagtagctgggactacaggcgcccgccaccacacctggctaatacttgtatttttagtagagacgaggtttcatcatgttggccaggctggtcttgaactcttaacctcaagtgatccaccctcctcggcctctcaaacattacagacatgagccactgcgcctggcctcttctcttcttcttcttcctttcctttcttctcctcctcctcttcctcttcttcctccttctctcccttcccctcagtcccttccctttgcctgtccttggcccttcctttccatacatttagcgagcggcagccatgtgccaggttccaggacaggcacggggcatcatcagtggacaaggtagtcaggctcctgtactccggatgtgtgtgaagcgcctgagggtcagctcaggcagtagtgattttgttctatggcctctttattttttttgagacggagtctcgctttgtcccccaggttggagcgcagtagtgcgatcttggctcactgcaacctccacctcccgggttcaagtgattctcctgcctcagcccccggagtagctgggaatacaggtgcagtccaccatacccagctaatttttgtatttttagtagagatgaggtttcaccattttggtcatatagcctcattcttaatgcactttgccccctggcttcccagtcagtccctccccttgttctccttgcccctctctcttgggctgcctctcacaaggctatctcttatcttgccttttttgttttgttttgttttgagacagggcctcactctatcacccaggctggagtgcagtggtatgatcatagctcaccacagccttgaactcctggcctcgagcaatcctcctgcctcagcctcccttgccttttctttacttgcggggcttcccacggttccatcctgggctgcttctgtgctgtcttggcctgtccttaacggtgaaagcagaggcttctgactctgagctccgactgtttcctgccaatgcccatgtgtctgtctttcgctggatagagcgccccctgaggggagggctgggcaggatctatctttgtgtctccagggccctgcacaggtccttcaggaaagttggggccctggggcccagtgagcaaggagaccgagaagaccctgtttgaagcaggagaggacagtgttcagaactcccatgcaaagcgcctcatgtcctaagtggacagatccttgaacctggggagggaggttcatatttacattgacagaggtggaagctcagaagggtgaagtcacttgccctaagttgcacagctaggaagtgacagagccaggacttgagctcacatctgttggacccacaggcttaatcctggcatgctgagcctgcgttccttgcttctggggggctacgtggagttggggtggaccccagaggctaccgagggcaaacaggcagttgaagacctggccactagggttcgtctgtccctgaggtgtcactcatccaccctgtccccatgccactttgctcctggcttttctcccggcccctttccttgctcagatcctggaatccttgtagttagttaattctggcaacttggtttcttccccctcccttttgcaggtatttagagaattacctggccaacctctttgcaggagcctgggagcctcagcccgagggaccgctgcccctggacatcccccaggcttccccgcagcaggtgaattgcctctcttttgtgtctgaggaccctaccctctccctgaggggagagggccccctgaccctctccctgagtcagtactggggccttaatcttgggtgctcatggcgactcaagggcggccctttggctggacgcggtggctcacagcagcaatcccaacacttagggaggccgaggcaggcggatcacttgaggccaggagttcaagactagcctggccaacatggtgaaaccctgtctctactgaaaatacaaaagttagccaggcatggtggcacgcgcctgtaatcccagctactctggaggctgaggcgggagaatcgtttgaacctgggaggtggaggctgcagtgagctgagatcatgccattacactctatcctgggcaacagagtgaaactgtgtctcaaaaaaataaataaataaaaagacagccctttgatccccacctctcgctccaggttcagcgctgtgtggagatcctgagccgggccaagaggcctctgatggtgctggggagtcaggccctgctcaccccaacgtctgccgacaagcttcggtgagaagcgccagccctgcccttgttttcacgttcccagtccccagtcctcgggtgctcttggggaggcgggaggccccggccacactgacctctgctctgcctggactcccagggctgccgtggagaccttgggtgttccctgcttccttggagggatggcacgggggctgttaggccgcaaccaccccctccacatccgggagaaccgcagtgcggccctgaagaaggcggatgtcattgtcctagcaggtgggcctgagcctcttcctttccctccttcccccaggaaccccctcaccctgttacccagcttcacacgaaggaggaggaaggtctagtgggcacctattgtacttgatacacattttcacataaagcgctttgaacccaaccagacgcataataggtgtatcagatagctactgccctgtaacaaccatccccaaactcaatggctaaaaatgcatttctgatttctcaagatccacctataaggtaggtggtagctgtggttttggctgggctcattcatgagtctgcacttgggttaggcaggaaggcagctgtgctgatccaggctgggcttgctcacctgtatggggattggctggccctgcagctcgtctgggatggcctcagctggggtcatagagttcttcacccctgtctccatggcccccttgtttctcatcctccagtaggctagcctgggctggccgacttggtgaaggatgagaaaactatggggctaggagagtgcggttattcaagagagtgagtggaggctgtgtggcttcttgaagtagagtctgcaggaatggggggtgggggtcctgaatcatctggaggtgtcttcactcagaggtcttgcaattgacgccagctgttggaggggctgtggactagggcaactacacaggtctctatgtgtggctccggtttcctcccagcatgatggcctcagggtagtcagacttcttagacagagagcacattccttggccccacccaggcctctaaaagtgaacaaggaagaaactgcatatcttccttgttgggtgtcatggtgtgtcactttcaaggaaaggggacctaggctgcacctctctccatgggaggcatgtcaaggtgaccttgtacaaatggatgtagggtgggagatattatggccatctgggaaaatataacctgcctctgccctatcctgttggccaaagcatgtcatgaggccagtcccgattcagggggtgtggggagctgcaaggtcactgtaggtggcacaggtgcagggagactcggtgaggaacagggactcatttgcatccagtccaccacagtggatcaagtaaggtagacgacatggggcctctgcctactgcattcctgtcccccacaccaggaactgtgtgtgacttccgcctatcctatggccgtgtcctcagccacagcagcaagatcatcatcgtcaatcgtaatcgggaagagatgttgctcaactcagacatcttctggaagccccaggaggctgtgcagggtgagccccttaatccccccgtacacatatgtgctcctcccagtccctctcctcctggtttctgctgcagctggcttgagcctggtacagtgattgaggcccagaccttgccctaggggtagccagtcaaccagagacaaatagttggctctcaaactgatgaatgcttctttctttaaattttttttatttttattttttagagacgaggtctcgctctgtcacccaggctggaatgcagtagtgcaatcacagctcactgcaccctcaaactcccaggctcaaaagcaatcctcccacctcagcctcctgagtagctgggactacaagtatgcaccaccatgccaggctaatttgttaatttttttttgtggaatcagcatctcactgtgttgcccaggttggcgtggaactcctggcctcaagtgatcctcctgcctcggcctctcaaaagtgctgggattacagaccagagctactgcgcccggcctgatagatgcttctgtaggaacagatggtggggtggacacagagggaggcttgaaaacgtgcatgtgatcacgttccctcccacactgcccactgccctcaggacagagagcacactcgttggccccttagcctgtcttcctgccgtatctctcccctccccttattttagtccccttggacttgaacttggttcatcattctgaggatgttgactcccctgcagcctaggcgacaggacactcttgtattaagcagagaagtagcaccgttgcatctgtgttgggaaggtccactcagcagccatggacggcaggccggaagggggctgggtggaggccaggggggctgctcaaaatggccaggacagaagcgaggaggcctgaactggagatgaacagcggcagagcctcaccttctcagagcctccatttgatcatttgaaaaatggggtggtgaaagatacatcacggggctgtttgttagttcacttcagtaacgttcgctgtgcgcttccacgtgcctggatttgagagatgtgcttggtggatgtagctcttttcattgagtgtttcccaggcagaaggaggtggagggaggggacgaggccagcttgggtttgtcacctgccttgtgctccttaacccttgtttcttgggccttgtcttcccttttcacctgggctgccctcccctggttctggcaggttctggggtgtttcacctgttttttttctaggagcacccctggcctgcttcccgtctgcctgctcggatgctgctgctggcttcctgctgttttgaggcctctgatgctggaagaacaggaggaagccagctccccacagctgtgtcctcttccttccccaggagatgtgggttccttcgtgctgaagttagtggagggccttcagggccagacctgggccccagactgggtggaggagctgcgggaagccgaccggcagaaggagcagacctttcggtggggcctgggtggagtggatgtgggaagggggttcccggcagaccctgctgccaaccctggtgaccttcgctgtcctgtcgcagggagaaggcagcgatgcctgtggcccagcacctgaacccagtgcaggtgctgcagctggtggaggaaacgctacctgacaactcaattctggtggtggatggtggggacttcgtgggcactgctgcccatctggtacagccccgcggccccctgcgctggctcgatcctggtaaggaagggcccccgcctggggcagtgggcaccatccatcaggacgccttcacacccacctgctcttggtcctcttaggggcctttgggactctgggagttggtgcaggatttgcacttggggccaagctgtgccggccagatgctgaggtgaggcactggagttgggagacttgctgctctctaggtcctgatccaccctaaccatcctgggtcccctcccgactaggtctggtgcctgtttggggacggagcttttggctacagcctcatcgaatttgatacattcgtcagacacaaggtgactgggctggcctgagggaagcttagggcctggggttctgggagatttcaccaggggtgggctgaggtggggagggagcctcctctctggcagaggccctatccctgtctctgtcctctggctggccaagccatggggctgaaggctgcggcctgccttcatcatcttcctgtagatcccagtgatggccttggtagggaatgatgctggctggacacagatttctcgggagcaggtgccctctctgggcagcaacgtggcctgtggcctggcctacactggtgagggggcctcagcgaggttgggaggacaggaggctgtttcagtcccagctgggcttgtgttcctctcctgggctggctgcatgtgcggtgggctgagtccttgccactatccgacttaatctcttcttttagattatcacaaggcagccatgggtctgggggcccggggcttgctgctctcacgggagaacgaggatcaggtggtcaaggtgctgcacgatgcccagcagcagtgccgagacggccacccggttgtggtcaacatcctcattgggaggacggacttccgcgatggctccattgctgtatagggccttgtgggtcaggacgcttggctgccttcctgcccctggactgtgtccagctggtttggagtctcatcattgcttgccctgggcctatcccatgaggcccagtgactccacaacctccctgaggaggggatggaggggtcaaatctcagagaggctctcttgtgagctcttggaccctcctcttcacggacccaactgtgccgtttgtcccctctcttatggagactgaataaaccacctctggcccatgtaggcccaagtactcagtctcagaacctgtgcatatttatttattatccacaaagatggaggtgcggaaaagaagagggagacaggagggaaccgtactctcccactggaactctggggcccactgaggcaccattattggggatttcagggtggctgggcactgcaaactgctccctcctctgtggtccctgaaagagccccacacgcctgcttcagacgtgtccacgcacaccagtcctcacagacacacacacacatgcatggaggcaataaatatgttccgtaccagactgcccccagcctgacgcttcagggggccccctccaaaagggaggggtttaagtgctcaatttttttcgggggggggggggcaaggggggggcaaggagatggggattggaaaggccagactctgttatctccatttgctgactagaggccaatcgtggggtcttccccgggaaagggtaggggaaaccagctgtttctctataagccccaggctacccctgtgtccatgctggaacccaggataggggctgccccccacaaagagtgcctcatgctagtctttgtgtcgtccaagggagggagaaacagtgcagtgctcaaagctaatactgatttggttggcagcagcaagagggccgactagaggtgactcaccacaccagggtgatgctcacagtaactggtgttgccccggccaaggggaggcaagagaggccagcctagcaagcgcgagaactacctttttggcaacaaaaggggaagcccttggtgctcaggaaagatggtcacaaccgctggtccctaaaatccccaggccccagacttggcaactagtgtccaaataccgggccctggaaactgggaatgagtctcagccatacacgcgactggtcccgtggtaactcgctggcaaccaggagctcggcctgagcaacaggtctggctctccttggtcaccagggcaccgccttagccactgggcgcccggtccttactaaccggggtcccaccccgtcatctggctcagaggcacacgttgatttgcttggagagctctctctccagatccaggatgagggcgtcgaagtctttgagattcaggtgcgggttgaagggcgcatcgaagtcgtcttcgaagtcaccggtgaccctcggctcgccgacctcctcgtcctcgtcctcgctgtcactgcccgtcacgtggtcgtagtctggcccggacaggaaatcccgcccacagggcaggaagtcccgcccgcaaacgctccagtcgccggcgtagcggttgctcggggggctttcggggcctcctcgaccgcggggccgagtcaccacttcggggtctgccagcggcaggtgcagaggtggctgtcgtttgggtcgcaagtaaggcgcgacatctggagattgtcggggcaggcggggatctgaagggagacagggtaggtcatagaaagaggcgacagccgacctctgattggctgcttagggaactaggctcctgattggcctgtggaaagcggccttcgaccgtttcaggttttcactggcagagctaggactggttgcttaggcaactaggcctctgattggcatgtcaagaggcagggcctctgactgcatcaaagatgggtaggggcaggtctgtggatcatgcctggatcatgcctgtaatcccagcactttgggaggcctgaggcaggcggatcacttgaggtcaggagttcaagaccagcctggccaacaccgtgaagccccatctccactaaaaatacaaaaattagctaggattggtagtgcatgcctgtaatcccagcactttgagaggcctgaaatgggtggatcacttgaggtcaggagttcaagaccagcctggccaacacagtgaaaccctgctctacttaaaatataaaaattagccaggactggtggtgcgtgcctataatcccagctactcgggaggctgaggtgggagaatcccttgaacctgggaggcaga

SEQ ID NO: 16250 - DNA, 26831 bp, Human
ctgcagtgagctgcactcctgcctggttgacagagcgacattctgtctcaggtcttgaactcctgggctcaggtgatcctccccactcagccacccaagtagctgggattacaggcataagccacagcagctggctcaatttttaaaattgaggggaattcacataacacaaaagcaaccatttgaaaacgtataattcaatagcatctagtattttcattatgttgtgcaataattgtcacctctatctcgttctgaaataacatatttttctttatatgaatgcagttgtgaaatagaattttaatgtaggcttttttttaatgaaggaaggggtgcacaaagagaaaagttcctcaggcccatgaaaatcacaatttctgagccgccctgtacacgtgaggtgtttagttggtagacagatgggcaagttttaatttttatatgcattttatttaatgttgatgaaaaatataattcacatttcaagtaggggtctaaagtttccattttagatacatttttaattttaattttaaaagtatttatttatttttattttgagacagagtctcactctgtcgtccaggctggagtgctgtggtgcgatctcggttcactgcaacctccacctcctggattcaagtgattctcttgcctcagcctcccgagtagttgggactacaggcacctgccaccacgcctgggtaatttttgtatttttagtagaggcggtgtttcactgtgttggccaggctggtctcgaactcctgagctcaagtgatctgcccgcttcggcctcccaaagtgctgggattataggcgtgagccaccacgcctggttcggtactgttttttaggtaagtgaataaggacacatggatatggccaaatataaagaggagacgcaaaagcctgcagtttgggaaacatcagtacagtgcctgccaccccagaggggctcatgaacatcacactgtggccaagaatcattatcatttcattcccaagggactccccgctctcctgactccccgctctccctgttgctcacctgggcattcaggcagaatagctgcatttactgggcacctgctgtttgccaggcacctgctgattttgtccttgtgaaaagcctccaggctggacacaaaaccgtcctaatttgggggactagcctccgggtgctttgtctagggctccgtatgcagctggcacttcacaaaggcttgttaatttcccttgagccactggggcagcccccagaggcttgtgatgatctcagtgaaataagagtgggctggagtcagggtgtgtcaaaaaggtccattatttttgtggtttcctcctcttcccagccattctcaggaatgattctggagacttgacgttttcctgccaagacctgtccttagaaccgggcacatcgcaacagacttaccttccccctcccctgccattttgtttttagttatatttttatttacttgttgttcttagagacagggctgtgctctgtcactcaggctggagtgcagtggtgcagtcacagctcactgcagcctcaaacttctgggctcaagcgatcctcttgccttggccttagaaagtgttgggattacaggtgtgggccactgcgcctggcctttgtgcttttttggaggggtggaggtctcactatcttgctcaggctgggaagatcatagatcactgtaaccttgaactcttgggctcaagtgatcctcctgcctcagcctcccaaatatttaggactaccacccctagctgcccaggccagtcttgaactcctgggcgcaagtgattctcctgcctctgcctcccaaagtgctgggattacaggcgtgagccaaaacacccagccacccccgccttctgagagtcctcaggaagcgctcattacccttcgcagccttcgccatctgcccacgccggccttctgtcctggccctcaccagccccaggcttctctgtttcccgcagatagaccatgagcagccatggcaacagcctgttcctgcgggagagcggccagcggctgggccgggtgggctggctgcagcggctgcaggaaagcctgcagcagagagcactgcgcacgcgcctgcgcctgcagaccatgaccctcgagcacgtgctgcgcttcctgcgccgaaacgccttcattctgctgacggtcagcgccgtggtcattggtgagctctgcctcttggagggcggggacttcagggaaaggcggggacttcagggaaattcctggcctctacacatctctttgctgcaccccttcattctcacctgcacacacgtcccagtcccaccagtcaccctcaaccccccacataaagacacaccacacagatgaatacacatgtgtgcaaacacaactgtgtgtgcacacaatgttacatgcatatccatgtgtacacacacactcacatatatacatatacaatgtacaaacactttactatgcacacacacatatgcgtgcattgaacttataggtgcaaacacaaacatgcacacttgtgcatgtatgttggaacttataaacacattcacatctctacatgcattctcttgagtacacgtgcacacacttatgagcttaagaacacgtacactcccatgtttgaaaatagtaagatacacacaaatcacacctatagatgtccaggaaaacacctgtgcagattcatgtgtatatgcccctgtatacagacacctatacctgttcacaagtgaatgtctaccgtcacatatcctggatatatacacacacatttacacatttacatttgcacagacacggacacacatttacacaatatcaatatggtaacccatacatgcatacatttctacaatgtctgcacacatcagtgcacacacaaatacacacactcataggatatttctctccctcactcccacccttgccctacccttcttgggatggatggaccctgcctggggctgagcgacccagacttcagtccatggaccccttcttttggccctaggggtcagcctggcctttgccctgcgcccatatcagctcacctaccgccagatcaagtacttctcttttcctggagagcttctgatgaggatgctgcagatgctggtgttacctctcattgtctccagcctggtcacaggtgagagagcccaggccagtgttggcctccaagacccgtctagagcctcagcttgaacccagagccaaggccatcccaagcatgggaccacttccttgacgcggcacctcaaacatggagcctgtgtctggtccagcgtccttggccaaacaaagcccaggtcccaatcggtcccaggttccagaccccatatgaccccacaccactcatctcagtaggcttcctgtccttttccttggaggtaaaatgccagcctgcaaggggcttagtatcacaaagaagtgagagaaagtcttggaagggcaaccagggagggtggctgggctatggtatggatgtgcagggagtggggtgtcgattaaggtgtggaaggtgagtgagatggaggtgacagcttagtgggtagagggtgggatgggagtatggttggcttatgcaggggtccacaaacttttgctttagagggctggatagtaaacattttcagcttcaagggccatatggtctcttttgcaactagggttgacccttgaacaatttgggtgttaggggcaccaacccccacacagtaaaaaatccacatataactgttttgttttcttttgtttttaacaaaatcttgctctgttaccaggctggggtgcagtggcaccatcttggctcactgcaatctccacctcccaggttcaagcaattcctccacttcagcctcccgagtagctgggactacaggcacgcaccaacacgcccagctaattttttgtattttagtagagttggggtttcaccatattggtcaggatgatatcgatttcctgacctcatgatctgcgcacctcggcctcccaaagtgctgggatagcaggcatgagccaccacgcccggctcacatgtaacttttgactcccgaaaagcttaactactaatagcctactattgactggaagccttacagagagcataaacagttgactaactcatattttgtatgctgtaagtattatatactatattctttttttttttgagacagagtgtcgctccgttgcccaggctggagtgcagtggcacaatctccgctcactgcaagcaccgcctcctgggttcatgccattctcctgcctcagcctcctgagtagctggaactacaggcacccgccaccatgcccggctaattttttgtatttttagtagagacagggtttcaccgtgctagccaggatggtctcgatctcctgacctcgtgatccgcccgccttggcctcccaaagtgctgggattacaggtgtgagccaccccgcccggccattatactatattcttaaagtacagtaagctagagaatagaatgttattaagaaaatcaggccaggtgaggtgacttatgcctgtaatcacagtgctttgggaggttgaggcaggagaattgcttgagcccaggagttcgagatcagcctgggcaacacagtgagactccatctctatataaaataaaaaaaatcagcaggatatggtgatacatgcccatagtcctagctactcgagaggctgaagcaggaggatcacttgaacccaggaggctgcagcgagctgtgatggcaccactgcactctagcctgagcaacagggtgagaccctgtctattaaaaaaatgataaggaagagaaatgttatctactattaattgagtggaagtggatcatcataaagatcttcatcccctttgtcttcatgttgagtaggctgaggaagaagaagaggagggcttgtcttgctgtctcaggggtggcacaggcagaagaaactccatgcataagtgtactcgagcagttgaaacccatgctgttcaagggtcaattgtactcgattctgccattgcagcacagaagcagccatagacaatatgagaacaaatgggcatggttgtgttccaataaaactttatttacaaaagcaggcagagggccggatttggcatgagtagcagtttgccaatccctggatttggggatggggaagaagaaaaaggcatgaagaaatggcttcttaggttgggtttcctagaagcagagcctgactgagatggggatatctgcacaggtgatttattgcgggatagctctcaagagaaactcgcaaggaagtgaaggaagtgggacagggctgggaaaccagtgaagcaaagatgtgggtttcaaaagaaggctggcctctcagcctcatctcatggggagctctggagtgtgagcagaaccacagaattgaatccctccccagctctactgccacctgaatcaaaggagttggccattgtgaatccctgcacagtcattctttggctctaggtctcccctggggtttctatgggcaaggcagctcccattttgctgagggcaattctcaggagaagtgggcagcctgagctattgtactcagtgctctcggggctgaaggatcagcagattggcttgggaaagggtgtaggagtggagcaccaagaatatgtgccacaaagggtgcgccgtgaggtgggttggaggaaggtgtgattttgggattaatagtgggatgacaagtggaatgaaagttaggttatgggccaggcgcagtggctcatgcctgtaatcccagcactttggaaggctgaggtgagtggatcgtctgagttcaggagttcgagaccagcctggccaacatggtgaaaccccgtctctactaaaaatacaaaaattagctgggcatggtggcaggtgcctgtaatcccagccactcggaaggctgaggcagcagaattgtttgaactggggagatggaggttgtactgagctgagatcgcaccatggcgaaggagagtccgtctcaaaaaaaaatagttaggttatggtgcaaaacaagagaaaacaagactcaatagaggatggggtgaaagtgtggaaaaggtggcttggagtagagggaaggcagtaggatagtggagtgctgcttgggataagggttgggatggcgtgtgagggtgtgtatttggaaaattagaagtagaaagatggtggtgcgggtgaatgggtaatgggtgggttttggggtgggctataggaaaagggatgcttggtgggtcggctgttgagttggtgatatggggagggtggaacggatgctaggagagctggcgttgggtatgcatggagctgcgggggccacatcatctgtccttcaggtatggcatccctggacaacaaggccacggggcggatggggatgcgggcagctgtgtactacatggtgaccaccatcatcgcggtcttcatcggcatcctcatggtcaccatcatccatcccgggaagggctccaaggaggggctgcaccgggagggccggatcgagaccatccccacagctgatgccttcatggacctgatcaggtgtgccaacctaaaaaaccacaatatacacatttgaaaaaggagactttatttattgtaaaagattatagcctgcaaagaggtcatcccacaggctgggaagcatgcgtccggtcaagagcagagacgggcacttctaaggaggaggggttggagtaggagctttatgctgaatgggttggctaaacatgcatattcaacaggttacaggaggagctatgaatattcatgtaggtggccctgatgcatgcatattgaagaaagttgcatgtaacatatgaccccatgtccactttggggtggatacttaacatttacttaacatttaaatgtatcacatttaggctttatacatcaaaaggtcttttcaggacacgaaggtacccaaatgcacagcctctgtcaatgagccagaaccagcccatggtcagtggtgttatcaggagaaagttactgaaatcagtctcttgtccaatcaaagctgtagttatggctggtggaacaggggccccattagtccttgtctgtgagctgatgagttgtaattattttaatattgcttatcataagactagtgtttgtttaactcctagagaaaaagaagaaccttttgacagctagaacacaatttattctttgagcgtagggtccatgacttaacccctgcgtggcatggtcttagatcctccttataatttggtatcttattgccccaaagagcctgttctatcagtcttatgatttctgttttaatttaatgcattaataacattaatgtgggttagttgttgtgtctagattataaaagggagagagtgtaaggaggcgtgtctgacctcctgtcccatcatggccaggaactcagttttaaagttgttctggggtccacttggccacaagagagtctgttcagctgttggtggtggtggtggcttaggtgttacttttagtttacaggtgactgtactcattttgatatgatttctgactctacttgcaacaactcatactgaaggagagacaaaggggacaggctcccgcagcctggacatagcagcacccatagtatccacttgtggtacccaatttctgccctggagccttgtatatattctccaacagcagctgctgctagaatatgatcttaggatatgacccttaaggtggggtcagaacagctggtatttgcctaagcatcattggagggtgaatgattctcttagagcagcatgattttttaatttatattttattttattttttactttaagttctgggatacatgtgcagaacgtgcaggtttcttacataagtatacatgcgccatggtggtttgcagcacctatcaacccgtcatctaggttttaagccccgcatgcattaggtatttgtcctaatgctccccctccctttgcccccacagcccccaaaaggccccagggtgtgatgttcccttccctgtgtccatgtattctcattgttcaactcccacttatgagtgagaacatgcagtgtttagttttctgtttctatgtcagtttgctgagaatgatggcttccagcttcatccacgtccctgcaaaggacatgaactcattcttttttatggctgcatagtatttgcatggcatatatgtgccatattttctttatccagtctatcactgatgggcatttgggtcagttccaagtctttgctattgtaaatagaagcagcacgattttttaaaaaattaactaaatttttgattttttatttttattattaaaaaatatttttgctattaatagttgcctttactcttttaattgtttttatttttatttttgcactccattgcccaggctggagtgcagtggcatgagcttggctcactgcaacctccgcctccagggttctgttgtgcctcagcctccagagtagctggaattacaggtgcacgccaccacactggactaatttttgtatttttagtggagacagggtttcaccgtgttggccaggctggtcttgaactgctgacctcaagtaatctacctgcctcagcctcttaaactgctgagattacagacgtgagccactgtgcccggcctatgaaaaattttttaatttttaatttcaatagcttttggggagcaagtgtttctttgttacatggatgaattatatagtggagaattctgagattttagtgcatccgtcccactagtagtgtacattgtacctaatgtgcagcttttaatttctaactactctccccgcctcccgcttctgagtttctaaagtccattatatcactctgtatgtttctgcatactcatagcttagttcccacttataagtgagaaatactgtatgtggttttccattcctgaattacttcacttagaataatggcccccagctccaaccatgccaaagacattatttctttctttttttttttttttttgaaacagagtctcactctgtcgcccaggctggagtgcagtggcatgatctcagctcactgcaacctctgcctttcgggttcaagcgattctcctgtgtcagcctcctgagtagctgggattagaggtgcctgccaccatgcccagctaatttttgtatttttagtagagacagcgtttcatcatgttggccaggctggtctcaaactcctggcctcgagtgatccactcatctcagccttccaaagtgctgggattacaggtgtaagccactgcacccagcctatttcattctttttcatggctgagtagtattccatggtgtacatatatcatgtgttctttatgcactcatcagttgatgggcacttaggttggttccatttctttgcaactgtgaattgtactgtgataaacatatgtgtgcaggtgtctttttgatatagtgacttcttttcctttgagtagatacccagtagtgggattgctaggtggaatggtagatctacttttagttctttaagaaatctctcagccaggcgcagtggctcacgcctgtagtcccagtactttgggaggctgaggcaggcagatcatgaggtcaggagattgagaccatcctgcctaacatggtgaaaccctgtctctactaaaaatacaaaaaattagccaggcgtggtggtgggcaactttaatcccagctacttgggaggctgaggcaggagaattgcttgaacccgggaggtggaggttgcagtgagccgagatcgcaccactgcactccagcctgggcgacagagcaagactccatctaaaaaaaaaaaaaaagaaatctccatactgttttccatagaggttgtactaatttacatccccaccagcagtgtgtaagtgtcccctttcccccacatcaatgccaacatctatagttttttgactctttaatgatggctgttctagctggggttaaggtggttatctcattgtggttttaattttaattaaagcagcaagatttttgccacacagaatcaaggctagccatggttctaccttaatcatgggcctagacgaaacctaaagttaaaagggtttaagagttttctgtggttttttgaggcatcactgacacatgtgtgtttgaattaaagtccttgaggtgatgtagggctctggccacatgctcagacagacctggatttgagggccatctgcacctcttagcagctctgtggctccgggtagcttacatcaattctctgggctgtggtttctttctatgtgaaaggcggcattcaataggactcatgtctagggttattgtagtgttttaatcagatgatagtaagatgcttgctcagtgcccagcctagaggaagcattcatatgttggctgcactattgttgttcttggtgttagtattactgttatcaccctagatgcccttccatggtctaaccactttccttcttctcatgtttttctgcagaaatatgtttccaccaaaccttgtggaggcctgcttcaaacaggtcagggggaagtacacagtttgatcaaggagattcggagggtggtgggagcttggggctgaagggatggtccaagggcaagaggcgggaggaagggcctgacagagcaacgggcaggggttcttgaggagtctaggagaaaggatgtattttccatggtgatctgggggggttagggagaagcacttaggtccgagaatggtggatcaggcttgtaatcccagcacttagggaggccaaggtgggaggatcacttgaggccaaaagttcaagaccagcctgggcaacagaatgagactctctgtctttcaaaaaaaaaaaaaagattaaaaaaaaattagctggacatgcctgtctcagctacttgggaggctgaggtgggaggattgcttgaacccaggagatcaaggctccagtggtcacaccactgcactccaacatgggtgacagagcaagaccccatatcaaaaaaagaaaaaaaaaaaaagaggacttaggccaaggacttcctgagcacagggctagaggaggcaacaaggctggtgtagagattccagaaattttgaccacagatggttgaggggagaggccctcaactctggttaagcattgctcagggagcttgtgaaaaattcagaatctatactacttccacacattggttgttcacttcctcattcatttattcaggcacttattcttcaaaaaatatttttaatttatttatgttcaaattcacacaaagattatatgtatttatgaggtatgatgatgttttgaaatatgtctgcattgtggagtggctcaatcaagcttattaacatatcaattaccttatatacttaacattttttgagataaagacacttaaaatctacccttctggtgattttcaaatacacaatacattgttattagctatagtcaccatgttgtataatagagctcttgaacttattgctcttgtctagctgaaattttgtgtccttttaccaacatctccccaatttccctgctccccagtccctggtaagcactattctattttctgcttctatgagtccaactcttttaaatttcacatataagtgagagcatgcaatatttgtctttctgtgcctggtttatttcacgtagcacagtgttttccaggttcaaccctcttgtcacaaatgacaggatcccctcctttttcaaggctgaatagtatttcattgtatatgtataccacatgttctgtatccattcattcactgatggatacttaggttgatttcatatcttggctattgtgaatagtactgcaataaacatgggagagcagatatctctttgagatactgatttcatttcctttggatatatacagtagtgggattgctggtcctatggtagttcaatttttttttgtttttttgagatggagtctcactctgtcgccaggttggagtgcagtggcaccatctcagctcactgcaacctccgcctcccaggttcaagcgattctcctgcctcagcctcccaagtggctgggactacaggcacgcactgccacacccagctaatttttgtatttttagtagagacagggtttcaccatgttggccaggatggtctcaaactcctgacctcatgatccgcctgcctcgaccttccaaagtgctgggattacaggcgtgagccatgcccggccggtagttctatttttaattttttgaggaagctccatatgatttttcataatgggtttactgattcattcgctcattcttccatgcactattcaagtcattcattcactcattcagatctgctgaatgagtgatagtcgataatgagtgataatcgataatgaagatcttatcgatcttccagggtgtgggaactgggaatcagtggtctcaaggaatttctccaggcgattctaatgcatccgctgaattgaatctgggcgcaatctctctctatttcagttcaagacgcagtacagcacgagggtggtaaccaggaccatggtgaggacagagaacgggtctgagccgggtgcctccatgcctcctccattctcagtggagaacggaaccagcttcctggaaaatgtcactcgggccttgggtaccctgcaggagatgctgagctttgaggagactgtacccgtgcctggctccgccaatggcatcaacgccctgggcctcgtggtcttctctgtggcctttgggctggtcattggtggcatgaaacacaagggcagagtcctcagggacttcttcgacagcctcaatgaggctattatgaggctggtgggcatcattatctggtgagtcctggtctgtgcccacgggatggtggagccagagctgggaagtcaggctgtggggaagctgccgaagggcttgctggggacttttggtcattcatttacgtattgggtgattcacttacccactcaccaactcattcattcatgtctttctgggatgatttcatcactagttgacttccttgttcatctgttcattcattcattcttctatgcattggttagttcatggaatatctcactctttcattcattcatgtccttctgcaatgattcattcactgctttgttcatctgttcattcactcattcttctatgcattgatgaaatcactcattcagtgatttattcatctatactcatgcttcaatgcattgatttactcatttcctcatgcatttattcattcatctatgcattggttaaatcactggccaactcactaactcattcattcattcacacttttctgcaatgatttgttcacttgttcactcccttgcttatctgttcattcactcattcttcaatacattgaccaagccattcactgacatttattcagctacatttattctttcatgcattggtttctggatttatttggtcattcatttatttattttgcaaaattaatgtatttttaattgacaaataaaaactgtatatattttcatgtgcaacataatgttttgaaatatctctacattgtggaatggttcagttgagctaactaacatagacgttacctcacatgcttatttttttgtggtgagaacacttaagatctaggcagggtgtggtggctcatgcctataatctcagcactttgggaggccaaggtgggagaatcacttgagcccaggaatttgagaccagcctgggcaacatgacaagaccacaaaaaatacaaaaaaaattagctgggtgtggtggcatgcagctgtagtcccagctgcttgggaggctgaggcgggaggacagattgagcctgggatgtagaggctgcagtgagttgtggttgcctgggtgacagaatgagacccagtctcaaaaaaaaaaaaaaaagggagagaccacttaaaatctactctctttgtgatttgcaagtacacaatacattgtttttaactatacctaccatgttgtccaatagatctcttgaacttatttctcctatttaactgaaattttgtacccttgatcaacatctccccaatctccctttcctgcgagtccctggtaaccaccattttactccctgcttctgtgagtttgattgtttagattccacagataagtgagatcatgtggtatttgtctttctgtgtcttggttatttcaattagcataatgtcctccaggttcatctgtgttgtcacaagtgacagggatttattcatctcctatgcattggttagttactattcattcattcatacctttctgcagtgatttattcacccatttacttccccatgtatctcttcattcaccaatttattcacttattcattctcatttttctatcggttcattcattttcttattcatctattcattcttccatgcatcagttaactcactcatgtattcattcactcgtaaatttatttacaaactcatccatgcattagttaaatcattgatggattcatctgtttatttactcagttaagtcatttattcattctaattcattcttggactcactcattcatctatgcatttgttattctttcattcatttattcaagtattctcttcattcactcatttgttcacgtatttgttcactcagttactaacttgtttcatttgcttatttccttacttattcatccagttgttaatcccttccttccttccttccttccatcattccttctctagattcctttattacttcagaaatatctttattcactcagcaggcattttcccaggcagactttgtcttgacctctggagtacagagatacagtgcactcataccttgtcctcaacaagctcacaaaatcttaggggagacagacacattgtagatcaatataacacaaggtggtaggttctgtagtaaaggaacatttaaaaaatgttgggaacttggagaaggaagcagtgagtagaggggtacgcagtgaatgcttcctgaagagggagtcatgaagaaggtcacctgttaactgcgtcttgacaggtgagtaggacttcaactggacagtgagaggggagacgtatttcaggcagagagaagagaacatgcaaagcttgaaggtacctaagttgtttggagaatggtggggcattcaggaaggtgagagcatggggtaagttgggagtggtggtggaagatattaacaaggctgtcagatcccaaatgggagaagactttgtacatcatcccaaacaattggaaagttgtatagtgtcatatgtaaaatgtttatttagaaacagaatgcttgttccccagtgccataaagaaatagcactcaaacataaatttaattatctcagcaaggcaatttttacttctgcagaaagggtgttcatcacagatggaacaatggcaagagcacacctgaacaaaggagggaagaagcaatttttatcccttatgcagtttgtccctgctactgtgtctgtctccattggctggagccagactttacaatctaaactaaatcccgactggctaataatttaaaacttttctaaataggtaaaagcaatggaaaacagaggaaaagaggaagttgcttacaaaaggacttagaaaagtaataacattcccaaataaggaaggggtataggctgcaagctgggacatgcctgtgagcacatccagcacagatatcttggttaaagtacaaggacgtagaatgtactatgtgcctgtgagcgtgtctaacacctacataggatagggcttaacaaagagttattagcataaagtaaggaggcttgaaggaagttagtctttaaaagaaactatttttaacacttaagatttattctttaacaagaagggaaactttgaagacgaacttttactttcttcatataaggaacttgaggccaagttgagggcctggaaaagcatctgaaaggaatgggagtggggagcttattaaggataagcagagagttaacaaggaataatgaaggctcagctgaattgggaacaatgaatttatagcagtgtcattggcatgattgggtgaaatgtccagatgtgccaggtggctgagtgtagggggtaagaaatcatgcacaattaatcttgggctgaggaattttgcaggggatgaggtggaaggatggaggtgaggaagttgagagagggattactcagagtaagcatagaggtggatctagtcatgttgacttggagaagactcagcaactactccccagggctaactctgagcccagtttggagaacacagatgtgactggagaagccccgtgcatcctcatttttgactcaagctattgtaccaccttcccaagaggtccccacctcctccaacacatccacgatgaatgtgagccaaagtagatttcaaatttttttttttttttgagatgcagtctggctctgtcgcccaagctggagtgcagtgatgtgatctcagctcactgcaacctctgcctcctgggttcaagtgattcttctgcctcagcctcccgagtagctgggactacaggtgtgcactaccacacctgactaatttttttatttttaatagagatgggatttcaccatgttggccaggctggtctcgaactcctgacctcaagtgatctgccctcctcggcctcccaaagtgctgggattacaggcatgagccaccatgcccagccataaacttcaatttctaaagaaagaggagtagccattgaagcctcgaaatgagatgatggtgccaatggcagaaactcactcgattgacccgtgggctggattatggggggaaacaggtgagcccctgatgaacttgcttctttcatcttctctattctcctttttactcaatactccagccacattggtcttctctctggtcctccagcactcctagtgcatgcccatctcagagtctgcattgtgcctgcaatgatttcttccagatacacagggtaccttctcatcatgcaagtctcagcttaaatgtcacctcttcagaaaagccctctctgaccatctgctcagaagcagtcccatccagtgactctcctttgctgttatcaccacttgaagtttgcaattagtgcatttctatgtgtacctcctgctttccccattagaatgtgtcttagttcatgtcagctgctgtaacaaaaataccatagacattgtggcttaaagaacaaaaatgtatttcgcacagctctggagggtgggaagtctaagttcaaggcacccacagattccatgtctggtgagggctgtcttctggttcatggaaggcgtcttcttgctgtgtcttcgaatgacagaagggtggagggagctctctggtgtgtcttttatatgggcactaattccattcatgatggctctaccctcatgacctaatcacctcccaatactatcccattgggggttaggatctcaagatatgaatttggttggagtggggaggggacataaacatttagtccataacagaatgtaagtgctttgaggacgagagccatgtgcctggtactcagtaggtactcagtcaatatctgtggaatgaatgaatacatcggtgattttgataggacaagtggtttgagagggaaatgcttaggctggtgaatgagtgataacaggcactgatagggaagagaataggggcatacacatttcaaatgtggaacaaacagttgggggcagaagataagggaagcttagaaggccagagacagggaatgtcttggcaatgtctaaggaaggaaactgaaggtagtgattatttggggcaggattgagagagcttgaatggggagtaggtacaggagagacctgaaagcttgtatatcctggagttgtaggaacttttctaccatggtggggagatgtggaagagcaggaggaggaggaggtgggcttcattcatggggcccggtggcattcattagtgtacggggaagactgggatggagtagggtgccgtatcatgggtattgtgtggctccagggccctatatgggcaaagccttggggatgccaccttcagacctgcaagggaggtcaggagggagccctgacaggtatgtggctccctcacacaggtatgcacctgtgggcatcctgttcctgattgctgggaagattctggagatggaagacatggccgtcctggggggtcagctgggcatgtacaccctgaccgtcatcgtgggcctgttcctccatgccggcattgtccttcccctcatctacttcctcgtcactcaccggaaccccttccccttcattgggggcatgctacaagccctcatcaccgctatgggcacgtcttccaggtatggccttgctccccaccccagcaccattcctggttgcacttcttgtccttcatgtcctctcctaaggcacctgccctctccattccttaaacacctcttctgagtcgtccaacaatgtccagggctcataatgtcaacacctggggtccagtcattgtcctgggctggctctcctggtctccttttctcctttcctgttttttaactttctgtggaggagaaccaggtaccagttttgaggttaagagggaaggttccaggatgccccatgagctcagtcatttcctagctcagagggtgtcatctccacttgtgagatggtgtctgggagatctcttggctgctgcttcttccttctcctcctccttcttcttccccttcatcctcttcctcctttttcttcttcctcctcttcctcctcctcttcttcttttgtagttttaggggattaattaagagcatcatcccaattcaaaaacaaatttgaaaagtagcacaacagccaaaaagatggaagaattttttttttcttttttttgagacagagtctcactctgtcacccaggctggagtgcagtggtgtaatcctggctcactgcaagctccgcctcttaggttcaagtgattctcctgcctcagcctcccaagtagctgggactacaggcatgcaccaccacacctggctaatttttgtatttttagtagagatggggttttgccatgttagccaggctggtctcgaacacctggcctcatgtgatctgcccaccttggcctctcaaagtgctgggattacatgtgtaagccgccacgcccggccaaaaatatcttttttttctttttctttttcgtttgacatgaggcctcactctatcacccaggctagagtgcagtggtgtgatctccactcactgcaacctccacttcccaggctcaagtgatcctcccacctcagcctcccaagtagctggaatcacaggtgcctgattccagtcctcccggctaattttttagccctcccggctaagtttttttttttgttgttgttgtttttggtagagacggggttttgccatgttggctatggcttgtcttgaactcctgagctcaagtgatctgcccgtctcgctctcccaaagtgctgtgattacaggcacgaaccactgcacctgatcaaaaatataatttttaaaattgcccataacgctggtcagggaatgtgcctcttggtctatggctaggtaagactgatgtcactgtatcctagaattaaactcacatagtcaccgctgagttggacacccagagactctcttatgagtccaggattccaaccgtatgatgtaaagctgaccacagaacacacgccttgtggacagacttaccccaaatgagatgcccacttctttgactaaactcgccaatcaattaggtcacttttctccgataagacatggcgggtagatggatagagaaagttagcacagctgaggtcaatgctggtgcaaacaggggagtctggagtaggggccctccctgaagtcagcagacctttggtcctgtcctttttggaaatggataggtagaacgaactactgccataaactagtgtgtagtcattggccttagctattggctttaagtgggtgaagagatcttcagcttgggagaccctcattgctgttttcttcctgtatcatgaggagttgctcctttcctttgtacagttatcagcctctgaaatgttatacccttgtcttctgcatcttgaggagccccccacctggcctgctcaatgttctcaaggggaacgctccttgggctcatttctgcccaggccacgcccagcccatgccctgctctgagccccgccctgccttgccacgccctattctcagctcttcctcacctggccacgtcctgctctgagccccgcctcacctactcctcccctgttctcagccccgcccatgtgacccagccctacccattctcagccgtaccccactaggtcacgccctgttccccagcctttcttcggccacgccccattctctgccctgccccactaggccacaccctgttcccagccccgcccccaccaggccacgccccatcctcagtcctgggctctttcccccagctcggcaacgctgcccatcaccttccgctgcctggaggagggcctgggtgtggaccgccgcatcaccaggttcgtcctgcccgtgggcgccacggtcaacatggatggcactgccctctacgaggccctggctgccatcttcattgctcaagttaacaactacgagctcaacctgggtcagatcacaaccatcaggtgagggggcttgggtaggacctgccagcaggtgagacttaagcggtcatcagcttggctgggagggttggggagggaggagggggccgcagctggagctcagaggagcccacggatgttggaagcgggatgtgggaagagcccaatgccggatgaggtaggtgaaaggtaaagttgccacctgaggctgtcaggagctgccaagacgttcctgtcagtttccctctcacgtgggagatccatttgtccagtgttttccaaagcatggctggtgcatcctgataacccgaggttcttgtatatagattcttatatttgtaggctctatacatttatttattcctgtatttataggtcccatcatccagtggttccaacttagtcattataaaaataacagtgaacattgtcatctccttcaggtcttcagcgttactttttcagggaagccctgtttaaaatggcatatcgggtcttgctaaggaggcactgtttccccgtgtagtactatctccatatagtatgaattttagttattcattttgtttattgcctgcttcccatactagaatgtaagctctgtcaggcgcggtggctcacacctgtaattctggcactttgggaggccgaggtgggtggatcaggagttcgaggtggtcaggagttcgagaccagcctggccaacatggtgaaaccccatctctactaaaaattaaccaggcgttgtggcatgtgcctgtggtcccagctactcaggaggttaaggtgggattgagtagtgagttgcagtgagctgagataacaccactgcacttcagcctgggagagagagagaggaggcgaggcaggggcaaggtgaggcgaggaggggaggggcggggtgggtggggatcgaggtgaggcgaggcgaggcgaggcatcaagcagtatttttctctctgtgtctggcttgggtatttaatttaaaatgccttggggagctgatctcttcccttctctctgtccttttcctctctcttcctcatcgccttcttccctccatctgctccccatgttctccctccccctgcagcatcacggccacagcagccagtgttggggctgctggcatcccccaggcgggtctggtcaccatggtcattgtgcttacgtcggtcggcttgcccacggaagacatcacgctcatcattgccgtggactggttcctgtgagtgttctctaggctggaccctggtgctcctgcttctgcacacactgctttcccctgcaacgtcctcgacctgtggacttttattccagcaaagatgcagtggtccagaattttcaagtgaaaaggaggccttggagaggcctccaatccatggcctctggaccccaaatcccacagttatctttgggaagtagggttggagacaagcaatgggggctttacctatcaggcagaaaaactcctcttttacctgttttatgtagaagtcaccaaaaggtgatccaggccgggtgcggtgtctctactaaaaatacaaacaaacaaaaaacaaaattagctgggcgtggtggcacgtgcctgtaatcccagctgctcaggaggctgaggtgggagaatcgcttgaacctgggaggtggaggtagcagtgagatgagattgcctgctgggttcacgccattctcctgcctcagcctcccaagtagctgggattacaggcgcccaccaccatgcctggctaattttttggttttttgtattttcagtagagatggggtttcaccatgttagccaggatggtctcgatctcctgacctcgtgatccacctgcctcggcctcccaaagtgctgggatttgttattttttttttttgagattacgttttgctgtgttgcccaggctggccttgaactccttagcttaagcaatcctcttgcttcagcctcccaagtagttgggactacaggtgtgagctgctactcccagctgcaaatatatatttaaatctcaatttttaaaaacaggaggtttacgggtaggacacagtgacatgtgcctgtaatcccagcactttgggaggccaaagcaggtggactgcttgagttcaggagttcaagaccagcctgggcaacatggcaagtcccatctctacaaaaatacaaaaattagctgggtgtggtggcgcacctgtagtcccagctgcttgggaggctgaggtgggaggaactcttgaacctgggaggttgaggctgcagtgagtcaagatcacatgactgtactccagcctgtgtgacagagcaacactctgtttcaaaaacacaaaaacaggccgggtgtggtggctcacgcctgtaatcccagcactttgggaggccgaggtgggcagatcacctgaggtcaggagttcaagaccagcctggccaacatggtgaaaccccatctctactaaaaatatcaaaaattagccgggcctagtggtgggcgcctataatctcagctactcaggaggctgagacaggagaatcgcttgaacctgggaggtggaggttgcagtgagccgagatcgcaccactgcactccagcctgggcaacaggagtgaaacaccatctcaaaaaacaaaaacaaaaacaaaaaccagcaacaacaacaaaaccaggaggtttacattaaaggaagcctggactttcattcccacatgggagctgtcagctgagcctgagttccaattttataatcttcagcctgccctagtctacacctgtattgactcaggcctgccctggtttaccattccggattctatgtgcttttcagttcataacccttaattgtctgcatgagatgttcatttttttcttttctttctttttctttctttttttttttttttttttttgagacagagtcttgctctgtcacccaagctggagtgcagtggctcgatctcagctcactgcaacctctgcctcccaggttcaagtgattctcctgcctcagcctcccgagtagctgggattactactgggcatgccaccatgcccagctaatttttttttttttttttttttttgtatttttagtagagacagggtttcactatgttggtcaggccggtctccaactcctgaccttgtgatccgcccgccttgtgctgggattataagcatgagccaccacgccctgcctcattttcttttttttgagagacagggtcttgttctgtcatctaggctggagtggagtggcatgatcatagctcactgcagccttgacgttctgggctcaagtgaccctgccatctcagcctcccaagtagctgggactacaggcacatgctaccatcccaggctgtgttttaaagttattctatgtagagacggggtcttgctatgttgcccaggctggtcttgaactcctggtctcaagcaattcttctgcctgtcagcctcccaaagtgctgggatcatatctttttaatgatatgatcttttttctgtaaaccacacccagcctcattttttaaaaaatatcacatctaagatcaaacatgaacatctcagacctggtccatcctgtttgttagtaggagaaacagggcagagagggggaagaacctgcttggggacatgtggtcatggattgtactgcaatgggagccctctgactccctggcacagggacccccctctgctgcaccctctttctgtgaagcttttcaagcccccattaatggcagcttctttctcccctgtaccagtgaccggcttcgcacaatgaccaacgtactgggggactcaattggagcggccgtcatcgagcacttgtctcagcgggagctggagcttcaggaagctgagcttaccctccccagcctggggaaaccctacaagtccctcatggcacaggagaagggggcatcccggggacggggaggcaacgagagtgctatgtgaggggcctccagctctgcccccccagagaggagggaagggggctggggaggggagtcctggtgacacatctgttgcccaactgaccgtgggctgaacacacgttctgcttgactcatttaggggggagggaaaagtgaaataaaggagcaggaatgaaaggtatataaggtctctgtttctctctgagcatatgctgagggcttgaaggacggcgtgagcaagggaggggaagaaacgtttctcctaggtttggggagaagggaagcttcagcttcaacaagaagagtggtcaactcatgtttctcacattctcaaagagtggcggaagaagaaggtaaagaaaaaccattatttctcctgataaaacaatatccatggtctctgtgtcaggggtcccccaagaccacctttaggttcagcaattcactagaaaggcccatagaattcagggttgggcgtggtggctcccgcctgtaatcccagcactttggaaggctgaggcgggcagatcatgaggtcaggagatcgagaccagcctggccaacatggggaaacccagtctctactaaaatacaaaaaattagccaggcgtggtggcaggcgcctgtagtctcagctactcaggaggctgaggcaggagaatcacttgaacccgggaggcggaggttgcagtgagctgagattggcgccactgcactccagcctggtaacagagtgagactctgtttcaaaaaaaaggaaagactcatagaattcaagacaggcgtggtgattcacacctacaatcccagcactttcagaggccaaggcaggaggattgcttgagtccaggagtttgaaaccagtctcaaaaaataataataataataaaataaaataaaaagactcgtagaactcagaaaagctatcatactcacagttatggtttattacagtgaagggtaaagattaaaatcagcaaaagcaaaggtgcatgggacagagtccaggagagaccagatgtgagttttcagttcagtagaaatgcccctcgcagggccgttttcagttcagtagaaagcaattatatctcccagtaatgagatatatatatatatatacacacacacacacacacacacaagtatatatatacacgtatatatatacacacgtatatatacacacacacatatatatatacactatatatacacgtatatatatacacacgtgtatatatatatacacacacgtgtatatatatatatatatatatgtatatatatatatatatatatattttttttttttcagacagagtctctttctgtcacccaggcttgagtacagtggcaagatctcggctcactgcaaccttcacctctcaggttcaagcaattctcctgcctcagtctccagagtagctgagattataggtgcccaccaccacgcctggctaatttttgtatttgtagtagagacgggagttttgccatgttggtcaggctggtctcaaactcctgacctcaagtgatccgcaggccctggcctcccaaagtgctgggattacgggcggatcacctgaggtcaggagttcgagaccagcctggccaacatggtgaaaccctgtctctactgaaaatacaaaaatgagccgggtgtggtggtggccacctgtaatcccagctactcaggaggctgagacaggaagaatcgcttgaacccaggaggtggaggttgcagtgggctgagattgcgccactgcactcctgcctgagctacagagccagaccccatctcaaaaaaaaaagataaataaatcaaacagaacaacaacaacaataaaaaaccacttttggactgttttgtaataacgggtagcttaaataaattgtacagctgtacaaaaatgttttttctttatattcttattctatatggtttttttttctgtttaaaaaatttgtaacatacgcattatcctaggcctacacagggtcaggatcatcagtattactgtcttctaccttcacatcttgtcccactggaaggtcttcaggggcaataccacgcacggagttgccatctcctgtattaacaatgccttcttttagaatatcttctgaaggacatgcttg

SEQ ID NO: 16251 - DNA, 8105 bp, Human
ggactgaggcaggattcggttctggctccagggctatgctccttccacttcctccctcacaatctttggctcctctttcgtcacagcacttgctgtgtgtgtgtgtgagtgtgtgtgtgtgagagagagagagagagagagatttaatattcatttctgtcacagactagagctacagaaggacagaaagtcagggagcatgtctgtcttacttaatggattctaagtgcataacacataatagatacccagaaaatatttgctgggtaggtgggtgggtgggtggatggattgatggatggatggatggatgggtgggtgggtagatggataagtaaataggtggatggatagatggaagatagagatgatggatgaaggaatggatagaaggagggctagatggagggatagttggaagatagaatagatggagggatggaagacagagagagataatggatgaatggatggatggatggatgaatgaatgagtggttggatgaataagtggatggatagatagatggatgggtagataaatgggttgatggaagaatgaatgggtatatgggatgactgattaatagatgggtagacagacggatgaatagatgtgtgagtgggtggatggatggatggatgagtggatagataggtaagtggaaagataaattggtggatgggttgatgaataaaaggatggatgttaaattggattgatggatgactagatagatgtgcgggtggaaggatgggtggatgggatgactgattaatagataagtagatggacagatgaatagatggaagggtgagtgggtgaatggatggatagatgatgaattaatggatagatggtagatggatagatgaatgaattgatgggtgactggatagatagatggataaaaacatagatgaatggatggttgatgggggaaggcatagcagatattatgccaccaaaattgtcagagaaggatctagatagaaaaaaaaaaagcattcccggtggggtgcagtggctcacatctataatcccagcactttgggaggctgaggtgggcagatcatgaggtcaggagatcaagaccatcctggctaacacagtgaaatcccgtctctactaaaaatacaataaaattagccaggcatggtggcgcatacctgtagtcccagctactcgggaggctgaggcaggatcatcacttgaacccaggaggcagaggttgcagtgagccgagatcatgccactgcaccccagacagcctgggtgacacagtgagattctgtctcaaaaaaaaaaaaaaaaaaagcaaaaagcattccctactgaggagaaagtgtaggaaaaggcaaagagatggggaaatgccaagagtatgacaaaagtctgtctgtgcagccagagaagagaacaggactcagagatgagaatggagaatgtggacagacattcagactcaaggaagagcaagggaggtggattgaccccttcgtattggagacccagtgagataatatcaaagttgcattccccacttcgatgacattctccttttaaacactcctccaaggcatctctttgagatggcttccccagcccgtcatctcctaggtagaagaggcaaacacatgggtcacttgccctgctcctcattccagggctttcaggggaagttcagtccaccagaagctggtgaatgacccacgggagacacaggaagtttttgggggtggggtgggggacattgtggggtaggctcagcagttctgaagaagacatccagaaatggaagacatcgtgaaattgtcattctaggggtgatatattactacttcatggattatcatctattgcccagatctgtccacagaccaaatccccaccacttgagtgctatttggtctcaaaaatccagatacataagccagtttgtcccctgagcccctcggcctccctttagagaactttaacctatcttctcttgactccaaggatcagacaagggtgctgagagccgggactcacaaccaaaggagaaatgagcaatccgcggtctttggaagaggtaggctgggtgcaggttgaggggagggtgatcatctggggagaaggaaggtgaggattttaatgttttggaaagagtggagggactgaaaaaatcatgatctgaactcagagctaggaggtactttgtagtcaatcaaacagcaaaaaaagactcagagatggaaccgaagttgggttgggtggtgggggcagtcaaacacagctacctctgtctccaaagatcaagttcttctcaacacattaaaggttctgagaagtcctgcaataaacaatttcatgttgattttttaaaagatgaagttcttaccactggggtgctcagtacgctgcttctgttctggaaagaactgttgacccccaatattcttcttcctcagacgggatctcagtattagcttcagaaactctgagacctctgcaagtgaggaggtaatagaggaatgctcagaacactcttggggaggatgaggagacctgcaaatccacaaaatacgacaactggaagggatcttcaaaatcacacacacactcattgtctatatttggaaactgaggctcagatgggagcagtgacttcccccaagttcataccaagctagaaaagagctggaccccaggttgggttgctgtatttgggaactaaaaataaaggacacccaattcaatttgaatttcacatcaacaacaaataattatgtagtataagtatatcccatgcaatatttgggatatacttatactaaaaaggtatttggtttttatttgaaatttaagtgtacctgagcatcttctattatacctggcaaccctaagcccaagcctctcttgttttgtttgttcatttttgagacagggtctcacttattgcccaggctggagtgcagtgacaagatcatagttcactgcagcctcaacttcccaggctcaagctatcctcccacttcagcctccaaagtagctgggaccacagatgcacagcagcacacccagctatatttttcattttttgtagagacagagtctcactatgttgcccaggctggtctcgaactcttgggctcaagcaatcctcccacctcggcctcccaaagtgctgggatcacaggcatgagccaccacacccagcctgcatgcctcttttgactacatctgcttctccttgaacctctccatgctgatttctgtcttctcttggccccaggagaaatatgatatgtcaggtgcccgcctggccctaatactgtgtgtcaccaaagcccgggaaggttccgaagaagacctggatgctctggaacacatgtttcggcagctgagattcgaaagcaccatgaaaagagaccccactgccgaggtattggggtgcctactccaggcctgtttgggggaaaggtactaggttggaagtgtaggctatggggacccagctgagtctggttcttcctctcactccagcaattccaggaagagctggaaaaattccagcaggccatcgattcccgggaagatcccgtcagttgtgccttcgtggtactcatggctcacgggagggaaggcttcctcaagggagaagatggggagatggtcaagctggagaatctcttcgaggccctgaacaacaagaactgccaggccctgcgagctaagcccaaggtgtacatcatacaggcctgtcgaggaggtggggacagatccaagagcacagagtctgtggtttgttgtttctgttttgttttttgagacagcacccaggctggaatgcagtggcggaatctcaactcactgcaatctccatctcccaggctccagccgtcctcctgcctcagcctcctgagtagctgagactacaggctcccgccactatgtcaggctaatttttgtagacagggtctgattatgttgcccaggctggtctcaaactcctgagctcaagcaatcctcctgcctcagcctcccaccatgcccaaccaagtctgtgtttttatccaagccagtcccagatccaaagccccagctgaagccaggcaccatggctcatgcctgtaattccagtactttgggaggcccaggcgggaagattttttgaggccaggagttcaagactagcgtcgagcaatgtaacaagaacccagctctatgaaaaatattaaagattagccaagggcatggtggcatgggcctgtggtcctagctactcaggaggctgaagtaggaggatcacttgagcccaggagttaagaggctgcagtgagctatgattacaccattgcactccagcctgggcaacaaagcaagcccctgtctctaaaaagttaaattaaattaaaaagccccactgcacatggcataccacaaaagcatcctttcttttttttttttttttagacggagtcttgctctgtcacccaggctggagtgcgatggcacaatcttggctcactgcaacccccacctcccaggttcaagcaattcttctgcctcagcctcccaagtagctgggattacaggtgcacgccaccatgcctggctaatttttgtatttttagtagagatgggatttgaccatgttggtcaggctggtctcaaactcctgacctcaggtgatctgccctcctcagcctcccaaagtgctgggattacaggtgtgagccaccgtgcccagcccttacctttctttttaagaggcgacatctcgctctgtctcccaggctagagtgtagtggtgcaatcatggctcactgcagcctcaagctcccaggttcaagtgatcctcctgcttcagccccccaaaacactgggaatacaggtgtgagccaccctgcccagcccctttccttacctttctctctgactttgcctcctcctcttcttgttgtttcagaacaaagggaccccggtgaaacagtaggtggagatgagattgtgatggtcatcaaagacagcccacaaaccatcccaacatacacagatgccttgcacgtttattccacggtagagggtatgagctcccagctggcccagggatccctctgctcttccccctctcctgccactcccaactcctgaacctctcctccaggacccacgcccttccaggatcccctctacctaccctctgaagctcccccgaacccacctctctggaattcccaggatacatcgcctaccgacatgatcagaaaggctcatgctttatccagaccctggtggatgtgttcacgaagaggaaaggacatatcttggaacttctgacagaggtgagttgacaaaaggtagctgggaccaccgcccaggccaagaagggtgcaggcggagggggctgagcctcctcctaacccctctccatttccctcagctccaaatccaagccagatctcaatacagaaactaagaagcccactttccaacaactttcccaaatgcagggactcttaaaagccacagtatgggagataaatttctataaacaaatcccccttggatataaacaatgtttgggcaaactgttttcttttaatgtttatatgtttttattgcaaattatttaaaaaatgcccagccaaggattccatacaaactatggtataggaggaggccacaacggtctctcatcttaggacaagaatacccacctgccccgttccctaaccctccccccataagtccatgacactgactcctccaagctcaccacacctgttgctgcaggtgacccggcggatggcagaagcagagctggttcaagaaggaaaagcaaggaaaacgaaccctgaaatccaaagcaccctccggaaacggctgtatctgcagtagaagtagaaagaccaggaggagctttccttccagcattctttctgtctcacagaaatttagaggcagctcttacctctccccaagatcttctgttcctaaggccaaatggcacccagtttcttttccatcacacccttcatgcaggtcctcctgtccttattagagcaagccagccaaaacttagcacaaggcatggtggcaacattaacatcacctccctcaggctggactttctatctttattaatgcaaccgaagagacctaagagtgcattcacttatcccactttctgttcctgtggtcttctttctcccatgaagcagaaactggataaagctcaagattttccatagacaaaccaaagcccactcatcccctcctaccccaatccaacctctgctggctcctgcatctcacttggaggtcaaacctcctcctgaggccaatgcattcccaacttccagttctttcctttaccctggagagttagtaaggtaagaaccattctttctctccaaaaccactcctccttggctggcaagttggtgtcctaactccgttctcttcctagctcatggcctctctagataataaagttgtctcctcctttctggatctcttcctcctaacacccctcccctgaaaccctggactctgccctctctccaagaaaatccatctattcaactattcttgcattcaattactctaaatgagagcgtgttggagctatggcaaattccctgttgtcaccttgctattttgcagacaacataatatttaacctctcataaccagagaggttaaataatttgtcaaatgcaatacagtaagacagaggcaaggacaaggtttgacttccagcccagcctcttttccacaacctgctaaatcctgatccatctgaaaacttttctaattagtgaagatgactaataaaaattttccctatctccaaggtaggagctttctggaagtttctagaaattttcaataaccaccagccaaggttacctccaggtaaccttgcagcaccaggctggaagtcagatcggcttcactatcttccaactctacagcctgtatctctccatccccagctttgacctttcctgctcaagtaacctacgggcacatccagcgtcactaaaaactcagggcttttcttcccggttactcctccaagcgttccctggtatcctcaacctcagatcccaggttcagatttctgcagtcaatctatgacccctctcttcttgcatccttcatatgccaccagacaccatgcccagtccagcctgattttgaaacaactttcatgccggtcttctcttccctgacatgttactgtccaggctcaagtcctcagcttctcatatctgcatctttgcaaccaacttcctcccttgcctctctgcttttccatcccacttttcatgtgtcctccataccatctataacagtgatctccctggaacactcaagaagacacaacataccatattatttaaagaccagggtactggacagtggctcacacctgtattcccgactttgagagtctgaagcgggaggatcacttgaggccaggagttaagagaccagcctgggcaacacagcaagaccctgtctctaaaaaaaaaaattaattaactgggtatggtggcacatgcctgtagtcccagctactcaggaggctgaggtgggaggatgacttgagcccaggagtttgaggctgcaaggagctatgatcatgccagtgcatcccagctctaggtgagacagtgagatccggtctccaaaataaatcaatcaatcaaataaagaccaaagtcaaaccgcacatcaggatctctcacacccttccaattttgccatctaccagcacttagctaaacccatctcccatctcttccaccatgaattcactctttcaaaaaggctaatgtcttcttactcacccttgcctctaagcctttgctatcaccatttcccccaagctggagggccctccctctccctttacccctcttccactacctcccacccctactttttccagaaagccatttcctctcttttttctgattgatccttccctctcacccaggattagatgctggaaatgaccacttctggagggcagggaacaagcccttaatctgcataatgagtgttcaataaacagttgtcaaactttgaaagaaagtgttgaaat

SEQ ID NO: 16252 - DNA, 46940 bp, Human
  misc_feature (1)...(46940): n = A,T,C or G
ggaggatcccttgagccctgaagtttgaggctgcagtgagctgtgatggtgaccctgcactccagcctgggtgacagagtaagatctcttaaaaatatatatagcgttttaaaaaatgattacgtacctcaagagacaagctaatcatatgatttatccagaaaggaaagaaccctcctatcacatgattctctgttgattaacgaagtgcccaggggcctctgaaatataagtttcccacaggaggaaactggcttagaaagaccagaaagatccggggggtctgctctgtgcggtgaagcttctcttcttggcacctgcctggcatcggaagagggccccttctccctccctgggcttttatgtggacactgtaatgcctcagttttctttctttctttttgtttttgacacagggtctcactctatcacccaagctggagtgcagtggcaccatcttagctcaccgcagcctcaaactccccagctcgggtgattcttcctgcctcagcctcctgagtagtagcagctgggaccacagacgtctgccaccaagcccaggtaattttttttctttttgaagaaacagagctttgccatgttgcccaggctggtctcaaactcctgagctcaagcgatcctcctgcctcggcctcccagagtgctgggatcacaggtgtggagaaataggaacgcttttacactgttggtgggaatgtaaattagttcaaccattgtggaagatagtgtggtgatttctcaaggatccagaactagaaataccatttgactcagcgatcccattgctgggtatatacccaaaggattataaatcatgctactataaagacatatgcacatgtatgtttattgcggtactattcacaatagcaaagacctggaatcaacccaaatgtccatcaatgatagactggattaagaaagtgtggcacatatacaccagggaatactatgcagctataaaaaaggatgagttcatgtcctttgcagggacacagatgaagctgaaaaccatcattctcagcaaactaacacagaaacagaaaaccaaacaccacatgttctcactcataggtgggaactgaacaatgagaacacctggacacagggcgggaaacatcacacactggggcctgtcggggggtgggggcctgggggagggattgcattaggagaaatacctaatgtaaatgacgagttgataggtgcagcaagccaacatggcacatgtatgcctatgtatcaaacctgctcgttgtgcacatgtaccctagaacttaaagtctaaaaaatttaattaattaattaattaattaatttaaaaagaaagaaagaaaccgagcttcgccatgttgcccaggctggtctcaaactcctgagctcaagcgatcctcctgcctcgccctcccagagtgctgggatcacaggcgtgagcctctgtacctggcctcagtttcctcatctggaaaacagcaggggaagatactgccagctgggacgcaggctctgccaactctggcatgccaaagctctgggcacagggtgagccctaccgaagtgggagcccagagctatttctgacaaggcccctgcgtgcctgcccagggaagagccaagtggccccaggcgagaccgccccgcccggctgccacaccttcccctgcacagcagccagcctggaacacacagaggccagagggttggtcagagccacatggtggaaactccagcagagggatttttaaagcaggttgcacttcattcttgctgagcgagtacacgtgtgtgtgtgtgtgtgtgtgtgtgtgtgtgtgtgtgtgtgtgtgtgcagcgcccctggttctgtgtttttattgtgctttcctgctggcttccagctgcaccgccagttccggggagggccctgggccagcggctgtccgccccccctcctttataaagtcctggcctcgggacagcccgcacagctgcccagcctgcggagacgggacagccctgtcccactcactctttcccctgctgctcctgccggcagctcagctggaaccatgggaggccgcgtctttctcgtctttctcggtaagtactttggggccccgctgggggtggtagcgaggaagctccagcgggaccccttggatgcgtctgagaaacgggaggcgccgctggtgtctgtggggccggcgatggagaaagccacatggtcaagcaggcactcacgggcacacggcgagaggggctggtggtgcttgggcacccccacaccccggcaggaactccagggtgctctcggagcctgctaccctgcccggagggatcctcaagctttctactggagccagtttggcatctgctccataagaggggaaactgaggcacgggggaaggaaaggggcaaaaagtgagtgctaggaccccagagccactgctcttaatatagcgcatagaaagacatgggcggggggcggggaaaatagaggccaggacttctccactgcagggtacccccagcttctcccttctttctctctctctctctgtctttctccttctgtctctctttcagtctctctatctccctaatctccgttttctctctacctctgcctctttgtctctctctctggtgaacaacaaggagatccctaggtccccatccctaaagcccctggtgacctgaggagggtcccccaggacatgccttggaaaggggaacttcctgagcgctgggaaccgcagctccacatgcaccccaacaggcggccacagcgttttcctgtgggaggggcgcccggggtgaaatatcaccactgggtttcaggatgggccgccggggctggcggcggttgtggtgtgtgtgcacctgtgtccctgaggaagcatgcgggtccagggcatcttagagcctgggggatccagcgccatcatttttttttttttttttctgaggcggagccttgctctgtcgcccaggctggagtgcagtggcacgatctcagcttgctgcaacctccgcctcctgggttcaagcgattctcctgcctcaatctcccaagtagttgggtaacaggagtctgccaccacgcccagctaatgttttgtatttttagtagagacggggtttcaccatattgggcaggctggtctcgaactcccgacctcagatgatctgcccaccttggcctcccaaagtgctgggattacagtcccgagccaccgtgcctgaccatgccttcatttttatctaaagaaatgaagatggcagtaaatgctcaggcacaccagacagcccccaagtcagaagagcggcagctggagctgagacccccaccaggctcatggccctttcctactcctcagttccttaaaccccacccccaagccaagctagggaggctgaggcaggaggatcgcttgaggccaggagttcaagatcagcctgggcaacagagcaagactctgtctctaaaataactttttaaattatttttaatttttttggccaggcgtgatggctcatgcctgtaatcccagcactttgagaggccaaggcgggcagatcacctgaggttaggagttcaagaccagcctggccaacatggtgaaaccccatctctacttaagaaatacaaaaattagctgggcatggtgggtcatgcctgtagtcccagccactcaagaggctgaggcaggagaaccgcttgaacccaggaggtggagattgcagtgagccaagattgcaccactgcattccagcctgggcaacaaagggagactccatctcaaaaaaaaataaataataaaaataaataaatcattttaaaatttttgagctgggagccgtggctcacacctgtaatcctagcactttgggaggccaaggccggcagatcacctgaggtcaggagttcgagaccagcctggccaatatggtgaaaccccatctcactaaaaatacaaaaaattagccaggcaccatggtgggtgcctgtagtcccagctatttgggaggttgaggcaggagaattgcttgaacccaggaggtagagattgcaattagccgagatcgcaccattgcacttcagcctgggcgacagagcaagaccctgtctcaaaaagaaagaaagaaaatttaaaatatggcggtactcacctgtggtcccagctactcgggagggtgaggcagggggatcgcttgagcctaggaattggaggctgcagtgagctataatcgcatcactgcaccccagcctgggtgacccagagagaccctgtgtcaaacaaaacaaaacaaaacccacccccatgaggacagggtgacagactctctggctttgagcatccgagtgggacgtgacatctgctcactctgtttgaacgatgggcaggatctgagcctgagaggggtcagcatcctcctcccacaaagtgcatcacccttacgcctcctttcccaccctgggatcccctctgaccccctttcctttctctgttgcagcattctgtgtctggctgactctgccgggagctgaaacccaggactccaggggtgagtctgctgggaagcagaaagcacagtccacagccagagcctggggagggtcctggacccccgcccagcccccttcagcccagggaaagagagggctcgtgcacgggaaactcagcgctctgccccatctcccccagtgccccctttttgtgtattcccttacccctcaccttctgaccgtgctccctgctcttgcaggctgtgcccggtggtgccctcaggactcctcgtgtgtcaatgccaccgcctgtcgctgcaatccagggttcagctctttttctgagatcatcaccacccccatggagacttgtgacggtacagaggcttgagggcagcgcaggggacatctgcgattatgaggcatagcccagtgccagtgggggacagaggttgttgtgaggggccacagccttaccttccagactatcatcatggccagagaaaagagaaagagggcaggtgtggtggctcccagcactttgggaggcagaggcgggtggatcatttgaggccaggaattcaagaccagcctgggcaacatggtgagaccctgtctctacaaaaaatacacaaaatagccgcgcatggtggcacacatctggagtcccagctactcagaagactgaggcgggaggattgtttgagcccaggagtttgaggttgcagtgagctatgattgcaccattgcactctagcctgggcaacagagtgagatcctgtctcaggaaaaagaaagaaacaaagaaagaggccaggtgtggtggctcatgcctgtaatcccagcactttgggagggattgtctgggcaacaggagcaagaccccatctcaaaaaaaaaaaaaaaagacagaaagagagaaggagagaaagaaaagagaagaaaagaaaaagagagagagggagggagggaaagaaaaaggaaaggagggagggagggagggaggaaagaaggaaggaaggaagggaggaaaaaggaaaaaatatgaagggggagaagtaagaagtgaataggcatggcttcctggagagagagaagctgcgtgctcaggaatctggagtctgtgcctcagtttaccgttaagactgggaagggggtacattctggccataggtttttttttctcccttatttttcttttttctttttttttttgttttttttttttttttttgagatggagtctcactctgtcgctcaggctgaggagtgcagtggcgcgatctcggctcaccgcaacctccacctcccaggttcaagcgattcttctgcctcagcctcccgagtagctgggattacaggcatgcaccaccatgcccggctagtttttgtatttttagtagagatggggttttgccctgttggcaggctggtctcgaactcctgacctcaagtgatctgccggcctcggcctcccaaagtgctgggattacaggtatgagccactgcacccggctgccatggggtttaaatttctacaaaaagactggggatggggatatggcgcttcctgtccatcccccacctcagcactgtccactgtgtccaaatctaggatgccagccagagaactgagatcaagtgtggtcttcaggaatggcctgctccagctgcagcatagcctgtgcagtgcaacttgagatcctttccaaaagatactaagcagcaggccccatgttggggagtcaggacgggggtctctgccctgacggaactcacatctttgggagatgacctcctgtcctgttgtgttccagacatcaacgagtgtgcaacactgtcgaaagtgtcatgcggaaaattctcggactgctggaacacagaggggagctacgactgcgtgtgcagcccaggatatgagcctgtttctggggcaaaaacattcaagaatgagagcgagaacacgtgtcaaggtaagaaccaccccacatcctccatcaccactgtccatgaggtttggggtcaccagagctgtttctgcagcatccagggagcaggtacccaagtataggttcagttcctggagtctgagatgagacaggtgtgcatgtacctgtttcgccagcccagagaggcagcgtggtgtgaaggccaagggaaaactctgggaccagctacctgggcccaaatcctggctttgccacctgttacctaaatgatattaccaacatcactactgctcttagagccttggtttacccatctataaaatgaggatgataataatggcctactcctatgccttctaggaggaccaaggaaagaataggtgcttctaacagagcccagcacacagcaggtgctacaggcatcttcattctttaaacgttattatgcactgtaatcccagcactttgggaggccgaggcggatggatcacggggtcaggagatcgagactatcctggccaacatggtgaaaccctgtctctactaaaagtacgaaaattagccgggtgcagtggtgggtgcctgtaatcccagctactcaggaggctgaggcaggagaatcacttgaaccagggagtcggaggtttcagtgagcggagatcgtgccactgcactccagcctggtgacagtgcaagactccatctaaaataaataaataaataaataaataaataaataaataagcaatggatgccttttaggagttgttcagacaagctgggctcctgtggggccacactcctggctggcactcagaagaaatctatttcgacacagcctgcctcatcccttgccatggtcttattccacactgcagctccagcccatgagaagccaggcccccatgcatcactctgctttgccttctttccagtgggaactagttgggtgcgggagggagcttcagacatctgcaaggccagatgggaaccagtagcaggtggacagagaagggagattaacacagagtacacagagtgggaagggaaggtgagcaaaggcaggaaatgaagaagctgaggctgagccaagggtcccaggggacattaagggggttcagcagacctgccctgctgtaaagagaaaagtggcagtgctcctgttcccagccctgtccctcctgttctccctgcagtcagtagagcctccctggtgggaggaaagtgaggacagagcagaggtgtacgttctgagagcacgcagctgcatagagcccagcaggggggctggttcacaggggtcccctgtgaacagatgctacattgcatgcacatatcttgaccaaaggacagagccttcctgtgaattagaaaaaggactctccgggccaggcacagtggctcacgcctgtaatcccagcactttgggaggctgaggcgggtggatcacctgaggtcaggagttcaagaccagcctgacaaacatagtgaaaccccatctctactaaaaaatacaaaagttagccaggcatagtggtgagcacctgtaatcccagctactcaggaggctgaggcaggagaatcacctgaacccagaggcagaggttgcagtgagccaggatctcaatattgcactccagcctgggtgacagagcaagactttgtctcaaaaaaaaaaaaaaaaaaaaaagaaaaagaaaagaaaagaaagaaacaaaaagaaaaagagaaacagaaaagcctctcctctccaggtagacacagccccatttggggaatggagaggttttcagcctctgctcaccgccttggctgggcatccatatgtagtcagcaacctacacaactgtacgtggtggtcatgggtccttgtcagtgagagcctctgttttagtctatgttgtgttgctataaaggaatacatgaggctggatcatgtataaagaaaagaagctgatttggctcatggttctgcaggccatgtaagacacatggctccagcatctgcttctggtgagggccttagggagcttccactcttggcagacgggaaaggggaagctggcatcccatggcaagaggaaggaagcaagagagaagggaggagataccaggctttttccaacaagcagttttcatgggaactaacaaggcgagaactcactcatgacccaaggacagcaccgagatgttcatgagggatctgcactcaggacccaaacacctcccacgaggctccatctccaacactggggatcacatttcaacgtgagatttggaggggacaaatatccaaactgtatcaccgcatgcacaggtggtgtttgtaattattgaggaggtgtgttgccatgttagaaacaggccagcactggctgggcgcagtggctcatgcctgtaatcctagcactttgggaggccgaggtgggcggatcacaaggtcaggagatcgagaccatcctggctaacatggtgaaaccccgtctctactacaaatacaaaaaaattagctgggcgtggtggtgggtgcctgtagtcccagctaatcagagactgaggcaggagaatggcatgaacctgggaggcggagcttgcagtaagccgagatggcaccactgcactccagcctggacgacagagcgagactccgtctccaaaaaaaagaaaagaaaaggagagaagagaagagagaaaagaaaagaggccaacactgagagagggggcttagttggtggataggcagagacacagatgagcaggaatgaagtgggagagggctctcatggaccccatccgcacagaacagcctgctagttcggagcaggacctgcctcttgaagcctcagctcagggaagggctccgtggggccctgtctgcatccccctcacccctcagcattcttgttttttttgtctacctggtgtcacaggcctcataggcaggagacctggggccactccctcagctccttgccccacttactccaggcatcacagggccgtcccaaacacctggtcacctgtcgctatccaaacctcaaggttcagaaccctccacagagggtcacttccaaaagctcagaacatccccctgcccatctggcatcttatttgtttgttttgttttgttttattagtaaagatggggggggggtgtctcaccatgttgtccaggctggtctcgaactcctggcctcaagtgatccgcccgtctcagcctcccaaagtgctgggattgcaggcgtgagccaccatgtccgacctggtatcttatttgtacaaaacaaaaagggggctggcactcaggatattcgatgagctcactgcgtggtgcattccagcgcagtatccattctctctgctatcatcagcgactgccaggatgagacagtctccacacagctctgctcacctggaactctctctgatcccccagctcatcatggacccaggcaccctgtccagaaatgaaggaggagggagatttgaaggcagggccactgtccccagtcgaacctgccactggccaacaaccccacctggagaagatgcctcgtggagccctgacctctttttctgccactcagtctctgtccctttcactgagcgagactgccctgacccttcctgatagttttggtccacctgagtgcactggaggatgttgtggctaacggtgggcacagtgacatggactccccatacttggagagttgagtgaatggaagaggcactagtgtggacccaatggcaagagaggttaacatcagggccattgctccaagcctgatcctctcccaggaggtcaacccagatcccatgggagtggaaccattcagaaataggtctgtgtccctggtggaatgccaagagatgagatgacagatacacctccatctttgcccatcagcatctgtgcccctctccagccactaaaccttcacccagggccagtctttctcagctatggattctcactacatcctgccatttccaagacaccttcctgaggatcaaaaaaaggcaccttcacagccctggggcaacccagctgtatgtcggtccccactgtccaccctggcctgggacccactgtccaggcagccctggcctatgcagcaccagactcatgctcccctggggactggttcaggggccagtcttggtccatgtgcctggagctgggctctcagagctagtgtggatgggagagcaccatcctgctagggccaccgggattctgataactcagccagtgagcagctgtcctggggaaatcaaggccaccagaagcagatgctggagccatgcatcttacacagcctgcagaaccatgagccaaataaacttcttttcttgcaacacaaaacggactaaaccagagggttctcactgagaaggacccatgaccaccatgtacagttgcataggctgctgactgcatatggatgcccagccaagagggtgagcagaagctgaaaacctgcctactctccattcctcaaatatgactgtgactacttgaagaggagatgcctttttccaattcacaggaaggctctgtcctttggcccaggactgccactgggaaccaagacaggtcctacctgggcaagcagcatgccccctgcacttggtcccaagaaaatcccaccctgacctttgtcctgaatcctcaggctgggacatccctgccccagctgggagctgcccagggaggcaggggagatggggaggactcagatgcttccagccatatctgaacaacagaaggcctgggccaccatgctcaccatgggacacctctgtgtggattagaaaagggaggagatggccaggcatggtggctcatgcctgcaatcccagcactttgggaggccgaggtgggctgatcacgaggtcaggagatcaagaccatcctggctaacacggtgaaaccccgtctaatactaaaaatacaaaaaattagccgggcatggtggcgggcgcctgtagtcccagctattcgggaggctgaggcaggagaatggcgtgaacccgggaggcggaggttgcagtgagttgagatcaggcaattgcactccagcctgggtgacagagcaagactccgtctcaaaaaaaaaaaaagaaagaaagaaaagaaaagggagcagacagtggtgccttccagatgcttccatgccaggaaacatggcggaccctcagccccgaaagctgctcacagctacgggcattcttcaccctctccttcctcttgcagatgtggacgaatgtcagcagaacccaaggctctgtaaaagctacggcacctgcgtcaacacccttggcagctatacctgccagtgcctgcctggcttcaagttcatacctgaggatccgaaggtctgcacaggtagaggccccaggaagacgctgtgaggctggacgggagctggggatggagctgagtcaggtcctccaaagcagccgaggaggagggagaagatccgcaggttcccacaaggtcaaggacctgctaagcccctgcctaaggattcacctcccaggaaggtctcgccacacggcagggaggcggcagggccttcagggcttggagtgcccttgtgggcccccagacctcaccccttcctcatctgtcacgtgcgagtggaagaaggtgtcacttccagttctaagaaggggaacctccaccatagtgagggagggagcaggagagagattttagtcagaaagtccagctcccatgactcagtttcccttttggtttcacctcctataaactggggaccatggtccctgctgtgcccatctggtaggaagaccatcataagatgctttgaaggtgaagttgaaggtcaccaagtggtggcacgtgcaataatggtcttcagtctgaggcaatgaaaagataggggagtgggtgcagtgagtggagggcaggcccaggctggtcagggacagggtttgaccctctggctttgtcctcagatgtgaatgaatgcacctccggacaaaacccatgccacagctccacccactgcctcaacaacgtgggcagctatcagtgccgctgccgcccgggctggcaaccgattccggggtcccccaatggcccaaacaataccgtctgtgaaggtcgagagctcagatcccacgttcccagagacccacaaacatctgatcacatgttcaacggcgcccacacaaaccaagcagaatgagcgctggaggcgcccgactgtgtcaggcgttcattcttctgaggctagatgagaaaagagcaagggtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaggtcaccaagtggtggcacgtgcaataatggtcttcagtctgaggcaatgaaaagataggggagtgggtgcagtgagtggagggcaggcccaggctggtcagggacagggtttgaccctctggctttgtcctcagatgtgaatgaatgcacctccggacaaaacccatgccacagctccacccactgcctcaacaacgtgggcagctatcagtgccgctgccgcccgggctggcaaccgattccggggtcccccaatggcccaaacaataccgtctgtgaaggtcgagagctcagatcccacgttcccagagacccacaaacatctgatcacatgttcaacggcgcccacacaaaccaagcagaatgagcgctggaggcgcccgactgtgtcaggcgttcattcttctgaggctagatgagaaaagagcaagggtcctgcggaaggagctggggtactgaggggggaggctcagggggaccccaggcaacagctgatgactcactgggaggaaggcgtttcaccatattcataacctgctcatctgcacggggcccacctgctgtgcccaggcctctccacgcttccataacccagcgtccacctctccaaggggggcactaatgccgggaggaacgagctgggggcacagacaggagacaggaccctctccaggctgggacaggacctgacccccttcttcctgtcctcagatgtggacgagtgcagctccgggcagcatcagtgtgacagctccaccgtctgcttcaacaccgtgggttcatacagctgccgctgccgcccaggctggaagcccagacacggaatcccgaataaccaaaaggacactgtctgtgaaggtatgacctggccctagaagctccccacccccagcacacacactgacacgctcccgcctaatgagccgcttgtcttgttccctacagatatgactttctccacctggaccccgccccctggagtccacagccaggtgagtggcccccacagggacgaggcggcgggaactccatccacacagcactgcatccgtctccttgttctaaacttcccacccgccgtccaggctctctgacccccacatctcctctctctgcagacgctttcccgattcttcgacaaagtccaggacctgggcagagactacaagccaggcttggccaataacaccatccaggtaaggacaggacccagggcaagggggcgaggcaggaaggtggctgcatcccacagaggcctggggcagtttgggtctgggaggggacaggacccaatgcagtgggtgctggtctgactcccagcatctttcagggctggtggaagctaatggacacccaagtgcacttaatatctttcctcttgctttccctggactttgggtttaggtcagcattgatattgcacagaagtgttggcctctgaggggccataaccagagtcaaggatcacctagggaatcccatccaatgtcattttttttttagacggagtctcactctgtcgccagtccagagtttagtggcccgatctcagctcactgcagtctctgcctcccgggttcaagcgattctcctccctcagccccctgagtagctaggattacaggcacacgccaccacgcccggctaatttttgtatttttagtagagacggggtttcaccatgttggccaggatggtctcgatctcctgaccttgtgacccaccctcatcggcctcccaaagtgctggaattagaggcgtgagccaccgcgcccagccgccaatgccatcttcatcccccagatagacagtctctaggatctgttccctggggctgagcggttggagtcttcatgcgggccctctggcccatggctcactaggtctgtgtccacatccctccagagcatcttacaggcgctggatgagctgctggaggcccctggggacctggagaccctgccccgcttacagcagcactgtgtggccagtcacctgctggatggcctagaggatgtcctcagaggcctgagcaagaacctttccaatgggctgttgaacttcagttatcctgcaggcacaggtaggtccctgggtctgccccagactccagctctgcatgttttatgtctccttcctttcccagtcccaccagagccaagtgaccacacctgtatatcagtgttactctcatcgacaaactaaaataagagattaaaaagaaatacataccagtctggacaagatggcaatactcaatctctacaaaaaaaaaatcttttaaattagacagatgtgatggcacaactgtggccccagctagttgggaggctgaggtgagaggatcgcttgagcccaggaggttgagtctgcagtgaactatgattgcatcactgtactccagcctggttcacagggcaagaccccatctcaaaaaagagaagacgaagaggaggaggaggaagaagaagaagaagagaaggaggaggaggtgaagaggaggaggaggataaagaggaagaaaaaggaggaagagggcaggagggggaggacagaaggaggaggacaggaggagaggaggggaggaggaagaggaggaaagaggatgggaggaggaggacaagaggaagaggacgggaggaggaggacaggatggggaggagaggaggaggagagaaggaggaggagaggaggaagaggaggaatggagaaagagaggaggaggagaaaaggaggaggagaggaggaggaggagaggagaaggaggaggaatggaggaggagaggaggcagaggaagataggaggaggagaaggagaagaggaggagaagagaaggaggagaggaggaggagacgagaaagagcggaggagaggaggagaggaggaggagcacaggaggaggaggagaggagtagaggaagaaggaagaatagaaagaaggaaaggaaaggaaaaagaaatgcataaataacatgcattttcattgtaatatgaattatcagcagtaaataattatgatgaagaatttaaaataacaaaatagaaatcacttcaaaagagaacaatttatttaatttggaatactataaattaatatcatttgatctctaagtatgatttctttcttgtttgtttttgtttgttttgttttgttttgttttgtttttttgagacagagtctcactctgtcgcccaggctggagagcagtgacgtgatctcggctcactgcaagctccgcctcctgggttgacagcattctcctgtctcagcctcccgagtagctgggactacaggtgcccgccaccacgcccagctaattttttgtatttttagtagagacggggttgcaccgtgttagccaggatggtctctcgatctcctgaccttgtgcataatccacttgcctcggcttcccaaagtgctgggattacaggcgtgagccaccacgcccggcctgcataataatttttaaagcatgaaaatgcatatagcattaattttattaagataaaattcacataacatcaagttcaccactttaaagtgtctgtttcacgtggggcgtgcctgtaatgccaggcgctcacacctgtaatcctagcactttgggaggctgaaatgggtggatcacttgaggtcaggagttcaaatccagcctggccaacatagtgaaaccccatctctactgaaaatacaaaaattagacaggcgtggtggtgcacacctgtaatcctagctactcaagaggctgaggcaggagaatcacttgagcttgggaggcagaggttgcagtgagccaagtttgcaccactgcactccagactacgtgagacagagtgccactccatctcaaacaaaaaaattaaaattaaaaataaaaataagaaaaaattttaaaagcgtgtgtttcggtagaatctagtatattcagaaagttatacaaccgtcacctctatttctaaaatgcttgcatcagcccaaaagtgaacactgcacatggtaagcaaccactcctcattcctcccttcctccaacccatggcagccgctaatctgctttctgtttccatggattttcctaatcaggatatctcacataaatggaatcatacaatatgtgaccatctagtctagctcctttcacctagcataatggttttgaggttcatgcatgccatagcatttatcaatatttcattctttttcatggctgaatactattctattgtatgaatacatcactttttttttttttatccatccatccattgatggacatttgggttgtttccaccttttggctgttgacaaaaagagtcaaactctgtaaaatatttgaagagatttattgtgagctaaatatgaatgtatgactgaccatggcccgtgacacagccctcaggagcccctgagaacatattcccaagtgaagtggtgttgttttctggggtaatacctgaggttcattgcctcatgccaagaaaattaaggacacagacacacaccaggagtgagtttatgagtggaggtttaataggcaaaagaaagagaaaggagaacaactctctctcttgtgagagaaaggaatgcccaaatgggacttcccacccatgccagagggcaccggattttatagacaggcttgaggaggcagtgtctaatttacatagggcccaaagattggttggaacaggtgtgacgtttacataaggtgcagggaagctggctgccccaccctaatcttattatgcaaatggagtcttcgccagctccttactgtatacgtggttggcaaagagatgggaagatggagccgccattttcaacatgcctagtcccaggtggccttttcctattggcacagctgccagcattcacctgtgcaggcttccagcttgcttgcctatgtctgcagctcgattttacaggctgctctttgttagaaaaaaaaaaaatgatataggggctgattttcattaaaaggaaagacttacccaggacttccttacccacactctctgcctaaataattcctttttaacttctatatcacaaggtagtcgtggtacagcttgttgtgattgttgttgttgttgtcttctgttggagacagagtcttgctctgtcaaccaggctggagtgcagtggtgcgatcctggctcactgtagactccacctcccgggttcaagcgattctcctgcctcagcctcccaagtagctgggactacaggcgcccgccaccacgcccggctaattattttgtgtgttttcagtaaagacagggtttcgccatgttaaccaggatggtcttgatgtcctgacctcgtgatccgcctgcctcggcctcccaaagtgctgggattacaggcgtgagacaccacgcctgcccccgcaacttggttttatacattttagggggacatgagacatcaatcaaatatgtttaagctatacattggttcagtccagaaatgcaggacaatttgaagtggaggtgtggggcgggtgcttccagattataggtagatttaagcttttctgattggcagttggttgaaggagttattatccatagaaaagaatgtctggaatacgataaggggctgtaaaggctgaagttgtatcatccagatgaactcttcaggtatcaggcttcagagagaatagatggtaaatgtttcttattaagcttcaggtctgtgttatgttaaatgctggtcagcttttcctcaactccaaaagggaggagggcatgacacatgtcagaccccccacttcccaccatagcctgaactagtctttccagttaaatttagagtgccctggccaaaaaggaagtccattcagatggttttgaggggggcgggagaggacttcgaattttttttttttgtttagatggctggtgtgaatagtgctcttatgaatattagtggacacattttgggttgaataactgtcttcagttctttggggtatatactaaggagtggaattgctgggtgatatggtaattctatgttcagcttttggaggaaccaccaaactttttccaaagcagctgcatcattctaattccccaccagaaacatacacgggttatcctctccacaccttcagcaaaacttgttacttccgttttcttttgttctgtttttaattgcttttattgatacataaatcttacatatttatgggtacatgtgatactttgttgcttgcctagaatgtgtaacgatcaagtcagggtatctcaggtatccaccactttgagtacttatcatttgtatgtgttgggaacaattgaagtcctcttttgtaactactttgaaatacatcatacagtcttgttaattatagtcactctgctctgctgtcaaacaatagaacttgggccgggcacggtggctcacgcctgtaatcccagcactttgggaggccgaggtgggaggatcacgaggtcaggagatcgacaccatcctggctaacagggtgaaaccccatctctactaaaaatacaaaaaattagccaggcgtggtggcgggtgcctgtagtcccagctactcgggagactgaggcaggagaatggcgtgaacctgggaggcgaagcttgcagtgagccaagatggtgccactgcactccagcctgggtgacagagtgagactccgtctcaaaaaaaaaaaaaaaaaaaaatctgcttaataagcggagaggtggctggcttggtggctcacacccgtaatcctagcactttgggaggtcaaggcaggcagatcacctgacatcaggagtttgagcccagcctggccaatatggtgaaaccctggctattaaaaatacaaaaattagctgggcttagtgacacgtgcctgtaatcccagctacctgggaagctgaggcaggagattcgctggaacccaggaggcagaggctgcagtgagctgagatcgtgccactgcactccagcctgggtgacagagtgagactccgtctaaaaaaaaaaaatatatatatatatatgtataacttatactttttgtctaactgtatgtctctacctgttaactcacctctcttcatcccagtgatacaggagtgaaaaagaaattatttaggcagttagcaagggtcagagagtcctcagtaaggtttcccttttaataaaaaccagcccccaaatcatttcttttctaataacgagcagcctgaaaattcgagctgcagacatagaaaagcaagctggaagcttgcacgggtgaatgccggcagctgtgccaataggaaaaggttacctgggggcccggcatgttcaacgtgggggctccctcttcctttatctttgtcaaccacgtgtacagtacagaagcaggcaacgtggagccagccaggtagagaatccatttgcataataaaagattaggctggggcagccagtttcttcatgctgtatgtaaatggctcacctgttcagaccaatctttaagccttatgtaaatcggacaccgcctacccaagctcatctataaaacttcgtgcatttcaccacgcaaccggaagacccacttgggagcccctgtctctctgcaggagagggagttattctctttttcctttttttttttttgagacggagtcgtgctgtgtcccgcagactgcagtgcaggggcgcgatctcggctcactgcaagctccgcctcccggggtcacgccattctcctgcctcagcctccggagtagctgggactacaggcgcccaccaccatgcccagctaatttttttgtatttttagtagagacggggtttcaccgtgttatccaggttggtctcgatctcctgacctcgtgatcctcccgcctcagcctcccaaagtgctgggattacaggcgtgagccactgcgcccagccagagctattctttttttctttcgcctattaaatctccactcttaaactaacttcttatgtgtccacatcctcaatttccctggtgtgaaacagtgaaacttgggtatttacaccacttcactagtgagatgatacctcattgtggttttgatttgcccttccctgataactaatgatgtttaacatcttttcatgtgtttgctcaccatttgcatgtcatttttggagaaatgtctattcaaatcctttgcctatttttaattgtgctgtttgtcttttggttgtccagttgtaagcattctttaaacattctgatagtagatcatctgagatgaatgatttgcaaaatattttctcccgttctgtagattgtcttttcattttcttgtcttttcactttaatgaatagaagttttaaatcttgaagacatttattttatctaatttttcttttgttgcatgtgcaattggtgtcatatttaagaattcattgacagggggtggtggctcacgcctgtaatcccagcactttggaaggccaatgtgggcggatcacctgaggtcaggagtttgagaccagcctggccaacaaggcgaaaccctgtccttactaaaaataaaaataaaaataattaaccagatgtgttggcacatgactgtaatcctagctactcaggaggctgaggcaggagaattgcttgaacctgggacacggaggttgcagtgagctgagattgtgccactacactccagcctggatgacagagcaagactctgtcccaaaaataaaaataaaaaaagaattcattaccgcatccaagaccaggaagatttacccctgtttcctcctaagtgttctagttttagcttctaagcttaggtcactggcttattttgagttaatttttgtttgttgtgtgagggtagggttaaaacttccttattttcatgttactatccagtaatcccagcactatttgttgaagagattattctttcccccattgtatagtcttggcaccccttgttgagaatcaactgaccataagatggatgggtttattcctggactctcaattctattctgttgtgtccttatgccagtattactgtcagtttgtagtaagttttggaatcaggaagtgtgaattctccaaccttcttgttcttcttcaagattgtttttgggtatttggattccttacaacaccatatgaattttaagatgaacttttcttattctgcaaagtaataataggctaaaatattgatagggattgcattgagtctctagaccactttgggggagtattgttatcttaacaatagaaagtcttccaatccatgaacataggctgtctttccatttagagagggccttttatttctttcaaacacttttgtaggccagaagcagtggctcacgcccaatattgtcagaggccaccaaggtgggagaattgcttgagcccaggagttcaagcccagccttggaaatatactgaaacatgatctccacaaaaaatttaaaaattagctggctgtggtagtgagcacctgtagtgccagctacttgggaggctgaggtggaaggattggttgagcccaggagactgcagtgagctatgatcatgccactgcactctagcctgaccaacaggtgagaatttgtctcaaaaaaaaaaaaatactcaaaaaactttcctataagtcttgagtctccttcgtaaaatgtattcctaacatttttgctgaaaatttttgcatctatgtccataagaaatattggtctataattttattttcttgtgatgtcttcatctggttttgttatcagagcaatattagcctcataaaattacttaaatagtgtttcctcctcttccatatttttaaaaaggtaaaagattcatgttcattctttcttaagctattggtagaactcaccagtgaagtcatctggtctgggctgttagttttgagaggttttgattactgatttaatctgttataggtctgttcagatcttctatttcttcttgagttggtttcagtggtttgtgtgtcactaggaatgtgtccatttcatctaggttacctactttgtagatatacagttgctcacactattctcttccgatattttgtaacttcagactatatatgtatatagtatatatattaagtcatagtatatcaaccactgcaggcacgattcctaacctaaccccccttatgtaattcccacaactcatagaattgtccctggaggtgcagaagcaagtagacaggagtgtcaccttgagacagaatcaggcagtgatgcagctcgactggaatcaggcacagaaatctggtgacccaggtaatggctgagatggggaggtggtcagtgaagcttcatggtgggaaaagatgcccaagaatgtgaaaaataagagatttaaagattaaagggaagtgtgggatgtttggagtggggctgtaagaggagagtccagctgaggaggaacggaccttgttggggaccctgagatattaaccgtggccttgtcctgcaggatgtgatacacatagaactaaagattgaaggaaagtgtgggaggggtgaagccaaaggaaggtagcccatctgagtagaaagttctgtgcagggcagaggaactctggtgtggacccagagattcaacctactccaagattcaaccttggcctcgccctgcaggcccttctgtggtgggccttgtctccattccagggatgggcaagttgctggctgaggcccctctggtcctggaacctgagaagcagatgcttctgcatgagacacaccagggcttgctgcaggacggctcccccatcctgctctcagatgtgatctctgcctttctgagcaacaacgacacccaaaacctcagctccccagttaccttcaccttctcccaccgtgtgagtgctggtggagttggttggtgggtgaatagtctgagtccgggcatagccttgctgctcagctcagccctggggctcaggggtctctgttatgggtacattatctccccaggaaagtcagtccttcccaagccggctttgggtaagcatttctgagcatccgacccaccagctcacacctgtgttcttttttttattgagacagagtctcgctgtgtcagccaggctggagtgcagtggcacgatctcagctcactgcagtctccgcctcccaggttcgagcgattctcctgcctcagcctccctaatagctgggactacaggtgtgtgctaccacgcccagctaatttttgtttttttgttttttttttttttttagtagagatggggtttcaccatgttggccaggctggtctcaaactcctgacctcaagtgatccacctgcttcagcctcccaaagtgctgggattacaggcgtgagccaccatgcccagcccacacctgtgttctgttcctgcagtcagtgatcccgagacagaaggtgctctgtgtcttctgggagcatggccagaatggatgtggtcactgggccaccacaggctgcagcacaataggcaccagagacaccagcaccatctgccgttgcacccacctgagcagctttgccgtcctcatggcccactacgatgtgcaggtgagacccttaggaggggatgcactctgcatttattgccgtgtaacaaatccccagagacatagcagccttttaaaaaaaatatatgcattatctcacagctctgggtcagcaagctggcatagcaagatggcttttctgctcagggtcttacaagactgaaatcatcatgtcaccccacccccagggctgccatttcatctgagacttgaggtccttctccaagctccctggttgctggcagaattcagtttcttgtgattgtaggactgaagtctcactttcttagctgtcaggaaggcatcacattcagttcctagaggccactcatatcccttctcacatgaccctctggcaaacttctagcattcctatctggaggacaaggaaaaaaatttcctcacgcagaatccctcttaagctttgtattagtcgaggttctctagagggacagaactaatggaatagatagatagatagatagatagatagatagatagatagatagatagatagatagatagataatttctgcctgcttatattctagccacactggcagctgattagatggtgcccacccagattaagagtggatctgcctttcccaacccactgactcaaatatatacatatatagagatatatagagagagatctatatatatagatatatataaaggggagtttattaggtattaactcacatgatcacaaggtcccacgataggccgtctgcaggctgaggagcaaggagagccagtccgagtcccagaactgaagaacttggagtctgatgttcaagggcaggaagcatccagcacgggagaaagatgtaggctgggaggctaggccagtctctcttttcacatttttctgcctgcttatattctagccacgctggcagctgattagacagtgcccacccagattaagagtggatctgcctttcccagtccactgactcaaatgttaatttcctttggcaacaccctgatagacacacccaggatcaatactttgtatccttcaatccaatcaagttgacacccagtattaaccgtcacaagttttgaatctgattctccaggaagagcccagagcttataaagactcatctgattaggtctggcccacccagggtaaactctgccttttttttttttttagacagggtctctgtcacccaggctggagtgcagtggcacagtcatagctcactgcagccttgaccttctgggttcaagggatcctcctgcctcagcctcctgagtagctgggactacaggcatgcaccaccatgcccggctaatttttgtatttttactagagatggggtttcaccaagttggccaggctggtctcgaactccttacctcaagtaatccacccgcctcggcctcccaaagtgctggtattacaggcaggaaccaccacacctcgcccacctgactttcttatctcatcacttagagtagatccaagggacatcatcatcatatcctgcgggagaaagggccaaaccacccttttgttttccatgacaggaacatcttatcaatatcctcccaggcagcaagccataccgcccagcccctcccgcccagacctgtaattaccccagcctgtaagcggcagtgggttctggcacgaagctagctcccccctccacaagtctcgtgctggacataaacctgcattgctgtagagctgccaactctctgtctttctttaactctcactttcccttcaaaacctaacgggcccacacctggaatctctgtgctttgggaggctgaaacgggaggatcacttgagcccaggaattcgagaccagcctgtgcaacacagaaagaccctgtctctacaaaaataaaaaaaaaaattaggacgggtgtggtggctcacgactgtaatcccagcactttgggaggccgaggcgggtggatcatgaggtcaggagttcaagaccagcctggccaacatggtgtgaccctgtctctactaaaagtataaaaattagcctggcatggaggcacatgcctgtaatcccaactacttgggaggctgagacacgagaatcgcttgaaccgaggagacagaggctgcagtgagcagagatcgcaccactgcactccagcctgggcgacagagcaagactgtcaaaaaaaaaaaattagcagggcatggtgccatacatgactataatgcacacccgttgtcacctacatgactacgcctgtattcctagccacccatgaggctcgggtgacaccttcgcaaattaaattaaattggtgacatcttcacaaatttacctggctccctcattcttgaatgtgctatgccaaagtaaaaattttaaatggtggtggggtcattaccccagagcaggaaagcatcactgtgaactcttcttttccgggtcccaggaggaggatcccgtgctgactgtcatcacctacatggggctgagcgtctctctgctgtgcctcctcctggcggccctcacttttctcctgtgtaaagccatccagaacaccagcacctcactgcatctgcagctctcgctctgcctcttcctggcccacctcctcttcctcgtggcaattgatcaaaccggacacaaggtattgacagcggtgttccagagggctcccttccttgacgcaggacacgctggctcatggaatgatgcggcatttgattccttaatataatagcccggctgggcgtggtggctcatgcctgtaatcccagcactttgggagactgaggtgggcggatcacctcaggtcgggagtttgagaccagcctgaccaacatggagaaaccccgtctctactaaaaatacaaaattagccaggcatggtggcgcatacctgtaatcccagttactcaggaggctgaggcaagagaatctcttgaacccaggaggtggaggttgtggtaagccgagatcgcaccattgcatgccagcctgggcaacaagagtgaaattccgtctcaaaaaaaaaaaaaaatatatatatatatatgtgtgtgtgtgtgtgtgtgtatacgtatatatacatgtatatatatatataggcccttgagtcctggggaatattagaagagaacaccaccaatttcccattgcctgactcaactacacagcaaatattctctataatgccatcaaatatctcagaattctccccaacaacttggtacaggagaagccatgggccacactcaaatctgatcgccgctctgggcgtcttttacttctccgccaggtgctgtgctccatcatcgccggtaccttgcactatctctacctggccaccttcacctggatgctgctggaggccctgtacctcttcctcactgcacggaacctgacggtggtcaactactcaagcatcaacagattcatgaagaagctcatgttccctgtgggctacggagtcccagctgtgacagtggccatttctgcagcctccaggcctcacctttatggaacaccttcccggttagtgcaaattctcacaatccttatcttctccggcataaccatggccattgctagaacctagatagcatttttatgacacctgcttttaattagatcagtagggattttaggctctattggttggattacactgcagctccttattcttagctattgagtttatttcaattacatttcaagctaggcattgtagaagagggttttcggaaattttctgaatgaaataaagggcaagcctttggaaagcacgaataggacaaagacactatgtcataatccctagggcatctttctgctagaagattataataattaaggagggtcaggctcagtggctcgcacctggaatccctgtgctttgggaggctgacacaggaggatcacttgagcccaggatcttgagaccagcctgggcaacacagcaagaccccttctttacaaaatttaaaaaattagcagggcctactggcacacacctgtagtcctagctactcaggaggctgaggtgggaggatcgcttgagcccaggagttcgaagttgcagtgagctatgattgcaccactgcactccagcctgagcaagagagaaagaccttgtctctaaaaaataataataatagttagggataatgcatttaaatctgtctcactgaaatagtaagaatgaaatcaaagtgctcaagacagcattttttaaaaatctaacctactttatctaaatcttttaggatactccaatttttcatttgaaaaagtagacctgatttgaataactaaaataattgatattgtcatagttaagatttatgagatgcttactttgtgccaggtacttttctagctagtttgtttgtttgtttgtttgccaattgcactggttgaaacctccaggacactgttgactagaacagcagacaattttgtcttgctcctgtacttagggagaaagcattgactctgtcctcattaatgtatgatgttagctgaggatttttcatagataccctttttcaggttaaagaaattcttttctattcctcatgtgttcggtattttgatgaagaaagagtgtttgattttgtcaaatgcttttccgaagcatataatttttaattatatggggtaaaaattatatgatcacataattagataatcatataattatataattatattagattattttatatgtaatttttatataaatatatatctatgtaatttatatattaatattatataactataaataattatataacatagctataaataattatgtaactatgaataattacataacatagctataaataattatgtaactatgaataattacataacatagctataaataattatgtaactatgaataattacataacatagctataaataattatgtaactatgaataattacataacatagctataaataattatgtaactataaataattatataacatagctataaataattatataactataaataattacataacatagctataaataattatgtaactataaataattacataacatagctataaataattatataactataaataattacataacataactataaataattatataactataaataattacataacataactataaataattatataactataaataattacataacataactataaataattatataaccataaataattatattacataactataaataattatattacataactaaataattatattacataactaattatattacataactataaataattatattacataactataaataattatataactatataactataaataatatgatcacattaaattgtataatcatatattatcatatcattataattatattatatataattatataagcataattatatgcttccttaattctttattttattaatacacatattaatagaataaaggattaaaattatatgatcacattataattatatggttatataattatatggttatatatgattaattatttacctttgagtcctggggaatattatatggttatatatggctaattatatggttatataattataatgtgatcttataattatatgattacataattatataactataatgtgatcatataactttaatcctttattctattaatatgtgtattacattgatggatgattagatgttaaactagccttacattcctgggataattaccacctggtcagggtatataatccttttaatatgttgcaggacttggtcggctagtatttttttgaggatttttgcattcattttcataagggattttggtctgcagttttcttttcttgtgatgtctatttctgggtttggtgtcagagtaacactggcctcgtagaagatttggaaagtgcttcctctttttccgtttttggttttgtgaactattaacactaatcctccaaaagttaaccatagagctaccatatgacccaggtatatacccaaaacaaatgaaaacgatgtccacaaaaaaacttgtacatgatgcagccataaagaataaggagatcggccgggtgcggtggctcacgcctggaatcccagcactttgggaggccgaggcgagcagatcacaaggtcaagagattgagaccatcctggccaacatggtgaaaccccgtctctactaaaaatacaaaagttagctgggcgtggtggtgggtgcctgtaatcccagctacttgggaggctgaggcacaagaatcgcttgaacctgggaggtggagtttgcagtgagccaagatggctccattgcacttcagcctggccacagagcgagactccatctcaaaaaaataaaataaaataaaataacaagatcatgtcctttgcaggaatatggatggagctggaggccattatcctaagtgaattaatgcaggaacagaaaatcaaataccgcatgttctcacttataagtaggagctaaacattgggtacccatggacacaaacaaggaaacttcagacaccgaagcctgcttgagggtggagagtgggaggagggcgaggataaataaacgacctatagagtactgtgctgatgaccagggtgacaaaataatctgtacaccaaaccgccacaacatgcattttacctacataacaaacctacaaaatgtacctctgaacctaaaataaacgtttagaaaaatgttgtacatgaatgctcatagaagcagtatttagaatagtcaaaaattggaaacaatgcctatcactgatgaatgaataaacaaaacgtaatatatccacaatgaaatgttattcagccataaaaaggaacgttaagagaccattcagtcattatttatttatttagaaacactctgtcacccaggctggagtgcagtggtgccatcttggctcactgcaacctctgctctctgcttcctgggttcaagcaattctcatgcctcagcctcccgagtagctgagattacaggcatgcgccaccacacgcagctcattttttgtgtgtttttagtagagaaaggatttcaccacactgggcaagctggtctcaaactcctgatatcaaatgatccacccgcctcggctcccaaagtgctgggattacaggtgtgaaccactgcacctggcctcattcagccattttaaaatgctgcaatataggtcttgctctgttgcccaggctggagtgcagtagtgcaatcacagctcactgcagtctcgacctcctggactcaagcgatcctcccacctcagtctcccaagtaactgggaatacaggtgtgagccaccacacccggctatttttttattttttgtagaaatggggtcttgctatgttgctcaggctggtctcaagctcttggtctcaagcaatcctcccacctcggcctcccaaagtcctggtgtgagccactgtgcctggcacaaccttccatttttgtttcattgtttgaatgtgtctgattgtgtgtatcttccttgagttgaaattttggggatctaagaccgtgttcattttctccaccactgtatcttcagagccaaccacagaccctatcactaaagaaacacttaatattgttgacgtaggaaggaagtgaggaagtggtgaggagggatggaatagatttacataactgttccatatctccaaaaactgatgcatttttttttaatctctcttttttcagctgctggctccaaccagaaaagggatttatatggggcttccttggacctgtctgcgccatcttctctgtgagtgacatcatctgagcatcctcgctgccccgctgagggtcattagaaaaacaagataataaagatggtgacaagagcaggaatgtcccctgggttgtcatgggttgggttaggtttcctaagaccactcttgaatcttcaaactcaacactgttactcaatatttaagaaaaagacttacgtgtataattcatattagacaggctaggatgaagagataatgggcttcaggcccggtgtggtggctcacgcctgtaatcccagcactttgggaggccgaggcaggcagatcacttgaggtcaggagttcaagaccagcctggccaacatggtgaaaccctgtctctactaaaaatacaaaaattagccaggcgtggtggtgggtgcctgtactcgggaggctgagacaggagaatcgctcgaacccgggaggcagaggtggcagtgagctgagattgcaccgccacactccagcctgggcaacagagcaagaccctgtctggaaaaaaaaaaaaaaagagataacaggtttcaaaatctattcaacaaatcttctgtggttttctgaaggtgaatttagttctctttctggtgactctctggattttgaaaaacagactctcctccctcaatagtgaagtgtccaccctccggaacacaaggtaagatggagaagggggtgataaccacacagacatgtatggttcccaagagccaagccatgtgcctcagcagccactgaggtcccttctcaggttcttttgaagggacccagaaaaaacagacgcagccatccttctatggcagccatcacagattcagtggtatcctgttgagaccccatgcaacatgttttgtccatgtctaatctcagtttgtgaatcccagagcaacaggaagaatcttcattgactggtaaatggtatatatacaaaataggatacgattcgatcacaaaacagaatgaaaccatgtcatttgcagcaacatggatgaaactggaggtcactctcttaagtgaaataagccaggcacaaaaagacaaataccacaggttgtcacttacatagagaggagccgaagaagctgatcttgtggaggcagaaagtagaatgataaaagttagccgggcatggtggcaggcacctgtagtcccagctactcgggaggctgaggcaggagaaccgcttgaacccaggaggcggaggttgcggtgagccgagatcacaccactgcactccagcctgggcaatagagtgagactctgcctcaaaaactaaaaataaaaataaagtagaatgatagattccagagtctggaaagggtatgtgagtgggcaaggtgatgaagagaggttggttaatgggtacaacatacagtcagatagaaggaataagttataatattggatggcagagtagggtgactctagttcacaatatgttgtatatttcaaaatagctagaggggagaatttgaagtgttcccaacacatacaaatggtagacacgcgaagtgacggataccccaaatactctgacttaatcatgacacactctatgcatgttaacaaaatatcacatatgtccccacaaagatgtacaaacattacgaatcaataaactaaaaggttaaaaacttctttggacttttgtcagcagtcctataacaaaagcacaaagaaggccgggcatggtggctcatgcctgtaatcccagcactttgggaagctgaggggcgggggcagatcacaaggtcaggagttcgagaccagcctggccaaagagaccagcctgaccaacgtggtgaaaccccgtctctactaaaaatacaaaaattagctgggcgtggtggcgggtgcctgtaatcccagctactccagaggctgaggcaggagaattgtttgaacctgagaggcagaggttgcagtgagccgagattgcgccactgcactccagcctaggtgacagagcaagactccaactcaaaaaaaaaagtgcaaagaacacgtacattttcttgcctgttcccacagcccagtctgcaccttcataccgtaccctcagttcaggctcctcatcacttctcatgcaatcctccctctgggaaaatcctaatcaacattaaatcctttacgggggccaggcatggtggctcacgcctgtaatcctaacactttgggaggccgaggtaggcggatcacttgaggtcatgagttcaagaccagcctggccaacatggtgaaaccccatctctactaaaaatacaaaaattagccaggcatggtggtgggcgtctataatcccagctactcaggaggctgaggtgggagagtcacttcacctgggaggcggaggttgcagtgagccaagatcacgccactgcactccagcctgagtgacagagcgagattccatctcaaaaaaataaataaataaaaataaaaataattcctctacagggtttgagcagtttgttgttccaggcacccttgtgcaaaattaatgaactttcttctagattcctatcattatcctttccaaattttgtgtctcatgcctggttgtattggtgatttgaagagactgtgtagttcatgaacacagaaatctctttgcatattcaaaaataatccttttttttttttgagacagagtctcgctctgtcactcccaggctggagtgcagtggctctatctcgactcactgcaacctccgcctcctgagttcaagcaattctactgccccagcctcctgagtagctgggattacaggcgcccccccgaccacacctggctaatttttgtatttttttagtagagaccaggtttcaccatgttggtcgggctggtctcgaactcctgacctcaggtgatctgcctgccttggccccccaaagtgctgggattacaggcatgagccaacgtggccaaccccaggtggcatttctactgtgggctatagttgacagtaaatatctaagctgaccacagcccagtctgagaaatcatctacaggggagggcaggggactccatgggcacagatgaaatagccttgattctctttctctgggtgcatcaccagcctcctttcttactcaatccaggatgctggcatttaaagcgacagctcagctgttcatcctgggctgcacgtggtgtctgggcatcttgcaggtgggtccggctgcccgggtcatggcctacctcttcaccatcatcaacagcctgcagggtgtcttcatcttcctggtgtactgcctcctcagccagcaggtaccactgcccagctcccacccaggactcttcctgtcctcactgctctctgtgagctgacccagtacacactttgcctctgcaggtccgggagcaatatgggaaatggtccaaagggatcaggaaattgaaaactgagtctgagatgcacacactctccagcagtgctaaggctgacacctccaaacccagcacggtaagatcacgcattgctccagagcacttcactaaccgacccacctgaggagcatgtgcctatcacacaaggaaacctgggaatacagcaggcaatgccctagaaaggctcgcatctgagtacgccttgactcattaaccattagcaatgatctcagtttaaatgtttttttttaatcagtcatagcctgtcatcccggcatcactgtcatcccagcatttgggaggcctaggcaagaggatcacctgaggccaggagtgcaagatgaccctgggcaacatagcaagatcccatctctacaaaaaataaaaataaaaattagccagacatggtggcatacacctgtagtcccagctactcctcgggaggctgaggtgggacaatcacttgagcccagtaggttgaggctgtagtgagccatgatcatgccactgcactccagcccaggcaacagagtgagaccctatcccaaaaatttaaaaaaaaaaaaaaatccttggctcttactccttagggaactgtgcttagtttgactctcacacacaaacactcctattggacacctactatgtgccatgcatggttaactaaatgagcaggaattgatctgaagcagtgatgcacattctacctagaagcatttaccctatccctttcctctacatacaagtctatctcacagtcacttggcaccaccacccaataaggcaagcatgggaggaaatgctgtacatatttatgaattaaacagaaataagtgttaactgggatttaggctttcttaacaagtctgcctctaccaactaccacttagtagtgggtagtgggcagtgcctctactcagcaccctctacccactgcaaaactcagaaagaaaagcagtaatggggccagcgatggtggctcatgcctgtaatcccagcactttaggaggctgaggcaggacaactgcttgaggccaagagttcaagactagcctgagcaacccagtgacacctcgtccctataaagcatttaaaaattagctgagggtggttgtgtgcatctgtagtcccagcaactcaggaagctgaggtgagaggatcacttgagcccaggagtttgaggctgcagtgagctatgattgtgccactgcatttcagcctggatgacagcaagacctcttctctagaaaataatacaaataacaaaattaaataaataaagttttaaaaacacactgggcaacctgggaatcagcgggtgatgccctaagagggttcacatttgagcgactccttgactcattaaccattagcaatgatctcagtttaaatgcttttttataaatcagccaggaacagtggttcaagcttgtaatgccagcactctgggaggccaaagcaggaagatcacttgagcccgggacaacttggggatcacttgaagccatattatcctatgcctcaatggcatgggataattcatgacattgatgactaataaccaacatttattaatgtagacatacaaagttctgttgtatttttctcacctcttcttccatcttctccagattgtatgtgtaattctaaccccatttcactgatgagcaaagtaagactacttggatttgtgtcaaatgtacagagtctcggccaggcacagtgactcatgcctgtaatcccagcactttgggaggccgaggcaggtggatcacaaagtcaggagatcgagaccatcctggctaacacggtgaaaccccatctctactaaaaatacaaaaaaaaaaaaaaaatagccaggcgtggtggtgggcgactgtagtcccagctactcgggaggctgtggcaggagaatggtgtgaacccaggaggcagagctggcagtgagccgagatcgcgccaatgcactccagcctgggcaacagaacgagactctgtctcaaaaaaaaaaaaaaaaaaaagaaatgtacagagtctcttcagccagtgagatttaggcctcttgagtcttgcttcacatttaaagagcccattcagggccaggcaccgtggctcatacctataatcttagcacttcaggaggccaaggcaagcaaatcacctgaggccaggagttcgagaccagcctggccaacatggcaaaactccatctttactaaaaatacataaattagccaggcatggtggtgcacacctataatcccagctactcaggaggctgaggcacaagaattgcttgagccggggaggtaaaagttgtggtgagccaagattgccccatgccactgtactccaccctgggcaacacagcaatactctgccaaaaaaaaaaaaaaaaaaaacagcctattcagcctgggcaatgtaacgagaccccatctctataaaaaagttttaaaaattcgctgggcgtggtggcacatgcctgtagtcccagctacttgggaggcgagaggatcgcttgagcccaggagttggagaccaacctgtgcaacatggcaaaatcccatctctacacaaaatataaaaactagctgggcatggtggtgcatgcctataatcccagctgcttgggaggctgaggcaggaggatcacttgagcccaggagttcaaggccacggtgagctacgattatgccactgcactacagcctgggtgacagagcaagaccccttgtgtaaagtaaatacataaataataaattttttaaagtcttgaaaagaagcccaccatgctgccaggcactttttccacatttgcatttctctcattacctttttccttttttatttttcttttttttttttttgagacggagtttcgctcttattacccaggctggagtacaatggtgctatctcagctcaccgcaacctccgcctcctgggttaaagcgattctcctgcctccacctcccaagtagctgggattacaggcatgtgccaccaagcctggctaattttgtatttttactagagacgggatttctccatgttggtcaggttggtctcaaattcccgacctcaggtgatctgcccgcctcagcctcccaaagtactaggattacaagcgtgagccaccacacctggcctcattacctttttcatccaacctgcacaatccctgtttccaacacaggatcttctatttccttttctgttctcactaaatgccctcaccacctatgtcacacacacacacacacacaaatccaagtcatcatgatgacacattgtaaactccatgctctcaatcatacaaccaaacatgaccatccaccttccacattcccatattattgactgtccatcctctttttttttttttaagacagagtctcactcgctctgtcacccaggctggagtgcagtgacaccatctgggctcactgcaaactctgcctccagggttcaagtgattctcgtgcctcagcctcccgagtagctaggattacaggcacccgccaccacgcctggctaatttttgtatttttagtagagacagggtttcaccatgttggccaggctagtcttgaactcctggcctcaagccatctgcccgccttggcctcccaaagtgctgggattacagacgtgagccactgcgcccagtccatccctgtctttgactctcctacagccttcatactttataaagaccttgatgattacattgggttcaccaagacaatccagggcaattttcccatctcaagatccttttcataaccgtatctacaaagtctctttctccatgtcaggtagcatttacaggttctggggattagggatgtgaacctctttggggggtcattattctgtctctcatacccatatagtttgggtttacctattgtagaatcatcaaaacctgcctcatattgtagatatttgcataaatatttatcaccctttcaccccacacagccactagaaatgatatatacacattgaagaaaggaaacatgtacttttgtgtagggaattagagttaggtcatcagatagccaacaaaggcttctgaaatttaaggtgtgtgatcagatatttctaccagctactgacaaaggaccaagaaaatccattgcattacttaatgtcattttatcttctactgtttcctaaaacttgttatctctggtgtttgaaaatgtatgtgccttggccggacacgctggctcacacctgtaatcccaacactttgggaggccaaggcgggcagagcacttgaggtcaggagttcgagaccagcctggccaacatggcaagaccccacctctactaaaaacacaaaaactagccaggcatggtggtggatgcttgtaattccagctacttgggaggctgaggcacaagaatcactcgaacccaggaggcagaggttgcagtaaagccaagatcgagccactgcactccagcctgggtgacagagtgagactatgtctcaaaaaaaaaaaaaaaagaaaagaaaagaaaagaaaatgtgtgtcttgctcttattctgcagtctctgccatggctttctgcagtcttgtttcataaaaacaaaatgtcttgtgatcactactgaataatctcctgaagcacaatatttattaatctcttgagcacatattaattatgcattaaatactaactatataagcaagtgaagctgaccatctcgaaccatagaaattacactgagtttcctatgaacctaggaataaataactcatattggagatggaaaagatatggaaaaaaggaattcaggctgggcgcagtggctcacgcttgtaatcccagcactttgggaggccgaggcaggcagatcactttagctcaggacttcaagaccagcctgggtaacatggcaaaattccgtttctacaaaaagtataaaaattagccaggcatggtggtgcatgcctgtagtcccagctaccgggaggctaagattggagtattgcttgagcccaggaggtcaagtatccagtgagctatgatcccatcactgcactccagcctgggcaacaaagcaagacccctgtctcaggggaaaaaaaaggaattcagtgctttttcctttaaatcttatgtggttaacaatagataacacttctaacatttcattaatttcccacctggcttcttttatgactccacatttaaagcaacattacacaaaccctggagctccgaggtcaagacatacatttggaaacagatagatctttttaaatgttttttaattgatccataatagacgtacatagtttctaggtacatgtgatcatttgctacactcatataagcaaatcagggtaactaagatatctatcaccttaaatacttatcttttctttgtactaataacattcaaattattctcttctagctagtttgaaatgtatggtagattaatgttaactataatcaccctacttcagatacaacttttttttttttttttgagagggagttttactctgtcgcccagactggagtacagtggcaccatcttggctcactgtgacccccacctcccagattcaagcgattctcctgcctcagcctcccgagtagctgggactacaggcgcctgccaccaagcccggctaattgattattattattactactgtattctagtagagacagggtttcaccatgttggccaggctggtctcaaactcctgacctcaagtgatctgcccgcctcggcctcccaaagtgctgggattacaggtgtgagtcaccacacctggcccagatagatactttactgcaacacatttacttcctcttaactttggtaacttggggtttaggaggcatacaaagatggggcttctgagaaagaacaggatggagcaaaatgaaagctgatatggccttttgatgttgccctgacaaatacatatggtaagaaaaccttatgattaaagacttcttggccaggcatggtggctcacacctagaattccagcatttttgggaggttgagatgggaggatcacttgagcccagaagttcaacagcagcttgggctatacagtgagaccccatctctacaaaaaattaaaattaaaaaatgagacaggagtggtggcacatgcctgtagttgcagctactcgggaggctgaggcaggaggatcacttgaacctgggagttggaggttgcagtgagcagagatggtgccactgcactccagactgggtgacagagcaaggccctgtctctaaaaagaaaaaaaaaaaaaagacttcttaaatttcttttttttaataaattttattgtgtatacacacaattgaggtttaacccatgaagttatgggatacatatagataataaaatggttatctatatgtgaagcaaattaatatatctatcatctcacatagttacttatttttgtggcacaagcagctataatctacttatttaactaatttcttatttctttttcaaaatggaaattataggttttctttctatagtcatatatatttctaaatatatatatatttctaaatatatagatattaaatatatatatttctaaatatatagatattaaatatctatatatttctaaatatatagatattaaatatctatatatttctaaatatctatatatttctaaatatctatacttctaaatatctatatttctaaatatctatatatttctaaatatctatatttctaaatatctatatatttctaaatatctatatatttctaaatatctatatatttctaaatatatatatttagaaatatctatgtatttctaaatatctatatatttctaaatatctatatacttctaaatatatctatgtttctaaatatatttagaaatatatatatatatttcaggccagctcagtggctcacacctgtaatcccagcactttgggaggctgaggcaggcagatcacctgaggtcaggagttcaaggccagcctggcctacgtggtgaaaccctgtctctactaaaaatacaaaattagccgggtgtggtggcacatgcctctaatcctggctactctggaggctgagacaggagaattgcttgaacctgggaggcgggggttacagtgagtcgaggctgcgccattgcactccagcccaggcaacaagagtgaaactctgtctcaacaacaaaatacatacatatatatatatttcaggttaactagaaaaatcttctgaataagatcttccctctttgcccgtggaaaatctgaacaatctttgagccatctagaggggaaagaaaagactttgttctgtgtgtttcaagaaattcaccatgtcagcaatatgaaggatgttatggaaggcgtgcttggcattcaattcctgcagaaaccggaaatcttccatgccctgcaatgtgctcatcaaactctcagcatatggacggccagctgtggcccatatcttggtcactctgaagcacaatatttatgaagctatagaacgttaagacctctttcacagcctctccttcctacaaagactcctccaaatcttaaaatgaagcaggaaaacgagcctaagaggactttcataccgacaacatctgaaaggactagaatgttcacaccacgatctggatttcttaattttttgtttttgtttttgttgttctctagttctacgggtttgattatttagtcatgtgaaaaatattgattactcacacatagatcaagagagacacggctcctgccttcatggagcttttaggggaaaatgaagtggctcttgcagctagagttgactcagaagccgaaattcctagaaatcaggtttctactgctaggcaattgaagtataaactattttataaacactgtcttctttcgtcttcacaccaacatgcagaaaagtttctaatctcagatcagggatgtgcaacaaattccatttcaaaggaatgacctgcaaaactcctaaatattccaagcaaatgcccttaaccctgtctgttatctgctttccttgaacagaaattctacatgaccataaaacctcgaagatgggtatggcacagttcatgccctgtaatcctagcactttgggagggtgaggcaggaggatggctcaagcccaggagtttgagaccagtgtgggcaacagagtgagaaccatctctacccaaaaaaaaaattaaaaattagccaagcatggtgatgatataggagttaaggagaaatcatttaggcaaatagcaagggtaggaagtcctcagtaaggttttccatttaatgaaaagcagcccccaaaatcattttcttttctaacaaagaacagcctgtaaaatcgagctgcagacatagacaagcaagctggaagcttccacgggtgaatgccggcagctgtgccaataggaaaaagctacctagactaggcatgtccaaaatggcggctccaagttcccttctctttgccagccatgtgtacagtaaaaagcaggcaacatagtgtcagccaaagctcatttgcataataagattagggtggggtggccagctcacataggggtaggccctaggtaaatcagacaccgccttctcaagcctgtctataaaatctggtacactatgacgagggtcagatttcccattcagacgcccctctcccatgcaagagaaagagctgttctcctttctctttcttttgcctattaaacctctgctcctggccaggcacagtggctcacgcctataatcccagcactttgggaggctgaggtggtcagatcacctaaggtcaggagttcaagaccagcctggtcaacatggtgaaatcttgtctctagtaaaaatacaaaaatatatgaaatctcacatagatgataatattaagttccaaaagcaactcaacctggtagattctaattttttttgaggcagggtcttgctttgtcacccatgctggagtacaatggcacaaacactgctcactgcagcctcgacctcccaaggcctaagcaatcctcctgcctcagtccccctccaggtatttgaaactacaggtgtgtaccaccacacctggctaatttttgtattttttgtagagacgtgggtctcactatgctgcccaggctcaggtcttaatctcctgagctcaggcaatccgcaggcctcagcctccctaagtgcggggattacaggcttgagccactgcacctagcctctatttgttttacaaaagagaaattgagatcctgaatgttaagtgacttgcctgaggccatcccactaacaggagccagggttaggattcaaaccccatccaactggtcccagagctggagcttcttgcactgccctacactacctaccatctccatcctctgggcacctttttataagaaccaaaacattacagagcattgctttgtcaactcagctgggaacatttcccagtgcaactcacatttttcactgctctgtgcctgtccgtataagctcaatgagtattgatttaggggctttggagaactttgaatgctaccccccaagtaaccattgttggcaacctggtacctctacttttagccatttctccttctctataaatagtgcagaagtaacccacttggtaacaggcatccttgccaagcctccaccactaggtcagtgtaagaattaaagaaagaggaaagaaacacaaaaagtggcttgatggttaagacaggtttattttagagaaaacacacctgagaggggctgctggctgaattaggttagagtcttttctacagactaagagtgtttaaggatttagggtgggagagtttcttagaggcttggactgcttctgtgttttttttgttgtgcttatatgggagggagagtggtgtgtttgcttttatacatttttctgcagctgtaggcataccccccaagtctgcttttagcttccctattttagtgcacctggagggaaaggaatgtgcttattaaggcccactgttttactgg

SEQ ID NO: 16253 - DNA, 12023 bp, Human
actagggtagtcagggccactaccttgattcaggtctgtaatcctagctacttggtaggccaaggcgggcagatcacttgagaccaggagggttttttgttttgttttgtttttttgttttgtttttttgagacggagtttcactcttgttgcccaggctggaatgcagtgacacaatattggctccctgcaacctccgcctcccgggttcaagagattctcctgcctcagcctcccgagtagctgggattataggcatgcaccaccacccccagctaattttgtgtttttagtagagaaggggtttccccatgttggtcaggctggtctcgaactcccaacctcaggtgatccgcccgccttggcctcccacagtgctgggattagaggcgtgagccaccgcacccagccgagcccaggagtttgagaccagtctgggcaacatgatgagactctatctctacaaaaagtagggaaattagccaggtatggtgacacatgcctatagtcccacttgctcgggaggctgaggcaggagcatcacttgagcccaagaggctgagactgcagtgagctgtggtggtaccactgcactccaccttggtctagttttatatattttagggagacatgagacagcaatcaatatatgtaagatgcacatgggtttggtctgggaaggcaggacaactcaaaagtagggagaaggcttccaggttataggtggataagagagaaacaattgcattctttcgagtttctgactagcctttctgaatatgcaatttacagagatagtcacttatgccttagtctggcttagtgaaacaaataggtaaggaagcgatcagatatgtgtttgtctcatgtgagcagagggacaattttgagttctgcctgtccttcatccataaggaatttccttgtaggcaaattgtgggggaggtatgtagctttttttttcttttcttttcttctttttttttagacggcatcttgctctgatgaccaggctagagtgcagtggtgcaattttgattcactgcaacctccacctcccgtgttcaagcaattttcctgcctcagcctcccaaatagctgggattaccagtgcccacccaccatgcctggccaattttttttctttttcatatttttagtagagatggagtttcaccatgttggccagcctggtttcgaactcctgacctcaagtgatccgtcgcctcagcctcccaaagtgctaggattacagaagtgagccaccgcgcccagctagcttttttaaccttgtagctatcttacttaggaatagaatgggaggcaggtttgtcctacacagttaccagtttgacttcttccttttggctcagtgatttggaggtctcaagatttattttcctttcacaatcacgacatggttgttttacatcattacgtttggggatggtttgtcaaacagcagtagtaattggaatttggaggtgagagaattgagtggggaaagagtggcatggggagaccaaggaagaagcttggggtggggtgggtagtggggacggtcattgaaacgaatgacactacggcttgcaccaggttgaagcagtacctggcaaggagagagaggatacgtggaggctgcgatttggagacagacccaagagaacttcctggatgccatcacccagagtcccatccagggagggtgggtgaggtggaagacaagggatcgggcctgcgccacgatcgtcacgtcccatcgaagctggagcggatccgggcacccggagcccccattccaacccctcccggccccaggcaactacatctcccagcatcgcccgctcgggccgcgggaaaggggaaaaaaaaaaaaagtttgggccaagcattcccggaatgtgcttcctgctggcgcggggcggggggcgggcggggaggcccgggcggggcggggagggcgcggggcggcgcggccggagcccggggcgcgcactcggctcggcccggcccgggccgcagcatggccgagccgctactcaggaaaaccttctcccgcctgcggggccgggagaaacttccccggaaaaagtcggacgccaaggagcgcggtaagcggagatcggtggggaacagggggcgccgagccccacccggcctgggagcggggtcccagggccccgaggacagacggtgggggggatcagggggagccccccgcaccccgctgcagactggggtgcctccagccaggggagggtaggggtcctggaaggaaggggctgggagggaggggggcgcggaccgttatgtgctgctggccggggatgccagcgctgcgggctccttgggaggcccgggagggggcctcgcccacgacaggaaatggggccgcgactgagggcctggagggtggaggggaggaggggctgggaggccgggacactggggcccagtcgggctgggcaaggggcatcgggagccctggaggcgcaggatgggagatgggaggcgtactcctgcaaaggaaagagaggggcggcccgtcaatcagagtagctgccccctccgcctcccacctactaacagtgacggcaactgcgcctgccttagccccaggaaactgtcccttttatacagatggggaaactgaggcacggagcaattgggtcatgtgcccagggccatcgacttaaacagctctttggactatgctacaaacagagaccctagagggtggacatcagaggtggccagaggaggagttcagcagggtagcaagtaaaaaccttagagaaacagctgcgtgggatagggggacccaggaaggaaggagttaaaggaggaaggccagaccattccatggacgtaccccttccccccaggccttcccaaagattcccaatgttcccagggaagggagaagggacagagatgcccaaacacaaacacacacaggaaacagcccaggacatgagacaggagaggagggagggaaggggaagtcccaaagcattgagcgtggggggtctggcctgggctgagggacaagggcccatcccaggatggcgacagagtttggaagacaggagggagggtaaaaggggcaggggactgggagtgactgtgctgcagggaatagaaaacccagctcctcactcctgagcacgtagtgcctgctgtgggctgtatacttttccaaaaggctcctggaagcctccctggacatggaaatcacatccccccatttcacaggaggatactgagcctcagagagggaagcgacttgcccaaggccacgcaggtgcaaagctccatgccacggttattgagagggtagaggaagtggagactggaacgcagtacctacgggccccaggaagcctgacttagaaccctgaggctgcagggatggagtccccttttgggatgccagggactgagtagggggtgctctaagctgataactgagatcgctagcctgtggctgcctattccaaacaaaacagcaggatccaaggaaccatgacttatcaggggccggccagggccgtacacagcatcccacccactgatcaattgcacagggctgctctgcaggcagtgaggggctgggtgggtctcactccccttgctctctgccaggccacccagcccagcgcccagagcccagccctccagagccagagccccaggctcccgaagggtcccaggccggagcagaggggccctccagccccgaggcatcaaggagccctgcacggggagcctacctgcaaagcctggagcccagtagccgccgatgggtgctgggtggggccaagccagctgaggacacctctttagggcctggggtacctggcactggggagcccgccggcgagatctggtacaaccccatccctgaggaagaccccagacctccagcacctgagcccccggggccacagcctggctcagctgagtcagagggcctggccccccaaggtaagaacaagcttcccatccccttccccaaggtgagcaccagctccacatcccttcccttcagggtagcaccagcctcacactccctcctcccagaggagcaccaacctcacactccttcccttcaggggagcaccagcctcacatccccaccccgtcagatgctcccagaggagcatcagcctcacaccctcctccccgccaggggaacaccagcctcacactccttcccttcaggggagcaccagcctcacccccctcccctaagcccaggttcctggaccctgaagtctgctctccacacaggtgcagcccccgccagccccccaaccaaagcctcccgcaccaagtccccgggccccgccaggcgcctctccataaagatgaagaagctgccggaactgcggcgccgcctgagcctgcgaggcccccgggctggcagggagcgcgagagggctgcccctgcgggctccgtcatcagccgctaccacctggacagcagcgtggggggccccgggccggcagcagggcctgggggcacccggagcccgagggccggttacctcagcgacggggactcaccggagcgcccagctgggcccccatcacccacctccttccggccctacgaggtgggtcccgcagcccgggcacccccggccgcactctggggccgcctcagcctgcacctgtacggtctcggggggctgcggccagcgccgggggccacccccagggacctctgctgcctactgcaagtggatggggaggccagggcccgaacagggccactgcgaggggggccggacttcctgcggctggaccacaccttccacctggagctggaggccgccaggctcctgcgcgccctggtgcttgcgtgggaccctggcgtgagaaggcaccggccctgtgcccagggcaccgtgctgctgcccacggtcttccgaggtaggacatgcggctgcaggggaggaggggcagggacccccaaaccccaccgccaccccccgcagagtgcctagggggctgggctccgggcggaaggtgtggcctggagcagcgaggccagggtacatgaagcttcagagcacacccggctcaggcccccttgtgtcctcagggtgccaggcccaacagctggccgtgcgcctggagcctcaggggctgctgtatgccaagctgaccctgtcggagcagcaggaagcccctgccacagctgagccccgcgtctttgggctgcccctgccactgctggtggagcgggagcggccccccggccaggtgcccctcatcatccagaagtgcgttgggcagatcgagcgccgagggctgcgggtgagcacccaccccaccccaaccctctggcccccagacctcagaccactcttcaggacaccctatgtacagatgccagacccctacccccaggcctgagccactcctagctccaatcccaacctagacaagggcagaaggcgcccccttgactgtagcaccctgggcagaacccatgggtcatccattgatttaaaaacaggatccaagccctcctggggctcagagtctgatgggggaaaagatacgactctagtcattcacaaatgtaaaactataactgggactggagttggggtggggtgtacctagggtctgggagagcttaaaacaaaacctggggtagtcatggaaagcctcctcaaagaagtgtcagtttcctaagtcaaaggagatggcagccaagacaagtagtccaagcagagggtttacaaggccaggttgtcaaggtagttccaacctcccagcccacaatgcccattgctgcctggcccagaattccagtgctcaccccactgggccctgattagtctgtggccccggcaagaagacattcactctctcttcccacccccaggtagtgggactgtaccgtctttgtggctcagcggcagtgaagaaagagcttcgggatgcctttgagcgggacagtgcagcggtctgcctatctgaggacctgtaccccgatatcaatgtcatcactggtcagcatggccccctctcccctgcctgctcacccccattcaatgcctcacttcaaggccttggggctcctctgggacctcagtcctcctatctgaccttgctttcacccacctcctcttcccccttagctgtgccctccttagccttagaagccagtggtgccctgaccagaggggaccctgtgttcacaggcatcctcaaggattatcttcgagagttgcccaccccactcatcacccagcccctgtataaggtggtactggaggccatggcccgggaccccccaaacagagttccccccaccactgagggcacccgagggctcctcagctgcctgccagatgtggaaagggtgagttgggcctggtgggagtgatgggacttgagagtgggctgataccaatagaatgtttcacccatgcctgggcctgagatgggcatgagctggcagcatcatcatatccccaagaaataggtgctattagcatcccacttcatagatttggaaactgaggcccaaagcaggtgacagttgcccaaggtcacacagccaggatgtgtcaaaaatgcaggctgaacgctgatctttcaacctacaagggaggttcctggctgagggaacctagacaagtcccatccctctctgtgcttcaatatcttcatctgtaaaatgagattcatggcagctctgcttttccaatgcttagttgcctttggcttcagtcttccctccaacaaaataggctcataatactaacatctaatgattaatagtcttaacccgaccacatcccagctatgagactgtgaacctgcttccctactctagccaccttagtctcttgcaggtaggtgccacaggggcctgactttgtctgacttacatcctctcaaccctctcccaggccacgctgacgcttctcctggaccacctgcgcctcgtctcctccttccatgcctacaaccgcatgaccccacagaacttggccgtgtgcttcgggcctgtgctgctgccggcacgccaggcgcccacaaggcctcgtgcccgcagctccggcccaggccttgccagtgcagtggacttcaagcaccacatcgaggtgctgcactacctgctgcagtcttggccaggtgagttcatgcccagggcctgcaccaccaatctgagccaggctgctacagtgatgccaccttaagggaccaatcagtgtcttgggcttgaagctacgccccctcatggagtaaactggtacctggttgcctcagcaaccagttcagatccaaccaatctgtctgttttgtctttttttattttcatttttttgtaaagacagggtttctctatattgcccaagctggtctcaaacgcatgatctcaagccatccttccgcctcagcctcccaaagtactgggattataaaccaaatcaccttgccccacagagctgattcatctttttatttttattttttattttttttgagatggagtcttgctctctagcccaggctggggtgtggtggcatgatctcagctcactgcaacctctgcctcccaggttcaagggattctcccacctcagcctcccgagtagctgggattataggcacgcaccaccagtcctggctaatttttatattttaagtagagcagggtttcactgtgttggccaggctggtcttgaactcctgacctcaagtgatccacccatttcaggcctctcaaagtgctgggattacaggcatgcactaccaatcctagctaatttttgtatttttagtggagatggggcttcacggtgttggccaggctggtcttgaactcctgacctcaagtgatccgcctgcctcaggcctcccaaagtgctgggattacaggcatgatccaggcatgatccacagacctgcccctacccatctttgatgcagtcagaggccctgcctcttgacatgccaatcagaggcctagttgcctaagcaaccagtcctagctctgccagtgaaaacctgaaacggtcgaaggccgctttccacaggccaatcaggagcctagttccctaagcagccaatcagaggtcggctgtcgcctctttctatgacctaccctgtctcccttcagatccccgcctgccccgacaatctccagatgtcgcgccttacttgcgacccaaacgacagccacctctgcacctgccgctggcagaccccgaagtggtgactcggccccgcggtcgaggaggccccgaaagccccccgagcaaccgctacgccggcgactggagcgtttgcgggcgggacttcctgccctgtgggcgggatttcctgtccgggccagactacgaccacgtgacgggcagtgacagcgaggacgaggacgaggaggtcggcgagccgagggtcaccggtgacttcgaagacgacttcgatgcgcccttcaacccgcacctgaatctcaaagacttcgacgccctcatcctggatctggagagagagctctccaagcaaatcaacgtgtgcctctgagccagatgacggggtgggaccccggttagtaaggaccgggcgcccagtggctaaggcggtgccctggtgaccaaggagagccagacctgttgctcaggccgagctcctggttgccagcgagttaccacgggaccagtcgcgtgtatggctgagactcattcccagtttccagggcccggtatttggacactagttgccaagtctggggcctggggattttagggaccagcggttgtgaccatctttcctgagcaccaagggcttccccttttgttgccaaaaaggtagttctcgcgcttgctaggctggcctctcttgcctccccttggccggggcaacaccagttactgtgagcatcaccctggtgtggtgagtcacctctagtcggccctcttgctgctgccaaccaaatcagtattagctttgagcactgcactgtttctccctcccttggacgacacaaagactagcatgaggcactctttgtggggggcagcccctatcctgggttccagcatggacacaggggtagcctggggcttatagagaaacagctggtttcccctaccctttcccggggaagaccccacgattggcctctagtcagcaaatggagataacagagtctggcctttccaatccccatctccttgccccccccttgcccccccccccccgaaaaaaattgagcacttaaacccctcccttttggagggggccccctgaagcgtcaggctgggggcagtctggtacggaacatatttattgcctccatgcatgtgtgtgtgtgtctgtgaggactggtgtgcgtggacacgtctgaagcaggcgtgtggggctctttcagggaccacagaggagggagcagtttgcagtgcccagccaccctgaaatccccaataatggtgcctcagtgggccccagagttccagtgggagagtacggttccctcctgtctccctcttcttttccgcacctccatctttgtggataataaataaatatgcacaggttctgagactgagtacttgggcctacatgggccagaggtggtttattcagtctccataagagaggggacaaacggcacagttgggtccgtgaagaggagggtccaagagctcacaagagagcctctctgagatttgacccctccatcccctcctcagggaggttgtggagtcactgggcctcatgggataggcccagggcaagcaatgatgagactccaaaccagctggacacagtccaggggcaggaaggcagccaagcgtcctgacccacaaggccctatacagcaatggagccatcgcggaagtccgtcctcccaatgaggatgttgaccacaaccgggtggccgtctcggcactgctgctgggcatcgtgcagcaccttgaccacctgatcctcgttctcccgtgagagcagcaagccccgggcccccagacccatggctgccttgtgataatctaaaagaagagattaagtcggatagtggcaaggactcagcccaccgcacatgcagccagcccaggagaggaacacaagcccagctgggactgaaacagcctcctgtcctcccaacctcgctgaggccccctcaccagtgtaggccaggccacaggccacgttgctgcccagagagggcacctgctcccgagaaatctgtgtccagccagcatcattccctaccaaggccatcactgggatctacaggaagatgatgaaggcaggccgcagccttcagccccatggcttggccagccagaggacagagacagggatagggcctctgccagagaggaggctccctccccacctcagcccacccctggtgaaatctcccagaaccccaggccctaagcttccctcaggccagcccagtcaccttgtgtctgacgaatgtatcaaattcgatgaggctgtagccaaaagctccgtccccaaacaggcaccagacctagtcgggaggggacccaggatggttagggtggatcaggacctagagagcagcaagtctcccaactccagtgcctcacctcagcatctggccggcacagcttggccccaagtgcaaatcctgcaccaactcccagagtcccaaaggcccctaagaggaccaagagcaggtgggtgtgaaggcgtcctgatggatggtgcccactgccccaggcgggggcccttccttaccaggatcgagccagcgcagggggccgcggggctgtaccagatgggcagcagtgcccacgaagtccccaccatccaccaccagaattgagttgtcaggtagcgtttcctccaccagctgcagcacctgcactgggttcaggtgctgggccacaggcatcgctgccttctccctgcgacaggacagcgaaggtcaccagggttggcagcagggtctgccgggaacccccttcccacatccactccacccaggccccaccgaaaggtctgctccttctgccggtcggcttcccgcagctcctccacccagtctggggcccaggtctggccctgaaggccctccactaacttcagcacgaaggaacccacatctcctggggaaggaagaggacacagctgtggggagctggcttcctcctgttcttccagcatcagaggcctcaaaacagcaggaagccagcagcagcatccgagcaggcagacgggaagcaggccaggggtgctcctagaaaaaaaacaggtgaaacaccccagaacctgccagaaccaggggagggcagcccaggtgaaaagggaagacaaggcccaagaaacaagggttaaggagcacaaggcaggtgacaaacccaagctggcctcgtcccctccctccacctccttctgcctgggaaacactcaatgaaaagagctacatccaccaagcacatctctcaaatccaggcacgtggaagcgcacagcgaacgttactgaagtgaactaacaaacagccccgtgatgtatctttcaccaccccatttttcaaatgatcaaatggaggctctgagaaggtgaggctctgccgctgttcatctccagttcaggcctcctcgcttctgtcctggccattttgagcagcccccctggcctccacccagcccccttccggcctgccgtccatggctgctgagtggaccttcccaacacagatgcaacggtgctacttctctgcttaatacaagagtgtcctgtcgcctaggctgcaggggagtcaacatcctcagaatgatgaaccaagttcaagtccaaggggactaaaataaggggaggggagagatacggcaggaagacaggctaaggggccaacgagtgtgctctctgtcctgagggcagtgggcagtgtgggagggaacgtgatcacatgcacgttttcaagcctccctctgtgtccaccccaccatctgttcctacagaagcatctatcaggccgggcgcagtagctctggtctgtaatcccagcactttt

SEQ ID NO: 16254 - DNA, 79989 bp, Human
ttgaacctggggggcagaggttgcaatgaggcgagatcacgccactgcactccagcctgggcgacagagtgaggctcggtctcaaaaaaaaaagaaaaaatctattttctctaacagcctaatgattagtcctctgggcgtgtccctccctcctagtttaatcaccggcccaggcgccctcatttacttgcttccgcggccaccagggccccctgggcaagcagctccgcagagagcccgccggcactcgcggacgcttctaggctgggagcggggaggaaatgtcaccggccccaaactcggccctagggaaggccatccgcgtctatacttctcagtgtccctgtcgtgcgttttccttccaaccccatgcacactcattccaacataaagtcgtggaaacgggcgtgcactgggctgttcccgccgaacaccgggcgcgactcaggctgccggaggcttcccgggcgcggaggctcggcggggtcccctttacgcagcaattccaatgaacaactaaagtccgtacagattttgattggaacagaccctaagactaagagcctggaaagaaaaaggcaaatcacccaataaacgcctgtcttcgcgactctctaacccggtcgtatcgcgagggatccggatattgaaagcccctttgccggaagactcgggcgctgggagaagcccgcatgggacaggctgccccagtgcccgccggctccctagaatcgtgcagctctgaccctttccaacgaggaaaaaatgtttttataaacaatgttttaaaaaaaaccgcacacttttttaaaaagtcagaatctcgctcttgtcgcccaggctggagtgcagtgacgagatcccggctcactgcagccgcgaactcctgggctcaagatttcctcctgcctaaacctctccaatagctgggactacaggtttcctcttgcctcaacctctccagtagctgggactacaggcgtgcaccaccatgcctgtttttaatttttcttttgtaaagacagggtctccctatattgaccaggctggtctcgaacctctgacctcaagctatcgtctcacgtcggcctcccaaatgttgggattacaggcttgagccaccgcgcccggcgataactcacacttttattagtttttcttttcttatctttttttttttctcagttttttatgagggtaacggacggggccagggtcatttatgatttgggatcttggggcagtcaagtttgcaacttcagctcaaaagtcttacgctcggagcgcgcaggctcagcgcgggctgcgagactgcgagtggagggcttgggaagccgcggtcttcgggaaaccgtccacgcggggaaggagaaaggcacggtgggtcctcgggggcactggctctgtggcccgaagtcccgggagcctagtgaggactagacttctttctagtaagagacctgaacgtgccctcccgctgggctgcggacactgggagccgggccggcgggtggcaggacaggcagtaaggtgctcatggggaacactgccccggggagctaccggcctgggccttggccgcgggctggggcggtgcgcgctccccgcaccgcgcgcacactcctgcacacacacctggagcgcgtcccgggggggagggggaggagagccaaaacgagcgtcttaaaatagagagccaggcagaggagcgcgagacaccagagcgggaggcagcgactgagagccgccgggcactaggcgcgcaggtcggcgccggagtggcacgggcgggcgggggcggggtgggcgcggacgcccctcagcacacactccgcacccggccctgcaggaagctcgcgctgattgacagctgcgttgtcccaaaaaggctcagcgaagatgctgatctgcgggtgggtctagacgcgcggcaggcgcgcccgctacccgctctcctccgcgcgccacccgagccccgccgcctccccagctgccgggagcggggcccaggccccgccgtcgcgccagccccgcggccccagcgggccgggcactcgcagccgcgctcgggccggcggacgctcgcgccggctcaccatgcactgccacgccgagctgaggctgagctcgcccggccagctcaaagcagccaggcggcgctacaagactttcatgatcgacgagatcctctccaaggagacctgcgattactttgagaaactttccctctactccgtgtgcccgtcgctggtcgtgcgacccaagcccctgcattcctgtacgggtaagacgctccgctaggggataagtggggttcggtagctttcacgtccgtgtaggtggcctgtgctttgcgatccgagggcgagaggaagggttaagttaagggattcttttcctgcgcctcagcaagcggtgggcattgcaaaggcatctgcgacgtggccgggaaggaccacgcaaggtgtggatggcacgagtggaaataaaggcggcagggccttaggagtgggctgctcgcgcaacgcctgattgtcctgctcggaggagaacgcttcctcgtttcctgctgaaagttcaaacacttgagcaggttcagcgtctaaatcgttgtttcaggaagtggtggtgtgtgtgaatttcaaacttgagcttggcggccttgcatctcaccttgagttaacttgtccagcctcctactgtctccactgtgaattttgcaagtaaatcagtatcctgaggttctcaacaaaatctcgaattcactgagctttgcttacaatgatcgccctctgagaaagtagttctgaagtacattgtctttgtggcacaagccgaaaaggtcaccctcgtttgtcttaagtcaagccgaaaaggtcaccctcgtttgtcttaagtgaccaaaaccagcaatggtaacaatgaaaacattactcacacctggttttctctcttcacgggaggtaagagcaatagtaaagataaagagaacttaatacatatattgaaaacgtagtagagtttctatcgaaaataaatccaaggtacttttaaaattttgaatgcattaagagaagatccaagtttcaaagtatctcggcattgttaggatttaggttatggaacatgggtataataaaacgaaaaagaagtaggagcactttttatcagaaaaaagttattgagtgtgctttccattaaaggtaagcataaagtatttccaaaccaaaagaacctttgagattgttagttgcatgagaggcatgagataaattaaattacacttaaaatgaaaaaatgaagggccaacagttttggaagatattttttggaacatttgagttgttaatgctcaatgcgtggaatcctgtattttctcttggttccattgatagtccctatatgacaatcagtaaacatatgataaatacatacagtgaagttcttttaaaaccaaattgttcctacatgtatttggttgtaaaatgtatactgtattcagttatgcctttttaaagttaatttgtctgtaaggtagaattaggcctgatgtcccataacaagccttgtaatactgaatttttaaaaccaagaaatatatgaaacaaggaacaaataagaaattttagaaacaagatagatctcctgagaactgatatttttacatttgtgtataggtggttgtggacccttggacacatacatactgaataggggtgataagttgaatattgttttgagcacaaatcatcctttgttataataactcaattcccttcgaggaaaaagagaggatctgtttcagtcattaacattgcgtatgggacattcccaggacaaaacagaacaacttctaagcacctaggtagagcctagtgccggcagaattttcagtgactttgtgctgtgttgacttgaaggcagcttttcctggcttataggagtcacagaattggatcatagaagaaaacgtggcagaagaggagtaataaatagctgcagagaatagtcattcagtcagaggtggctgagtaagtgtcgtgttttattgaaccttgtgtgggaaataaatcagaggaaaaaaaaatgattcatatgtagttttgtgagtgttataagtgaaatgcacgtatttcacagacttaagtgttgctcagtcttgtgcttttcgaagttcactgatggttcgtggtagagggtggctgttggcaatggttttctggctccgttattccagtactttcttctttcggattgttagttgaaaatgtgtcgttattttgctctagttgagaattaaaatatagaaactgggatttgctggtggaattaaacccataaaaactggctacaatagttcatactttcagatcataagccttcagtgggtttacagttacagttaaagccttacatgtattagatcatgggaatcccattagtgtcttctcaggggttttgcaaataccatactttcaaagcatttttgtttttaacagttaaggtcaggacaaaaatctttgattagatgaatgtaatcttttttcttattaattaaaaacaacaacaataagttgctggcatcccaaaggacactgtaattttcttcttttcttttctttttcttttttttttttttttttttgctagatggaactaaatgttgagcactggtggtggaagcaatgcataaaaagttcaagtgaaaggcatacattggaattaaagttactgaactttctcagcctttcatttgctgatttaagatttaaagacgtgtaacagaagtgaactgtgtcaggtaaaataatgaaaactaagagaaaaaaaaggcctcaaaattaaaaagttaccagcatgtacaataagtacataaaattgggatggaaagaaaactacagcattaaaaaaaaaaaaaacactgcataatgaaacagttcatgctctgtggatttagtaacctaaaggtcaatttatggtaccaaatatcaggcagaatagcatgtattcaagcaaactgagaaatggaaatagttttcatctcaggcagataatcacctgacaggaatttattgttcgacattctagccttgatggaatcctcaccttccaaaaattgttgtttaacagacgctttcttattataaacacaataattttagtcttggaaagatgtctctaaatttctctcggtttcctagtacgtctcgtaaatcatcctaatagacactgcaaaagggaatcctttccctgtaagcctcaccacagaacggtttatcatcacatttaaactaaaatttaaacagctaagcccaaaagaatgcctccatttgaaaagagttgtgtcattcaggccattggtgaggggtggaatatgcttagaattaagttagtatataaaaagttggttttattcttaaatctgtaaacagtaatccctactcagaaggcagtgtaatgccatttagaaatcagcgatgagctctccaacttcagagcattgaccgtcattacaaaggccaaaagagaggtgcattttaggatatcataaatacacttcatttaggatgctttattttctttttccggttgtgattaatgtttcttggtggaaaagcccacttgaagaaagctggtttcttggggtagaatagtttgtggaagcatcggcgtggtcatttttgaagcctctgcctttctgtctgatctttagaatcaggcagtttctaaatttgaggcgtgttgagaaaaaatggataacttgcttcacaaaaataaggattgttacaattaccctaagggttttcacatgaagatactgataaatgaacctatggtactaattacttttattacaatttttctacttagaacctagaattaccttacatttacacatgcacttttgtggggaggtgagtgtagatacttggacattttacagcctgcgaataggatgagacttttaattattccactaacctataatctaattcttttccccttctctggcagaatgggtctgttgaatctcttacctgtctgatctttggtggttagacctacagagctggagaggctcataaaatcatagatcaatatcctcaagcagaaggtattttttgcaaagtgccagggtcacgtcagtgcttcgttatagtttcagtccactgtatgccactctcctccttgtcatagtactcagaaatcaggaagacttttccaacttggttacacacccgggactaacccgtgcagtcacacccaggggacagtcaaccagccagttagaagggacatttggggaagggtgtttatcttttaggaggtggcatcaagaacattttatcctgtggtggatccaagagaagcaagtcctttggggtagtgtccttgggtgcgtttttatcacaaacattgggtgtcatcccagcaaaaaattaaatgcggtgcaggtatgtatagtgtctcgtttgggagttagggagctggctagtgcttcatggagttagctctggtgactctccaaatctcagcttggtctttttcagtcagagacccaaactcataggatcttaggaacctgagagttggatactggaatgttaatggagaaacataaaccaaggtctgggaaaaatgatcgttatcaacaagcatttgtatttctgccagaggcacataggcttttagtagcaattactcataactgcttctcctgttcccattgtaagggtaaataaatagagggatgcacgggatctgggactcatccagggtcagtatatatttggaactgagctcttttgggatccttaactgttatctcactactcttttgctagagataccaagggattccttaggagtcagttttttttttttttcttccaatagcgggatcttggctcactgcaacctccaccttctgggttcaaatgattctcctgcctcagcctcctgagtagctgggattacaggcgcccatgaccacacccagctaatttttgtatttttagtagagacagggtttcaccatgttggccaggctggtctcgaactcctaatctcgtgatccacccgcctcggcctcccaaagtgctgggattataggcatgagccatcgcgcccgctgtgaagtcggttttaactcatgaatagttcattagcggtgtcttctctggctctgatttttctcaaagcaaatgaaaaaacgattagaaatttcgttcacgggttgaaatgcccctccaaatgtccactgttcactatcatttaattcagtaatttcatgcaacaaatatttatatttgcttggtgatggcattgtcattgagtctattattttgaaacttaatctaactgttgactagcagttagggtgtttaaaaaatccctctcaactacttgtagaaccattgctaagcccttctttgtttgttttgttttgttttgtttgtttgtttgttgttgttttttcctagtgtatgtgagaggcagctcggaattgggataggggaacatctaatacttttgcttactatgtggaattttctctttgaactctacctacagggtgttatcaccagcaaaactgtcaaatcaactttgctacatacaactcaaatgaaactctattatgaggctgatttcctacagatatgtttgttttttgctggttgtatttctggatccaagactgaatttgtgatagaaacatggatagtataaagttgttagttttagcatatcctagaaatcagagtggaaagattaaatgtaacatatcccaaaaatctatatgaaaaggagttaggattgcaaaggattattttatttataaagagagattgaaaggaaaaaaaagaagggaagaaggaaagtaagagtgggtttctttgaaattcttgaggctgcacagattcagcctcatagcacagcattcctccgaagggctgtacaggcaaaacaaagctggcttgtgaaattctgtcgctccatgggtactaaatggctaaagttgattctacttagacgcgtgctggggcctcttcaaggttgagatccagagcttaagctctgcacagcatttagccttcgctctggaagactgagtaaatgttaaaccagaagcaattttaggtgttatttgcactttgttttgaggtcaggtaggaggagcagcagagatgcaaaggtaggtacgtcacatgggctgaggcctcttcatttgtttttgtttttgttttatttttttgaaacaggatcttggtctgttgcccaggctggagtgcagtggggcgatcttggctcactgcaacctctgcttcccgggttcaagcgatcctcccacctcagcctccctagtagctgggactacagacatgtgccaccatgcctggctaatttttgtatttttagtagagacggggtttcaccatgttggacaggctggtctcgaacttctgacctcaggtgatctgcccgctttggcctcctgaagtgctgggattacaggcgtgagccactgcacccagccgaggcctcttaatttgtactgagcttgtgaacgtgcatgctatggagcctgagggtcttccttgccacacgtcctgcccacgactgtagttagcagactagagttggtgggtctatggctaagcccattgacaagctctcagctggaatatggttagagggctgcaaggactcaggtgggatgcataaattaacacctcattttgcatcttctgttggggatgcagttctgttttacactccagtcttgtggaatgggtgtttctagtgtggctctagggacgcactcacagctggattaaccaccttttccccgagaacttgctaaagcccacaggtgctcaaaggatgggcaaaagaccactgtgctgcaggtggcaccctctcttggaagcagcatgacgacgagaagaagagaagcattgagggcattcgtgcaaagactgcaagcgtggagaagcaccttgggcctgcctgtcggtgcctgcctccattttagctgcctgagaggatggaacggtagtttctttccacagcacagatggcaaaatcagaattcacgttaggatttattagtaacgggagtcagaccaggactttgtacaaacttggtggcattcacaaatactctccaggaagagaggtgttttgtttgtttgttttttaaccagaaaacctttgcaaaccctcaggatttaatttatttttattacagcttagtaacagttagaagaaggaaagtcttgttaaaataaatgctctaaataaaaacacagttaattttccattaccatgtctaattactcatcatcaccagggcatttttatatggcaatttaacttcttgaaagtggaaacttggcacacgtttaaggaggaaagccatgcacctagatagatatcagaaggcggtataattatatttgggctcgagttgaatcctacatatgattgctctgaagaagagagaagagagggcctctgtccgtagtcactaaggagagactctggtttcttgagtgccagttgaaattgaatacagagggagagaattctgaagattaggtgatgttcaagtacatctgaaaagggcccctgccagtcaccagttgaagttgatttcagggctagttgagaagtctggagggcagctctgtaagcttcctcctggcagagtgcacacagatgacacagccttcctccatgcacaggtcaaaagacgactgaagagaagccaagctgggaggatctcagcaccaaactaactacgttccatgtacaagcagacacgcttgcaggattcctttttaccgcgtctttccagcttaccaacatgtccttaggaacatattcttctgggtattgaggaaagatgagtattttctgttttttgtttttttgtttgtttgtttttgagacagagtctcgctctgtcactgaggctggagtgtaatggtgcaatctcggctcactgcaggctctgcctcctgggttcaagtgattctcctgccgcaccctaccaagtagctgggattacaggcgtctgccaccatgcccggctaatttttgtatttttagtagagatggagtttcaccatgttggccaggctggtcttaaattcccaaccttgtgatccacctgcctcggcctcccaaagtgctggaagccaccgcacccggccagatgagtattttcacaatgtgcatagaataggattggctgctgcctaggtgatgtcagatcatttctgatctttttttttttttaaaaaaccaacatatgcatttggtaagtgatatgatgcttatcctttggtttttcttattcaaggattacttaccatgtggagaaatggagtggtcttgggcctgatgaaatttcatgaaatagtggctatatttctgtcctgggaagtacctggtactggcaagtccctgatattgataacctgccaacctccactgcccacctttctttcccagagtccttttcactcggtgaattaaccatcactgagactcaggatgatgggcttttcccaaaagaggtcacagtctcgtgtggattgaaggaagtgtaacttccatgcttagtttaagcaatatctaagggagctgactttgcacatttcctaatggtaacttatagacaatggaatgctgatattgcatcttcttatcttgaggaaatatcatgggcaagaagagttgctgagactcctttttctgagtcttacagtacttatccaaggggagccacaaacttgagagaaatgctagaaatactttataccctaaaccatattcatagacagggcaataatagtaatagcgactgtttagaaattacctaacatgtaataggcactagactcagtgctttttgatcagcttcaaaatatccctatgaaataggtttatcatctcctttggtaatggtggaatcctagaagctaaatgactttcctaaagtcacaagatataaagagagctcttatgaagcaataagaaaaatgggcaaaggctacaatcaggcaattcatagaaaggaagatctcaatggccagtaaacatgaaaggatgctcaacctcgctgataagtgggaacacccgaattaatatgagataccatttcacactcactgggtagcccaaaatgaaaggacaaaatcggttgatgacaaggagatggagcaacaggcattctccacactccggcgggagtgctgtatggtacgattattttggagagcaatttggcaacaaatggcaaagctgcagacgcacataccctagggctcagcagttccactcctgggtatgtgcctggagaaaccagtgtatgagtgtaaaaggatacctgtaaaaatgttcacctgtgtgttatgttagtaaaaaataaaaaacaatttagctgtcctttcagaaggaaaaaggttaaaataatatatgctatatccatgcaatgaaattctatgcagcaattaaaataaatgaaccagatacacttgtattaatatggatacattttaggaatacaatgttgagaaaaaaagttgtagattgatacttactgtctgataccatttatttaaatggttgaaaaggcacaaactaatactacatattgtttagagaggcaggggcatgggagtggggagtgctaaccacaggtttttattttcctatgtaatttatttatttattaagacaaaaaggcctaatgtaaatatggctaagtattatgatgtgaagaaacttgggtcatggctacatagaagttaatgacattattctttgtacttttccatatatctgaaatttttcataacatgaagattgaaaagtgatagcacaagagaccgcacatgtccacagaactcttaatcttgtggaacttttgatctttttcttaatagcttttctatcctgaaacagtagcatttaaatacagagcttgttgtacatagtctcacagtgggaaactgagaacactttataactaaacatatgtacaactcacactgaaacaaccactgtggcttctgaaagtggcttttggatcttactaaccttgcctggctgattgagggtattatttatcaccaagataactgctgtttctccagtaatgctttggcatagaataaatagtctctgagttgggtacatgctcttgaaggatgactagtgaagtatttggtcccccagtcgtgcaagagagagttgtcagggtttttctgcttcttcttactgatgtttaaaatcattataaactgcctctgattgcaccttgcttttatgagtatttgttgatatgacaatatactacccttagcatttcaccagtggtcctttgctattgacagtttcatttacagaaattatctaaggacagctgtgattgaaccaaataatctaaaaatgttaacgtgtagcttcttagcaggaaagaataatgttgatattggcatgttattatctgtccaagttctctttatagtccataatcatgatctgattttaaaagtttgttcaatatatggtattggggactgttagaagggatgaatgttaccatggtgatctcacagagatgtctgttaccagcaatcagtgggcatcctattgtttggaggagtaaacctggaccacattttactccctaatgacaaccatagtggcagaaactttattcagcccaacaccaaagacgtttttcttttctcagcaaagtagtcccaatttagaaatgttgctattagacattttggcaaaaacgtggccttttgggagctctatctttctgtgtccttccaaagggaaagtattagtgtggaggaaacagtttgtacaatcaagagtttgccaaagcatttcccttcctgccaccactcctgtctgcctaaacaaatacatagacaaataaacaaattaaagctctggaggggggcctcaccccacccacaggatctgtggccagggtggccagattttctttggtgctaagcacgaggactgtgcccaaactggacgtgatggaaaggatggtggctctatcagtttcattaccagggttcagactttcgcgggttacgggacaaagtccttctgcattttattatacgcagatagtcgcacactctggctgggatcagttaaacagactgacacttttgcttgtgccttactctttcgacctcctggaactctccagtgaaaccttattcctcgtaaaatgaactagccaggcttggggctgtgaatataggaaacattatcaaggaagatattccaaagagctgccgtgggactacataagtcagaaaaaatgcggaggacttcctcctgcaacccaggggagtctgttcacttgcaacaaatctgacagatccacttttgaatcctctgtctggaactacttaggaaaagacaagcaaggatttaggatatttagggtaaattttaaatgtgtttcactgaaagagagagagaggaaggtgttttaatatggttccaatctaagacctttcttttccatgactaaacattttactgaaataattggtaagttaccccagaggagatatttcgggaaggtgttgttaatattgttatccctggatatcatggtaactcattaatgaacctcagcacattagacagctgtggctattggaagcatgttttcaatcatcagttcagagcaaggcatgaaggaacatcctattggagtgcttgcttttttttctactgggagattgggcctttgctggttagaacaatcaggggctaaacagcatatttcatttcttagggaggtgctaaataggagtaacaacaataataaatggcaaccacgtgcccggcactgtgctaggtgcttgtatacataaatgtgttctagtgaaatagttactattaccactgcttttcaggcagggaaagtgaatctcaaggaggttaagaaatgggaacggggtcacacgaataagtggcagggttgagattggaacttgcatctgtctctttcaatatagactccagtactggatatgattatatgaaaatgtgtaaattagaacatgtctgtctcattacatataggcaacatactgtgtgtgtgtgtgtgtgtgtgtgtgtgtagatataaaaaatatatatggtaaggtccaattaatgcatcagctctgttggaacttattttgaacctgccaactcttttacacatatttatactaatttaatgtgtgccagttcgtctttcatttcctgtggtgattggggtttctgaatgattccagagggattccaagaggcggtggggttttgcggggaagggaggtgattgggagattgcagacctgttaccatctggctgtgtgactctccactcctcactgccctggggtctgtgtccgtgtctgtgtagcattcgctaccactctctgggtcacggtgcttccatcagctgtcattctttgaataaagctttcctaggggaatcaagggtggaattcctactcattcattcattatcaactagagagaaagtgctgaacaactaaagccaaccaaatgccttgagagttaacacttcggatatttttcatggaatactcattaggttcagtgagaaaaaatgtctggtcgttgattggcatcacttaaaagaacgagattattttttcacattatatctggctgagctggagtggattctgggaatctctatttttaaaaacctttctgtatgattgcaatgaaaagtcaactctgggaaccacaataatgtagataacagcttaaatatgagattgatgtaatttgcaccccacgactcaaatgtatgaaaccatttagtggagtaatcctactgttggggttttgagtcagacggtcctgggttttattgtattttattgcctgtgtgaccttaggtaaattacttaacttctatgacactcagtttcctcatctgtgaaatgaagataataataatcacataatagggttagttgtggaggttaaatgagataatgtatataaagctctcagtattttattggctgtgtgaccttaggtaaacttaacttctatgacacgtaatttcctcatctgtaaaatgaagataataataatcacatgatagggttagttgtggaggttaaatgagataatgtatataaaactcctagtatagtttgtggtaacaaagtgcttagtatttgatagcttctattaaaaataattatcttacaatagtaacctcatcactgaagtacaaccctttagggaaagattaccattattggtgaattaaacttaagaaaaatttaaatcttgaaaaaccccactttactccagggcatttttctgggttacagcgacactagctgcttttaagaccccttgcaacctgggtggtctgtgaattgtttgagttcaagtcttcatgaattaggtatgtttcattcctcccacttttctgttttgtaatatgaattcagaattttataaattcataaatgagtggcacaaacaggtcagcgctacaacatcacaagatgtgctttgttactttatttttttttttaacaagagtttcctaggattcattgcccctaggaaatgtttcatcacacagctgtaagagtctcaagaactgtcctagaaaagtggcagaatttctcaacacgtttgatttcttttcttctttcaagagtagagttagggatagtcttttttttttttgaaaaaaaaatgaaactattctttttttcttattttcgagcactgagagaggaaaataactccactgagatgttcttttccaattaggtagcatggaaaaaggtagcagtatgacaactaatcactttcctagtatattattgggtctgtgattcagagtgagttccaaatgaagtgcctttgtgacagcttttaaattactggtggggctagcttctgaatgtattctaagtggtaatgatggatggctgtcatgtggaggaactgcctgaggaagagttccatgtggatttttttgggattgtgtttctcagctggtcactagtgtcttatgaagtttagtatctgctggtgaaatactttaattgatgaatcccctccacggtgtgagaagaattctcttgatgaggagttctcaccttctatggtgcaaaggcatcgccagtgaacagggtgatgcctctgtccagccatttataatgatgattccgacaggcaatctctagtggcctcatccaggttctgtggtgggtgggggccaagtgggataagacaggtggatgtgtcatcaccactgagacggagtggcatgtatttatgaagagtgagaaggctgactttgtcccctagggtcctcagaaccatagagtctgagttttctgaattgttgaaaataggactcagtcagagacatggatcgttggcatcttgttgagaatattctattcagcctgtggattcagaaaaacaaaatgcatatgtttgtgttccagtaggaggggagtaggcaggaatggggtgggagtggaaaaggaatgttggccaatggggaagggagagtgaggggtaaggaaacaagttagtccactgaaacagggatccaaatgcttactcagcatttgttgtctccaagagaaaaacaaattgaaaaatgagaatggaagatttcatttggaaatggccctgtgagtacgtgcttattttcagaggcgttccccataactgacagcagtcaatgacttctgattgggcaatggcctggccagccacacaggtagcccaatcatcatatgtattaatggtgcattcaaaaatttcatcatcctgggtcacaaaagatcatgacgactgtattataatacaataatggtattcatgcagtggcgcacagaaaattgtgtgtacttgacgcacaggcggtgtggaagcaggatttaaagtagaactcctgtcaaaaacctttcctccagagcctccactgcctcattctgtgatgtttcaatacgtcagtttctgctgttggtaaaacacatcttacctccccagtatgttggggagcagtgattgatgaaggaggattaatttgctgcttttcgggagggactccgtgcagtctccaggggattacatgtattatggtgtttccacagaaagctagaccagggattggctaaatctggcccactacgaattgttctactaccacaagctaaggatggttttcacattcgtaaaccgaggaaaagaaatcaaaagcggaacatttcgtgacctgtgaaaattatgtgaaattcagacatcagtgtccgtacataaaaatgttattggaacacagcacatgcaccagtctgcgtgttgtctgtggcagctttcatgctgtcacagtggagggagaggttgtgacagacacagcatggcccataaagcctaaaatattgacttgctggccctttacaaggaaggttcgccaacccttccactagactgttggaagcagagctcctcagttacgaaataaggtttttactgatccataaactatgatgtcattccagggcacaaaaatacctcctttgatccagggttctgttgtcatcctgtgacacgagaaagacccgacagtgggagtttagtggggaattttgcaaggactctcttaaagtgagatcaggctctgggctttaaggataaatttccagacctttctagaagtaacacaggattttctgcacggagaggggggtcaaaaatatttatagtaaagtggtagaattcaacaaagtatttttgggactttctctttgctgctgcagccccgaccggttttcccagggggaatctgaggatggcccctgaggagaggctgggcgtgtcagcatcactggcatttttcagtttgagatttggatgacagtttatatgcttcttaattgactttaacctgctgcccatccctagaagtaatagtaatggtaataaaagttacacaatcacatcgccacagctctgtcctgaagggcttgcatagctggatggagcacttaattgggatggtccactctgctggggaagtgcaggagactatgtgcctttggaattttcaactcttcagggtcaggaactgccagacctctcaggaaggatgaagcacgactctctctagttgctctcttatttacattgaggcccttgggtcagggtgaggctttgcgtctccaaggtagcctttgagctaatgaaacccactgtggggtgagagatgcgaaattaacctgatttgctgcaacttcctgtgcactgtcgggcttaccagccagtaggctgaagaacccttgagatctggcccttaccataaaatggagaggagtgtgcacaagtgcaaggtcgattaatgtcagaggagatgactgatgttggtaggtaaaattccacttccaagaaaagtatgtgtggtacaggtgacacctgattttcttactccaaatcacagatgatgttgaaaaaacaataataataacaatacacacacataacaggaaacactggtataatactatgtgccaggaactgctctgaatgctcttatatgaattgactttttttttgtttgattcttgttttttgagacagagtctcgctctgttgcccagtctggagggcagtggtatgatctcggcccactgcagcctctctttcctgggtgcaagcaattcttgggcctcagcctcctgagtagctgggatacagatgcgtgccaccgtgcccagctaattttttgtattttagtagagacggggtcttgtcatgttgcccaggctggtcttgaactcttggcctcaagcgatccacttgcctcagcctcccaaagtgctgagattagaggtgtgagccactgcgcccggctaacttgtttaattataccacagtcatatgaggagatactattattattctcatttgacaggtaaagagacagatagaaggccagaaatggttgttcatgcctgtaatcctaggactgtgagaggccaagacaggaggatcatttgagcccaggaatttgagaccagcctgggcaacatggagagatcttgtctctactgaaaataaaaattaaaaaaaattagctgagaccagaggattgcttgagcccaggagttcaaggctgcagtgagctatgattgcatcactgcattccagcctaggcaacagaggaaaatcctatatctaaaaacaacagcaacaaaaagagcggaggaacagaagacaaatccggtcctgatcaccctttgggaactctattgtctaatgtggcttagactcaagaatttcttattttgaaaagtatggtgctgggtacagagtagatagatcctcagtaatgctttctaaaaatattaaatattaaatatttaaatattttctgattttctattattactgatttgattttcctcatctagttctttctttgtaggccatataaaactatccctagaatgattaggatatcctttttttttttttcctggagcagtaaagttcttacatagctgaagttctagggaatgtattagtgtccaaatttgcaaagtgagttaatgacagggacacagttcaatattttatccacaaccttaggaactattccagaatggctatgatttaaatgaattttatcttactgttaatatttttaaaaattaaatattgagtaaggaaaatgtttataaaatatatgtatgataaaaagaatagtaatacaatgaacacttgtgtctacccaccacccagtttaagaaaaatatttcagctagacagggtggctcatgcctataatttcaacactttgggaggctgaggcaggaggattgcttgcggccaggattgagaccagcctgggcaacatagtgagacctcatccctataaaacatttaagaaataaatttaaacaaaagaaaaagaacatttcttctgggttgcctgggttcccctccctgatgctgtctgcgtctctcccccattagaggtcaccagtatttcagttctcagcttttctctgtagttttgccatgtgttatccctaaatcatatgttgttgagctttggtcatttttgaactttatatagatggaatcacactatactttttgtgacttgcttttttctcatagcattgcatttcccagattcctctctgctgttgtgtgtacctacggttcactcattttcattgatagagtgtccagtgtgtacataaaccatactgtttatctgttttgttgatgggctttgcggttgtttttgctgctttgaacatgcttgttaaattcctttttagaaaactaatgatcaggaggactcacttaagtgaaatagtttttctatgagaaaaacagttctacagtttaatgaaaattgtaatatctgcgccttgaacaaacagatgtagtttttattttaggacgcatgctaactacctatgaagtgggtttatttttagtggcttttttttggttaaatttttttccccagagttgaacaatgatttattttaatttctaaaccaaatcaaggcatttattgtaaaaccactagaaaataagtcttcccaatttaacagcatatgttttataaatattttaataaaatgaattttaaaatattaaataattttagttagaatgtgaagtacttctctaaattaaacattaataaagctttttcatccagagcaacaaaagaattgcattatataggtaaaatggcctctgccctactcacatttatttgcggactggaaaagtaatgtttatttctaacatatttttagcttcaaaagactttagaaaccttttgaaataatctgcagagctgtgcaaaggcaccgaggtttaggacaggcaggaagctatagtccactcagcattttttttttttttttgactggaaagaaaaccaaagcccagagtaattaaattgctcaaccaagatcactcggaggcttgcaatgcctttgaaatacaatgactctaaactagctatatgaatctgtactaccatttctaaattagaagccacaagttgctttttataataatatatattttgttgcttctgtgcatcttaatttattttatataatttaaaaaacaaagtcactaatcaaatccataatgacagtttgggatttgatttttaaaatgcttttctctaccctgttgactgtgccgagcctagagagtctatttagttcccgtaggctggtttctgggattgacaatatttccattgtcatacaactctgctgtcgccagtgatgttcgaggaccagcactacccttgaaggatcctgctgttgtgtcaacaaataatggcacaggcctctctgacagcttgtccacaaactctcctgagggtttctgtctgaaggaagcagcagctttgcaagagtgattttagtgaggtcgtttggattagattgagttagtgggccgtgagttccgtgcatttagggttgtgtgtgaggcttttcgtgttcttgaaatctcctccggccctcccggtcacacccctccagtgccacgttcagccctctctctctgcacccatcctgaaatagccatggttcagcatggaagaaatccactcctctcatctctcagtgctggtcagctccgcatttgcctgggggtgggttttgactgtcttctccttaaagagaatctctgcacgtgtaaaatctgtttcaggaaagtaataggaaggcagcaggacttggagcctgatggtgtggattcagcttccagttctgccgctcactgggtgacctgggcaggctgctcatggtgaaatgggtatagcgacacccgtgctcagggtttgctatagagattgagcgcagtctcctgaatctcgtgtggacaaaagatttcacctctgaaaaatatagaatcttagatgtttctgtctgtttctacagcagaaagccaggaaacacaatctgcaagaagctaggggtgtaataataaccaccagatccatccgtcagctgccctctctctgtgtgctccggtagcaccggcttatttaatgcatgacatcgactgtctctcccgtggggctctgagcttccttccagcaaagactgttccttcatcttggggcccctcacaccagcatacatttttgcacttagtagatggtcaaaatagtacggttttgaaccttactaaactgctcgtgtttctttacagcacttttcttctcttacttgatgtaggtaatatgttttctcttacttgacgtctccctgccctgggatttagggatcgccttggccccacacctgtggctttctgatattgccactcctccccactcacctttttttttttttgtctaagtatttataatatgcagtttgtcacacctagctagtagactatattttctgcagtgatctcttccagcttgggaattcttaaattaaaggatttatttgtaggtagtaaacagtctactttttaagaaaactctctaagttcatattgtctgtacttcatcatgagggataatggttcatttcaagttaatctacacgactcaagtgtaacccatgtggtgggtggggggacggggtgaggtggcagctgttcaacagtgcatagcaactcttcacaacagtttaaacatgaaaaaggaattggagtaatagaatatgctggaatttgatgaggacactgagagctacaggacgtgggatttgaacttgcagctgtagacaatgactgtgtctcctagaacccctgaactcttttgccccaagatgccccagaagaaagactggtggagttaccagctcatggattttacatcctatctattctcacacacaaatgaactcccataaagtagaggctgagtagttcttgtcaccttagtgtcccataaagctgatgataagaataactagaaaacctttaaaaacttacaaggctgggcacggtggctcacatctgtaatcccaacactttgggaggctgaagcaggaggattgcttgagcctgggaattcaagaccaccctgggcaacatagtgagacatcatctctacaaaaaatcaaaagttagccgggcgtggtggtatgtgcctgtagtcccagctccttgggaggctaaatggggaggatctcttgaacctggaagttccagactgcagtgagctgtggtcatgccattgcactcagcttgggtggacagagaccctgtctccaaaaaaaaaaaaaaaattcagagatgaaaagtgctaagaaactgaagtaattaacagtgctgacccatttgaaataaaattattcatgagctcacttgcctctttttgtgcacaggagattgtataggtggctatgattatttttataaaaaattggattctaaacaagtttatcaaatacttagtatccaccttaaaagctttcacgaattaaatttaacccttaaatgatgcagtgatccgcactgaactttctgattaaaacaaaggaaagctaacaacacttatcgtttcaactagagttcgttaaaaaaatattgtggaccatttacgcaccaggcgctatgtgaagactgcacagatgatggtgatgtgagcgtcagagcccctgccctcgttcttgtgggaggcacagatgagtaaatacgcagttaccagaatcatacgaccaattccatgatgggggaaggtgggtgtgctgagggacacctaactgagactgagacttggccgagcagttggtgagggcccagggagggcagcctctaagttgagacctacaagatgaaaaggaaggccgagaggaatgatctagcagaggcagaacatttctgaaatgagttctttttctgaacactatgttgaatacagctgaacattttctgatggttgaggatctcatgaccttcagggtaattgtttttatcaccaatctttagctatctagtgctgtggatgtcactgtataagatgtagtaggctattactgataacacgatctcaactgcatctttagaagttgcatttttaaaatgaacctgtgtaaactcaacctaatacttgtataatggaagcatgatgcagactgtgatggtgacttgggtgtttctgtagttacgtggttttggacttactgttgctccatacgtttatagctgttttgttttcttctcttcatcattgctgccttggagggtcagagtatgatccatgtgtcttgatgaaattaggtagggctttgtgttttaccaggaaaagaggctcactcgattaggctgggtttacttctagttttgtaatgcgcccctggagtagcatggatgagttgtttcacttcttttgaactctgtttctctttttggacagagatatcatgctaattgctgaagtgcctgaagattcttaaatatcaaataagacacttaggaaaacaccagatatgattatgtgtaaaatttgcctattccaagcacatgctcaataaatatttgctgaagtaattctaattgagagtttaaacattcacagttcatggcaaagcattggaatagttgcaacaggtgaactaaaaaataaatcttgttgctgttcccattggaaatttagaaccctgtgtttgagtattttcgattctggttcatccatcatttggttagctaggtttatcaaaattctgcatgggaggtcaggaaatgtgttagctcactttgtgtagaacacagttcagcattgttagtaaaagctaagtttgatttagttccagtagttggcttaatagaaccttaggagaaccaactagctaagcagggcagtgagagaagggatctacgtggctgtgtttgcttgacctcaaaagcctggggataactgtgttttgttcctttataatacagttgctcagagaaagtcatgctgtactctttacctccatgagcaccattctggaattgcagttcaacgtagggatattttcagcaagggaaaaagcataaacacttttctcaatgttcaaggaacatcatgacagactacctatatgatggtcccctgggtcagctcagattggcccaatggattagcctgtcagtggaatattgaattcataatatttagaacttcagtattgtaggctctctgggagtgcagttaattaggcagcttcttaattggattgctgttcttatgggaagaccttcatattgaccagagaggcaaagtgggatgacaagtcgtctggaatgtcaacagagcaagtttgactttaggttggctgctgctttctgcttctcttgaatctagagaccttctctctctctctacctctctgtctctctctctctctttttaaacaagatgaggtctcagtatgttatccgggctggtcttgaactctgtggcccaagcaatcctcctgtctcagcctctccagcagctaggattgacacaggacaggtgagccccagaattggggcttagtctgggcaggttcttggctttgcccagaaaagaattcaagggtgagctggtggtgttagatagcagcttttattgaagtggcagtgtacagcagcagcagagggacggctccctgcagagcaaggctaccccataagcagtgtgcccagaatagcagctcaggggcagttctacagtcacttatacccccttttaattatatgtaaattaagggtgatttatgcagacatttctaggaaaagggtagtaacttacaagtcattgggtcattgccatggaaaggggtggtaccttctgggtgctgcctggcaatggtaaactgacctggcacactagtggtcatgtcttatgggaagctgcctcccaccccagacctgttttagctagtcctcaacttggtctgatgtccaacttccacctgtggtgtctgagccctgcctctggcctcgagtccaacctcctacctcaggattccaggtgtgcatcaccatgcccagctgagacttggtcgttgattagaaccgtagacctttagagccaaagggtacttatgactgcttatctagtgagcaccttcatttgggagaggagaagtagaagtttaactcagctctgaaaacattcgttgagtgcttactttttgccaggttgagaggttgagggagcagctataatgatgcattatcctctcaaagagttcctgagtagtaaaggggtacaaacatattagaagtcaatttaaataccctgggcggtgctgtgaaaaaggtaataagcatggcggcaccatgggaccatgaaggaagtgggacttagcccagtctgtaggggaggctggggaagatcttctggatgagaaaacctaagctgaatcttaaaggataaatgagagttaaccaggagaacgagacttctggagtgaggctttggacattctgagaagaggggaaaatgtgaccaaagataaagtggctggaaacagatagtatgtgtctgggaactaagggtaggccaatattaatagaatgtaaagtatacattctatactcaagaaggcttgtgccgtggagattttattctgtaggctctggggaatcactgaatgggtttaagcaagagaataacataattggatttgggtttggggagaatcattgtggaggatgacgttgacagggataagattgaaggcaggagagcctgttgggaggcttctgccatcatccaggcaagagatgacccagggcggtggcaggcgtgggtcaaggatggagcagagggactcccagcatataatgggcaggagaaaattaggtgtctaagcaaaagcctacccagagagataaagaaagattagaaaagagagtcaagaagagaatttccagaggaacaagtgatcagctgtgttaaaggcagctgaaggatccaatgagataaagactgaaaagtggtcagagccgtgctccttaaaatgtgattcatgggccagcagtaccagtgatatctgggaacttgttaggagtgcaagatcctgctcttcactaagaaacatattctggatataaaaatggttgttgatgaccctgacattatcatcttcattggcatggttgagatagaatcaacattgcagtaaatttaggagttaatgggaaatgagacggtggaaataatatagtcttgcaagaaacttggctaaggtaggaaagagagaaattgttagagatggatataagttaagacatagttttagtatggcagagacttgaccacctgttttttagcttaaagcaaagtatagacagtttgaggtttatgaggaagttggataatgggtgatagtgagtcctggaggaaaccagaggggttggaaaataggtaaagtggctttatttctttaaattattttttaaaaattttagacttcaataatttaatcatgcaattttgtggttagaaagaggttgtagtgactataaattgacataggatatgtagacacaagatcagaaagagcaactaactccagcctgcagtttacacacagtggcttctgcaaggttgatccatttggccaaagttgtccatagcaccttgtaggtagagacttgtgataagtggatcaagcattcaaagaagccgggcacggtggctcacacctgtaattccagcactttgggaggctgaggcgggcagatcacttgaggtcaggagttggagaccagcctggccaacatggtgaaaccccgtctctgcgaaaaatacaaaaattagccaggtgtggtggcagacacctataattccagctacttcagaggctgaggtgagagaatcgcttgaacccagaaggcagaggttgtagtgagccaagattgcaccattgcactacggcctgggcaacagagcaagactctgtctcaaaaaaaaaaaaaagcattcaaagaaatgaaggccaacttccagaacatgtggttgacagtggtttttttttttttcagataaaataaatatgcaaaagacataaatatccttacatagaagtgtatgaacaaatataaatcatcgtagtgtatgggatgaggtgaaatgactgccattttagaggtgtgaagcttggctttccatccaactatgtgtctcagggtttccttaagaggcatcgctgtataccagcagaagcctgcagctttgggggcacagacctggcttgaattctcagtcccttacttcttagcatgttagcttgggcacattgcttagacacactgagcatttgtttccccattccaaaaaaaaaaggcatactcactacacaggattgttatgatgactaaaagacaaagtgtgcatgtaaactgtcagggatatcatactattataggcctgataagcatccaacagctgtttgaatgcataaatgagtgagtgaatgtaaaaatcagtgcatgactaggcaggccgtttaatattcaaatgtcactgtttccccatctgtaaaaaaaagggctaataatggtgccctttcatttatagtattttatacagagaaaaatgagctattcatgaaaatgctgttaatgaaatttaatgtttcagaaattaaagcaatcaatccactattttgtaaatactggggagacttcagtggtcagaggattaactggttggttaactctctttgtctcaggttcccagcagatcctctaaaggagaaatcagtgaattaatcactcagtcaacaactgctacttgaatgcctaagctatggaagatgccattgtagacacagagggagatccaaaccaaacaacaacaaaaaccctgggagtccttgtcctcaaggagcttaaagtctatcataacataagacattccaggaaggaagtgattcaggccaagtgaggagccaaacagcacacagtgaagaaggtattcagatgaggagaatggtatttgcaaatcaactctatatgcaaatgcatatttggagaagtaggcatgtagtaagaccaggtggaatactaatggtgtccttgaaagaaggctcagctgtcctcgtgttgcaatggcctcacctgcggctctgctgctttacagagctcccagctcaagtgggtttttccagcccctttgggttccccagtcaggtggccactgtcagtcatttactttgaaattgtttcttctactgcactcctaattgcttataaaataggtggtggaagaaattgaagtggatatattagggcagtgttgcaaacttaatttttatcatggggatgagatggccttgcactggctcatatttaaaggcttgtgtgaaatctagatgtctctgcatgttattcctagttcctccaggaggctgctactggtttctcagccttcaggagaggcagcctttactcttgcaccaccattttccaacataccgtaggccacagtccccactcggcactctgggagtgtttccccagctagaggtggtggtgccccgcttccccttatgactgtccattttacgtttgccatacaactggctggcatttcctactatagattttatgtggaatttccagtgcctggatgggaaaacagtaacttagccctcatcctgcttcttgctgaaatagtctttggttgctttcattacaattggagtttggatcacatggcaaattgtattttttaaatattttttagagacaggatctcattctgttgcccaggctggagtacagtggtgtgatcatagcttactgcagtcttgaactcctgggctcaagtgaccctcctgccttagcctcctgagtagatagatgggactacagatgtgtgctgccatgcccagctaatttttaagatttatctcagagacagggtcttgctatgttgcccaggctaactagtacttttctgaaaggcacagaaaggtcagcaggtataaggacaccaccagaacaagggtttggagtcctgcactggaaatccactctaatgaatgattctatcaaagatttcatgaaaaataatccagtatctatgttgtcctgaaattttcaacaaggaccactgtggagacccatacctacacacattgctgcactcattgctacacccatacctacacacattgctacacagccattttggtcacggttctgaatgacgttgccacgtcctgaagaaaaccccagtcagcttggagagggcagcgagggaggctgcaggctgacggggtgaacagtgcaccatccacagattacaagggcatgcctgtctcatgcgccaaccaaaatgatggtgggactcagtatcactccatgtgacacttatcaccttgctttgggtgattagaaccaattaagagggtgacacatagcagagatggagaaagaaaacacaagggcatcagtttttccccttttgcccaagagagaaagcaagtgtctgccatctgcccacttcctaagtccactttcaaattgctggataacctttagtttgtcagttgacctttccgggcttttccctgcctcccacttggttgataaaacaacagtgatgttacctgttctgcgagagtaatgttggctaataagcctggtgggaaattcttttctcttctgagggccttgctgttatttcatgtttcattcccaggaagacacaaagcctgtccatttggtgtgagcagtgaatggaggattccgacaggtgcccttgcaagcttcctggtggaggagccattccgagggcatcagtcttgttttgatcttttctcagatggaagacttgaatggagcactctctcagcctgtttagggggctctttgatcttgctgtgcctaataggcagaactctcctctctttttcctctgaggacaaaaataaacatagatgctgagtttgtgaacagctgcataaacaatgcaatttggaagtatgcaaaaatatgtgggttatatatacatccatacgtatagcctcttgatctgacttttgcatccttgtgaccaccgcttgatctgagagacatttccatctgatgcaatgatatccagtcccttttaatgctccaagggatttaaggcctcagagcatttggacagaagcatttctttcctctggatgtggctcaattctgggatatcccgactacagcacaataaaataactctccttaatgtgccaagagtaggctactcacactcttgagggtagttgacttgggttaattttctagaaggggtgatgatagagtttgcaagtctgaaaccaaactcatcacctttctgctaccgctgcctcctagggaaccctttcttttgacatccatccctatttatttaatgggatccccatttgtcccctcacataggcatggggctccaagtaccctttatttatctccttcactccttacctctgattagtctttataaactatagttcttttttgtttatttcttcattgatacttttagttcaggccattattaccagcactagtattgtggcagttccataactgacaatataactttacactttaagatgatagataaaatgtgattgtttggggaatacagatgacagaacagagagtactgacatatcctttaggctctcgggagaacatagaagaaatgatgactttcaataggcaaaaatggtttaaagtttagaaattctattttgcattctgaccctagtctccacgtcatgcatggttttgtatttgtgcctctgttgcgatgtcccctctgcctagaatgcttgcaattctttcttctaccaatcagagttatctctgttactcagagtccagatcatgtaccatctccttccctgaccactccaggcagaagtatttgctcttgctgctgatttctagaatgcttatattctttagtccacatttaagtgattgtcttgctttataggtacctatgtatgttacttatctatctcattactagattatgaattcctggacaaagaggtttttttcttaaacatatttgttacctactgagcatagcacagtgcctcgcctatggtaactctaaatcaatatttaaaaaataataaatggatggtactaaatcatgataaacacacattcatctgaaattccttgtgcccattgttttaaacaaacatttaaggagctcttcattcataaaagtcacacaaatctcatttaattcttacagtaatcctacagcaagtttcttttgtctttattacttttgtcttcattttcacagtttagaaaaatggctcaaagagattaattccttcagggctacccaacttggtagtagcagagtctaaacacaaattcaggtctacccgacaccagagtgcacactcatattcccgggctgtattgttccttgggtgacctatgtagagatacaaggtgaataaggcacagttccagcttctaaggagcctccagctagtggggagacagatgtgcaagcaacagttgtattgcagtaacatagctagtgtaggagaggtggctgctgtgacagtgcttggggaggtggaggagggaggacactgcaggcacctcccaaggctctgctctctgagaagggaccctgaaggaggtggaccccccagtcctgggctaaccagcctcaacggtgattgagttcataactgcctctttagttcagttgagcctgcatgtcatggcaaactaggacatcgaccctcagtttttggattcacatgaaataattgatgatgatgatgttgatgatgacagaatgggagcaaagggaccactggagtaattaaagaactggttttataggaatattttaaaaatcaggttaaaaaaatgcaactgtgactttcttctgttttcaagtatccaacccatggagttggaagcacttagtgggcagctaattaataaagctgacagtggtctactttatatcctactacgggaaggatattctaggatatgttgggcacacacctctgctcttgcgtatattccagtatagactctaagtcctacagcttgcgaatgggacctcagaagtcacttgtttaacctcctgcatgctgtagagccttcacccacagagcctcagagcctccatggtggtctcagtctctgcttgaatacggctggtggagaggacagcttcctataaccctactcagtcacatcagaccaaactcctacatcttcatgtaacacatttgagaaacctcagttgagcacctgttttgcgtatgatgctatttactagtgatacaagttgaagaagacacagctttccctcattaggggctcatttagttctattagcaattccttagatgacgttgtttccaaacccatccctgctctcaataccctcttttgcagagttacaggtcatttaaaacctgacttcaaaattggacataacactttatgcacagtctatgctttgcacttctgttgagacttgcgctaggatcagcccaaatcccatgttttactcatccccacttcacagacagctgtgaaatcagatgtttttcatattatacttattagtggataatacagttcagtaaactttgagtacctactaaatatgcagcactctactaaatgttgtctcgaaaatatgattctggactaagatgcagtttttggattcaagttcagtccagtaggaaagacatgcataaacagaaattatccatacagtgtggtaggggtgtgataaaaatgcatgcaagatgctcatcaaacacggaggaaaggctcttacccctcacttgcagtggaggagggtgtggatggggtcagagaagcaccctggaggatttggcgcctctgttaaaggttggagcacaggctgggcgcggtggctcacacctgtaatcccagcactttgggaggccaaggcgggccgatcatgaggtaaggagattgagacagagccagactccgtctcaaaaaaaaaaaaaaaaaaaaaaaaaaagttggagcacagatgaaagctaaccaagtgaagaaggagaagcgggcaaacagaacaacctctgcaggagtatggcatggaaaggcctggggcatttgggggactgacagaaggactagaacaatacatttggtgattagagaagaagctaaagagattggattcctgaaagccactggaagatatattcggttctgttgatgttagtccattttaagctttaaaaatcccgatgatgtcatgcaatacattactttttttgtgacatgagatttgatagaataccttttttgtttctagacacattttagtaaaaatttagtaaaaatattgaaaaaggaataataaaacaaggaccacagcccctcacaggccctagaagatagccattaatcaacccgcacagggatgcttagctcacagtgcgtcggttttgttcctgcatgacctggccctgcctgtctcttcactgtgcttcatccacatcctctttgctgttcctagaacataagcttttccgtgtttctggctcttaacctatgttgttccactctctggaacactctctggctggtgcttttcagcctttcgatttcttctgaaatgtctcctctttggagactatctcggcctccccaccctcagcctcccccatacatgctccatcactgaagcctgtttattcctttcatggtacagtatttaccccaagtcatgattaaatatctgtttatatatttctttattggattatttgtttatttttctctctctagactgcaagctccttgagcagaccatgtttattttgtctaccacaggtgctcaataaatatttttgactatttattacatgagaaggtttccatgcaaacacccattgaatacgattgaacttgaaccctaagagatgggctgtgacctttgttgccctcaaactaatcaaaggggagtgatattcaccatccagaatctagaataacttagaccttgtgggccaggagctagctacccatatgataatacaagagctctcagagaaatcatggaagttttgagcaatctctctctccctttgctaatttacttttcaaaactgaagtataatggaataacttccccacctctcaaatgtcagcatgctctgaaatttcatgttctctcaggcgagcgattcatgttttccatcccacccaccgttctctgccttgtgtttaaggatgtgagtgatagtctatctactagtctaggatgctactgaaaagtaaagcaaccaaatacttgcttttagtgaattcttcagtgtgttttttttaagggctcaagcacaatttttaaacggtctgttctaggatctctatcatcccccaccacatacacattccccccaccctccaggggcttggtaaccaagctgactaaaccataggcttgtttctcttttatgaaacaggaacatcttttagatgacgtggtgaaaagtgaatatatttgatgggataattgctgtccattcaccatttttaggattgataactttggaagagctggtaaaggttaagttctgccttagagaaacttttaccagtagctgttcttttattgtgcttttattgtgatatcaaaagtgcacgtggcctggtttgattttttcccctctttgcaaacttttaggacttgatttccatcctgtttcctgaaactttaaaatgatctgcattttggtgagtcttttttcattcattgttaagatggccaattcatcttattcacctgcagttaagaaatattctgttatagtcttttatttataatttcctccattattttttcttggaatttctaccaattggatattacaagtcctaggttgatccactaattttcttatctttctcttcccatttctctactttgtattctgactctgtgtcctatcttagaaccttgacttaacttatatgggccttaatagcctcatctataaaatggaattattgatggtacctttttacaaagatcaaatgtcaatgtacatttacaaatgaatagaaaatgtttatggaacagtacctagtgttgttaatattactttctacagatttgtctttgctctactattgttaatattatattctatatccttgcgttttaatctattttttattttttcctcaatttgatcttccagctgtcttctactttgaaaattcagctatcatatttttattttccaaaagttatttcttgttctcgaattgtttcctttttgaaatcacatactatttcctggatacagtattttttctcatctctctgaggatgttaatgacagctttctttataagtttttcttctaccccctgaattccctctgattatgccagtttccttttttccacctgtttgtttgatttctgtctttcatgtttgaggctttcctcagatgtttagtgacttgggccgtctctttatctgcaggaatgaagctctgagacactgaatgggaggggtgtgtggggctgtgtgtacatgaatgaatatgtgcacaccctgtgggccagcaggcctccctatagggtccaggcagggagcaagctgttagttgggagcctataaacaccagagccagtaggtcatttacggtggccatttggtttcactggagaagaatcccccagttttctgccagcaggtggggtgaagatacatgtctgcttctgggattgagagggttgagtcacagcagggttcaccccacagttctgcacacagccatccattaaactctctgccctctgctgtgcctgactctgcctggtccagaccctcttcagatcctgaactattgagatcatgttctcctcacagtatacacggtgcagccacagtatagccaagcccaaattataacaagattgtttccaagtacattcttagacaggcttgaaataggtctgtaatacacagatgtcccagtctctctgttggtgctatggtgacactctatgtggagcagagtgtttaaagaatagcagagtgggccgggcccagtggctcacgcctgtaatcccagcactttgggaggccgaggcgggtggatcacgaggtcaagagttcgagaccatcctggctaatatggtgaaaccccgtctctactaaaaatacaaaaaattagccgggcgtggtggcagatgcctgtagtcccagctactcgggaggctgaggcaggagaatggcgtgaatccgggaagcagagcttgcagtgagctgagatcgtgccactgcactccagcctgggtgacagagtgagactccatctccaaaaaaaaaaaaaaaaaaaagaattaaaagactagcagagtggatattactgaaaataatacggacatgaagaagttatgctcagcaaatagcactttcaggggagctttgcttacatggcaattctgtaagtgaattgcgggctcatgggctggatgatatcaggaagaaaatagtaagaatcgggatgaagcccatgtaaaggaaagttagagaaaaagggtttacatacccaaagacagaagcactgagagacttcattatagtctgcaacttgccaattagcaagtcaagaagaatttgttgacttttgatgtgtgctgggagctgagctacttctcagctctggccacacggcagaatcaccaggcccggccacaggccaattaaattagaatctctgcgggtggggcctcagcattaatattttttaaaggctcacaaggtcttttgaattgcagctgggatcgagactcataggaatggcgcctctctggaagagcatcagatagaaaataggactcctgtcctttcgaggaactcggttggagcttgaaatttaacatgcaaaatttaagcaacatataaagtgtttataagtgccaaagaagtagtttatggccgggcacggtggctcacacctgtaatcccagcactttgggaggccgaggcaggcagatcacaaggtcaggagattgacaccatcctggctaacatggtgaaaccccgtctctactaaaaacacaaaaagttagccgggcatggtggcgggcgcctgtagtcccagctactcgggaggctgaggcaggagaacggcgtgaacctgggaggcggagcttgcagtgaaccgagatcgcgtcactgcactccagcctgggctacagggcgagaatccatctcaaaaaaaaaaaacaaacaaaaaaagaagtagtttataaaatataggtagatgattttgaatagggagttactttggtacttggaatgtttatgattcaggacaggcaagaccccaaattgggactaagcctgggagggttctcggctttgcctaggaaagaattcaagggcaaggcagtggtattaaacagcaacgattattgaaacagcagtgtacagcagcaacagaggtcctgctccttgcagagcaggcagtgtgcccagagcagcagctcaaaggcagtctgcactcacattgatacccacttttaattatatgcaaattaaggggcaatttatgcagaaatttctaggaagagggcggtaacttctgggtcatctggtcattgctgtggaaaggggtggtaacgtctagctgttgccatggcaatggaaaacacgtggcacacactggtgggtgtgtcttatggaaagctgcttctgtctcggccctgttgcagctagtcctcactttggtcctgtatccaggtcccacctcttacctcagttagggactattaattgagtgccaatgatgtgtctggccctaaaataagttctgaagaggttcagagaataatacacagtatatgttctcaagaaacttctattttaggtagaggaaaaccaaaatataaagcttaaaaagaaccggagagctatttgatgctaaattatgtttggaaacttacgtgcagtgggagtttgaagaggaattcttaggtatgtttggaaaaagtttctagctgtaggtagaatttgagttttgccttaaagaactgcaaataattcatttaatttagtaatttaaaaagtgaataatgggtacatgctacttcccaggcaccgtgctaagcatttacatgaattatcttattctcgtaatatatttttgagctatgcattattattatctcttttcaacaggtagaaaaaccaaggcttatcaaacttaaaggaatttgtcaaaagccacgcaagttactaagtggtgaagccaaactcaaaagcagagctgtatggctcttgagctgggcttgtaaccactatctgtaggaccagagtcggcagcagagagaggccagagcgtggcaaatgtatttcttgaatactgagtaagtggcaggttatgctgagtagatatttggttggaaaggtgaattggggcccagttcaatttgtcaggggtcttgactaccatttcatggaatttaactttattttctggacgctggagagtccagaaggtttttgaggcaggggatacaatgttggaaagcattttctaggaaaccgtaaaggccggagataggggaaccaggtaaaaagatatctcagtggtcaaggcatgaagcttaggggcctgagagaggcgggtggaacggaaaatggtggggaaaggtgtcatcggcaccttggagaagaatcttctttatttctagagacagcagggatgtgagaatggacagtaggccgggcgcagtggctcacgcctgtaatcccagcactttgggaggccgaggcaggcggatcacgaggtcaggagatcgagacaatcctggctaacacggtgaaaacccgtctctactaaatacaaaaacaaaaattagccgggcgtggtggcgggcgcctgtattcccagctactggggaggctgaggcaggagaatggcatgaacctgggaggcagagcttgcagtgagccgagatcgcgccactgcactccagcctgggaggcagacggagactccatctcaaaaaaaaaaaagagagagcggacagtaatagctcggggattatttaggtttgatatcagtttgaacttccttacattaccgtgaggaagggaggttttggagttcagaatgtattaatacattcttcagagacttttaaggaaaaggcaaattgtgatttttttctgacacggtttaagttctgtctacattagttctaggcttgtaagtattgtatgacctttgactcaattcagttctggatataatttagtttaggccctgtgactaagctgttttatatggcttatctaagagctaccgagataaaggatttacataagtatagtctttcattctaatgttggactctggtaatacttctcagtatgccaataaaccttatttcccgttcccctgccttcttttctttagtattaatgatagccactaggttgggtgcagatctcaaggccgttctctactggatgagattctctccaagtctcagatgagaaacttccataaatcctttccctaggcttccataaccctatggttacacctaacccatgtcctcaaatcccatattagcattacatgcaaatgacagcactggggagaagcagggagtgaatcagagcctgttgatggctctgttttgattacagccatgggtttgcttaagaaagatattgtgccttcattgtgactggcatcaaaggtatgtgaagatactacctaagctaggtgtgagaagcccaaatacattattactaatgattttcataagggctaaagagtttaggccaaaaataattaaagagaacaatagtgctgtcaataaaactcctcaataatgagatagtaattaatggacgaatggcctcattgttctttttggctctaggcattaagcatctcattttaaaagttgtggtaagtagtgcaatattgctcatttatatttttatttagtactgttaatttatttcactttttatttaatcttaaatcttttattttaatataaaaattggaatgatcctctcctttccccccattataaactttacaagcaagagtggttttggtgctttggaactttctcagttcactccctatgataggtcctgtaatcaggctcttactacatgttttgatggtgttattgatgatcatgatgagtttcaggtgcgtttttgttgcctaataatacagattctctggtgttctctatgacttcattgtatggggtcagcctggccagttctcctcatggccctttctccctttaagccccagaagccatcgggaaaagcctttcaccttattttttcagcaaagcctgcaggatgccatggggggatactcttacaggactattctaggcagcaagttttcttcatacagtggttcagagattttggataagcaataagaatggttctgctgggcccactggtcataacttgtctaattaatgcatgtcccattacttttgatatgtctcccttctccccaggaaacatcagatgcttgcaaaccattttccatatcacagagcaccgggccctggaatctttcttgggccccttcttaagactagattgctcaaagagttgtaggccaaggaatgaatgtatcctgtgttgcacaaaatacatttagatatttatcaagacttaatttaatgaacttttcctcccttgctccaactttactttgtaaccctcctcctgaagaaaaggtgccaacattccactttaagtctaagctgaaatcatagatgatcctaagtgttttagaagtaaattagtgactcaagtcccaccagttttcctctgtcttccaaatgacactttttcctgaggcttccgattggatccaacgtgactggggcttttagcccccttcttaggctcctcagagtccatgctgagaatgactcagccaatttcagagatatggattccttttgaagacccctgtttcatctttgacttttataggaaaggttggattggatgggctggctgttctctgtgtgggcacttgaaaggtaaggccttcgaacttggccttcgggtgtgttcagggccagggacttgtacacagaggaagtctggatgtgctttttaaatcttagcactgtgacttgagttttgccatttcaccttgcagtgtttgggaatcgtgtcgtagattgttgacctagccttgacactcagtggttgttgaggagtgaggagggtgtggctagggggcggaggtgggaatgttggttgagaaagactaccaaaatgttagtgtgttgagaagtaacaggaacagtgcttgggcatggaaaagtttggcatgacagcctcttcctacagaaactttcccagaaatttctcaggaggaaggagttggctcagggtttccaatggattatctttggctatgatgcccaaagaatcttgacactaaggatttatagcttttactagttctgaatattaagaaatagtagagtccattaaaaatgcttggagtttgttgatatgttgggggctggtcatttcctccttgaactctgacctgctagaagctctaatgagtcatgaatgggctaatgagttgtcacctttagtttatatttaaatactaccttagagatgtgaaaacttgaacctgactctcatagcttcattatggacccacaaatgtaaccgactggatggatggtttccactgagattttggcctggtgtaattcggctgctgcttgaggctatttttggaggcttttggagtatcgtaggagtacatctatccagtgtctttgtttttttttttttttaatttttatttatttatttatttatttttgagacagagcctcgctgtgtcacccaggctggagtacagtggcgcaatctcagctcactgcaagctccgcctcccgggttcacgccattctcctgcctcagcctccccagtagctgggactgcaggctcccgccaccacgcccggctaattttttatatttttagtagagatggggtttcactgtgttagccaggatggtctcgaactcctgacctcgtgatccacccaccttggcctcccaaagtgctgggactacaggtgtgagccaccgtgcctggcccagtgtctttatttttattttaaaagatattacagcactcctgtcttctgccagtgctttgctaagttgtgggataataaaatggacacagctagatgggaagggtcactgctctgccctgactcagctccattccccaggacagggaggccacgtcccaggaatatttcttatctcctgctctcagctgtgcggtgaagagggaaggcagatctttcctgaaaggatcaggtggcagctggatggagagtggtgggcttgggtcactagaagagagctggggcccaacgaaaggaacgcgtgcctgcagggcaaactgcattttaaactcttctctttcagggcctaaaagttgcttttgtcaaaaatcctcttttctgtgccaaacctgaatagcagagatgaaagcacgctacagctgttggaggggtgtaggtctgctgcagaatcagagtctgtgttggttgttacacttggtgtgggaactgggttctccgatgctgactgcaagagaggagatgtttggcgaaggattgtgctagtccagagttcctctgtcagatcataacagtagcctccatttgtatggcctttgcagtttataatagtgcctatacaataaaatatgtcaaatattacattgtcattttcgtaagtttctattttctgatgcagtttcaaaaccttgttctggtacccatcttattaagtaggcagaagagatcctgcagtttaaaaatagatactttaaaattctgtgctttgaaataatcttggtaaaattcgacactgcagcttattgaccttatttttctttctgtagagagaatgatgatttttgaccctgtaatcctgagcttagaacctagggagaagaggaagcatttatttgtttttgcactttgttttgtaccacatttggtaggttgttaccagctgaggaagtaaattgactaatcaggggaaacccaaagcactattgatatctatctctaggcgtaatggttgcaaattctataaaaaggcctctctgcttctcatgtggtcaataaggaaatggctcatggaaaatgagaaaatacctgaacagctggctgtaaatctgagttctctgcccacgggtgtggcttggctcagttctttggacttggtaatggggtcattatttctgtattcgatggatttcagaatgtcatgttatttcagcccaagcggttccccaggaaacacaactatttgccctcttcttcccagcactgaaactagagtgccttctttctcccagtcagggagaaacctctccaaatagggcttcctttatcttgtagaagttgcttagcttttctgtatgtgggaacatacatagctttttttagtgtatacatttctacagtttgaaattttctacattgaaacatattgtttcctattgggaagaagttgatgtgatctctatcacgaatgaaaacatatcctttatactgcctttttcttttgggaattgggtaccctgtcatgagaattacgggggcctattctcaagtagtataacgaacgcctggcatagctcattattaacacaccctacaaggttttaactatgttggaatgcacatcaactgcctggaagacagaatgtcagaaaggaaagtctctggtaagttgtacagaaagtcctcaaacaacatcgtttcattcaatgttgtttcattataacgttgatgaaaaacattaatcttggcctggccactgtccgtgtggagtttgcacgttctctccatgtctgcgtgggttttctctgggtccttcagtttcctcccatgtcccaaagctgcgcacatgaggtgaacaggcgtgcctacatggtccctgtgtgagtgagtgtgggtgtacatgtgagtgcgccctgtgttggggggtgtcctgtccagggccggcccccgcctggcaccctgagctgctgagaagcttctggccacctgcacccctgaactggaaaaactgggtaaatacttaccctacttcattttattaatcattcttcaatgtttatgtagttcatatttatttcagtgtttcatattagaaatctcttggcctttgtttggaagtttgatgtttttgtcgctagaaacgtgctgtaggaacttcactcttgtttatatcaattggcctgtgggaaaattggtttcttatattggtttcacttaaagccgaagtttccaagaacctttctataatattaagtgaggactttattttagaattgtgggaggtagcgtgatatatacttaaaggaggatggccatgaatccaacagacttctgctcaaatctcagacatgtgacctcatcatgggatagtttctgtgtggagtgaaggatgtatgtgcaaagtccagcccctagtggtgcccagtgagtgttccttccttttgtccctctgtccttggccttgagacttgtgggggaatctaaaagacaccaggctgatttaggtcttgtggagcctctctgcttgtgggcggttgactcttcctgaggccctcaccacaggtgcagcattactggcaatattattattattattcttgtttttgagatggagtctcactctgtcgtccaggctggagtgcagtggcacaatctcggctcactgcagcctccgcctcccgggttcaagcgattctcatgcctcggcctcccaagtagctgagattacatgcattagccaccacgtctggctaatttttgcatttttagtagaaatgaggtctcaccatgttggccaggttgttctctaacttctgacctcaggtgatccgcctgcatcggcctcccaaagtgctgggatgagcacaaaggcatgagccactgcacccggcctatcaatattattttttagtgaacaaatcagtgtcagtgttgtgggcctttgggttgtaacgcaatccaaggtctactgttcctttcccccctcctcctaaacatgtattagccaaatttggggaaattttccaagcagaagctttttggattggctgttaatacatcacatcattagctgtgaatcttggatacactcaagctctcccaaaaatagaccacatgaaggaggaaaataagaacccgaggccatgcaagcactcagtatttggtggctcttgcccagaaaggcaatacagtgatgtgaacagaacactcgttttctctcctctggaggcctgagctctgtttctagttcggacctcagctttcttctgtgtgactttgtttaatgccctctgcctcatccatcaaagactggattagaaaaaataatctctcttctgttatttagtgtgttattagctataaatcacctaatctcaaagtcttaattgtgcatggtgcaaatatagtcttttgcctttcgtagttacagtctggatcacccatgggaatatcaggtaagtaaatagtttatagtttattacttcacctccttgtgaactgagatgattgagcagagctggagaagttgatatgcatgcattaatattttgttctttgcacacgtattcaactaatatttgttcagttgataccctgtgcaaagtacaggaagaacactgtgggagatagaagtaaaaggcaaaaactttaaatgtggttgagaaatattagagagacatattgtttcctagtgtaatattagtcataaaatcattgtaccttggtaccaaaaagggaccttcaaaatcatctcattccctcatttacggatgaggaatattcagagcaagaaagacctcactgtggcccagaggctgagcaagtttaacggggttgtcaaggccagagttcaaccttcatagacaggatttggctccgtgcaagggaagagaaaggccttcttgctgtagggagcaactgtctttggtcctggtagccagttggataccgtggtttgcgaaccgatgtgcattgtgttgcaaaatcttattgctgttattcctgtggttaccccttattatagtagtgtcttcaagaggaagactcaaacatgagtaaatattgatgtctcatgtaaaaattttccctcaactgtttggggatgcactggctgccatttattcttaacagcttaaataaaagagaaagggagaggaactctcattctatccaacaaaatccttccatcaaacacagagcttccctttcctccttacttcaacaggtagattccttcaaagttggaatcctttttgtaacatagtttgatgacccctgtgtgcattggatgcataatcactaaggatacacatctattagaaatgaatagaataccaaaaagagaaaatcaatgggattccatagaagtcatataactgactgcgtgagatggaaacatcctgatggaaatgcctgtatgatgccagtcatcacagtaatgggaaatcttccgatcactgactatattttgggggccttgccagacactggtttgtttgcaggtgctccggtttaatgacttgccttcatgttccagcaacgagctcttcctgcttgtccttactctgtggaaccaattccaacatcagaagttgaaatgaggcacaaatgccttttcctctattttctctactcctcaggtttttggttttacttttttttttggacagttataatttggcaaatttgtatacttttatactggcatatcttaaacttttacctgttgctttatatcattcagtttggatcacattggaatctcagctaacctcattcttagaatgtcagttaaatgccactctttcatgagaatcctgatggcctatacttggttagatcttcctgaatactctttttcctccccttagagatggggtcttgctctgttgtccaggctggcctcgattgcctggcttcaaatgatctcctgcctcatctttcccaagtgctagctttacagacatgagccactgtgcccagcccctcaacactctttatagcacctgaactactgctttttaaatcatctgccatcctggctagaccctacgctggacaaggacctggtctgtcttttatgcatttatttaattaaattttcttccttttcctttttttagagatagagtctcactcttgacacccaggctgcagtgcaatggtgcaatcgtagctcactgcctcctccaactcctcggttcaagtgatcctcctgcctcagccccccaagtagctaggactacaggcacacaccaccacacctggctaatttttaaaatttccattgagatggggtctcactatgtcgcctaggttgatctcgaatttctggcttcaaacgatcctcctgcctcagcctcccaaagtgctgggattacaggcgtgagccatcgtgtccagccaggacatggtcttctcgtgtattgttttatccccagttagtgtgtagatctcttgtgtgtacagtagggattccacaatttatttagttgaattggattttattctctttttttttttttttgagatggagtttcactcttttcgcccggactggagtgcaatggcaccatctcggctcacggaaacctctacctcccaggttcaagtgattctcctgcctcagcctcccaagtcataggcattacaggtgcccatcaccacacctagctaattttgtatttttaatagagatggggtttcaccatgttggccaggctggtctcagactcccgacctcagatgatccacatgccttggcctcccaaagtgctgggattacaggcatgagccaccctgcccagccagattttattctcttttatctccctttgtttttaattctttgcaactaagtcaagccatagagagatttaagtcaggattagaatgtgtagggagaagaatgaaatcagattggatttttttttttttttcccaagacggagtcttgctctgtcacccaggctggagtgtaatggcgtgatctcagctcactgcaacctccgcctcccagattcaagcagttctcctgcctcaggctcccgagtagctgggattacaggcacctgccaccacgcccggctaatttttgtataattagtagagacagggtttcaccatgttggccaagctggtctcgaactcctgaccccttgatccacccaccttggcctcccaaagtgctgggattacgggcttgagccactgcacccggcccagattggatttttaaaattacatatttttttgcatgtaatcaggaacttgcctgtggacccagggggccacatgcagaaaggtaatctccagtggctttttctagtaactgggtccagtgccctgacattgtgcacatctccccagcatgcctggtggagattcctaaaccagggctatagtccacttccagggccatagtcagagaaggggagaaagtttcaaaacttatgtgaaaaggctaatgagtaacctcattgaatgtttatcattcttgaaattctctttggccattttactagtcctgtactctctggcttgtgctgctgcctcttatgctatataatgcctgtctcttctattgatgatttcctcttccagccctgttgatgaagatgtactccaaggtccagtccttcatcctctgtttctttctctctctctccttttttttttttttgttgagatggagtctcactctattgcccaggctggagtgcagttggctcactgtaacctccacctcctaggttcaagcgattctcctgcctcagcctcccgagtaactgggactacaggtgcctgccaccatgcctggctaatgtttgtatttttaatagagacagggtttcactatattggtgaggctggcctcgaactcttgaccttgtgatcctcccaccttggcctcccaaagtgttgggattacaggcatgagccactgcgcccagtccatcctcttgtttcttaaatctttcttcttgggagatgaattctgctttcaacccttcaactttggttttgagtgaatttatgcattcatctcagagcccttctggggagcatcagcttgtgactgtctctgacacttggatgtgtgattgtcacttcaaactgtaagcctcatgttttctcccaaaacattcccacgttgcagacatcagatttctctcaatggccctaaatccagcagtcacctcgagcgtcttgagtcttccccttcctgtgtgtctgcctgtcttctccccaccctgcaggttgtttccagatactactggattttcctcgacaatgcctctggaatccatcccttccttcccctcttggaactcagttcctgctcttttcacagctcaccctgtcaccaggcactgtactctctagaattcctacacttcctacaccactcagcctttgccacatgtttcttcatttccctctttacctttaaataattagtttttttgagggcagagatcaggaattgcttctcttcttgtctctaccagtcagcacagagctgagtagctgttcaacagagttccctaatgatgatgacagtgaaccagaggattcctcccaggaaattttgtgtgtggactttgcctctgtgaatgccaggatgtcagctagaaatgattgagcacaagctatgaggcagagggatggatgaggttagcacaacaaagcagtgttgtgacttcttagtgaatagagacatctttacaatatggaacattcactggatctgctaagttgggtgattgaaaaaaatcagtgccttttttggaatagttcttcattgtctttcatactcatttgcaatgttatcccccaacaagcttgtagagaagtattactattgcctttttatagaagagaaaacagaagcttcgaaatatgaccaaggtcatagagctcaaaggtgtcagaaccacatctctagccctgaaatcctgattccaggtaaaatcaattcaacaaagcatggagttaagcaccaggaagatggagtttcaaatttttttcctaaagaagttttcaatctcgtgagaaacagatgggtaaacaacataactcctaattcaaggtttgaattaagtaagagtgaatcaggacacaaacagaatgtgtgggtgcatgaaggtaggagtgagtgattctgtctttgtactaaacagcagctgttcctggcagctttccgtcagggagtgcttgtgaagcatggatgaaagcaggtgtgggtgtatatggaaaacagcatggccgggaggagaaagaccacaccatgtccatgtgctaactggccaatggaggtgaagggtggtggaggctgcgggctggatgatgactgaattaggtgatgtgacattttaggcagcatgagaaagtctagaaacctacctgttgggctagcttaatcgatctcacttagctccagcattgctgagtggttttgtgggtgtctacatttctagtgatattgcagggataaggtgataagacttggcttgtctctgcaaagtgaagaatatgaaaagaaggtgtgaagcaatcaggcttccaaggtctctctgatgtcctttgcttattttccaaactttcttcatttttctaaatctccccaatcttttctccccactccacctctctgccctttatttttaaacctttgtaaacttcttaagtttttatttaactggagggttattccagagtctctatcatggtagtctaatatggattttagaataaatttattccgtgtttctaattcatttacatttaactcacaaaatgcccttcctccttttttttttttttttaatgaggtagttaatgttgctaagacattttgtcagcctttgagttggcctcttaaaacattttctgttttcttcagtcacacaaaactggaatctgtagagagtgcatctgtttcattcactcttgctggactagaaacttggtgaatcacagttaaaaggctactcagaatctctttgtatttcctccctccctctgtcctcctctctcctaggcttacagattatgcgtatggggacacggtcatggaactttcacatctggtgaccaccaacactcagctcgctctcagcataagacagggcaaagtaacttactttaaccaccctgtatctgttttccatgctggtttttttttgttttttttttgagacagagtctcactctgttgcccaggctggagtggagtggcacaatctcggctcactgcaacctccatctatcgagttaaagcaattcatctgcctcagcctcacaagtagctgggattacaggtgtgcaccaccacgcctggctaatttttgtatttctagtagagatggggtttcaccatgttggttggccaggctggtcttgaactcctgacctcaggtgatcctcccacctcagcctcccaaagtgctgggattataggcgtgagccaccacacctggccccgctgcctgcagtttttagaaattggctttggttctgtcttgtgacccccaactccatccttccttgcctgttactaaccttgagaagggctgtgccttgggaccctcaaacttttctgtggatttttttttttttaacagatctactaaacccaagtaactatttggggagtgttggtagttttaggaagatgtccagccaggtgagcccttcctctgacttctctgagctccctggttgctgtcagtctcggtatatggctgcaagggcattggaagacttccattgagcaaagagaaactggccgactctgctactgctgaatcttgctttgcatgtgaatgcacagatgataagaagatacgtatgcatgcttcacaagtaggtgtgctttcttgataagaaaattaatctactttaatttggctcaatcactgagcattatgaaactaagtgaagggagagaaagaaagggaaccaagtgccccctgggcacttcacatacattaatgccgttaatcctcacgataatccaggagggagaactgttattggcctaactttataggacattgaaatcaagaaagacttggtaacctgctcactgtgtgagtcaggaatagaggccttattttttccactacctcaaactaccagccagttggtaggaacgggagcttaggggaatacttcggtgtgggtgattttatgttttttttctaggaaactcagctatagctgcccagttatccatggcgtacatcttccaggttatctgcatacttctggaccagtgtctttgtgtgtgcgttgtttatgtccctctgaagctttctgtgtatatataggtcacacattcctgcaatgtaaatcagtcaagcaggcagcttagaaattcttatccattcagacctttggcctttgcttgtgtaaactggaaatgtgggtgtggagagtcaatgtggggactagaatgttggaagaatagaagagaagcccacaggaggtgtgtgagggcagaaactgtacttgggggattttgccctgaggttcaagtatggctgtagctgcggggacctggcttctgccatgaaggaggacttagatggaggagctgtgccaagaaccagcaaccctggagtgggtacatgcctggcccaagcatgttcacatgcacgagttcactgacagctttcagaaccagcatgactgaaaatactctgtttagcctaccaaatgttccacatctccccaagctcccaggatgtctccggcacccaccaaccactcatgtactcaggttttccagaatccaaaaacagattctcaaaaaggccgaacatttggcagggaagtatttctaggtaaatgatatgcacagttatgtgatctccatcccagagggaaacattggctaagaggattggttgaagaaaaacaactattagaaaatgtgttcaatggggtcatgtttatgctccttctgtcaactaaaactgtgtgtttaaacaatgtctttggtttattacagtcatcacactgtcagtagcagataatgtgcttgaatttcacaagtgtatgtaaatgatctagggtagcagggcagctgtccccagtcaacgttttcacattgtgataattctcaggaaagagaaagacatacttaagagttgtacgttatctgtcttctcagtaaccaaagtgtctcctaatgtatgcattaatttataatttggcactgtttttaaaacctgggtttgatttttagtcaaaatacagatttatggtgggatttatttcacagtacttttttgcaagagtaggaaatgttggaatgcaagcgctttgtgaaattaaagctctgggtcaatgctactttgttggaaatcaagtcatatattaaaattagaaaagacagcaagcagctggctcaagtatattttgtctcacttttctgctccccatgggcttgcttttcggagagatccagtggtttgtagcacacacattacccaccaactcccattccagccgtgcctgttcttctgaactttagagacacatatcaaataccaagagctcaagacagtgcctcattgcgattctatttgttgacaatggtgatccttttaagatcctgaaatgtttctcagcatcacggcagctttgtgtgtgcgcctccaacttcacgggggcgctctcagccagtggggaagagtacactcttagagcggaatttgcatcagaacgttgggtcaagattgctgaaacaatggactttggtgattaggatgttgctttaagtcactattatttattagaagttgtgtttttttttttttttcatgaagatttttcattaggtttaagctttatggaaccaaattgcccaaatctctggaagtcatttttaaataaccagcaattgcttttcagcctactaaaggataggatcatcagtagaatcatttctataaattaatctataaggttagtgtaactctaatcaagtttttaatgggacttgctttctttagagtctaacaagttgatttctaaagttcaactggaggccgggcatggtggctcacacttgtaatcccagcactttgggaggctgaggtggaaggatcacttgaggtcaagtgtttgagaccagcctgggcaacacagggagaccctgcctctaaaaaaaaattagcagagtgtggtagcatgtgcctgtagtcccagctacttgggaggctgagacaggaggattgtttgaacctaggagttcaaggttacagtgacctatgattgcaccactgtactccagcctgggtggcagagggagaccctgtctctaaggaaaaaaaacggaagttcaactggaaaaataaattaatgtcaatagccaagaaaattctgtaagcaaaataaaggggggactcgttctaccagataagaaaactccctaaaaccccacaatcattaaagtggagtgatcctataataggatcatatattagttcagtagaacaggacaaaatctgggaatagacccatgtatacataatataacccaactatttctagggccccatatggcctagtggatgtaaatcagaaatctgactgtggaagccttgaatatgaagatctttattttacttgttcctaaaggagtatattcatggatttcacaaagtatactccctaaaatattttccagaaatcttgtctaaatagccttcactctcctgcaaggtgcaaactcacggcagcctctaaaaatgtgtccccatctctctggtcttcgtggttttctaactttctcttcccccaccattccctgccccccatacattgtgttcccaatttgtgaccacctccacagagggcagcccttgggaagggtagtttttttccccagttggctgcttttctggagagcgggatattcccggaattctgctgatggaaattccccaggagactcccagaattctgatgagcaaaaattcccaacttcatttctttgggaatttactatatcttaaccctgccattttaagtcactgaactagtcaatatatggtgttagggtttttggctatccattcagaaaaaatgtgacatacttatattttgtaaaataaccattttgtaactatatgtttcaatagattaatatacatattactggatttaggtcatatatatatatgtacataggaacaattctgtaagtttatctctaagatttggggttgaaagcagtgaggggagtcttctactttatgtagttttgaattgttttaaatttattttgtagcaaatgtgtgtaacattttaattttttttgaaatttccttttaatttatatttagtaaaaattcactattttggtagaagagcaagttttgacaaatgcaaaaaattatataaccaccaccgtggttaagatacaaaacaatcttagcacctcccctggcatctcctccagtcccagccagttctcctgtgcttcccctttgtggttaagctcttccccgacccttaacctctggcagtctattctctattcctagttatgcctttcctgtaatgtcctataatagaatcatatagccttttgagtctggcctctttcacttaagcatagtcatttgagattcatccactattcatcaagttttttgttttgttttatttttttgaaacagagtcttgctctgtcgcccaggctggagtgcagtggcatgatctctgctctctgcaaccttcacttcccgggttccagcaattctcatgccacagcctcctaagtagctcgtattataagcacgcaccaccacgcccgactaacttttgtatttttagtagagacagggtttcgccatgttggccaggctggtctcaaagtcctggcctcaagagatctaccacctcggcctcccagtgtgcatcaatcgttttattgctttatatttctgagtagtatttcgttgtgtgtctgtaccagtttttgtttatccatccccaaatgagggacatttggattgtttctagtttttgataattactaataattctgctataaacatctgtatacagggttttgtgttctcttttcacttgggttaatatctggggggttttgctaggtcaaatggtaagcgtttgtttaactttataagaaactactaattctctttccaaagaggccgtaccagtttgcattctcgccagcaatgaaggagagttccagttgctccacatcctcaccagcacttgatattgtcagttcattaaaaacgtcaactgttctagcagctgtgtaacagtacctctctgtggtttttaatttgcatttccttcattagaatcttttcatgtgctaatttgccatatgtagaacctctttggtaaagtgtcttttcaaaactttggcacgttgttatagggttattttttaattgtcaaactttgagagttctttatatattccgggtaaaaatcatttgtcaggtgtgagatttgtcaggtctcacagtctgcagcttttttcattttcttaacagtatcttttacagagcaaaaattgttaattttgatgaagaccagttttttgcctttttattttatgcatcatgcttttggtgtcatggctaagaattctctacctaacccagtgtcacagagatttttctctaatgtttctttctaaaaattttataggtttgtgtttctactgaaggtctatgatccattttgagtgaatttttaaaataatttatgaggtcaaggctcttattattttatttatttttatttttatttttattttttgcatctggatgtccaattgctccagcaccatttttttaagcaattatttttaaaaatttttattttacttattatttattttttgaaatggagtgttatgagtgcagtggcatgatctcagctcactgcaacctccgcctcccgggttcaagggattcttatgactcagcctcacaagtagctgggattacaggtgcgtgccaccacaccagctaatttttgtatttctagtaaagacgggctttcgtcatattggccaggcttgtctcgaactcctgacctcaagtaatctgcccacctcggcctcccaaagtgctaggattacaggtgtgagccaccacacccagcctcatttgttgaaaagactactatttctccacattaaatgatgtttcttttaaaagaatgaatgtgattcaagaacccaaacatcttttgacataaagggagaaaattgacataaagcgagaaaattctctagacctttggattctgaatgggctaaagagcccccctttcccaggagaacacccacaatgtttgttttactagaagtgtcataaaactaaacacattttatactcaatttctgggatttctagactgattttctttgcctagcttttagaagaagttttaaccactccttgggatcaagggtcaatgaaagattattctttttgacaaactgaacataaaattaaactttagaatgggaatgaaacttataactcatttaatgtaactttcctttttaaaaaattttaaaaaaaagatacgcacctgtgcaaaatgtgaacaatgcagaagtatcatctagatttggggatgccaagggacatgggctttcctactgcttctctgtcccctcctcagtgtctttggccggctcgtcttcctctctgtgacctgagatgttggcgtgccccagagttcagcccttgtatttcttcatttttttattccacccactcccttggtgatctcatgcaatcccatggtccaatatgccacatagactcccaggaattgtgtctctaacccaacctctatctgactgactcctcaacatgtgcaagatgtctaatagcaacttacctaacacagaaatcatggttttctcacttaatcctgctttttgcccagtctttcccatcttggtaaagggcaccatccttcctccagttgctaagaccaaaacgtcaggcctctcctggcaactctctctctcatacctgacattcagtccttcaacaagtcctctcaaccttaactataaaatgcaccccctctcactgctgtagctgctgcctctggtctactggcctcctcactggtttctctgctcccaccctggcccctgcagtccaacctccttagggatcatttaagacatcagtcagatcatgtcctccctcagctcacatcttgccaatggcttttttaaaaatcacattttgaataaaatccaagtgatttgccctgacctacagggccctgcgtaatcgggctccaacagatctcttcccagttttctctcctgtgacttctgcccttgcctactctgcctttctgctggtctttcaacccatgctcattcggcctttagggctttgcctgtgctggttctggggctggggtgcttgtcccgtaccttctccaggctctcctctgcgtgggggtgcttacctgcagaagggtcatcttcccaccatggccttccctgactcctcatccccaatactgccctctgccccacctgccccatcttcacactttgctgtatttttcatcatagtttatcactacctggcactatttacatatttacttgtttatttgtttgctgtctgcctccccaaatggatgtaagctccatgaaggtaggactttatagtattcgttgctatctccccagcttccagagcggagtgtagcccatagtagatgctcagtaaatattcatggctggattgaatgcaggattagatgcaaatgtgtagattccttttcaccctgttttattccaagcccagaggttatcactgttaacagtttgataactagccttctagacttttaaaaatgcatttataaaggcagacaaaaaaaaaatcatagttttaaagaataatacaaatgattttacatcatatttttctcaataatatattaggtattttctcgtattagtttatatatagtttatccatctattcatctctctttctcatcagtttatatgttttttttttaagagacagaatctctgactgggcacgatggctcacacctataatcctaacattttgggaggctgaaattggaggattgcttgaggccaagagttcaaaaccagcctgggcaacagagaccctgtctctactttaaaaaaaaaaaaaaagtaagtaaaaaaaaaaaaaaaaaaaaaaacagagacacggtctcactctgttgcccaggctggtcttgaactgctggcttcaagcagtcctccagcctcagcctgccaaagtgctgagccaccacacctgaactagatagtactttttaatggttacattgtagttcatactatggatgtaccacaatttatttaattattttcctgttgagagatattaatatataggttatttcccctgctcatgattataagcaaggctgcagtgaatatgcttgtatataaatctttgtacgcatagacctcaaattacgaaattcccctgtcagtgacttggtagatactgcttaatttgtcctcaaggattatactgttttatactcccaccaacaatatatgaatgcctatttccccgtatgcttgccaatgctagatattaccacactttcaaaatattattcaatgttgggtaaaaaaatatttaactctcttacaaaagagaaaggtgatacaaagccttccttacaggtggattgttagtcatttcctataatgataagcttcttagtttctagattacacattagcctgctaaagaaagatagtctcttttgaaagaagtgacagacttaaaggagtaaggtgatttaagatgagaaacatcttatgcctttttaagaagcttccaacttcttttccaagaagtatcatttcaggatgtgtgctgtgagatccaaaccacaagcccacatatcctcattttcttgctctaaaatatcactcccaggtgatttttttttcttaaaaagaatccacagcacaaaacatcaagtgttggagttggctggagagttaatggaagttgtagcaagtggtgatttattgttatttaaccactttgtggtttctgctgggcctagctagaagtgtactcaaagaataagagaagctatttgttttatcaactgtgactgggggccaaacaaaggcatgggaaggaataagaagagaaatgccaacccagagaagagagctggagcacaggtagtacctggatgcttctgtgatgttagtcggtttcaactcagagctagtgtgaatgttggttggctcagatgctggctgtggccttgaagtcacttttcagggctggactgagtcccaaagggcagtccctgggtcttctccattttcatcagatatcaaatggggaggatgagaggtcctttcgtggcatcagtatattagagtttgaaggattctttagaatcagctagttttcttactcaccttatagatgatgaaactgagagataaaatgattcacataggtaatgatccagacattttaagctctgtgttgaataatcaaagggaaaagctctttacttgaactttacagatttaacagattgttggacagaaaagaactcttgccttgaaattcctaacgcaggagtggcatataactggtatgtatgccaccataccctgccccggccacatgcccatagcagacattgttaatcgacccagcaccttttcctcagccaagctctggccagcctgagaatcctccttaacatagtgctggaggcgccagtcataccgatctgagctttcatgtgatttaaaatctgtttgcctccctcttctgaatgatgtatccatgtgattcatgatgtgctgatagcatgggacttcaagtcagaagaacttggtttgactcctccatctgctgcttcctagttacgttatcttaggcaactcacttaaccttcctggggcaatttactccctctgagatgagaaagttgaattaaataatccgaaagcatcctgtcaagctctgaaaaatgctatgcttcaaggtacacagacttctcaggaagaattcatagctacaagcatgtctttttataaagaccacaggtggttctcaggaagtttgcatattacaaatctatttcgggtttctgaaatatgtgtctctagcttttcctgactacttcttttcatctgcctggtcccatggaccaagaatttagggattccgaagggagagaggggaaagatctgcttaaaaccagaggacttgcaggaacctcttctgggccgtgggcttcatcttcccacacagagcagagcagacctctgtgcctgccctgcagctgtaggtcttgagttacctctccttccccttcctccatctgtacctccttaagagcagggccctccctgtcagacagacctcagccagcggccctccgcaggtcctggcctgcttccccacaccgttccctgtggtgacctgcctccctgcttgttttccaggctccccttccctgcgggcatatccgctcctctcggtgatcacccgccagcccactgtcatctcccacctggtccctgccaccccgggaatcgcccaggcactgtcctgccaccaggtcaccgaggcggtctctgctgaggccccagggggcgaggccctagccagcagcgagtcagagacggaacagcccacgccccgacagaagaagccccgccggagtcgcaccatcttcaccgagctgcagctcatgggcctggagaagaaattccagaagcagaagtatttgtcaaccccagacaggtgaggacgcagggaagggactctccgcagtgaaggcccctgggaacgggagacttgctcccattgtgggccgtggagccacagcactggtacagtgaggcaggacactatggcggagtccactccttggctcaaatcatctcaaccttggttaacagaacccagcccacatgaatccaccacacggtccctggagcctgcctgcggctaaacttaactcaccactttatctccatatttgaacttaactatttcagtatcataaacaaggtccagtttagcaaatggttgctcaggcggtcagctgggaaacaggcttggtttttaagccactcactcttaggattggaggcagcaggactagatttggaattgggattcatgatcttctcaatcttctccacagcctccagctgattccccactgactcagtttgctggcctggctattgcttgggaaggactggagggatccagttgaggaggtcagacatgttagtgaatttgctggatgtcaagtcagaaccatttgactgagacccaggaggacctggctgagagccccttctttgaacccctctgagatccatgttggggaggctgtgacccttgctttcttggaggcctcaatgcctcacctccttttctttaatttactattttaactgaaacatatgccagagtgtgtgtctgggccgggtattgtggcccacacctgtaatctcagcagtttgggagactgaggcagtaggatcgtttgaggctaggagtttgagagcagcctgggcaacgttgtgagaccccgtctctacaaaaattaaaatatgagccaggtgtgatggcatgcacctgtagtcccagccactcaagaggctaagatgggaggatcacttgaacccaggactttgagactgcagtgaggtatgattgcatcagattgcatcgctgcactctaggcgagaccctgtctccttaaaaaaaaaaaaaaaatagccgggtgtgttggctcacgcctgtaatcccagcactttgggaggccgaggcaggtggatcacgaggtcaggagttcaggaccagcctggccaagatggtgaaaccgcgtctctactaaaaatacaaaaattagctgggtgtagtggcaggtacttgtaatcccagctacttgggaggctgagacagagaattgcttgaacccaggaggtggaggttgcagtgagccaaaatcatgccactacactccagcctgggcaacagagcgagactcagtctcaaaaaaaaaaaaaaaaaaaaaagtgtgtatctcagtgtctcatcttgttctttcagactgactctggagatggctgagctaataatgtgtgatcctatttattggggagatttctcaggtccttcttcctcttcttttgcctgctgccttggacataccaggttggacaccagtcctatcaaaaagtaaaggaaggaacctcaaatgaatctcttaagctgtgtagtagctctttgatacaaatttaagtgacagaggagtctgcatatcaccgactaaaagggaatttagcttctgattctgttaatgaggcaccgtcagctgtttggtaagggccttctgggtgccactggggcactgtggcagggattacgggtccagaaagcagtcgagagagtcctgttgtgacagaaagggatcatggggaaggaacgactacaggaacaaagacgcagcaagccaggcgctggtgcctgtgcattgctgagtgcagtaggaacacaggatattgctgagcgtgggagatggggttaggggaggcttctcagaggaggtaacatttaagaagagctttgattccaggagggacaggaagtcccgcactgaggggttggcacacacaaggcaaagaagcgtgtctcgccgggtatgtggaggaaactgcaagtagccaggacatctccagcttaaggtgtgaacaggcaaatggtggacctcgtatgcctggctgaaatgtgaacttggttgtttaagcagttggcactgcctttatgagctggaggtgacatgatcagacttacattttagaactgtctctctggtggcaccataaatgatggatgagagaggccagagacggagcagggaccagttaggagagaatccagtgatcatcacgaagacttgaattaaagggtggcagtgggaacagagaggcaggaatagagaggaggacaattttttttttattattatacttcaagttctgggatacatgtgcagaacgtgcaggtttgttacataggtatacacgtgccatggtggtttactgcacccatcaacccatcatctacattaggtatttctcctaatgccatccctcccctatcctccccacccccaaacaggccctggtgtgtgaggttcccctccctgtgtccatgtgtgagaagaggacaatcttgaagagagaattggcagaatcaacattgcggaaggaagcaagaagggagttgagaattctgtggtttctggactgggccagcaggtggatagggacgccatgaactgaagtaggaagacagaggacagagtagacttaggtggggaaaggttgagttctgttctagacctgtgcatttggagtgtctttgggcagatgatggagacaggtctgtgaaccggaggttagtagatgggctctccaggtatgacatggctgtttccacttccctagcatataattgagagcctcatgaacttgtgcacccagtggagtgggcacctttgtctatggtagcacggtggtatgtcagacgggcttcagcgtgcatgactaacatattaggctgatttttcagaagtcagagaattttttttttcagaaatattagttcttcttaaacctcctggggctccctgatacctgcccaggcatctctcaggtcacctacacaggattgattcacttatctgggaggacaccattggctggcatggaagctgccatcttcacctgccctctcagatgttcctcgcctccctacgtgaccagggccatgagcactccctcctcccacagctctcaccctcctcctctgtgtttgtttctccagtttcctaggtgaccccatttaagcgaatatgcagggaagtgagaatttgtaacggtggcaggtaatgagagaaagctgatgacagtgaagcatgtttctgtagccagagtgagtcagggctgcatttttcccaagtgagctaacactgtttgctaatgcagttgcagagctgtgaactgagccttccattgactaatgcacctgatggcctcaggtgaactgggctcgggaaggcaccgccagccagaaccatggaggacccgtctccagggaggcctgggagaccagaagtctgtggggtggccccctgggttcttggttctcaatgagcgactgcttgggaagcagtgcttcatttgtgggaagagccaagtgctgttggcactgggaatttattggctttagcctgttaatcactttcaataaaactgccagcttctagtagctcttctacagggatgaccagagggatgtgagtactgatttaagaccacttccagggtcccctgaaggaagactctgtgtattattggggctttaaattatgcagcctggtcagagcagggcaactgggcagctgcacctgagatcatcagggccggtccctgtgggcctccctgatagttagatctccccaggtggagagctgcagctgaaaacccacacctgagactccccatggagcaggcaagtgagactgactgtgggcccgagattcacagacggcaatcctcagaaacctagggcctttcaaaaagtgggggttgctgcccaagctctgtcaggggtgattgtcccaagctgctgcattcgaagtccacactgctttgctgagcagggctggcgtggcagtgaggcagcttatgttggcttaaggaggtggctctccagttggtgctgaggtagacctggggttcttatcctattaggtcaatggttgttgtctcaaggactgatgttggaagtctgactgcagacttccctttctcattctacttgtcccacccggttgtttgctgcttcctgggatgaagcatccctgcgatcccctttgacaggttcaacttgtgcagatatattgtgagtgggtgtgagccccaatgcaggagctggtgtacaggtcagacatcgtgggtttgaatcctgccccacttcttaactctacgatcatctgccagaggtcggtaaaggttttctgggcagagccagacagtaaatactttacattttgtgggccatatggtctgtgacaactacccaattctgatattgtagcacagaagtaatttatttttatttatttatttattttgacaatgtctcactccattgcctaggctgcagtgccgtggcgccatctcggctcactgcaacctccgcctcccaggttcaagcacttctcttgcctcagcctccttcgtagctgggattacaggtacctgccaccacacccagttaatttttgtatttttagtagagatgggggtctcaccatgttggccaggctggtctccaacttctgacctcaggtgatccacccgcctcggcctcccaaagtgctgggattacaggcatgagccactgtgcctggcctgttacaataaaactttatttacacaaccaggtagcagacaggatttggccacagttgctgagagagtctaatctctccaagcctcaactctcttatctgtaaaatgggaacaattacactgcttcactgcgttgtgaatgggatagataagacagcatgtcaggggcttagcatgtaccctgggatgccgtggtgctcaggaaatggtgggtgtgttagatttagccccagaaatggctttgacttttaggacttttcagaagactacagagaagtacagcaccatgattagcagtagaatggaaaacaggaagggctgtggatttaatgtttcttttggaatctttataatatttatttatttataacattttaattgttataacaatttaggacagctacagcgattgaatcaatccattaagaagtattttttgagcaccggttctggatttagcagtgtgatgggcactttcatgggtagaaaagaagtggaaggtatacgctgccctggctactgagttagggaggcagaaataacacagttggagtgatcagagaacagcaggaaacgtgggaccatctgggtgactgctggcctgtgggagggtgcagaggagacgagctgtgggagccaggagaatcacctgccggaggtgggaccggggctgggtctggaatgatgagtggattcccatcagcaacatctggctttgccttttgtttccagtctggacgatgggccagagggtcagagtgaatgctcttgtcaagccaggaaaaggactgtgtgatgagaagccccaggcatccttctcaggtcccttgcagaccgtgaatgtttcaggatggggactggcccaggtgtcctcaggcatgggcatctgtttctcagcttcccagagtttcctctgttggattcttggaaggaaagaaaagcgctttggggaagacctcgtttaatgggggaggtccgagccttggtagccagtgctggagcctgtctggagcctgccagcaggatcccatctctcctgctgcctcccattctgctcacctttcctttgtatcttgtgccttctaggttggacttggctcagtctctgggactcactcagctgcaggtgaagacctggtatcagaatcgcaggatgaaatggaagaaaatggtaagaaaggagtgactaaccatgatcccttcctgatgggaaggacttttactccagggctgttgggagggaggccggaccatttggcagtttgggctgcagagattggaaggccttctatgctgctggcttgcggggaagctgttggatctgtaggttgagctattcctcttgacctggagttcctaaacagagggatattctttttctgtttccttagaaatcaaaggaaaaaaagcttacaggcttttaacttgctagttttattattatacttaagttctagggtacatgtgcagaacatgcagttttgttacttaggtatacatttgccatggtggtttgctgcacccatcaacccgtcatctacattaggtatttctcctaacttgctagttttaaccctacctgctagccttttcaaacaacttccttcttcctcccaccaagagctaaaaatagaagtcagtactctttgtttataatgacgtagaggatgcatctgttcttttggctgtgcgtcctctaacgcagtgatcctcaaactttggtgggcattagcgtcccctgggtagcaggttaaatgcagaactctaggccccctcccaggattctggtcccagaggtctgggccaaggctgggaatgtgcgtgttaacaagagccctggttattctgaagtgcctggtatgatgaccacagtttccatcatcctgctctagtgcctagctaatgaatatttccatctttgatttttaagtattagaatagatacatccctacgttgtgaggaactcaatttcattatcatttattcttttcactaaaaagggcactattaaatcaaaattttccaaagtagttgagtgtttcctttctcagctttgtaaaccactgagacaaggtcaaagcccagagcaaaagaaaacgaggaggggtggcgataagggaagaagccctgctgttctctggagcccaggtgccaccatgccacctgccataggcttcttaccccctcaccaaacgttagtggctctttctcctctcgtccatgccatgccttcatgatgacattctaatttgctaacctgtctggtcacaggccctatgtcttggtgtttcagggctaaaatatgatgtttttcacaataatcaaataactacggggttctgccaaccccagttttcaggaaaaaaaaaaagtcagtggatagatgttttctcaatgttgtggttttgtccaatattgttttttcttaagcttttagttcttgctattccttgctattttctgctaacaatgaggagaaaaaaaaaaacaaaataagtaaattgcagatgaacatcaatgggaaaaattaggaaaaaagtcaacaagcagcaattattatattcccaaaaaagaaattcctgggcaaatcttgtaatttcctctggggggacctgaccctgaaatgaaagggttttcaaaatggaggcgacttggctcatgaagtgcccacgaattaagacagagatgccagttatgtgttcaaacatatggatattgcatgagtcagcaaatatatattttgtgtctcttgtgagccattccttgtcctaggcactataagaagtaattaaataaaatatcacccttgccttcatggaatttatgatgtagtcagagaaacaaggcccaggaggtagctgccgagcatgttataattaagtgctggttgttacggatttataagcccatcggagttcagaagagaggtaatggagaaggtggccgggagaagttgaaattgaaggaagtggcccggcacggtggctcacgcctgtaatcccatcagtttgggaggccgaggtgggtggatcacatgaggtcaggagtttgaaaccagcctggcaaacatggtgaagtcccgcctctactaaaaatacaaaattagctgggtgtggtgttggttgcctgtaatcccagcgacttgggaggctgaggccagagaatcacttgaatccaggaggcagaggttgcagtgagccaagatcacaccattgctctccagtctgggccacggagcaagactccgtctcaaaaaataaaaataaaataaataaataaataataaaaataaaataaaaaaccaagaaattgaaggaagaatggattcggttaaatagtcttccaaaaactctacagtgccaagcacacatggacaccttttgggggattggtctctaaagaactagacttgagagtgagaagcacccggccgtgttcccatgcttgcccttccctggctgattttgggcaagtcccttcactgctttctgtgcaagatccaccacccaccttcttcctcgtcagtcatcagcattgaaatcaatgcctcctaagtagcagaggcattgtttaaattggttatcagcaatcttttcgtgagtcagatgattaaggaatcgacaggcagcctcctctgccagcaccgcccagtgcccgtgggccaatgcgtgtgccttcgtctctgacgtcacttgtttttcaccagcaacagcgttgctggcatggttgtgggccagttattgatgggtatcaatgccatgtaaaccaaaatggaagagtaacttagcagatctaacctcagaacattctgcaagccagtcaccttcaggtccctttaggagccaagaggcccaagctgtcagttcacttttgagataattcattgagcatttaacattcatcaggccatggagatgcaaagataagacatgagcctgtccaccagaaaataaaattataaaaaggtactcagtcaagtgcagaagacacatctgcaaactggtattattatttcacggagcggtcagggcagcagcagggaaatttataggatcagcgcagagagtggaatagcaaggctgtgttgtgatcctgattgcttcatctagtttcccagtaaaactcttttcaaggctatctgtttaggtaccagggaggaaaagaaaaagataattgagtaataaagatgtctcaaggctagtaacctaattggaactggaaaaagattagcagttgattctcagacttattcacatggctgccaagggtaactttgccagaaccgagatagcatctctgacgaattctgacccgtcagcattggtaacctatagcgggttgggtaaatttaatcttgcatatttaagatgggatgcgcaccctctattccatgtctgttggctttagttcccgcaggacccacagtgttttgcaacaggctgaaagagcctcattatttggtggtctctttgagctctaaaatgcaattctcttccatgagaggatccaaacagatacctcctttctctcctagtgacagaattgcgtgggccccacactattcatggtcattatctttctcatgaaaagtccccaaatagttaacaactccatgaattgttaccagtagctctctgtgtaatcttgggcaggttacttaacctctgtgtgcctgtttcctctccagtaaaaggcctaacacgtaccttgtagggttgtgttattaactgagctaatctctgtaaaacacgtaaataggacctgccatataggatacagccaagagatgttattgccgttattattatcattattagtatttttattacctagccacaaaatccatgtcttcagagaatccaaatatttggaggccaggatacataagccaaaagtgaattctatgagtttcagggactccgcacagccctgagcatttgtcctttctcagtccctgctccccagtcatctccaagtcagcgccttggcatttggggccttgcctgaggtccagtggaacatcacatcttcaggctgagaaagtcagctaatgggagcagcagtgtctgggaggagattcatgctggggaatccaaacttgtttctcagcttcatggaaacagtcatcagttatgtggccctcgctgccctataaagctgcagagagagacagagaaaaaggaacaaagatcacccccactaataagtctactgcctggagtctgctgggaggttgggtaattgcaaataaataaccagacgtagaacagtggcccattttacatatccctcgcgcattatgctgaatgcaatactgctaagactgttagactcaaatggtcaggaggtttgtgttcaaatcccagctctgcccttggcttgctctttgatactgacaaactctgtcagctcagtttcctatctgaaaagtagagggaaggagagagttccttcctgcactgacattccctgccccctacccaggctgcttggagggaagcaaaagatccggtcttaacaccctcagcaacagaacatctgaatacctcgttgcagagtttggaggagggctgtcaccaggcacggctaataaaagtggatggtgtcctaggtgttcttccgagaggcagaaggaggcatgtgacctcttagacaaggagctctctggcttctctggaccaacgggactaaactggctctaagaataaatggggagagggctcctaggaggaaggccacagggtgcatgtgaatgggcagctcctgatggagagtggttctgagataattgcatgtctcaggtgtgctggaaggcaaggggccagaggttgagtgcagaaagcagccaagagggtagttatctcctaattattgcttgtgctggaatgttttattccatttagaaaatggtctaattgttttggggatttttttttcatgcagtaggaaaacagccaggtggggtccgtccaaaccgtgtgggtggtgttctctaattgctgggctggactttcttttgccaattaggtggcttccatagacctgcccttttctagtttgattactacatggggcaacttacttttgtataacctctttcatactgagtggatctgctttcaacatgtaaattccatcttggcacaattgggtgctttcaaaagcctgcactcagactgaaatcaaaatcagataatgacttacgtgaaaagaaatacagggaacgtcttctccccagggttggtttctgtcagcatctctacctcgttaaaggtccccttaatatctgtgtgttagctgttgatgcggaaaggacagtggttgagcagagttttagctaaaaggaggtgtttactgagaacttcttggttttcttacttcatactcaaaaattaactcaaaatgaatcatcatctaaatggtgagagtgaaaactataaaacttagaatatgagtaagtatccatgacctcggattagacaaaaccttcttagatatgacagcaaaagcacaagcaacagaagaaaacataaattgggcttcctcaaaatttaaaaattttgtgctgtgaaggacatcattagaaaaatgagaagacagcccacagaatcagagaagcttacatctgataagggacatgtatccagaatatttaaagaacacttacaactcaataataaaaagacaaccaaatttagaaatgggcaaaagatttgaatagacaatttctccaatgaagatatacagctagccaataagcactatgaaaagatgctaaacttcattagtcatcagggaaataaatgcaaagcagaaccacaatgagataccacttcccaccctctaggatggctgtggtcaaacagccatcaacaagtgttggtgaggatgtggagaattggaaccctcatatgcagctggctggaacgtaaaatagtgctttggaaaacagtcctcaaaatgtgaaacatagagttgccaaatgatccagcaattcaatttcacttctttcccatgttcacagccgcttcattcacagtagtaagcaacccacgtgtccatcaactgatgagtgaacgaacaaaacatagtatatccataaaatggaatattatttactgataaatgctacggcatggatagacattgagaacattatgctaagtgaaagaagccagtcacaaaagtgcacatattatatgattctgtttatataaaatgtccaaaaataagcacatctgtagagacagaaagcagactagtggttgcccagggctgtgggcagatcgggtaggggctgggggaaaatagggactgaccgctaatgctatggggtttctttttggggtgatagaagtgttggaaaattgcattgtggtgatagttgtacaattctgtgactatcctaaaaatcactgaatagtgcactttaaatggatttggcatgtgaattatatctcagagctgtatacaaagtaagttatggttttatccttaaaattcagcacctggaggtcctctgctgctcttgaaggaaagaggaacagtcagtaaatatttagggactgcatagaagttagctggaagtttgattcttggagcatggagtaatggagagaagcagggtttgtcttcaaggagcttatatacaaatatagaagacaagaagattaggctaggtttataaatagcgaaaatatctcccacccctaatcatctgtgctaatccaggtcctctggaagcccttctcactaactgcccagaaaatcaagaactatgccaagccagtggaggaaggagtgtctactacattccaaagcaaaatataaatatttttaaaattatccctgtctgcctcctgggactcttgtgtgggtcacaaattgggataataagggtgccaggcctttgaagtcagccaaggccatttagggtccagttatttggcttgctttatatcttttctcgactctagggaaaggtttgttgagaaagcctagttcatttggtaacagttgtcaaacacctgctatgtgcaggggctgagtgagaggggcagcaggtaaacatgcagtgaccatagtttctgaaaagtgctctggccagaacagtagaggctgctcctagggcacacggcagagggcatttaacctagacctgggggatgaggaaggcttccaggagaagttagccaggagaaggagggcggatggtatatatattctgggcaaaggaaacctaccattcaggtgccgttctggtcctttcatacacattatctgttggtcaccctcactgtcaccctgtaatacaaggtattattattcccattttacagattagaaaacggacactcagggcctttaaaggacttcccaaagacaaagatgataagtggcagagttggaatttaacccagtttttctactatcaaagccaaaatgctttttaaactctgctgtactacttcttcgaacgctacaagactacatgttttataacatattttttctgattacagaaatacttatgtttgatcattgttgaaagtttagaaaatatagaaaaaacaaagattaaaaatgattcatgatcctgcaaacaaggtggtgtacagatcactgcagacaaggtggtgtataggttgtctagcctccaaactggattatgctaagaatctgttttttacaaaactatatgaataatattttctgtgttattaaacattctcctatatagtaattgtaatggttgtcaagtattctgtctttgggatttactataattctacccaattacatggctaaacttttaggatatcacccccctccaacttttgctgttataaccaatattgtgatgaatatttttgcagatcaatctttgtctcagtcttagataattttttagaatttagcctaaggactttctgtgtcaaaaagccatgcacattttaaggcttttgacttgaactctcaggttgtcttgaaaagtgtgtaacaatcacactttcatacagtgtgttttttttcctgcttgctacaaatattattgttgtctttttagcttgtcaacttgatagttattgcattaacattttaattttcatttctttccttattgttgaagttgaattctgaagctgcctatgattgttgtattaaatgccaaaatatataatgttgaccaaaaatgcgttgagcatttaaaaaatggaggtgtctttgtagaccagaggtgatgggttgagaatatattttgccaaatcctgcaatttcactgctggaacagatggtttagatgcaacgtgaggttatactgggagtggaaaggtggagggaaggaattatttcttagattcaataacaattttttactcacgtaggttcttaaaggtggacaggaagcacccacaaaacccaaaggtcgccccaagaagaactccatccccacatcagaagagattgaagctgaagagaagatgaacagccaggcccagggtcaggagcagctggagccctctcaggggcaggaggagctctgtgaagcacaggaaccgaaagcacgtgatgtccccttagagatggcagagccaccagacccgccccaggagttgccaataccctcttcggaacccccaccattaagctaaagtaaaacccttttgagggaagagggagactggggagaagggaaaagagagaaggcagggagagtagggagagaaaaccttccagcagcccagtaaactgcgggcgaagagatctacccgtctccctccctcccacagttaccattggccttgtcatcgcaagcatttgacaaagacttgcttgtcttgggcctgtcacctcctgaaaggctgctttagctgtggatgcccttgattaagggagagagcgcctaggagctgcctgccccagctggggtgacggctgtagggctgggtctatgttgcaagccctatatcctagcatgcagtggaaagtgcttagctctctccctcctgacctctgggcagccagtcatcaaagcagagagacgtggcggcatgtgggcagcatgcccaggttccttgctgactcagcacttatttctgtagttttaaaaaagaatttaatgtttttggttgtatttttttgggggggtgagggtgggcaaaaacatggggggagttctgagttgttagaaatgtttctgaatcaagtttgtttgaagacacgtgtgcctttgtacccattataagatggtcataagacccaagaactgataagctttggttttttttttgttttgttttgttttttgcttcatttacccattcatgcctagggttccattattggaaccctaagcttgtgggagttatttctatcctactgctcaaggtcatcaccaagatctgatttttcataaaaaacatttgtgaccttcggcataaatgggttaaggtgccatccctgaaactgcaatgcagatatgttcagataacttttattttttaattaaaaataaatctttcaaaaggattgagtgttttgtgtcttctgaggagtgtatctaacccttcctgaatgtgtcctatgggaagagagatccagagagtgaaccaaactaggggggccaccttttccccatctataaaacaaaggattgggccaggccattggtgtccaagtgctgagagctgtgggagtggaaccgagcctccgggatgaggacagggcagagtagctaggctctcccttccacctctcccaccgccttctgccagagcagctcccttctcagccgcttcacatttggggcgtccaatggtcttacttttttaaagaggtaagaaatgtatatgcttcaaaagtcaaaactataaaaaaagaagtcttgggctgggagcagtggctcacgcctgtaatcccagcactttgggaggcccaggcaggcggatcacctgaggttgggagttcgagaccagcctgaccaacatggagaaaccctgtctctactaaaaatacaaaattagctgggtgtggtggtacatgcctgtaatcccagctacttgggaggctgaggcaggagaatcgcttgaacctgggaggcggaggttgcagtgagccaagatcatgccatcgcactccagcctgggcaataagagcggaactctgtctcaaaacaaacaaacaaacaaacaaacaaaaaacaaaaaaaaacttgcttccaccctgccctctcctcccctgaatccccggtaggtaattatttttattggtttcttgttcatctttccagggtttcttgactaagtattcatttggatgatgggctctgcaacttttaacaaaagaagacctgagaactacttgactagatgtgctgggtgattttaaatttaaaaattgtgttccacgttaatttaagaccaaaaagaaggaggctctagacttcctagcaggaggactctgcctctgttttttttttgtctgattctcatgcattctggcccagagcctgatctcagaggggtcacctttatgatcactgccccagcgtgctcacctgtgatggcttacagggccgagtgcccatttagtggactctcagttattaattacacacaaactctgcccagttgcaggcttggagaataccaactttcaacagtggcctcaacaaggaagccaaatctgttactacttctgtaaaacaatcacataattcatttcaaagttaaacaggaaagatccgcgtgttttccatcacctggcaggccgcctgcttttctccattaacaatcagaaagtgactgcaattttgactttgccaaggcagtgcctcatcccctttgttattgagatcaacagagaaagcagtctttttcttaactcttgtgaatagacaaaggaggggaggatttggcttctgagaaccagtttgagcagaccacacctagctgcctgtgcgaggttgcttgcaccaagcaggcagaacgctgtctcctccacctgtagcccaccccatggtacagttttatgatctgcctaccaggtggtgtcacaatgagccaaagaatgtgcacaatggccaaagtaagccggtgggtcagtgttagttctgtgtcaatcctaaggaagtgttctgtcccattcgcgccaccccagagaggcctcctgt

SEQ ID NO: 16255 - DNA, 24945 bp, Human
acaaaccaaaaatacaaatagaggcaccctctttcacacactcagctcagtccagattgcaaagtgcttctccagccacaatcctacttgccttaaacatttttgtgaataagaaagggcagagttttttttttttctttaatcccaagcacagcctacaacagagcccttctttcagagacatgaatgtcgcctcattagcttgtacagtactggctgtacagcgcaatttaaataataccaatagcagctgcctattcagggcttggtgagtccttgtgcttagccctttctggccgttgcttcattgggtccttacagcagccctgtgaggtgggtattgttctgagtcccatttaacagaggtgggcactgaggctcagggagttgaggtaacttgcccaaggccacacagctggagcatgcacgtccaccaggcggtgcacggccctggtaagatgctgatggtgactacattgcctggggagggccaggacttttagtttgtaaagtgttctgatagctggctcttacaggtttcttttttctttttctctctttttttttttttttttgagatggagtttcattcttgttgcccaggctggagtgcagtgacgttatctcggctcctgcaacctccgcctcctgggttcaagcaattcttctgcctcagcctcccgaatagctgggattacaggcgcctgccaccacacctggctaattttgtatttttagtagagacagggtttcaccatgttggtcaggctggttttgaactcctgacctcaggtgatctgcctgcctcagcctcccagggtgctgggattacaggcatgagccactgcacctggcggctcttacaggtttctgagctgctttgtggctcgtgtgtcctaaccccagagtacacctgtgtgtttgtttcacaagtgtcagtgtcccctcattgactcgaagagtactgggtgcacggtgcgcgggaagaccgcattgctgggcacacagtgtcccatccttggaaagggtatggccctttaaagtcagcactgcattccatcagcaaagagaaatcctccacatttgatagatgaagacacaggcttacagcggcagtgaccacagacgtagcattggccaccatttttcatcacttaccagatgtgaggcagttttacgtacaatatcttttttacaattgtttaatctttttagagcagggtcttacagttggacctgtgttggattctaactgctgggctcaagcaatcctcctgccttagcctcccgaatagctggcatacatgcggttatcttacttgattcttccaagagccttatgagggagatattatcatccctgttttacatttgatgaaaccaaggcctagaggaatgtgaagccttttcaaggacacatagcagagctgggtaggattctagattttcccttgccagaggcctggcggacggcagcatagggctggtttcaagagtatgtgatctgtgcagccacacagagccccacgctcagagggagcccattatgtggtttaatgcctgctgttgccttcttgacattcttttttttttgagacggaatctcgctctgtcacccaggctggagtgatcttggctccagtggtgcgatctcggctcactgcacctccgcctcccgggttcaagcgattctcctgcctcagcttcccaagtagctgggattacaggctcgtgccaccatgcccggctaatttttgtatttccagtagagactgggttttgccatgttggccaggctggtcttgaactcctgacctcaagtgatccacccacctcagcttcccaaactgctgggattacaggcatgagccaccacgccgtccttgacattctttataatttttgaacaagggatttccacgttttttcactgccctcagtgggaaaagcagggagctcctggctttccctcactcattcctttctcccctgcctgtcctaggccctgtttgacacacagaacgaactacgcgcacacatcccaaacttcaccttcaacctgggctactcagggaaattcttccacacaggtaagtgggcctgcccctgccctcactagcaacttccaggactcctcagcacccaaaccctcaaagcacccatccatgagggcagcgggtgggtttactggcccacattagaggcagaggtgacccctctgcccccgtggagccaacagcctacaagagcagtcacaacccaggcagaggccatctggggacaacagcagcggcagcaacagcagccgcttgtccctccctgtcctttcgggctgagctggcctgggtggggcatcttctccctcttgcctctccctcctatcttttacaattatgtgtattatttctgcttataaaagaagctggttgagttttaagaacattacagaaacatgtagcatagaaagtgaagatgccctgtaattgtacccaccttggatgaccagtgtcatgggtttattttagagtcctaagggttgagggtgagggctataggttgcttggtgcgcactttccttcctctttggggctctctcacttgctgtcctctcttcatctgctgtccttcagggactgggcagaacccctcagctggtcatctgcagtgaccattccccctagctgccttctgcccaggcctcagtgagacaacctctcttgaattctaagaaaaccatttattcaataattcagcagatggaggggtatatgcaacatagccccaaagccaaataggagtgatcctgggttgtctgtctgtattttttatattctttttaaaattttttatatatttttggctgggcgctgtggctcacgcctgtaatcccagcactttgggagggtgaggtgggcatattatttgaggtcaggagttcaggactaccttggtcaacatggcaaaaccccatctctacaaaaaatagaaaaaatagcccggcgtggtggtgtgctcctgtagtatcagctacttgggaggctaagtcaggaggattgcttgatcccaggagttcaaggctgcagtgagctatgatcgcacaactgtactcctgcctgggtgacagagtaagactccatctcaaaacaaaaagaaaaaaaattatttatttttagagacgggacctctctctgtcacccaggcaggagtacaggggtgcaatcacagcttactgcagccttgaactcctgggatcaagcaatcctcctgccttagcctcccaagtagcaggtactacaggtgcatgccactatgcctggctattaatattttaaaaatttttgtagagatggggccttgcactatgttgcctaggctggtctcaaacctctaggctcaaacgatcctcccaccttggccttccaaagtgctggggtttcaagtgtgaaccactgcacctggttgttttttatattcataacccttagcatatcagaggtggttatagtaatatgtctgagatagagggtcaaacatcctgtatatatacaaagagcttccatagataattagataaaagacaagtgacctgatttggatcattggaatagaatcagagcaggtatgtcagaggtagaagaaacccttgagatcattgactccagaccctgaattgtgcagatggtcccaaggatctagagagcagatagtcttggccaaggtcccccactgagtcaagggcacactctagactagaattcagggctctgggctggggctctgtctgctcctgtgctgtagcccagataactcttccaggcagctcctgggtgggctctggccatgctctcccatccccaggcacaggcccaggttagagggcctcatggcccagtgggtggttctgagctgcctgtgttgctgcaggtaccaatgctgaggacgctggggatgatctgctgctgtcgtatgtgaaggagttctggtggttcccccacatgtggagccacatgcagccccaccttttccacaaccagtccgtgttggccgagcagatggccttgaacaagaagttcgctgtcgtgagtaagattccttgcagggcagagcggggcgggctaagggctgggctggaggtccagactgctggcctcttgctgcttttgcagtctgctctgacggatttttactaacacctctgggccagggccaagggagagctgcctttatagccactgtctccttgaagccccaagagaataacccctttacagacaagaaaccaaggctcagggaggtcacaccagctactaagaggtccagctgggacttaaactcaggccatttgtttcctgtgcccaagctcttactagaaggggaggctctggaaagctggaagaggtggtcaatgaggagggaacgagccctaggtgctaggtagaatgaagagaaggtaggaaaggccctcgtccttgtccctcactacagggtacttgagtcctttgtgctagaggcatgtgcaccggaccaagagtcaggagacctgggttctaatcccagctctgccagttgcccacactgagattctgggcacattccttgccctcccaggcctcagcttcccatcttaccatgaagtctcagaccagcagccatgccgacctaacctctgatttctctctcccattctacaaaggggggataaggcccaaaggggaaggacccctatgctcaccctggcctggtcatcctctccctaggagcatggcattcccacagacatggggtatgcagtggcgccccaccactcgggcgtgtaccccgtgcacgtgcagctgtacgaggcttggaagcaggtgtggagcatccgcgtgaccagcacggaggagtacccccacctgaagccagcccgctaccgccgtggcttcatccacaatggcatcatggtgagtgggcccctggaagcccaggaggtgggagaatggagagcacagtctgtcatgtgtgtgcatacgctgtcctggtaagcacggctctggtttgctggcttaggggttgcagatcagcttctgctgcctcctctggcacccgaggctctctgccccagggaaggtgggctgccactccgacccctttcatgagctctttcttagcttttgtgacagaggatcaagcaataatcagcattcttgaaagaggtttctgatgaggatgtgggacagggctctgttacagtctttttgctgattaaaaatttttttcttggctgggcctgatggctcacacctgtaatcctagcactttgggaggccaaggcaggcagattgcttgagcctaggagtttcataccagcctgggcaatgtagtgaaaccccatctctactaaaaaagtactaaaaaaaaaatatgcctggtgattagccaggtgtggtggtgcatgcctgtagtcccagctacttgcagggctgaggcaggaggatcacttgaacctgggagattgaggctgcagtgagccaagattgcgccactgcactccagcctaggtgacaaagtgagactctgtctcaaaaaaaaaaaaaatttttttttcccctggggcttctaccatgcatctatccctttttttttctttctttcttcttttttgagacagagtttcactcttatctaggctggagtgcaatggcacaatctcagctcactgcaacctctgcctcctgggttcaagcaattctcctgcttcagcctcccgagtagctgggaagacaggcatacaccaccatgcctggataattttgtatttttagttgagacagggtttctccatgttggtcaggctggtctcgaactcccaacctcaggggatctgcccaccttggcctcccaaagtgccaggaattacaggcgtgagccactgtgcccagcctcacatctatccctttccttggcactggggacacagaaatgcacagaacggaggaaagttcctgcccttgtagacctgacattctagtggcaggagacagaccatatgctcatgcatgtgtgttgtgggaagtcagggaccccgaacagagggactggctgaagccatggcagaagaacataaattgtgaagatttcatggacatttatcgcttccccaatcaatactcttgtgatttcctatgcctgtctttactttaatctcttaatcccgtcatcttcataagctgaggatgaatgtcgtctcaggaccctgtgatgattgtgttaactgcacaaattgtttaaacaatatgaaatctgggaaccttgaaaaaagaacaggataacagcgatgttcagggaacaagggagataaccttaaagtctggctgcctgtgggccaggtggaacagagccatatttctcttctttcaaaagcaaataggagaaatatcgctgaattctttttctcagcaagaaacatccctaagaagagaatgcgttcccaagaggaggtctctgaaatggccgctttgggaacgtttgtcttttacagttgttgataagggatgaaataagccccggtctcccatagcgctcccaggcttattaggacaaggaagttcccacctaacaaattttggtcagactggttgtctgctctcaaaccctgtctgctgataagatgttatcaatgacaatgtgtgcccgaaacttcattagcaattttaatttcgccccgtcctgtgatctcgccctgcctccatttgctttgtgatattttattacattgggaagcatgtgatctctgtgacccacaccctattcgtacgctccctcccctttcgaaaatcactaataaaaacttgctggttttgtgacttgggggtcatcacaggacctgccaacatgtgacatctcccctggacacccagctttaaaatttctctcttctgtactctttccctttatttctcagactgacagacacttagggaaaatagaaaaggacccatgctgaatatcgggggttggtttcccccaatacatgtgtaaaatatacagtggtcagatggtgatgagtgccacggacaaagttaagcagggaatggaaggaaggaatgctggcaagagaagctggtttaaataaggtggctaggtgggccttcctggaataagccacgctgccacatgaggaagagcactcaaggcagagaacacaagtgcaaaggccctgaagcgggctgtgctggctgtgtttgaaggccaaataggaggccgggatggctggaggggagtgagggatggtggtagatgaggtcggggtgggtgatggaccagatcgatagggccatgtaaggccagccattggatggccatgggcttttaggctgagatgggaaggttttgaatggagcatgatctgactcatctttgaaagggatttctatcattctggctgttgtgtggagcagagactgtaggggacaaaagtggcagcagggagaccagttaggaggcactgcagtcttccagaccagaggtggcagcagcttggaccagggcccaatgttgggatgtggccatactctgggcttagaatagttaggcctgtggttagatgagttagatatagggtgtgggaggaagagaggagtccaagatgactgcagggtttttagtctgaggtgctggaaggatgagttgtcatcagttgagctggggcagcagtgggtaggcaaggtttgtacatttgtccatcagtccatccatccatccactgacctcagcaccaggccctcgtgctgaactccaggcactcctttaggtcctcaaccctgaactccagggatgaggtggtgacaaggcaggcccattccctgctcccttggagctcacagtttcatgaggggagacagacgacaaatggctaagccagtgtgtgacaacgagtgtcaccaggtgaggttctaatgttgcaagggggcttgcagaacatgtctgggattgctgcttcagagagggccaggcaggggccgtggctgcagcagtcccaagtttccagaaacattcccactctgttactttgaggcctgctcattttgtgcagagaatagcagtgaagtttgtaaaatggcaagggcctgtagttcactggggggaacgctgtgctgtaggctgcacccaagggtaggggctgtgcgaccacatggagactgcctttctgaggagcagctgggccttcttcctctgaggaagagtcctcccaccaccctcatgccagaaggcaccatagctcctctcccccaccccctcctcaggttctcccacggcagacctgcggcctcttcacacacaccatcttctacaacgagtaccctggcggctccagtgagctggacaagatcatcaacgggggcgagctcttcctcaccgtgctcctcaatcctgtgagtgctccacagcccatggctgctggtgagaaggggctgctgcacagcctgtctgcagctgacacaggcttcctggagccaggaaagggtggagaggcatgagtgagtgcctggcagttgggagacccactctccagcactggccctgcctcggctgtgtgaccttggctaaagaatccgagcatgctttttttttcctttcctaatcatgtactttaatacaaaagtgttggcatttttatgcatgttcccttcagtctttgctcatgtgtgtatacacacatacacagatacacacacatatatgaacaacatttgagttttctaggtctcgctttccttatttgtaaaatgcaaacaattacctctgctttaataatattaaataaacttcaagtggtggttgttattcagctctgtgggctgagtactctttatcttccatgcaccccacccctaacatttacaaaataaaacccaaatagctcccacattgggtctgctttccatttcaggattgtaatatttggggtcagtcaggcctggttcgtctgtcacctcatccaagtactcgcagcgagtttgttgacagcgccagcgtaacttccactggtcatcaggagccttgcaagctaaggcagggtcagaagggtcagagttggcggtgagggtggctcagacactgatgggccctgcctctctcctcccctcccctggagcagatcagcatcttcatgacgcacctgtccaactatgggaatgaccgcctgggcctgtacaccttcaagcacctggtgcgcttcctgcactcctggaccaacctccggctgcagacactgccccctgtgcagttggcgcagaagtacttccagatcttctccgaggagaaggacccgctctggcaggtggggggctgggcagcctgggcaggttgctacagggatggaacgccaccactcacaggcacacactccagatatggactcaaggctcagccatcatgccttcacactctcgctcgaatgtaaactcaggtccccatctacttaccagcatgggtgcgttcactcctttgcacacatgcatgctcatacatgtacatacttccccacgcagacctacatgcatgcagtcatacatagccttggaaaaaacagtgttaaaaaaacgagtgggctggacgcagtggttcacccctataatcccaatactttaggaggccaaggtggctggattgcttgaacccaggagttcaagatcagcctgggcaatatggcgaaaccctgtctctacaaaaaatacaaaaattagccgggcatgatggtgcgcatctatagtcccagctactcgtgaggcagaggtgggaggatcagttgagcctagaggttgaggctgcagtgagctgtgatcacaccactgtactccagcctgggcaacagagtgagaccctgtttcaaaaacaaaaaacaactccaagtgaacacagtgcagacaaagtacagaaagtgaatgcgttgtcttggtcaggctcttagataatctcttgtatctcttctaactccagcaggctctgagtgggaaaagggattgatgggagggtttgggggccagtttttgggaaagtctgctcctacgggcttttaaaaagtggaagcagaagctggaattggtgacagtctcatagttcagaccaggagtccacaaaccgtgactcatgggccaaaaccagcctgagacctgtttttgtaaagaacgttttattggcagacagccacgctcattcttgtatctactgtctatagctgctttcatgctatgacggcagagtcgagtagttgcaatggaaacttccatgccccaaacctaaaatatttactaaacacttaccaaaagattaattaaactttataggaagcgtttcttgaccccctggttcagacgcagcttgtccagttaaattcaacaagtgcttatgagttcctgttacgtgctaaggggcattttgcgagctctttgggggacatgaaactgaccagaagtggagcctgcctgtcagtggctcagtgtctgggggtggggatgtgacaaggacacatgtagcatgtaggtatcatgcccattgggctgtaagggccacatatccatgtgcagtgggagtccactgactgggttctggggcgccccacacatcccttccactgttgttttaggacccctgcgaggacaaacgtcacaaagacatctggtccaaggagaagacgtgtgaccgcttcccaaagctcctcatcatcggcccccagaaaacaggcaggtctctctgctcttgaccgagcttccccaactgcctgctgtctcagccacagaattctgaggactgccttgccctggccccactcccggataatttgctccctctttcccaggaagtaggaatgaagttggggtgaacacaaattgcctgtcagtatggaggggaaagaggtggaggaggggcctggagttctcctatttatcctgaaccatagcctcagggagctctccctgcattatcctgggagtctccaagtccagtcagagaagcccagatcagttgctctgctagtttgagtaatgccaagcaaaactggtacaaagaggactgtgatcaattagctatgtctgccagaggtgcagtagggagaagcagtgacatgattgctaagcatttgtcatccatacaaccctgcaaggcacaaatgggcactcccattttgtagacagaaactcaaggttcagagaagtcaagtgacttcccttaacacattcagttaggcaatggcaattccaggcctgaactctgatctctgtgaccctgaaacatatactcttaattgccaaactctatagcctccttctcttctgggctctctcattatagcatgtaaaccatagacttataccacagaaagtgaatgaactcactgaggaggaggtagggcagggtgcatgagtgagcagagggtattgggaagaagagacataggaacaagatttcttagttctttaagaatttcacattaacagaactgcagggtgacaaactcccttttccctgagctcctaccaagtgccagaggacagaggcccagagctggaaaggaccagctcttctgggatgctgaggggacagcagtcagttaaacatggctaccagagtgcagtggtgaggcagattctgaggccacgtcctcgtttagtgaagagtgctgtgatagattagcgatgtccgtagtaggtacaggagttgcggtgttcacatgcatgccatatatttgccaccctggatttagtaattccttcattgcacagatgaagaagctaagaccagagaaaggcagagaccttcccaggagcccccagtgggtcgtggggagctaggcccagaacccagactctatcttttggctgggggctgggccctgggtctcaggtgtctaccctccccacaggcaccactgccctctacctgttcctgggcatgcaccctgacctaagcagcaactaccccagctctgagacctttgaggagatccagttttttaatggccacaactatcacaaaggcatcgactggtgagttggcctttctgtccacagcgggacgggaaggccatcctggggcctcccaggagtctgctgtggccacagcaggaagcagctggagcttgctcacacacagctgtcattcctgtaaacagggacaaagtgcagtgacccttgaatcatggtgtgacagcgttgtcatagacaggacactcgatgaggaggccctttgcccctttgctctaccgcctgtagtcagacgctgaggtcgaagtccacccctcccttgcttgcagagaaacatcctgagtcttggggaggagaagggtttgcccagggtcccaaggtcggaaatccaaatgttctggctctcctcactgcgtgtggctgactgtgaagcagaggtgttcttgtgggcccttcagggacaggtcgctggtctttgggcgtcacttggggaagtcattaagattgccacttcccaccagagcctgcagaggttacctttgtagaggttcccagcagagggtcctagtagaggttcccttaagggtgtgggggccagagcagagatggttttactctccaccttttcagttggcatctttctctatttgccttttttctttctttttaaaaaatgtttcatgtcaggtaggtaatgtgctgagatcataacaaggttcgaggtgggtacacctcacacgtgtgtgaacacccaatcatcacgtgcatggactgcaaagtttgcctttttaaaccttgtccatgtattaccattatttattatttttatgtcagtgggttccctgggtggagaggttatgggccttctgtctttcttttttttttttttgagatggaatctcgctctgtcacccaggctgcagtgcagtggcgcgatctcggcttactgcaacctctgcttcccgggttcaagtgattctcctgcttcagcctcccaagtagctgggactacaggtgcccgccaccatgcctggctaatttttgtatttttagtagagacgaggttttgccatgttggtcaggctggtcttgaactcctgacctcgtgatctgcccgcctcggcctcccaaagtgctgggattacggcgtgcgccactgcgcccggcccatctacctacatttctaacatctccacagtctcttgtctaaaatctagtgtggtcagatgaattattggaagtcaacatttttcaggttttagaaaggtaatgtggtgcgaaaccatatatttagtaacatcttcagcgacacctggggcagcaccctgttagcaaattcattaatatgtctgtagcaaagtatgtgaatatttacactaagtaagaggaataagtcaggttttgttgccaaatggctttgctacaaacctaggaaacaaagcctgtgttttcaaagctttctcaattgagatattgtaaacaaaggattgtggacatgcaaagaaaattcagaaagatgagagaagacgtaattccttggcccaattcccaagagcttgattttgtaggtaggtctaaagtggggtgcaggaatccagcaggcccccagaacgctctgatgaagcacatccttgggaccagcctggatcagccccacctcacaggataggatagggaccctgtacccttcatgagagtggactttgcttcccacaagccccagaagttggaccctgagtttgcataggtagattcccctgggagggtctggagtgttcctttggtttccagaggttccttcatccagaggtggccattgctctggtgggatatgggcattagtctggaaagccgtgctcacccacagcaggctggggaggggttgtgggtagcaggaggtcctggtccacagtgacggcctagaaggtgttcccccaggtcaggaaagaaagtccgccctctggaggccccctctgctctgtgccagcctccctggggcagtcctggagccactctgagccccagctcgccccctagaggcagagagagtgacagccctggcagttaagcctggagcagctgagggggcgggatcctagagtttaggattgaggggcattaccccctccccatgacctgcaactgccggcgcacccacaagtcttcagatcctcccaactccagagtcttctggaaaaggaacgaatttgaaacagggaggctgccaagaggccattcccctccagaatccccactggaggcaagtccttgtttggttgggagcaaagcttcccacttgctctctgaggacattctaccccagtgcctcgcccttgtgctgcattcccttagccccctcctcatgagttttgtctgtgagccgcctctctgggcttcctgcaggtacatggagttcttccccatcccttccaacaccacctccgacttctactttgagaaaagcgccaactactttgattcagaagtggcgccccggcgggcagcagccctcttgcccaaagccaaggtcctgaccatcctcatcaaccccgcggaccgggcctattcctggtaccaggtgagtggggctggggtggagtccctgtgtcgggaacacagggctccgtctgacactcagttactcactcactcaacagatattattagtaagcacctactgtgtgccagccctgagccaggcgcctggagcgtggtgatggctgagaatagagtccttggtggaggagacaggcggaaatggaaagccagccaccagttgactgtccacctgcctagtgtcatgcggggtcctgcctctacttctgacactgacaagaggtggaggctggttacgcctagaggaagcttagatttggtgaacagcaatgcaggatcatactgactatagcttcctcgctggacacgggtgggagtgggagctcatggaaggacaagacacaagactgccattcacagtggagaaggcaggcacctgaccaagtgaggcagttacctgggctgtgatacatggagagggtgtggatccaagcccctatctggggcatgtatgaaccagagctgtcttttttttttttttttttttttttgagacagagtcttgctctgtatcccaggctggagtgcagtggcctgatctcaactcactgcaacatccgccttccagtttgaagtgattctcctgcctcagcctcccaagtagctggtattacaggtgtgcaccaccacgccaggctaatttttgtatttttagtagagacagggtttcaccatgttggccaggctggtctcaaactcctgacctcgtgatcttcccgcctcggcctctcaaagtgctggcattacaggcatgagccactgcgcccagctgaaccagagctctctttaatgcctatggcctgacttaatttcctgcctgccagcccactgagcctgcaggaatgcttttaggccttccctggtggggtaggcggagtccctcccctggctgccagcattcctgtgattatgccacacagccaagcactgtgattcagaagtggcgccccagcagaaagccaccctgttgtccaggccgaggtcctgagcatcctcgttaacccagcagaccaggcctgtgcttggtgttggggagggggtggggccctgggtcttagcccatggttgccagagaagtgtcccctgtcctggctgggacagcctcttcaggcctggccactgtcatagttcccaccctgctttgaggctcttttctcagatgtgacagtggctgtctcccgcctgggaccttgcggtctcccgcagggctggcacctgcctcctctttgctcccatggaagtctctcctcctgccactctctgaggctggtgaggaagccccttcttactcttgttctctagggcttctgtttatgccctgatgtctgctttcctgtggctttttctttaggagaagaaaaccgagaaacacttgtcaagtgtttctgttttctgccgtgctgtgtgcccccgcctcctggcgctgtgcagggaatgggcagtctgctttcatgggggaacgtagggtagagagagagccgccacaggttgggtcagtccctgttctgcactgacactgctgtacatctgcaccttactggagagtcacagctggtttctagaaggcagaggaggggtttcacgtttgtgtccccttctcaaagattagaaaaccaagtttcagcaagtttcatgtggtggcatttgaatccaagtcttctaaatctaagaccctattcctttttctgtccatgatcaagaggggtaagggatagaaggagaagggagactcattctccccaggaggacctgggaagatgttggaggagaggaagggtgggggcctgtctcagaaggaggtcgggacgaggaggacgctgctgtgcaccatattgccccagccctgggctgtgtgtgatcctcaggggagggggttggcggctgggggatagtgcctgtcgcacaggtgcctgagctctggctttctggacttagtgaattctgcagattcggacctcccatggcattattttaagtgattcagaccagccagtctcccttttatagttctttcccagtccttctgatttccataaaggagaaatgctcactttagtgcaagtggtcttacgtcctttctaacactgtcaacctctgctttcaacaaagagagcatgttcagggcctgttgcacacatttgtgtctggctggagtttgagaacattgtttttattgccatttgtgagtggttgccttctatatatgacaacagtgcagcagcgtgatcttggctcactgcaacctccaccccccgggtttaagcgattctcgtgcctcagccttccgagtagctgggaccacaggtgtgcaccaccatgccagctaatttttgtatttttagtagagacggggtttcgccacattggccagctggtctcgaactcctgacctcaagtgatccacccaccccagcctcccaaaattctgggattacaggcatgagccaccatgcctggcatcaggaaaccctgatttcgtccagttcccgtatttcaaagatggagaagttggggctctgggaccagtggcttcccttgacactggacacagtgagaggcagagccaggactcagacccagagctcctgggtccagctgaggatcttctggccaccttgcgggctgctgtccctctcaggccacttcctttgtgtcctccaagtggcatgctgaccctctttccttgcctgcagcaccagcgagcccatgacgacccagtggccctaaagtacaccttccatgaggtgattaccgccggctctgacgcatcctcgaagctgcgtgccctccagaaccgctgcctggtccctggctggtacgccacccacatcgagcgctggctcagtgcctatcacgccaaccaggtagctgctgtccctgacccttgtgagggcagtcacagtactggcttgctgtggttagcggagagcctccaactctttctcaccagccgtggggacagatatgccctccttggagagctagacccttgggtctataaaaagattttattattattattattattttgagacagggtctcactctgttgcccaggctggagtgcagtggtgtgatctcagctcactatagcctcgatgtcccgagctcacgcaatccttccacctctgcctcctgagtagctgggactacaggtgtgagccactgtacccagctaattttatttttttaagaaataaggtcttactatgttgcccaggctggtctcaaactcctgggctcaagcagtcctcccttggtcttccaaagtgctgggattacaggcatgagccactgcacctggcctaaaaagactgtagacctgtttatcccaaggttgatacatgagaactccccaagcctgtgtcccatcaccacaggccctgtagccctaaagggacccagaaagccctgaggcaggcaggtgggagcaaggagactgggcgtggtgatggagggagagcctgatcataccaggctgtttatgtatttatttatttatttagagacggagtctcgctctgtctcccaggctggagtgcagtggcacgatcttggctcactgcaacctctgcctcccgggttcaagcgtttcttccacctcagcctcccaagtagctggaattacaggcatgcaccaccacgcccagataatttttgtatttttagtagagacgggatttcaccatgttggccaggctggtcttgaactcctgacctcaagtcctctgcccaccccagcatcccaaagtgctgagattacaggtgtgagccaccgtgcccggccatgcccagccataccaggccttttaggcaaacttgcggagtgtttgagcaggagagtgacatggactggaagctcagagagaggccagagagggatgtttgtagggacctgaggggcaggcagggtttggtgagagcttaaattctaggagaaatggcattgggcagcagaagctggtggaaagcaggcgtgagaccacagaggcctgagcttggggatacctgcccttcaacaggggaggaggagccagttctagagggtgcagggtcccatatttataagcaggcccattcctgctgccgtggctgttgcccttgtttgccaccgaagtcaaagcaggtcccgatcccctttctccctttccagattctggtcttggatggcaaactgcttcgcacagaacctgccaaagtgatggacatggtgcagaagttccttggggtgaccaacaccattgactaccacaaaaccttggcgtgagtgttgccttttcctttctgcaggttatttccctgataaggcacctgggccaacaaagccaaagtcttgaataattatgagagagagaagttagttagagtcagaaagtatggaaagttattaatatgacttaagtcatattaataaaggtatcaccttaaaaaaaagggagatgatgaatctgttctactctggtcagaccatcctggggtcttctctttggtctgggctgaacattttcagagtgttttatgtaagtaaattagatcagtaatgagcagccctaattcccacaagattttcttagcattagcttttttttttttttttagacagggtcactctgttgcccaggctggagtgcagtggtgtgattttggctcactgcaacctcaacctcccaggctcaagtgatcctcccacctcagcttcccgagtagcttgggaccgcagacatgtgccaccatgcctggctaatttttgtatgttttgtagagaaggggtttcaccatgttgctcagcctggtctcgaatgatctgcctgcttcagcgtcccaaagttctgggattacaggcatgaggcaccgcccccagccagcattagattttgacttacgatttcaggaaaaggaaacacaaatgttgttgacagttaataaccgtactcactcagaacctggtgcaagtgcgttgagaatgccctcccactatgagtaaaggcctgcccgcattgcatgggctcagggctaggaaaggctgctttcctgtgctatgtcacagataagtgacacactcagctggatgaggggaccccaagagaaggaggaatcaagtcaccctccttggctccattcttgggaaagttttgcaacaagaatattccgtcttcactgtcgtgggagttgaaggtggagaagggaagtcagtccttcaccttgagggagaaggggccacctgctgaggctgtgggccatggtgtcagagatgcctgggttagggccccacatccatctcttcagcctttcaagcctcgctttcctcatctgtaagttggggataaagataataatccctgcgtcctgaaggccactgaattgaatgaaagcttcatgtggggctcttagctgagagcttggcatgcactaagtgctaaataaacggtagctgctattgtccttgtcatcatcatcatcaccatcatcatcgtcatcgtctatacctatcctatgaccctttcagaaatctctgttctccttcgctattcatgggaattctgttttcttgatgccctcatgctcaagaatctcctcatagttcctcatccagggctaaattctgatgtcagtattcctcccttcccataacagcttcggatctcatatcccaaaaatgcctttgaagacaggatgatgttggcagtcttgctgtgtcatttctgaagtttactccaaaaaatgaaattctccagtgacaggcatgcttaagtgcagctgtggatactgcatgttttgataaagatgaaatttattaaaaagcaaaagaacctccactaaacacccctcttcccattgacgctgggaggggtaaagaaggcttcttgggtttaaaaaaaaaaaagagttactcagcattgagaatgctcagaaaagatttcccagaacactgaaggatgggaaactgttcatgttgtagattgctgaagcggctgtggctggtcgggctggaggagagaagactcagaatgtgcgagctgccctttgccggaagtaggacaggcacgtttagtgcagcctaggacacatttgatcccacagatggcacatagcttctgacagtccatgtgggttcaagagcagtagattccctgggctctgccattcctggggtccatgaacatggctttaaggtcggaagtgggtggctgagccagctcccatccaaagactttcccacctccacaggtttgatccaaagaaaggattttggtgccaactgcttgaaggaggaaaaaccaagtgtctgggcaaaagcaagggccggaaatatcccgagatggacttggatgtaagtggtggacacactacctgtagcacctgcataagggtaaggggtccctgtatggagttgagggggattctctttcctttaccatgcactcagcatgttcatggccttagcatttcttggacagtatttgtaagaggaggaaaatgggggctgggacatggtgggtcagacctgatttcgtcaaacaagtgttggttaccttctactaagggctgagtgctgtggggttttgaggatgagccagacatgttctctgccttcaaggaactcctggtcttggaggggtatgagtcccaacaccactaagtagaatacaggcagagagtgctgcgcgcagtcagagagggcacacaagtgctatgggaattcagaacaaggggatgtcacttgaacctgagaggggtaaaaaaggctccttaaaggagggatgggggtctctggagttgcgcctagaaggatgagatccattttgtaggatttggacatatggaatgggagggtaggtaagaacagcatgtgtaaaaccatagggggaaaaaagaaattttaaaaatatatagaaaaagggtcacagactgggggtcttgttacttcctccttttcctacttgcttctgtttttgttttgttttgttttgttttgtttttgagacagggtctcgttctgttgcctaggctggagtgcagtggcatgatcatggctcacagtagcctcgaccccctgggctcaatcgatcttcccgcctcagcctgccatagtgctggtattataggtgtgaaccaccgtgcctggccctggccctgcccgccttgggttttgattattaattctctctcctctccctatcagaagaattttgacttagtgagctatattttgatgctcctgccaactgggagttcactattggaggctaccatttagaaggagattgtggataaataagaggtgtatggggggtggtgccagcagcatggtgggttttttgtttttttgttttcttttgagacggagtttcgcttttgtcacccaggctggagtgcaatcgcgtgatcttggctcactgcaacctccgctttccgggttcaaaagattctcttgcctcagactcccgagtagctgggattactggcgcccaccacctcaccccgctaatttttgtatttttagtagggttttcctatgttggccaggctggtcttgaactcctgacctcaggtgatccacatgcctcggcctcccaaagtgctgggattacaggcatgagccaccgtgcccggccgagcatggcgatttttagaggaggtcactcttaagtcagtacacaaggtctgagctttccttcccgttacagtcccgagccttcctgaaggactattaccgggaccacaacatcgagctctccaagctgctgtataagatgggccagacacttcccacttggctacgagaggacctccagaacaccaggtagccgtggccaccacagccagactgaacgtttgtgaaagctgggacatcccaccacacgctgagccagacctgcagagtgggaagctggaccagggcagctgcgcacttatgagcaatactctgtggaggtctggtggggctgggggagcacccaggcggatctgcaagcacctcggagcacccaccgctgggtctgcggcctaagggacctccctcgccagcagaggtccattccgttcccagctgctcctggggaggccgcttcctggtaggagggagtccacgagactcttttctgtccctcactgtgttccgccgactgtcccctctcgtcacccatcactccctgcttccgcagggcgcccctcagtattcgctgccatatgtccctgtcctccaggctgtaggggaggagagcctggccgggggagacagactggacatttccctgtttcgagccaggctcttccaaggggccagctgggtccccggagtcagtcctaggctggatgggagggtggccccctcaagaggactcccagcctccacatctggttcctaccttcacatctcaccctcccgttctggggaagaatttctggttcctacagtatccactccatcctcaaggcttcccgcagggccttggggcactgccttgccatcgggcccagttctccgggccccacctgcacccctttcttccccctgggatatgatgtgtggtgtttcctgtggtaaaagactgaggcaggccaggggtctgccagtaacatgttcccatgtacagacacggtccccacaccctcccagcctcaggcccaggcagacatgggcgagctggtgagactgccagccacggctttgcttagccacctgtggccgagggctctcagagacccccttaacctcccaaatactaagaagctaaaatattttaatattttgtttttttttttcttggtgccagagtttataccctgggtgctggggtcgcactgtgttatatatatatatatatatatataatgtgtatatatatatattctattttttttggttgggttcgtttttaattcagtcctacaaaatggtggtaagccccagtctcaggggtcaccctgtcttagagctagagatgaggtggcagggagggaggctgtgtcctcagtggcctggggctgagcagaccttaggaaggggccctccccagtgccgtggctgctctggggctaccccaggtgaacagaggtggtgagatgcgcagggaagaccagctctctccaggacatcgggctgcgtgaagtccagtgaccctgaggggattttggccaaaggaaacagccagggctgggctaggagagctggggtcaaaagctgccccacccactctccctcacatggtgctaggctgggagctgccctgagagctgggatgcccaccaaggcccacagaactgtctccaggcccttgtagacagtgggatctctgggctgatttctggttggggtctgctcctaccccaccccatttaacaatgtgaagtgactgaggctggggtgcctctccctggccccctccaactgccaaattctgcttccctctgaaccccaggaaatactttctggagaggcttgtcttgttcagaagactctagcatcttggggctggaaggtcctttgacgggtatgaaacaggtccagaaaggggaggtggcctgcttggccgacgtcatggagccagctgggagcagggctgagcgttgaacccgaggctcccggttccaagtcccatcgtgctcctcttccaatgccacactgcctctgagcccatccttgggaccctactctgtgccaggttcctgtcccttcctccgtcacagcatggtcattccaggatatggggacaaaccactccttcccagccagggtgcctttgagccttctcattccgaggtctgcgtttgcatccctgtcgtgttctccctcgaggggtccttccccagcctgtgggggcctgggtctgttctgagctgattcccttttctccagttctctgctgggatgaagaaagttggacactcagtgggaccagctgcaggtggtttcactgtgtacacagcagtgtccccatcatgcctctcaatggggcctgcaagcctgggaacttgggcatcgttgggccagcaggatgagcagcaaagggtctgaggacagggtggcatgtctgcttgtgtgctcatgaagacatgcccacgccatggagccaggggcttacagagaggggcagtgacttccagagtcccatccgtcagtgaggggactgggctgcgggatgggtgaggatcttacagctcccaggttcggaaatctaccctctaggcctggaggcctctctcgcagagcatggaaggcaggagaggtgggctggcctagggcaggagctccacttctctctgcctctggctatgggaaggagcaggcggttggaaatcctgtgacagcagagatcttctggatttttgcctggacccttctgcaagcctggagactgga

SEQ ID NO: 16256 - DNA, 21706 bp, Human
agccatgtgctcatctgtgtcatgtgctgatccacacacatgtggacagccatgtgctcctgcaaggtagccaagggctccgcccggtcagcaacagccaggatttcccttcccctctcctacaagcagccttcatgttgcagcaaacactgggcattactcctttcctttctgagcctcaatgcttctacctgtgcaatggaaagggttcctctgagcaggaagcggagggagccctgtgctggctgagtctctggctctatcacatatcagagccccagaagagcaagagtctcaccagggccagcttcccaggcgggtcaccattgcagtcacacagagcccagtgtgtggaagggccccaggctcaggtgaatgctctgctgccaccatcctgaaatccttaatcatttttgaacaagggaccttatattttttattttgctcccggccctgcaaattatgtcctgatcccgaaacatctgcccagccctgagatgatactgaccagcccccggctaatatggtgacccaagagagagacgggttgaacagataagaccctgattctgaccttcttctggggaccacacatccctgcacaatgagaggaacccaggaaatgtgggcccatccaatcccacagggtgcttctgcacagctccctggcacaaagcccttgtggggagggaccccatctgacttcctgacccagagccctgtccttcatgcacccttccccaaatccctcagccttgtccccactcccagttcactgacaccccctcaagtgttcccagcccccactcccccttaggtagctatgaaatgtttgccagtccttcatatggagtggaggaacacgtgatgcatttaaaatcccaagggggctccagccataataaatggatcagggcttttggatcccgattcacacaaacagactgctaaaaagacatttttgaatcaattggagtactttgaatacgaactgtgtgttaggtaatacccaggaatttgtgttaattttgctagatgtgataatggcatattatgtaagaaaatgtccatgtgttttagagatgcgtgctgaagtatgtaggggtaaaatgacatgatgtctggaatttgttttaaaatacttcagaaaagcggggagtaggtgaaataagtgtgacaaaaccttaatagttgttgaagcggggtgatgggtacacagcagttcattatacaattctacttttgtgtatgcttgaaacctctcaattaaaaaaagagggtagagagtcatcaagataatttactaaaagtttcctgtaatgtccccagaagacccccctaactcacacacacacacacccacacacacactgccttttgagaactttctctagaaggccaacccaggcagtcccccaactgtaaggaagactcgtgtatgtatgtgcatatgtgcatttccccagggaaaaacatccacagcttccatgacgagaggggtcgtgacccctccccgccaaaagattaaggacctgcgatcctacagaccggagccctgtttgaagtctgcgttgcccctcacctcaagctggtcactgtgtgaagttggcctagaatcccccggcccctgggagcttgttcctccgcctgtaaaatggggctgcagggccgtccacgcggccaccggaaggacaaggtgttcaggccgctaggccgctccctggcaagcgattcccactcgcagcgcggcctcgaccctcgcccaagacgcgccctccgcgcccccaccccctccaggccctggccagtccacctcccgcttggggcggcaatttgtctccttttgaaccccccgcccccgacgggtttccccctttgattcgcggcccggaggcttccccccgctttgaaatgcaaacccgcctcggctggggccgcgggcggcccggagctataaaaggcctgggtggggcgggcgcggcggcaggacagccgagttcaggtgagcggttgctcgtcgtcggggcggccggcagcggcggctccagggcccagcatgcgcgggggaccccgcggccaccatgtatgtgggctatgtgctggacaaggattcgcccgtgtaccccggcccagccaggccagccagcctcggcctgggcccgcaagcctacggccccccggccccgcccccggcgcccccgcagtaccccgacttctccagctactctcacgtggagccggcccccgcgcccccgacggcctggggggcgcccttccctgcgcccaaggacgactgggccgccgcctacggcccgggccccgcggcccctgccgccagcccagcttcgctggcattcgggccccctccagactttagcccggtgccggcgccccctgggcccggcccgggcctcctggcgcagcccctcgggggcccgggcacaccgtcctcgcccggagcgcagaggccgacgccctacgagtggatgcggcgcagcgtggcggccggaggcggcggtggcagcggtaaggacccttccctcgccctgcgcctctggacctgcaggtgctcgggcgcggcccaggccgccccctgtctgacctctgctccggccctgctcgggttcccgggagtgtggccctcctgtccactctcgccctggggggctgctctttggctccctctcctcagtctcaggctatcggagccttcagcagcacagcctaaccctctctctgtacagatagggaaaccgagaccccctgcgaagtgcggaaatgcgcctgcggccgcggagcaagacccgaactagaacgcaggctcccagactcgtgtcccacactcatttagcaacaccgactccgtgctcttcatctgcttcttccactcctaacccagccctaggcaaaggcggcaggttcgccccagaagggacgattaactaactgtgtgaacagggcaggtgactttcctggccagggctgggtctccccatcacacagtcaagacattgctgggtcatatccttcaggctgaaaaagagccctctttggccagactggggcaaggggtctgtaccttaccttctcagggtcctccctgaactcttgaccccgggggaggggaagcgggagcagtgggaaggggggctactgtttggctcctgagcctgtgaacctcctgcccccaggcaggcctctctgatccgccctcttcaaaggcagggtagggggcaggacaaagggcccaactttaatgaggggcggcttgacctccgttatgggtcccccctttgtcatgcaactggctctgccttggctcggtagtgactcctgttggccggaaagtgaacacgacgttccattgtccggactgtgtccggcctgtcctgacaaaggccacctagccttgggggcgggaagctggcctgcccaccctttgatgtccagcccctcctccccttaccccagctgcgaataatcctgggacttctcccacctcctcgcactcttcacccccatctccccacacacacccagcttgcctcggggcagatgctgggttggccttgatcaggagctacgggttctggccataatcatatcccctttttggaagtcccggggatacataacctcctatctgcctccagggagatgcagggaaccagactctgccacttgcttctgtggccttgattaaataacagctaatgttttggaacacttaactaacggaccaggcatgacctaagtaagatcttgcatgcattaactcctttaactcttaaaacatcatcgtaggtactattatcacccccattttaagatgaagaaactatggcatagagagtttaagtacttgcccaaggccatataacctgtaactagtggggctgggatttgaacccaggtggactaaccactaagtctgtgctctaattctctacacaacagctcctcttaaatcagtcatcttttctgggtttcagttctactgtctgtgaaattagagagaagggagattatgcagtggtttgtacccttgtttaagttacaaaaggactcctttgaaaaatctgctgaaaggtacaaatgttgcatcattgggcaatttcaggggttctggaggctaccagaagctttatccataaatccggggttaagaaccctgtgttctatgagaggaggtggtggcagcaccagtgctcaggatcctgcagttcccagtctgtgaggctctggagaaggaagcctgtgtttcctgctcctgtgttccactttctgcttcctgctcatggggtgactttggagatgaatggggaggttccctatgggtagggacttggagagaggccatcactgtgtaagggaaaaggagtgtgtcagtgggggtcaggggactgggtatcctggaggagtttccaggagcttccatacaaatcacctcgtgtctctgggcacgagagctgctgaacctggctcatcctctggtctcaaaagtcgcttgaaaactgttgtctgcaggcagatgagtctaccccaggcaaaaaagcatttccccctccttgctctccgagagtagagggaaaggcagaaggaggtctgggggttcccaaggctccaggaaagggacttccctggagccaggttagccctcttccgcagaggatgcaggaaccctgaccttcttgaagccagaaggtgctgcctgtcttcccagggcatctgactgtctattcagtgctcctgaagtgggggcagaattgggttggcactgttgactctccctgagagagaggccaagcccctcctgtctttggcctcagtttctccttctgggcaatgaaggcatagggtttccaggggtgcttcctgtgcaatgctgctgtccaggacagctgaaggaggatcagtgcatgccactgccctcctaatccccactggcactggccaccaggtcttcagcctgccaccaatcctggctagcccccttttgccccacttctgagcctccagcattcgagagtggacaaactggacagttagagaccacacatgtagacgagggaaccaaggtacagagactgtgaagaatgttccagtttcacacaagcggggctgagctgggctagatgtcagaagaattggtttagaattttcctatggtttcccatcatatgtaggataaaccccacattccttcctgaggtctacaagactacagcatttgcacctgcctgcctccctgacctcatccccagctgctctcaccttggcttccaagctctagccattccagacttcttttagttcctcagacctgccaagtcctactgcagatcttgtgcacatgctgttctctcttccaggaaagctctttcccctgattctttgcaagagtggaaccttcttacccttcagatcttagtttcatcgtcacctcctctgtgaagccctccatcatttcccaaagtggactccccactacacccatcacgaatctttgctgtgtttccttcagagcactaattccaatctactcacttccttacacttgtttgtatgttgtccattcccgtgaggtccagaactatgtctgcttaacccactactgcatcctggcacccagctcagtgcatggcatttagtaggtgctcaatatattttgttgagtgaatgaacagggcaagtgtgagggacaaaaggcatctctggggaacaggggagtgggtgagatcttggctttcacacaggtttctgaggtcccagccctaggattgggacctgtgactgtcaagccaagcagttcaggtcaatggaaacctggctgcctctgtctctccacttggatggtaccccaactcacctggggaagtggggttgctgaggctgggactaagacttcagtttcttctaaggagggggcagtgacaatgggaaagatgagagagaggctgttgggcttcaatcagtctccgattccaaaagacaatattaatcagttatgagtgatcagcatcatttgactgaggccaggataggaaatgactacaagacgttctttttttttccttttctctttgcattttcatgaggagggttttaaatatcatcattttcattaggatggttacgcatcatccttccgtggaaggctcagcctccaattcctttgaataaagctgctccacaggttaatggcccattggggtggctgaggtctcaggactggggagatgttcacgtggatgagactgtgggagcaaggtttagatcttggtccaaccctgtcaactttcagatggggaaactgaggcccatgaaggatatgaatcctcccctccccccacattgcaggtcctctcccttggcccattgccacagccaccaacctgctgtctcaccttcagcctttctgtactgctccagctatcttctaaaaccattgccatatttaccttctcaaggcacatgccctgctcaagagcattctgtggctccctactgacatggaattgccatttcattttatgccatttcttttttcttttttttgagacagaatcttgctatgtcacccacgctggagtacagtggtgcgatctcggctcactgcaagctccgcctcccaggttcacgccattctgctgcctcagcttccccagcagctgggactacaagcgcacgctgccatgcccggctaatttttttgtatttttagtagagacggggtttcaccgtgttagccaggatggtctcgatctcctgacctcgtgatccgcccgcctcggcctccccaagtgctgggattacaggcgtgagccaccgtgtccggccttttatgccatttctttgttgtaaaatccagctccatttctatggcaatcagagccttcttgagaactggcctcaaccatctattgaagccattctcctgctactttgcctagataaggcaagttaagagccagggcttgggagtctcagagctgggattgcatttccataagaagctgtatagcttcggacaagttaatttggatcatttctcggagcctgggctgcttctgctgtaacaggataataataggattgcatctcagaagagatgcctgtaaagcaccgccctgccgctggcacacagtaggtgcttagggcatcggtgcctgtgaccacctctaccagtcctcagcaggtgcactggagcacacacctcacactcccagcctctctagtctggtccctcggcctgcattgccctcccttccctctcctgcatcttcaccagctcaaatgctgctccttctccgaggctgtctcctgtaggaagccctccctgattcctcctcccaagcactgtatcaggcccttgttttcatgacacttaccactgcctgtctactttcattgtcttgtttatccctgccactgaccatctgtagtccctcaaggaccagtcctaatcagtcccatcctcaccctgtcttgcacatagtaagagctcgtgataaagcaaataactgtggcattggctaaatctttactgtgtgccaggcactgtgccaataactttgcatgggtgatctcacttaagtctcatgatagccctgagtggtgtaaggatctagtatactcattttatagatcaggataatgaggctcagagagggtaaggtggcctgcccaagctcatacagctaggacatggcagcacagtgtttacacccagtctacagcccagcaatcgtctgtgaaataaagacacactcacgaaggggagcctgagacccccccttccccatgggcatcccagccaggttggggggaaaggaggccaggcaggggatgtactgtaagaggctgggggaggagggggcccagcaggggcctggctgtttagaaccgattctccaggcagaagctacatttgacacctcatcgctcagatatagctgggaaagggaatgacccagttagaaggtggcagaaggcttttttttggttgggtgttttctccctgctgctttggcagatattgctgctcagagcttggggaatcattgtgaaggtccaaaatggtttgttagcagcagggtctggtgtgtccataggaagttatcttaatgggccggcctctcaggtttttgtgttggagctcctgggatatggaaacaacattcacatctggagtcaaggccgtcaccatgttagcatgccagaccctccccatgccacgctcacccctcaggcttgtgggggcaccccacatggatcccccccatcaacagaaagagggagcaagctaggctccacaccctcccatggcttccttttgtttttgaaaccaaatccatatccctctcctacagaatctgctggcctctccagccccatcttgtgcctctctcattcattcattcattcaagcaggcaagcagtaatattctctgagtgagtgtcttctgtcctgaacttgctcctaggcattggagatgatggcctgaacaaggcagacgggtccacctgcatgcagagagctgccctctctgccctcactctgctcctccctgcctgggggcctttgtacctactgctcactctccctggaatgtctttccctgttcatgacatggaagcctccttctcaacctcaggtcttggcttaaatgtggcctgttcctggagacctcccccagctaagtaaagtagcgttcttcccctcacctcaccagtcggtttagctcattgctcactttccttcctgctgctaatcccagtttgtcattatttcatttgtttgtttttaatctacctcccctgccatgaaggagataatgaactatttatcaaataagtactaagcagttattatggtaatcataatgcgaaccagcatctattgggtgctcagtgtgttcagcattttttcaaatgcaagatttctgtccccggaacagcacatttcttctccatcaaatgagtggctggactaagctttaggagcaatggagatggacagaaggctgtgctttggaggctgagccaccagctgctggagtggacttggggagcaagggagacaggactgagaggtgccaccttggcttttgatctgaatggctggaggatggaggtgctgtttattgagttaaagaagcagaggaagtagcaggtttgttttatgtattcaccaaggattcatcaagtactcactgtgtgtgtcaggcacgtgataggtgctggtgagctaaatggcatggccctaccctcaaagagcattcagggagccaaggcctaaggggagggtcttcaccaaggtcacacagccagctaggggtaggaaggggctggaggcagagcccctcactgcagccccacctcgaacgtgagacttcgggagccacacctacagtggagtagcaagggcttcactctcagactagtctagtggaagatggccaggggggcagtggcctggaaactccaccaggaaacagttcagagaggcctcaagttcttcggcctcagagaagacctgaagggatgcagttgctgtttgtaaatcttaaatggctgtcttgggctcagggtgcccctgtggaaaaactcaggaaggatataaatgggtggcagatgcaagaactggctgctttgcagctagtaggcgtgtgctgcagtgtgggcgtccggaccctggtaggagtttgatctagcagcgtttgtccagtaggactttccgccaggatggaaatgctctgtatctgtgctgtccagtaggcagccaccagctgcacatggctgttgaacacttgaaatacagctagtgtgactgagaaacagaattttatattttatttaattaatgtggctagttgctgtcatattggacagtgcagaaaaatctctctcaagagttcccagaatggaaatccattctgcataagctccttgttcttgcattgaggaatctctcctgcctttttttttttttttcctgagatggagttttgctcttgtcgcccaggctggactgcaatggcgcaatctcggctcactgcaacgtccgcctcctggattcaagcgattctcctgcctcagcctccagagtagctgggattacaggcacacgccaccacgcccagctaattattgtatttttagtagagacagagtttcatcatgttggtcaggctggtctcgaactcctgacctcaggtgatccacccacctcagcctcccaaagtgctgggattacaggcatgagccacctcgcctggcctctctcctgcctctttcagcttctttgtctctgtagtatcatcatcatcatcatagtttttattaataagtactttgttaagtaggttattactttggtctccataactaccatataaagaaagtattcatgtcttcattttaaagataaataaactgaaactcaaagaggtccagcaacttgcctggggacataccactggcacatggccagtctgggggagagccaccggtctctgtctgactctaaagtcccttcctctttgttacctcccaaagctgggtcagattgtggaccttgatgaagaagatagggcagcagatgatgcaaaggtggccctggaggaggagggtgcagagatgatgaagaactctaactaggaaggagggtgacagtggggaggagaatctggctaaggctgtaggactcccaaaatggctggcctggccattgtccccctttccccgctcccatgccagcttcatccctgctcagggcttgagtgaggaaccatgatattagcagccggggactgccagatcagccaagacaaggacccaactgtgggtcaggcagaaagcctgatgtcccaggaagggtatccatccattgtagagctggtgaggttagggcacagtggagagccctccccctggtggtacagatggggaaacaggcccaaataagggatcacatgtccagctggtgggccggccagatctccccactcccaggtcagtgtgttcttggccctatggctccccattaggcgacattcctctctctcacgagggactccaccaacatgctcacttctgcaaatagctgttttctcctttttgtctccatagctttttaccctttccagactgctctcacagccattctgttccccaggcaggggaaggaaagcccagggaaattcagtcacttgtcaagtccttcaactaagatgaccaggctggaccacagtccaggtctctgccaccaggcaaggtctagaagctcgccccaaacacccagcctttcccaaacctcagtagagtgtgacgctgctacaatttaggcccctcaccagaagtgccaccacctctgagctggcccacagcctgccacccttgcagcgctcctacaagtattatctggggtgagatcagtcctcctgagcccctctttcccaccctttcctttgcctattggccttgcagtcatccacagcaagtgacctataagctctctggacttgcttccttatcttggaaaagggggctctttgcagtagcattctatggctaccctattcccacctcccctgagccccctcctgccaaaagccctatgcccttcgtttgtcattcctaggctggcatcacagacacgggtgagctccccatcgcctgttgctgcatgcagtgtgggtctctgagggacttggctggagggcgtgtggggcaggtgctccctgtgggggttgcctggggtggcaggcagcaaggtggcagggggggccaggaggtctgatctttaagggaaggctcaaagctgcacaaagggctcaaaactgcagagtctcgagggcacttggactggtgcacaggctaaaccaatgcccagaggagaggaggaactaattctaggccacacagatggcatggaactgggaccaggacccactgactttagctggtggtttagaatccacaggggcctcgttaaagatgacagagaaattaggatgtggtagatctggagtggggcctgggaatctgcattttcagcaagcccttgtgtgtacagacgtgcatgcctgtttgcatgtgtgtgttggggttaggatcttgaagcacagccagctggggctggaccacccagggaggagtcacaaaggttttcagagctggatttgtggtccaggcctgggggggccaaagctggtcatccaccagggccacacacccggcaggaagagggcaaaggaagtgctgacctaggggccatttgattgtgctggagcagaggccacactctgtccttgcctggcccaggctggatggggagcccccactgcaggccactgtggctcctgtccccatcctccccccgggcaggcccagtgtctagactctcagactgaaattggtcttagaattctttcagctacaataacaaacacaatcagagaatcaacaaacattgggaggttcacgtttccaagttggaagggaccttataagtaaacggtcatttctagcagaccgcccattgcacagatccattccctggcattcctgccagatggtcatcccacaactgttggaaatgagtaagatctgcccttccccatgcacctcctgcatgctagacattgtccatctatctcaagtgagcccctgtatgccgcagggttggagagaactacaagaaaccttgtaccatttgattgataggttctactgctgtttctgaggccagatagacctggttttgaatcccacctgcctgatgcgtggtcctctctgaccctgagttttctcatctgtaaaatagagtgatagttgcccaactccacgggtcattgagagatgtatacaaagggcccagcacatggatgtgttggctattattagaatattaattttccccattttacaaatacagaaaatgaggctcagagaggtggggagactgtcctaggttacccagccagtgagcagctgcactccacaaccccagaggtttagttttaatgacatccaggagctctgggctggaactcctgactgccccgagacacctctggagtcacagagtgtacctctgttgggctccacagcccctctccagagcccagagaagggtgacaaggtctgtgggccaggtcttcaccggcagccttgccaggacagagaggagtaattatggagctaaagcccaaccaaccacacgttagggtcacctggaaaactattcaagtaccaaattttgagacccattctagcgccactaaatttgaatttctggggccagaatctgcactgtgaaaaagcttcccaggcagttccaaggctgctggtcaggcactgggagccattggcctgtaccgtgcatgcattaggggacgggagtttgctacctctcatggtggcctaatccacatggatgggacattctgcgcatcccaaaactggagagagaaagcctcccatttcggtgagttacccaaggctcttcccctctgtgctcacccctgaagagctgagggggctccccattctccctcccacccattcacactggcatctggcccagaggattacttattaggtggctgggagtggcccgcccctcagcagacacctgttataggagcctggacttcccccttagctccagcgtcccaggggcctgtaaataattcatccccagccctctccccaccccactgctctcacacacctccctgcctgctccttcccaggctccagaggtatcttggggcagttgggagttccagcccagagctgggactggagcccagggctcctggggctgtcattaaaaatacaaattaacacatacacttgataaagatttaaaaaacccaaagtctccctcctacctgtggctttccaacctccagtgccctctccagaggcagcccctattactggcttcttgtatattctttcagaaagaactatgtttgggtatgtgtgtgtctcccccatttttatacacaaatggtaacatactatttacactattctgtcttgctttttttttcacacgtcttagaaattgttccatactgggacatatggggttttgaaatttctttttaatgactgcataatgctcctctccacgaatgcaccatcccttctctcaccagctccctgcttgtacacgtgtacattgttttttgtcttgtgttatcagaaacagatggagctttgggcagctcttggtcggatcagttactggaagtgggattcttcggtcaaagggtatgtgcctgttaaatgaggctagatatcgccaagttgggcgctaaggaggatgtttcagttctcactcctggaacagcatatgggattccctggtttctgagccacacggtgtgatagcaaacattttgttctttggcagagccattttcttgcacgaaaattgtgtgtttcaagcagctccaccagagagaagttggccaatgggttcctgagcccaccagctcctctccagagcccagagaggagtgacaaggcctgtgggccaggtcttcactggcagccttgccaggagagagaggagtaattgtgcagctaaaccctatctccatctggtctcactcctgaccccctcccttgtggaagagctgggcctgaggtcagaaacctgagtcctggttcataccatgaccagtcaggacagccctctgcaagtgccctttctgagcccatttccccccacctatgaaatggctctcatgggtctgggcttgctcgtcagaagaggcaggagtgggtgctaggactctaaggaaaaagcaccttcaggaccactgcctgtcatccctaggcgaaggtctgggtgggcagggagcctcatgccctacctcaggcctgtcctcctgggggtggctgtgagtcctctgggcattttaagggcccccagcctggggctctcagtagccttccctcaccatggtctgggctctcctttcccagaagtagcaatggaggggtggtctgctatttaagcttctgttaccaacactttgggggctccatggcaggctcagtgggccctaaatttggcagcatgcggaattgtaccctggagaggcagcaagagctctagggcatggggcatggccttgggcaggcccgtgcctgcctgggcctcagtgaccctgactacacagggaggtaggactggaagggctcaccaggcctcttctttggccctccagctgccatgcaaccattgtgaaccccgatctcttcctcagtaaagtgcgaggagactaaactctcacaaccgcttccagctttagcccagtgaacccaatgggtctgtggattcagagccatgttggcctccagtgctggtggcattaggcagaactgtttttgagccggcgttgcattttctaggccaaggaggggcccaatctggagccaaggcctgggcagccactcccttatccctttcctggggccaaacctggctgaagtccgaggctatcccgtgctatgctgggcagcggactgaggtcagtggacatggaagcgtccagtgtggttcctctgctctggcaggaaacccagggaaaagctgcccaggaacatctgctgcctcccattctccacaaagccatttggctcacggagagcccagtggctgtcctgccaagctgcgtgggcttggtggagggggacaggcgtcagaatgggggcgggtgagtggttagtacaggggtgctgagggacaggcagggccagggctgaaacccaagaagatgaaggctgggctgtggtggggacacttgcgagaggcgggaggggttgatggtctttcagagacccgccatgccctggtgggagcgtgtgcgggtctggaagtgcttgcgtgcgcctcctatttatagccacgtgctcagcttcttataaaggaaactggtgcttagccaggccccacacaagcccaggccaagcatgactcttagtattctctccagacagacctctgatcccagtcccaaagaaagtcctgacattaacctcagctggtcctcaaatccagctctgggccccaggctgagcctcataaagaagccaaggcaccgccctctctcctgggttacggcagctctccctgcacttccccttcctcttgcaaatctgttctccatgcagtagccagagtaatattaaaacctacatcagacttcatgtctcctctgctcagaatcctgcaatggctcctgtcccagacagaggaaaacccagagtccctccccttgtctcctgtcccgtcccccttctcactgcacctcagctccaccagcttcctcacagctcctcactgtcagacagcaggcagacagcaggcatgccccacctcggggcctttgcacttgctgttccctctgcctagaagcctctccccagatgtctgcatgactcttttttttgtttatttttcttgagacggagtctcactcgatcacccaggctagaatgcagtggtgtaatcctggctcaccacaacctccacctcccaggttcaagcaattctcctgttttcccgcctcagcctcctgggtagctgggattacagatgtatgccaccacgcccggctaatttttgtattttttagtagagatgaggtttcaccatgttggccaggctggtcttgaacccctgacctcacgtgatccacctccctcagcctcccataaagtgctgggattacaggtgtgagccaccgcgcctggccctacatgactctttcctgtacctcctttacacctttgctgaaattccccttttcagcaaggccttcacggcccattctatttaaaatcacagaccacctcctccctaaattcccagtcctccttccctgcctccttttcttctgaaacacttatcaactagtgtatcaaatattttatgtttatttttcttttcatcatctccctcccctagaagctaagcatcacgagggcaggggttttattttgctcagtgctgtagcccagagcttggctcacagcaggagctcagtgaggatctgtgggatgagctgcatctctcctgcccggtgcctggacacagggggatgtgtggacggcttgggcagaccagcctccggcctctggtgcaggcccagctcagggcttggtatcgtgagccagagcctttgaggtaactggcaggtcctaggggtccagcagcagccccagtcctccctgtctgatgttgaggccatccccaggcattcggcaagaactagggagcccacacctgggacagttccagattctttctgcttccacctctacctgtggtggctcttcccttctctcttctcttgcacaggaggaaggagcagctgccatctcattagtcttgatcacccttgcctgcccgatatcccctccgtgtctccagcattcaaacctatctgatatctgaccacagagtggagagtttgttaaaaatgcagattccacccccaggctttctgactaactggtcagggatgcccagaacctgtgttcttcacaagctcctggagaatggctgctgtgcagccacatctggaagctgctggtttaaagttgttggagctggccttcagaatagggctctgggtcaggagacctgggctgaagctgcagctccgtcagcagcctgctgtgtaaccctgagctggttgttttgcctacctcactgcctccctgatgggcatgggaggagtacttgcctcccagactgtgagtctgtgggtctgagtctgggaaatgactgtttcccttgaacctggagtgtatgtctctccccacctcagggtcctacttcagggagcctggattgtcttcctcctgggggtcctgcctgggccttttttgtagcctcctcctctcaactcaccttccttcccggctccttctgcttctcaggtaagactcggaccaaggacaagtaccgcgtggtctacaccgaccaccaacgcctggagctggagaaggagtttcattacagccgttacatcacaatccggcggaaatcagagctggctgccaatctggggctcactgaacggcaggtgtgtctgtcttcctatctcagccataggagcagtgcgaggactctggtctccaggctgccaggcagagtacagagctcagtagaaggaaaacagagaggttgagtctccaggccattgtcacacagcacagcagaaactgaggtgctaccagcaccctcccttaacaaaacccagtatccttgcccccaaaggcaggggtaaggggatctgattagccacaggctacagcaggctattattagtgctgtaggaggtgcacgtgctatttacattaggggagcagtcacagggataacaaggaaggcttcctggaagaagtgtggcctgggaagatggagagggggaaggttacaaagaagggcatctccagggtaggggtgcaatgtctagagggggagaatgaattcagggtccatgtggtctgggaggctggagaggagataagccacaaagccacatggagaaataggggctcactgtcctcgtctctccttcttgcactctctctttcactctctccctgctgcccactccatctctgtcctccaaccccacaggtgaagatctggttccaaaaccggcgggcaaaggagcgcaaagtgaacaagaagaaacagcagcagcaacagcccccacagccgccgatggcccacgacatcacggccaccccagccgggccatccctggggggcctgtgtcccagcaacaccagcctcctggccacctcctctccaatgcctgtgaaagaggagtttctgccatagccccatgcccagcctgtgcgccgggggacctggggactcgggtgctgggagtgtggctcctgtgggcccaggaggtctggtccgagtctcagccctgaccttctgggacatggtggacagtcacctatccaccctctgcatccccttggcccatctgtgcagtaagcctgttggataaagaccttccagctcctgtgttctagacctctgggggataagggagtccagggtggatgatctcaatctcccgtgggcatctcaagccccaaatggttgggggaggggcctagacaaggctccaggccccacctcctcctccatacgttcagaggtgcagctggaggctgctgtggggaccacactgatcctggagaaaagggatggagctgaaaaagatggaatgcttgcagagcatgacctgaggagggaggaacgtggtcaactcacacctgcctcttcctgcagcctcacctctacctgcccccatcataagggcactgagcccttcccaggctggatactaagcacaaagcccatagcactgggctctgatggctgctccactgggttacagaatcacagccctcatgatcattctcagtgagggctctggattgagagggaggccctgggaggagagaagggggcagagtcttccctaccaggtttctacacccccgccaggctgcccatcagggcccagggagcccccagaggactttattcggaccaagcagagctcacagctggacaggtgttgtatatagagtggaatctcttggatgcagcttcaagaataaatttttcttctcttttcaaaaatgtataaaaatcattatacatagcattaaagaaacatttttgagaagtacaaatcatcctcaccttccccagcaattgtgtattcctttcccgtttgtttaggcccacaacaaggtcacctttaaaatacatttgaaagatcaaaacagaacaccattcgtttaggtctatgagactacgtaaaaatgtgagtccattttgtaagcagattcatcagactcaacatatcagtcttttgaatttttcagatatgttcagttcaggtttttctttcaataatgacattcattgctcaccccatgtgctacgcgtggctgggcctgggaagcacacagtccttgtcccctagactggagaaggggtgcgagatcatgtcttgggaagatgtggagggggaaggttacagagaagggcatctccagggtaggagagcaagatctagagggggagaatgcattcagagtccatgtggtctgggcagctggagcaggagagaagccacaaagcccccctcagggtctgacttcaggggtcctgaattgctctgcagaagtccccagtccagtggggaagactgctatgcacacagatgacactaatataacaggataagggccaatctgagcgtcaggggagccagggcatccaacgagagcagagcacatgcctagcttatcctggaaggcttcctggagtaggtaatgtttgaactgagactgaaaaggactagcgagtatggatcaggccaagaagggaataaaggagaaaaggaacttgagcaatatggactgaaagtataattttttttgaactcgggagtctactacccggggccttctctccccgggggctctggtgccagctgcctgcccctctgtttactgttctgggaggtggccaggccataaaaagtgtgcacagcctgcctgacatcgccctttgctcccatgataacagtgcacaaggtggatcctggcctggcacaggcccctgaagtgcagcaggcacttctctctctcctcctaccagtggcctgggagacagcgggcattcattagtaatggtggacacctgaggcttgggaaagaaccagggttccaagagtagagggggaggggctggtgaaaaggcggctggcccggactgaatagagttttctgatcttcaaaaaaatatgctctgtgaccctagggtaactgcttcccctctttgggcccgcattgccccatctgtaaacttggggaagttgtctaccagaaagaaataactctggtcaagtaagtttgggaaatcctgctgaagccacttctctgatagagtcacagtgggccattagcacatcaaagtctctgacaagccccacagcaaagaaaccccttgaattttctttcatctggccttccccgtgctttgctacctaggaggcccctactcacacctcccagcatcccactgaactccacacactgcagtgctgggatgttcaggctggagggcctcaccttctctgtgtctcagtatttagcagcaggttttgtcgtcaaatggcctggatttcagcgtgactacttccaaactgcaagacttcaggcaagttacttagcttcttggagcctcggcctccgcatgtgtcaaatggaaataaaatagtctaactgagcttagaattgtgtttcgctcagggcccagcacataagaagtgcctgtttttgagccacctgctcacggggctgctgctgcatcccagtgtgagaggctggcaggcgtggctgatgttctacccacctgaaggaggacaagcctgtctccgcattaggaagacctctgcccggcaggaggtcagtggccactcctctgatagagtcacagcggcgcattaccacatcaaagggtgagctgcagcagttgcccacatgggaggtcaggaggttggatgcgacccacaggttgggttggtgctcacctaccaatgggtgtttagccccatgaaaaaggaaa

SEQ ID NO: 16257 - DNA, 20721 bp, Human
aagacagggagggggctatcggaggcaggaggatatgatcaatgaagatggaagctggtatgggagagtggctgtgggcccagacctcaggctctccctaccttgccttgtgggattggacctctcagccaagctgtcaggatatggggagggggaatactgggggacgttttctggcttgtaccagtcctaactaaggagtcagatctcctgaatactatttctgccgctgccacttgcctggtgactttggacaagttcattctctaacctgaacctcctctggctaagccctagcctggaggcaccaaaacaggccccactgggtgtgtgaggtgtggggaagaatgctaaagggctggtagatgtgagaagactgttctcaggggctggtgttatcaacctccctacatacacacacattcacactcacactcactcacacacacactcattcattcaagttctctgctctggggcagctgggcttggaaccactgtggtgtgtcttttttctttttcttgtttttttttttttgagacggagtctcgctctgtcgcccaggttggagtgcagtggtgtgatctcggctcactgcaagctctgcctcccgggttcacgccattctcctgcctcagcctcccgagtagctgggactataggcgcccgccaccacgcctggctaatgttttgtatttttagtagagacggggtttcaccgtgttagccaggatggtcttgatcttctgacctcgtgatccgcccgcctcggcctcccaaagtgctgggattacaggtgtgagtcactgcgcccagctggtatgtcttttttattcactgacatgagtgacttcttgagaccatttgtgagtctcttgggtcctgtttccattcttttccactctccttctcttccctctctgccctccctccccacaagaggccctgtccctcttgctgggtgctgggctggggggttagcaagctttatctcatttaatcctttaacacttccaggggctaggtcttagtagccccactttataaataaggcaactgaggcacagaggggtgagactcactgcttacctgctggcaggctaggcaacctagagccaacagggcagagggttggttctaggttgctacctcctctcagggtcctttcccttttctcaagcagaattgggcgggaatgagaaaatgccagatttccgcaaaggagcagcattgctcagagatgaacactggacttagagtcaggggatctaggtccaagtcttgctgtgcctttaacttgctgtttgaccttgggctcatcccttcttcctgaaacttggtttcctaatctgcacaatgatgaagctggaccccagattcctattgtctctctctgtcctgaagagtcttggcttgggcagtcttgagtctcccagcccctgctgtgagtccctaaaggcgagcatgcaggtctgacaaactcagctgtgtgttcctgcatgcccctggggtagggagtgggagattcaggagtgggagccttacacccaggaagaagtatgaagcaactcattcagcttccagccctgccccagctatttgattgctttcttccatctcccaaccagccccatcctcactgtgccagcctcctgggattcaccccatggtggggttgggaactccagttgggctcctgattggctcagctttggaggaccctatctcctgcccctggagcagaagcaggcttccctctgattgggggaggagggggacgagctggcagcatcctgctcttggaactctagtcaccatggaaacagagaaccgggaccgctccatgagcatggaaagggcagcttctctggagggatcagaggatcctcattactgggacctcctgctaactggcctgaatggtgctgggatgggcggggggtgtctcagggtaacaggcctgctcaccacccaacaccaggaacagtggcaaccattcctcccggagctcacctggggtgagaggttgctgaaggctgatgctcacccagctggagaggcagcctcagggaacggggcattggaggggaagggtgggtttcacttaagtctgggatctgctgctcctgtcacctcagcatgtccatgatcacagctaaagaacttccaggcatgtatttgtttcaccccttgcagcctagttactttaaaaacagctcttcatgctctgtcattgtcatcgtcacccataataatgtctggctgttcctgtcaccacggcccctgtggccaatagccagtttctggcaaaatcaccactgtggtcaccatcactgagggtctcctaagggagaatgccccatggacctctcacccactttgaagcatgaaaggagaccttaggaacagctggcctccgctcccctctgggcatgcatctcctctccagggacagcaagattatgactttctgacacagatcacggcttaagtaccttcttcctgctcatgagccaaaattcacaaaattcacccagccctcaggctctccctaccttgcctggtggggtttgacccccccagccaagctgtcagcatgcggggagggggagtattggggaagttttctggcttgtgactgaaaagtaccagtcctaaccaaggagtcagatctccttggttcttagtaggccccatttgagccacggagcatcagtggattccctccctcaggggaacccccaggtccctccaagtcctctcctttctatgctgagggctcccagcttctttctgttgtcctcctatcacctcttttcctgaacaccctccagcctggccacctgccctttggacatgctccatattgtctgcatctttcttaaaatatggtgcccggaacggaggaacaaaactccagcactggtgggtgaaggagacctggctttcgcatcaggaagccttgggctccagacctagttcttccactcaccaacctggtagaaacctcgggtatgtcatgacacctctttgagcctcagttttcctcatgacgaaaatggagcttagatgaatactgagctcaaaaagttgttctgagaatgaaatcaggtaatgtgagtgagatgtctagtgcagtgggcacatagtaagtgctcaatatacagtaacttactaagatcatcatcatgctcttcatcttcgtcatcctcatcctcatcaaaataggaccatccagccggccacggtggctcatgcctgtaatcccagcactttgggaggccgaggcgggtggatcacgaggtcaggagaccaagaccatcctggctaacacggtgaaaccctgtctctactaaaaatacaaaacattagccgggcgtggtggtgggcgcctgtagtcccagctactcgggaggctgagacgggagaattgcttgaacccgggaggtggaggttgcggtgtgctgaggtcgtaccactgcactccaggctgggcaacagagggagactctttctcaattaaaaaaaaaaaaaaaaaggactatcccttgatttggcatctgtgttagccagactaaggtcagggtagctttgttagtgcctaagctaccctgctggcccagtaagttttggtcgcctaaaatcctgaggctctcctgcatatgacaaggttagtccagttgagagcacttgattatctggactgagaatgtcttttcatttagccctgttcaattccagagtcttgtcttgaggtcacatttctggcctggcctcagtcttctccccaacctctttggtctctctcattggcagcctgtcaccccagacctgctgatgacccccagtgaccagggcgatgtcgacctggatgtggactttgctgcacaccgggggaactggacaggcaagctggacttcctgctgtcctgcattggctactgtgtaggcctggggaatgtctggcgcttcccctatcgagcgtacaccaatggaggaggtatgggcctgaggtcctgtcggagggtgtctggggtgatgggccaaggccctggggtacagtgagcttttaggtggcctcagccactgtctcctaggcgaccttgggcagaactcattgaaagtggtttatagtaacttggggctgggaggaaggagtttaccctgtcttgtccttctcatcacccaagcccttccttcctccctctcatccccaggaaggatacccacatggttccctctctaaggctggccaccccacgccctgcacggtgggcagagggagctgcctctgcttcgtgataaggagctgtatctgcctgccgatgatcactgcactttcagtgttctccccaccccctccttcctccacctcctcctgagctgtgctccatcaatcattccctctcttgagtctccaatctttcctcctctcttggttccttccattcaggctgcaaacacaaagtctctcccatcttaaacaaatttcctttcatccctgcttctccatcaagtgacggttccaagtctcattagcaaaagctggggctgagcgcctaccacctgtcaggccctgggcttggtgcttgctgtgcccatctcatttaaccctggtgatgaccctattgggtaggcaccatggatatgatgaggtagctgaaacttgaagacaccagcgtccttgcccaaggtcacagggtggcagacccaacattccaacccaggactatctcctccctagccagtgtgctctcaccagtactcgtatctccttctgtctctagcaaactctgaaggaagcatatattgagaaagtgagagaaatccaaataaagctagatgaagcaaagaaaggataaatttacatgactaggatgtgtgggactggagctggcctctgaagctctaggaccttgatgacacccatggtgtctctcggcaagcactctccccatgtccctactcttcctctctgtgtgctgacctcattttgtcctgagacaggcttcctccccgcagttggtgggggacaggccttggggggaggtggccacagacaactctgcaatgacttcatcctccaatgggtttagcaacccaagagctttgcagaactgctctgtctgaatgaatctatacagaattgcagggaaggcctctgataggcctggctttggataggtgcccacgggggaaggaggagagggcggtgaaccccctccttccagccccaggttatgataaaacacttccaactaattctgcccaaggtcgcctaggagggggttggttgatgtgactggcagcccttccagagtcatatggtggtgggcagttctctaaagaagtgactgccaatgtgagaaccaaaggggaagggctattgggcccacggaaccacaggtggcagtcacaagtgtctgaggcggcatggtggggaggggcaggcagatagaggggagccggattctgaagggtgctggtttctgtactgaggagtctgcactttcttcagcaggaaattcacacattctctccctcattcattcattcactccctcagcaggcgtttctcagcgtctgcgctgagcccagcactgttctgggcactggggctccagaggtgagtaaatccctgctggccactctggccctcagcagtctggtatagaagaaaagaaacctacagtgttccatcaggtctgagggggcatctgcaggccaggggaggggcggggctagagctgggcttttgagggagctgcccccaaggcccttgctgaccaccccgctcctggcaggcgccttcctcgtgccctacttcctcatgctggccatctgtggcatccccctcttcttcctggagctctccctgggccagttctccagcctagggcccctggctgtctggaaaatcagccctctcttcaaaggtgaggcctcagtggtccccagggagggaagggctcagggtctgggggaggcagggaggttgcccccagaacccctgccagctccaggcagaggtggaagtgaagcccagatagctgccagctccccagaagccactccacccggctggcagagagcttggcctgggcagcccagcagcctctccccacaccaggcgccggcgcagccatgctgctcatcgtgggcttggtggccatctactacaacatgatcatcgcctacgtgctcttctacctcttcgcctccctcaccagcgacctaccctgggagcactgtggcaactggtggaacacagaactctgcctggagcacagagtctccaaggacggcaacggggccctgcccctcaacctcacctgcaccgtcagccccagcgaggagtactggaggtcaggcagctgctggccccgcggcatctgaggggaccctgcactgctgagggtggccagagggcatcccccacagtctcagcatgtaccgccaagatgagctcaggtggtgatggcaggtggactctggcttctaatcccagctcttcacctgaccagctgtgtggcctcaaacaatttatttggcttctgttgctttatctgtagcatgagggcaataatactaggtatctcagaaaggttgttgtgaagattaaaggagagaaagcatatattaataaattgtgcagtccagtctggtggatagtaagtgctcaataaatactagctgagaatgatgatgatgatgataacagtaatagtaacattatggagtctcagtttcctcctctgtaacaggggttggtaacagtacctgcttcataaggtgttatccagttagtcatttacccactcattcattcttttaataaatatttattgagcaactgctatatcataggtaaagcacttagcataaggccaggacgtacatagtaaggaccatctcagactcctctaatagagataggactataatagagtaagggactgtcatcagaattaaacaacataatgcaggtgaaaccattatcacggtgctgggcacacagtgggtcctgggaatggtgggtgtcggaaggacgttgcactcatcagcctatcccaatgccccattttatggtcaataaaacaaagccttgtcactgcattctgcctttaaaagaagaaagagaaagaaagaaagaaagaaagaaagaaagaaagaaagaaagaaagaaagaaagaaagaaagaaagaaggaaagaaaaagaaagaaagaaagaaagcaaagcccagaggcttgctcagtattgctcagtaattagtgacagagatggtattgacactaaggactcctgagtcctgatcctgttctggaacattctaaaatagcctggtccctaggtgggactgttggctggccagagaacacagaccctataacccccatcccttacctataaaggactgctgttaggagatttctcccagataggctccatgtcttgaaatgttttggtctttaacctgcctgtagtacatagttcattcatttgtccacttcaagtccatctgaagtgtccgcacctgctgaagagtttatctgaccagtgggaaagaatcagcctgagtttgcagcttaaagccaaaggatttgatacaatcactggcagctgccagggtggttctccatggccatgccacagcccactgcatcagtcaggatgcaggcaggaggccgatggattgtcagagggtttcactgaagggagtttagtgaagggacttttcagagggtcatggaagccacagcaaaaagtgaagcatcagtgactagcaacagggacagctatcaccacccctgaacctaggaggcaatgggagggaaccaggagagaatcagagccttggaagaggggctacctaaagaacacagtcatggccaggccctggatggtgtgtgtgtgtgtttgtgtgtgtgtgtgtgtgtgtgtgtgtgtgtgtgtgtgtgtgtggtgtacacatgtatatgcaaatacccagacccctcattcctcccctcactacagtctcccactgttgcctcccattagccaaacccacacggaagctgaagaggaaggaagaagaggaagggtggtctcgaactcctatcctcaagtgatcttccttcctcagcctcccaaagctgaggaaggggtaaggtctggtgaggccagcctcctgggtcagagttggtcggagaaggatggagagggatcaagagggcgtcaagtggagaacagcagtagagccttgtgggctggacatggcttgactccatgtctgtggagcctggtggggtgaccaggggacactgagacctttgtctcccacagccgctacgtcctccacatccaaggcagccagggcatcggcagccctggggagatccgctggaacctctgcctctgcctgctgctggcctgggtcatcgtgttcctctgtatcctcaagggtgtgaagtcttcgggcaaggtgaagcctgggaggccccggaggcctgaggggctggatggggtgaaggcttcctggagaaggcagggcatggactgagcatgagaagatgaagagacttcagctgggcagaggggaagggagagagccttgagactgggggatgagggctgcttgaagagagacatggaggtgaggacgcacgggggcaaggctgctttactagactggaagctcaccaaggcagggtctacattcagctgtatcctgacccagtgcttggcactttgaatgagctcagcaagagtttgttgaacacttagagtgtgagtgcatgagttagggggctctttgagatgcaggtgaccagaacccagttatcacactcagttggaaagtccagagggtgtgcttcaggcacagctgggtctaggggttcaatcagtgtcatcaggaagctggttctctgggtctgtcagtagtgcttccttccaggatggcttccttctgaggcttcattcttcgtgaggtcaccctagcagctctaggcgtacatctaagcttggtaaagggttgtctttccccagtttgcaactattttagaattgagtctcattggatgagcagggctgtgcacccatccctaaattaatccctgtggcccggaggatggaatgcttttcttggctgggcgtgggtcatgtaaccacccctggagctgggaatagagtcagctccatggtgggaaagtcaggtactgttatctgaaaaaggtaaactagagactggaagacaaagccacggatgtctactttaggtgatgaaggggtggaaaggacgataaagccattttgaaaaaacttggggccggaggtggtggctcaagcctgtaatcctagcagtttgggaagccgaggtgggtggatcacctgaggtcaggaattcaagaccagcctgtccaacatggtgaaaccctgtctctactaaaaatacaaaaattagccgggcatgatggcaggtgcctgtaatcccagctactcgggaggctgagacgggagaatcgcttgaacctgggagacggtagttgcagtgagccaagattgtgccactgcactccagcctgggaggctgagtgagactccgtctcaaaaaaaagaaaaaagaaaaactcagaaaccttcaggatggattgcccaatcattggtaaatcagaacttgtttcctctgcaaggtgcagacgataccagaagtatcatttacaaggaacagagccatttaagacaaaaaagacagggtagaaaccatatagaaagagagaagaggttatggtcaaagccaaggcagtgaggacgctgagacttgatggtgtttgctgaagcggtggctggaggtttgggaaaagaaggaaagagggaggagtgagtttgggaatgttgaatgtctgaggatgatgcagagtgagtttgcaggggcagggagtggacacggggaggaggaggcttttataaccaacaatggcggcctggaccaggggctgcagtggacatggccttgggaagcaaggtggtggtgctttgctgatgctgggtgtgtgaagggaggagggaagcctcaaggatgaaggccggttcctggcttgggctacccaaaggctggggaggcaagtgacacagatgagtttacaaggaatggcactgagtcaaggtccccgatgccatcagctcctcacttatcatctctcaggtggtgtatttcacggccacgttcccctacctcatcctgctcatgctgctggtccgcggagtcaccctcccaggggcctggaagggcatccagttctatctcaccccccagttccaccacttgttgtcttccaaggtgagcccctcagggcggggtgcagagggaggggccaggcctgagctggagagtggaaagagggctccctgggacaccgcagtaccaggcactctgctcagcccttcttgcgtcttttttatttattattattgttatttttttctatttttaaattgataggtaaaattttatgtatttatcatgtacaacatgatgttttgaagcatatgtacctgggggaactgttaaatctagctaattagcatatgtattatctcacataattatcatttttgtagtgagaacacttaacatccactctcttagcattctccaagaatacgatatattgtcactaactgcatattatacttcatttattattattaacaatcatggaaacactatcctcattttacagaggaataaactgaggctcaaaagggttcttatcaagcttaaggtcatacagctaggggatcgcagaacagggatcccagcccagatttgtgtgactgtaaaccccaaggagggcattagtgacaatggtgataacaatggtactgacagctaatgttaatatttattgactggggactgtgcctgaccttgccctagtgttttacatgcatgtgtgtagtgatttaacccaccctcctcccatgaagtaggcactattcctatcccctcgttacagatagggatcctgcggtccagaggggtgacctggcttgttcaggctgcacagctagaaaatggtgaagctggggtccaaatccaggtgccaggattccagaaaggaagtaaaggggttatgcaggcttactgccaatacaaatctcctgcacactttacattaggctctgtgtccttcagaactggaccaagcttagagaccatcttctagatcctgggtgggaaactgaagcccgcagaggggaagggacttgcccatgtcccaccgtgtaaatgttgggggaggctttgctcctggtccacgtcacttgtgagccaggctcatgaccacgccatccctcgtgaccacgccatccctggagctgtcacaccatcttcattcactgccttccttctctgtccttgaccatccgcacaccctccctttccatccttcccggcacaggtgtggattgaagctgctcttcagatcttctattccctgggtgtgggcttcggggggctcctcacctttgcctcctacaacacgtttcaccagaacatctataggtcagtgtcccacagcctcccagaccctggggtccaaagcagggaggagagtggccggccagggagggcctcagaggctgaaaggaaggcccactcaccctggcccgcacctggacttcttctggtagagacactttcatcgtcactctgggcaacgccatcaccagcatcctggctggctttgccatcttctccgtgctgggctacatgtctcaggagctgggcgtgcctgtggaccaagtagccaaagcaggtgggcaggctgccaggcctcagtggggtgagcatgtgtgttgggtagagatggggctgggccagtggaccagcaagattatggatgggggccaggcgcggtggctcatgcctgtgatcccagcactttgggaggccaaggtgggcggatcgcttgaggtcaggagttcgagaccagcctggtcaacctggtgagtcccagtgtctactaaaaatacaaaaagtagccgggcgtggtggcacatgcctgtaatcccagtactcaggaggctgaggcaggagaatcgcttgaacccgggaggtggaggttgcaatgagccaagattgggtcactgccctctagcatgggcaacagagcaagactctgcctcaaaaaaaaaaaaaaaagattgtggatgggtatgtcatgtgtgtgcatatgcacacatgtacgtgcaaaggaacatgtcctagctggtctctggtggtccatgtgcaaggggatgggtgagcaaacgagtgtgcattaacccatgtctggaggccaatgagtttctgtgcaagattgtcacattttgtgctttggttgcacaaataagtcatattgtgtgtggaggtgtctatgtgcaagtgaaaagggtgagaatgatcttgtgaatcactgtgtcttttgccagtggatgcatgtaaatgtgtgtgttagtggggttatttgtaccaataattgtatacataagtatatttcaatgaggttttatattggggtcttgtgtttgtttatcaacctatgtttatcgagcacctacaatgtgctggtgtaggtcctgggagttaaggaagtatcagagggtgcatttaagtgggcatctctgggttaggctaaacaaatggcccaaatgagtgtaagtggccgtgtgtgtctgagtgtgcgtatgggagcccaccgcatgacccaagctgctgaccccgtgtgcccctggcccaggccctggcctggcctttgtcgtctacccacaggccatgaccatgctgcctctgtcacccttctggtccttcctcttcttcttcatgcttctgactctcggcctagacagccaggtgagtctcgtctgtggcagcaggcaccccgtgtgtgtgtgtgtgtgtgtgtgtgtgtgtgtgtgtgtgtgtgtgtgtgtgtgtgtgtgttggggatagaattctgacccccagcccctcctctctcctcagtttgcttttctggagaccattgtgacagctgtgacagatgagttcccatactacctgcggcccaagaaggcggtgttctcagggctcatctgcgtggccatgtacctgatggggctgatcctcaccactgatgtgagtggcgctacagggaggatggcaggtgggcgggacaagggcagacgcctgcaacgagatctctggcccagctgagcagttgctgggccccctccatcttcctctttgcaaggaacccagtccctccccggccctatctcccaagggaggcagtttggccttgtgatccagagtcctggctgtggagatttagtctgcaagatctgggttcaaacctgactcctgcacttgctgagggggcttcaggataaatgatttcccctccctgagattgtttttcctcatcagtaaaaggagggttctataatagacggctgtcttgggactcagataagacaaggcctagaagggctgggctggcagccagtggtcaccctgtcatcttgtgctgtcagcatggctgcttcctgctcacttcttgccaggagaaggggctgtagcagagaacgaggcccaggaaggggacaccagaactgtgcttgtgttttaggggggcatgtactggctggtccttctggatgactacagcgccagcttcgggctgatggtggtggttatcaccacgtgccttgccgtgacacgggtgtatggtgagaagagccgtgggaagtggagtcgagctctccgcagtgggagaatgggagtctaccctggggagccccagtacctgggtccctggtcccaagggccagggtttccagtgggggcagctggggtagaggaggggctgctggcgcttgtggggccggcgggtggggccattcctcctcccctcccctgtgcaggcattcagaggttctgccgagacatccacatgatgctgggcttcaagccgggcctctacttcagggcctgctggctgttcctgtccccagccacgctcttggtaactggggagggcgggagggtttctggctggggccccagaattgaaagcgggagtcccctctgcacgttcagtctggtagggccaccctggcccgcagtggagggctgtggggtggccaccagaatcctagtccatcccctcccctgatgttcccagcttctgtagctgtgctgggcctggccctagttcagttggttaaatgcgtgggtctttcccaggccccagggcctcaggattggagcctttaggctgtgatttctgtcttggggttagagcagctaagggtctggggtgcctcagaactgggctgctgcaggccttggtgttgggtcagcttcgagctgggctggctgaagccctgcaaaggctccagagatggaccacttcaggttccggtacagcttaggatcctgggtagctctgggctggactgtctcaggccttgggctggcactaggctgggctacctcgggccttaaggcagtttagacaaaagcccgcagtgatgctgggagtccccactctgcaggccctcctggtgtatagcatcgtcaagtaccagccctcggagtatggcagttaccgcttcccgccctgggctgagctgctgggcatcctgatgggcctgctgtcctgcctcatgatcccagctggcatgctggtggctgtgcttcgagaagagggctcactctgggaggtgagtctgcccaccctgtccactctcagccttcctgacctgtggcctgaccctaggtccccctgctagaacagaaaacatatgcacccaccccttatccagcttcttttagcctgaggagacttgcctgggctgaggcagattcaggggctggagtcctgccctgtggcactttgtaccacatgaagccttaggggagtgggtggcacaatctaaagaccactgttaaccagggactggccccagatcccaccgtgggttgggggtgtgtcaggtcttgaactcaggtcaccagcccagagcttgcttctggaactcagggtcaaatggcgacagtgagggaccccagagggcaggctatcaccctactcccgtgcccaggagtcctgctgtgtcccactggtggcccgggatagaatgatggtgtgagccctgcccacgcctagggttttggggagggactcagacaaacatagagagtgcactctgccacagggtctgaggccttggaagagaggagtagtgaccctttgtgggccagcagaagtggtgtggtctgagcctcattgcaccctctgaacactgaggccagcacttctgccgccgctggtgtggagtcctccggtggcaagaggccatcatcatgaatgcagctttagtgagcccgatggatggcatccagagagagcctggaggcacccacaacatacacatcccaccagaagtgtgctggagccagctagcactggttcatccttaaatattcaggaatgtgtgagctaggtgttcaaccattggtagctaggaattggcaatggtggagatatttacaccacagaaaatggctacaaagcgggcctcccttgcaccccaccccacagtctgcttaccagcacactactgcctctcctccacttcccccgtgtagctcctgcccctcagctcccccaccacaaggctccacctgcaggggttgctcaggaggcagaagtggtttatgcctcccccatcctgctgccagaccacaggggcaccctggagtctagcctctgcactgcctccaattgctgtgtgacttggggcaaactccttcccttctctgaacctcaggagctccacctctgttccttgcttgagagccagggtacctgcaaagggagggaagagaggggagttgcttaggggggaggctccagctcccaggaagctcatggtccccaagccttgctaatgagccactaggagtgctgggctctccagcagtcaccaccgccccgctgccctgctgccctgctgccctgtcccacagccaggtggaaggggcatgttttggggggctcgagagctgtggtgagcactgcggaagaggcattccccagctcaggaatgccagcttcagaggccagggcttccagcactgaccctaggatcagaatcctgcctctgccatttgccagcctcgcggccctaagcaagttactgcacttccctgaacctcagcttctctgtctttatttttattttattttatttattttttttgttgagacagagtgttgctctgtcacccaggctggagtgcagtgcagtggagacagtaagcatagtatccaataggcaggtttttttgtctttttttgtttgtgttttgagacagagtttcactttgtcacccaggctggggtgcagtgacgccatctgggctcactgcaacctccgcctcccgggttcaagtgattctcctgcctcagcctcccaagtagctgggatgacaagcacctgccaccacgtccagctaatttctgtatttttagtagaaacaggaccaggctggtcttaaactcctggcctcaagtgatccgcgcacttcggcctcccaaagtgctgggattaagtgtctttgtctttaaaatggagagagtgatacctacttttaggcctgttatgagaagaaaagaagtttatcaatatagtctgcattgtgaaaggcagaaaagcaaaatattttaaaggttcaggatggagtcaggacgggttcaaatcccaacgccaccacttcccacctgtgtgaccttggccaacttaactgatctctctgagctttaatactcagataatatcagtgcgggcggatggtaaaagtactaatacccctctcattaggacactgtaaagattaaattagccaatgcttagcacagagctggagtgcactgggtgctcaattttaggccaggggttctcacagggggtgattttgcccttgggggacatttggcaatgtctggagacattgttggttgtcgtggaggggagagggatacaaggaggggtgctcctgtcatctagtgggcagagttcagagatgctgctaaacaaccttccatgcgcaggacagcccccataacacagaatcctctagaccgaaatgtcaggagcactcaggttaagaatgtctgagcacccccgttttcagctggaaacaaacctaagtccttgttctcagggagcttgtattttattgtgggggacaggcaataaagaaatatgtaaaggtaagttctgcacttaaaaaaaaaaggagtacaggaataaatggagagtggtactttggccaggatggtcagagaagacctctctgaggaggtggcacctgactaaccggacagggtgatccatgtaggtatctagggtaagagcattccaggcagaaaggcaacacgtgcaaaggccctgaggctgggggctggcatgtttaagaacagcatggaggccagtgctgcggctggagcagagggggtggagagaactggtggagctgatatcagggaggtaggcaggggccaggagctggaggccctggtgcacactttggatttcatttccagtgagatgtgcagccattggcaggcttctgagcagtggggtagcatgcgttcaacacatcttcctaagtatcactgtgctgtgagtaccgagctgtgggagaccccggctaaaggcatcacacatggtatctccctcggaacctgcccagtgggctgcccaaatgttaattgcctcctttctttaaggacacaggggctccctcttctccctggcatgacaggcagagggatttgggaatgtggttgaggaagaaggaactctggaatctccaggcttagtcattatcttagtcaccccgactccgtccatggaaactggggctctacaagggaaaggtcagaggcagaaggaggcaggtcggggctggaagaaaccgggaaagccagctgcaagcccaccgcagttctcccggttcatggctcttttccaaaagcccccagctccttaagattcagcatttaggggaaggctcccggattggcattcagacactctgaggaggggcccgccgcgtaattatagcaacagccaccacttcccaggccttaccctgttcccagcaccctgctaagtgcgtcatctcagtgccttcacaacaaccctgtgacaggactgggattcccgaattacagaccaggaagcagagcacccagagccgagcggcattgccaagagccatccagcttgcaagtggtagaacaggattctcacccaggcaggtggatccctcccctggggaagtcatagtgccccccacttccccgccagggggctgtggccaggactcccccagtgatgtggtcaggtgtttgctgggtgtctggccacagtgaaccctccaccagcgctgcctgtttcctgttttcactgctctcgttgctttgctgcagcggctccaacaggccagccggccggccatggactggggaccatcgctggaggagaaccggacgggcatgtatgtggccacgctggctgggagccagtcaccaaagccactgatggtgcacatgcgcaagtacgggggcatcaccagcttcgagaacacggccatcgaggtggaccgtgagattgcagaggaggaggagtcgatgatgtgaggcaggaggcaggcgggcagaaggccctgcccgggacctcacagtcccttcttagaagcctgcaaaggtcagctgtgccctctgggattctgagaggctatgggggggcctgccatagggatgccagtcccccaatgggggtccctcctgcagcctctgcctctcctgaaacctctgacaaccccctacacacacacacaggcatactcagacccactcaaagctgagaatgatccaactcagccctactttgcggatggacatattaaggccaggaggggagggacttgccccaggtcgcatggcagaggggacttgaacccacgcctcctgaccagccagctccctttcccatggggcagccggcaccaccttctcatctctattcagggcctacacccctccctttttggggggagcctgtccccacacaccttagcacaaccagaatcttgagttgggcagggagggtcagggctacagaggctcttgaggctccgaggccctggggatcaaaggtcaatgagttaggtggggagaaagatccctgggggctcctgtatgcaggactcctgaaggaggtgggagctgagggccctggaggatggggaaggtttgcagagagaggaagaagagggcagggtggggaggagctctgggccagaggatgctgagctgcctgggcagagaccaagagggttggagacactagttttaccaggttacaggagggttcaagacagaaggaaaactaacagagggggagccagggatgatggggtgggcaggggatttgcatgatgaggagtatcattccagatctgtgcagagcggatcggacgggacagggtggagcggggaggcctgtgcaaagtgggaaagagctgccggtggcctgagccagggtgctggggctgcgggtggggaaaggaggccccagcacttcagacaaaggccaccccttcacccactggaccccaagccgcaaaagctggggaggtaggaagggtcactgtgagggcccagggcccctctcttcccatctcccttgtcctggtggccttcagtgtctcttccagttccaggagctgctgggaagctggccttcattgttggtgacagggcaaccatgggactaggaggtggcccatacacatggctggctggtcctgaggccacccaccttgttccaggacatgggcccgggcccggtgtgggggtagacgcagagggcagagggtagcccttggtactgtgggtccctcaaagaggagagtggggtgcagaaatgcctcagcatggctcatgcacacagcattctcccgtggggcagggttccctcatgcaacaggcctccctgtggccagcctctctgcctgtctctcgctgcgtccccccaaccccttgtgttctattggttcattgttaataaatatcaaatgaggtcacgctccttaccccgtctccttactgctgagagccgtgaggtgggcagcacagggctccccagctcccactggacaggggaggaaacaggctctgctccctccttccccggctctcctggcttctgccctgggtctgacatttccctgtggcagtaggtggtgggtggggctcagaaaggaagacaactccaggcccttacagactacttagttccctgttatacagacagacaaaccgaggcccacggagggaaagagacttgctcaaggttacccagccaagccgggcagagcctggggcagcaggggccagcaaagcggagcccatgagcccgctgcctccttccctctcccactcctcctcagccctgcctgcaggtgaaggctggagctgaagaccagggctaggaggagccaagagtttcccaggccggaagaatctctgggttccacccaccccctcctggcagggccttgtcatataaaagagccccagggcctttcaaatgcgaggcccaggtgtttgcaaaggctttgattgggggtggaaag

SEQ ID NO: 16258 - DNA, 8774 bp, Human
cagtggtcacctaagtctattctttctttccttatctacttcagaagaccatcaaaatatttactcatgttaaacctaaacaaaatgaatatgggttacttttacatatcttgtgttcttgaataagtcataggtcctggattttggcagtttggtaacgtaaggtttatagaacttcacaagggcccatttttctgtcagttccaaaacaagaaacttcctgagtccttcatctaaaatatattgtctcggctgggtgcagtggctcgtgcctgttatcccagcactttgggaggctgaggcggatggatcacctgaggttaggacttcgagaccagcctgaccaatatggtgaaaccctgtctctactaaaaatgcaaaaattagccaggcgtggtggcatgcacctgtaatcccagctactcaggaggctgagataagagaattgcttgaacccaggaggtggaggttgtagtgagctgagattgcaccactgcactccagcctgggcgacagagtgaaactctgtctcaaaaaaaaaaaaaaaaatgtctctatctggccacagtcacaaatgtttgttcatttgttcattcattcattcaaatgttttgtaagcctgctatctcagcgttactacattccattcagattacactgatgaacaagatgtctttcctccaggagctagagagattcctacttcactaatacaagagtgtggttagtactctaatggaggtgcaacatgctatgggacacagagggtgtagtatttcatttgggctaggggagattggttagtgctttctggaaaaggtagcattgtaactgggttttaaaaaattattaggatcttgacaggcaaagaggtggatggccattcgaagctaagtaaacagcttatgtaaaggcactaattcatgaagcatttggtaaacaatttatgttctattcctttgagagcctggttcattttcttctcttactccggttattagacttactatttgttgttgtcctttctctttttctggctatttttacctcctttgttttcctatagttcctcatggtagatcttatggcattagttttatagtctaggacacagagatgaaggatcacctgtattgcctccaagtggaagtgcagggcaacattatttctctatttaacctgtgtttcagtgtgtgtacttagaatagtaaagtgaatcttgcatgaatgtaggccctgcccacagggcagatgactccatactagaacatagtggaatagacaaaaaccttctacagcatgtatgagacacttggcccatcgaccctcttcatgccctttacattcagcaccctcatattgacttctctctcctctttcctaccaagcaagggagtactgttcaaagacgcaaatgcattctgccctagtttctttttattgctaaaaacatttatctttaccctacaacctacttttctatttattttcaacatttagcaggttgtttaaaaagggaccaaaaaataaaacaggaccatcttccttgtttcagggactggtaggcaggcattaaggttaaggtaggggttaagaccagatcctattttgcagtctgcctgggaggtgaaaaacctgggaagaagaccgctggtagcatatgtatggaaaggagacaggctgcccttacatcttttcaggaggaaaaactgccagggggagccaggcatatatggagaagaatccttaatggtttatactcttgggaagtcctgtacccagccagttatttgctttgacttggctgtttaaggtctggttctggtctttttttttccccctaaccaagacaaatgaggctcaattaaggaaaagggacataagatacctattccaaaactgaattccttttaactctcatgaaatgacaaatagaattgttagtatatgtgagcactgagaattactttattgatgaacactggtattttctctggtgtaggaagctgaaccatctatctccagaaatgtcttcagaaagtaaagagcaacataacgtttcacccagagactcagctgaaggaaatgacagttatccatctgggatccatctggaacttcaaagggaatcaagtactgacttcaagcaatttgagaccaatgatcaatgcagaccttatcataggatccttattgagcgtcaagagaaatcagatacaaacttcaaggagtttgttattaaaaagctgcagaagaattgccagtgcagtccagccaaagccaaaaatatgattttaggtttccttcctgttttgcagtggctcccaaaatacgacctaaagaaaaacattttaggggatgtgatgtcaggcttgattgtgggcatattattggtgccccagtccattgcttattccctgctggctggccaagaacctgtctatggtctgtacacatctttttttgccagcatcatttattttctcttgggtacctcccgtcacatctctgtgggcatttttggagtactgtgccttatgattggtgagacagttgaccgagaactacagaaagctggctatgacaatgcccatagtgctccttccttaggaatggtttcaaatgggagcacattattaaatcatacatcagacaggatatgtgacaaaagttgctatgcaattatggttggcagcactgtaacctttatagctggagtttatcaggtaagcagcaatgaaacaattggttatttctagaaaagtaatctagtacatgaaatctcatatctctaagggatctgaggaatcacaataattaaaggtatcatttattgagagttcaggatatatgaagggtagaggcaaaattcaaaccctaacctgactccacaggtaatataaggctggttcactggacctccaccacccagtacaactccttaattttacatgtcagaaaatcttggctttgcttgagattatttgtggctggttattggcagagtcagcattagcagttaggcaagtgggtaacagaatggagttgagagtgcaggagtttctcactttttttttttttctggagacagggtctcactctgtcacgctggagtgcagtggcactatcttagttcactgcaacgtccgcctccctggctcaagcagtcctcctacctcaacctcctgagtagctaggactacaggcacatgctaccacacctggctaattttattttattttattttattttattttttatttttattttttgtagagacagggttttgccacgttgcccaggctggtttcaaactcctgagctcaagcaatcctcccgtcttggcctcccaaagtgctgggattatagccatgagccaccacacccagcctcaaattctaaatgtctcttaccttccattaaaattgctgatctattgagcaactcttactaaaggtagtggttgtcttggattgttggggagggagggaaaaagttggggaccacagtttcatattatcagccaggagaaaggataagaaatcaaattcttgagtctcccatagaatccactaatctgtcattatcatcatgcccctggcttttggcatccaggagtcagtgccaggattaaaccttctctaatgcaggcatttcaaaccaacaagggaaggggaagagtagctcactttagttggtgctcagatgagtggggagggagagtgaagatggtgtgaagatgagctgtctactcatatataatggtaaataataagtctacttacttatttattatttattcatttatttataaagagacagggtctctctatgaccaaactcctgggctcaagtgatcctcccaatattgcctccccaaatgctgggattacaggcatgagccatcacgcccaaccaacttttgcctttttgttagtatgtcccaccaagaaggaagaaggcataacaattctgaaaacttattagacagaggaaaatataaagaagtaaaaatgcagaatttttattaatatgggagacagtgtggcataagtacatatatactgcatgagaatggtttcttagtatgaggttaaagataagtctacaataatttttaaagtgtgattctactttgatgtaaatctaattttttgttttaccaattaaaacttcacttgtacacttgctcttagccaagaggctgagaagccgtaagacttcacttttacagtagtgatttgtaatttaaggaaaatacttggtttcttaactagaataattttttccaatttgaagttttcttgtggatccttgagaatgtttttcttttaaaagaggtctgttctttgtgatgggaagaatgaaaaaaaaaagaggtatgaaccttattcaagtttaagaaacgtatgaaaagaaagaaatccaaagttcctgtctcacctgggttaataagtaacagtgtgaccttgggcaagttgcttagccctttaaacataattttcatctttgtaaaatgagaagattgatatatgattgtgtttattctagctctgacattctgtgatgctctgatgatatgtctccatgcaagaaatgtcaggataatataaaatttagaagttcttttccatttatatttaacacttctatatccttccttccaggtagcgatgggcttctttcaagtgggttttgtttctgtctacctctcagatgccttgctgagtggatttgtcactggtgcctccttcactattcttacatctcaggccaagtatcttcttgggctcaaccttcctcggactaatggtgtgggctcactcatcactacctggatacatgtcttcagaaacatccataagaccaatctctgtgatcttatcaccagccttttgtgccttttggttcttttgccaaccaaagaactcaatgaacacttcaaatccaagcttaaggcaccgattcctattgaacttgttgttgttgtagcagccacattagcctctcattttggaaaactacatgaaaattataattctagtattgctggacatattcccactgggtttatgccacccaaagtaccagaatggaacctaattcctagtgtggctgtagatgcaatagctatttccatcattggttttgctatcactgtatcactttctgagatgtttgccaagaaacatggttacacagtcaaagcaaaccaggaaatgtatgccattggcttttgtaatatcatcccttccttcttccactgttttactactagtgcagctcttgcaaagacattggttaaagaatcaacaggctgccatactcagctttctggtgtggtaacagccctggttcttttgttggtcctcctagtaatagctcctttgttctattcccttcaaaaaagtgtccttggtgtgatcacaattgtaaatctacggggagcccttcgtaaatttagggatcttcccaaaatgtggagtattagtagaatggatacagttatctggtttgttactatgctgtcctctgcactgctaagtactgaaataggcctacttgttggggtttgtttttctatattttgtgtcatcctccgcactcagaagccaaagagttcactgcttggcttggtggaagagtctgaggtctttgaatctgtgtctgcttacaagaaccttcagactaagccaggcatcaagattttccgctttgtagcccctctctactacataaacaaagaatgctttaaatctgctttatacaaacaaactgtcaacccaatcttaataaaggtggcttggaagaaggcagcaaagagaaagatcaaagaaaaagtagtgactcttggtggaatccaggatgaaatgtcagtgcaactttcccatgatcccttggagctgcatactatagtgattgactgcagtgcaattcaatttttagatacagcagggatccacacactgaaagaagttcgcagagattatgaagccattggaatccaggttctgctggctcagtgcaatcccactgtgagggattccctaaccaacggagaatattgcaaaaaggaagaagaaaaccttctcttctatagtgtgtatgaagcgatggcttttgcagaagtatctaaaaatcagaaaggagtatgtgttcccaatggtctgagtcttagtagtgattaattgagaaggtagatagaagaatgtctagccaataggttaaaatttcaagtgtccaacatttcccagttccacagtgggaaattttgcacacttgaaattttaaccaagtggctagatattattcctcctttgaagctaatggcatttgtatatacacactgcagcagagcttgtagctggacagagtcaaaaagaagaaaatacggtttcaggctttcttgcagatatgaagtattcttggaatgcaataagtatgtattgaactgtactgtaaagtagctccaaaacttaattactctcctgttttaggggttatacatttggactgtgcattctccaagagatgaagcggtgaagttgggatttacattggaagtgctgtagacttctttatgtggctcagtggagagagggaaagaatgttgcacctgctctagtaccataggtcaagaggcttctggatcacaaagtcataactagacaggtttgttcttgtagttttctatccccagtctttgctccccagatggcagtagtttttagtaggaaagtgccattcctgtccttaaggcacagtctcatcagaagtctaatacctgggcaggtttataacatcctgagagccagcctgacattagacagaataccctttgtaatacattggaaatttttactcatgcctttttgtttaggataaataggtaagcacaaagagctcttcaaaatcagaaaaaacaataggagtccttccttgtcttttctgtgatctctgtccttgtttctgagactttctctaccattaagctctattttagctttcagttattctagtttgtttcccatggaatctgtcctaaactggtgtttttgtcagtgacagtcttgccagtcagcaatttctaacagcattttaaatgagtttgatgtacagtaaatattgatgacaatgacagcttttaactcttcaagtcacctaaagctattatgcaggaggatttagaagtcacattcataaaacccaagtgctatgggtgtattattcatgatagctggcccacaggtcatgaattgaggaggaatttgctttcaaaaagcaagaatgtccaacactgaaagtttatagttttatatttggaccttgaaaggtaagaaaaaaccaggttctccaaagttaggaatagggaactaatttatgaaacagccatcttaaaaaaaaaaaaagtaaactgcaaaagtacaaaatcatttttcaatctgttcccagtttctaaacaattttaaatatttatgagaagcaaaccctatgtgtagggcatctgttggagtgggatgcttttagacatatattaagtatgtacatgtttaatatgtatatttaaaatgcatatatattttattatatctatattatcctatatagatatatgtaacttagctttattgttagctccataagctgccagtgttgcttttctgttggtagagctctcccatttggtgacatggaaaatacctttccattatcacaacaaagcagttgctcagtagaaagtctagatttctgtcttataggtgatttctgtcttataggtgattataatcaagtgtaggcttcctgaattttgacatccttttagaacttgggtctggaattccagaaatgttaattgctgcttgtatttgttcttgtttgttttttagccagtatttgccctttctatccagccttatgaataatagcagtaaaatcacagtatcttggtcagtctttatttttttccttttttcttttttaagagacagtcatccaggccagagtgcagtttgatgatagcttactgaagcttcccactcctgggctcaagttatccttccattttggcctcctgagtagctagaccataggtatgcatcaccacaccctgctaattttttaaatttttttctagagagagggtctcactgtgttgcccaggctggtctcaaactccaggctcaagcaatccttcagcctcagcctcccagagtgttgggattacaggcgtgagccactgcacttggccaagttatttatttttaatctctcttgcccttctcccaaggcaggcttaagttgagactattataggtgtctaataacctgtgacagagtaatgagtacatgcttaagatgttataattagccaacaccaacacagcaaaaaatataattccagccaaagattctggaaaatccctcagaaggagggataacaggatttgacctttaccagcgatttctgtccatatgtggatgtaaacagttctggaacgttatgcatgcagttagcgaatccttgaattatgttctggtttgtacttgtcccatccatccaaacaagagattctgcttttggtagccatctgtagaaacatttaagatgtcactagaatttacatttcatcctctctacttgggttgaggttgcctatacttgcatattgttaaaatgttttggttgctgatattcagaggaatgaaacctggaaccaaagcctaatttgccgataaaaaaactgttttcggccaggtgcagtggctcatg

SEQ ID NO: 16259 - DNA, 7453 bp, Human
tttccggtgtggagtctggagacgacgtgcaggtaggaggcccgggcgcgacaatcggggggcatcctgcggcgaggggaccctgtggggcttgggacgagagacgggggtctttccgtgggaaccgagctaggtgccgggcaagagacgcgcggctggcccacctggatcctggccaactcgggattgagttcgttcctggtctcagaaggcccgttttgcttcagggaggagcttgtgaagtaagggtgagtgcgggtccagccttttaaggcctcggccccgcaatacggccacggccacggccgcgtttgagctgcacagcgtagttgagggaacccgggacagacgtgggctcccgcctctacctcgccaaacttttttcttggtgatcgcaggcccacgcctaatctcgtttgtttcctcgtctgcaaaataggaataacaatagcaccgatcccatgggtttgtagtgatcattcaaagaaggaaagcagggaaaactctcgcactatgttggatgcttctaaatctgggcgattctttccgttgctgagtcgggcacgttgcaagttctgggcgctcagggcccagcaccaatgtttgctgtgcgcttgccctgcgtttatatactcctgatgaccactctgctcgttactttaggggatgttaggaacggagaaactgcaaattggcatttactgaatggccatcatgccgaaacatactcatgcttacgtatttgagatatgctggagcctttctatgcttctcgaggcagaactttgggcttctctcctgtggcgcgttccttacaatagttaacgcactgggtcgtgctcattggtctgatttgaagataggaacatttaacttcgtacacccaagacttacacttgaagtacttactgtggtcacacacttaactaaagtttatatagggaaggcagaggagagatctaggaacacctgagacagactagggtagttatttgtggtgtagaggcatcttggcaggaggcagagagtgctgggctgggagtcaggacacgttgtttctatgtttggttttgccactgtctttactgtgaccataggctgagacactctctatcttcaccatctgcaggatatcgattagtgttagtgtcttctgaaaatgttaaattgttctgaacaccaggaggttcagaaggcctggggctttaggccggaagcagtcttatcctagccttccactttctcattcattctcacccgccttcctcctgtcagtttctctctcccttagatcttgtgacagtatgattgcaattattatgaaggtcataataggttagagttatttagtctcaggacccatcagatttctgagatgggtcttttccattagcctgccttttggatatattttagtgcctttgatatttgatgttggtgacaaagatttagttctaaatagttgtgggagtcaaatcagttgcatttttgaacattttgaagggatcaggtggagcacaggaaaacaggagatgagaggcttgagggctgtgttggtaagggtcccttgaattctaagctgaggagttcatgcaggaatcaagcagctccctcgccccatgaagggtgttaggaatggtaccagtacatgggtagctgttggtcttgggtttcttcttgccttttggggtgcagccttcaggcatctgctgctagatccctaggcttctatcttgtaggtgctgtgagctgagctgttggtagtttctggggaaaggatacttctcatggtactttgccatatggccacagttgatacccccccaagtgcaaggagaaagaagttttagtgaggcagaaatgagagaatacagtagagtattggatggaagaagacagggacatgaagcaggactagggtttcatttaatagccaggggaaagggattctggaaatgttttgtctgttaaccttgagtttcttttccttccactcagaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaagtgagtacctgggtggagaggcatccagctggcaaaaggctgaggaaggcaatggctgggacgggctagcagttcaggggattctctctaaagaaatgctgttttgtccaggtaagaaaatgtgcttgtccatttagcccacaaatattgtgatttcccaggggttacaagagaggagacacattcttcgtccttacagcgtgatggtcattgaatccttggtttcttgggaattatcttctttccctagttccctttgcaggagcagcagtggactgcaagtgggctctgggtgcgggttcgacggccatttagcaagttgtgacttgtgtgaaatcactcagattctgagttttggtttcctcatatgtaaaattaggacagtaatgtctaccttgtggagtaatggtaaggattaaatgcaaaagtagatatataaaatgttaatactgagtatagctatattgggccattcaaccccactggactgaactccatgagggcagagcccatgaccatcatcctccaccatgactgagctgtgttgctcttcactcattaggatatcgtaagcactccttgttggacgaggaagaaatgaccctgtgcttttgtccccagggaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggtacgagtcgcagaggggatggctgggtggtagaaaacctgctgggcttgggtgctggagcacctggatttgaggtttgggttttttgttgtgaccttgaacaagatattttaggcatatacatacttaataattggctcctgtgtacaccccccagcagctcagtgttgagcacccactgtatactaggagctgtgtttcaggtactagaagagagtgatggggaaacagacatggtctctaccctccttgtgtgggaccgaggctggtgggagagtcagactttaaacaacagagctccagggagtatgtggttttcatttgtgacaaatgccaggaagcacaagtaaggagctggtgataaagtgtaatttaaactagggtctaaatgataagtccggagtccttccagtgaaataaggacaggaggagggtattccagctagagacaactgcagggaaaggtcttgaggtgggggtgaacctgggcacctgtgaaggaaagagtggcatgaggtgcagtcagaggggaagaggtggagtcctgtaggagaggggaaggacctggatttgagtgatgggggcatgaaagctgaaatagatgactgttgcgtgaacaagccagacagtggtcagaacataacaacaaaccatagtggccccctcagcctaaaatatttactgtctggctttttttttttcctcttttttgagacagggtctcactctcacccaggctggagtgcagtggcgctatctcagcttactgcagtctctggctttcaggctctagcagtcctcccacctcagcctcccgagtagctgggactgctagtagtagtgccaccacgcctggctaaattgtgtatttttgtagagatggggtttcaccatgttgctcaggctggtcttgaactcctgagctgaagcagtccgccctgccttagcctcccaaggtgctgagattatgggtgtgaaccactgtgtacagccctgtctggctctttacagaaagtttgcagacctctgaactagcggggtgttgggatcttagaaaggagatcttccattgacttggccaaaggctcttcttaacttaaaccttcattttctaggaccaagacccctggacctggggcccagtcggccctcagagcccttgcccgctcgggtatgaagatcgggcggattggtaagtgcccccctctagctaatgcttgggtttattttgaagcattggccccaaaaagcacgtgctgtgcccagtggatgtgcagcggctggtctggtcacttttggcagttaagtttgttaagggaggctgcaagaggcaccttgtgacttaaaaatctctccctgaatatctctgtcaccttgatatgaatgtcctgtttcatttgtgaatctctgtcctacactgcctggtgcaggtaaaactgacaagagatgaattgtcctttcctccattcttgaggtcattgctattagcattttgtgtgtaccatctcctgcattgtaggatgttcagcatttttggtttccgcctactaaatatcagttgggcatgccagtcgtgtgacagccaaaaatgaagtggggggtaccagcttctgttattaataccctcaggcctgtgatctcctggctccttacagctcttaggaagggaacagtagtctttccctgcacattgttctgtgcagttagtagcgacatacactgacgccccaggccaaagttcctactgtgtcctacttgaaggatgattttgttttcttgagacagggtctggctctgttgcgtgggctggaattcagtggcacaatctcagctcactgtaaatttcgcctcgtgggcggatctgtccaaaggatcctcccacctgcatctactgagtagctgggacaacagtgtgtgccacaccgggctttttttttttttttgtagcggggagtttcaccatgttgcccaggttggtcccaaactcctggcctcaggcgttccaccagcctcagtctcccaaagcccaaagtgctaggattacaggcatgagccaccggcgcccagccttaaaagattttttcagactttttttcagtgtctttttacttaatgaaaacgagacagttgcagttaccctgtctagaagggttttttcctctagagaagacggtgggctagatgtcagaacctggatttgtcctgtgcctctgacatcttgcgcacagctcagcctgtttccctttctggaaagtgagttaagaccacgtcaggaaattcgaggaactggcagatggggccgcttcatgttcacatccatctgttaggtactggggagtcatttggggagcagcaggatctgttgctgattggttaggccattggtctagggagtcctgggggcccttcccatccagctccaggcaatgacgctttctcttcctccccacagaggatgtcacccccatcccctctgacagcactcgcaggaaggggggtcgccgtggtcgccgtctgtgaacaagattcctcaaaatattttctgttaataaattgccttcatgtaaactgtttcaactccagccttctctccttcatcaggggctactcaggcatttgatttcttcctcctatttggcttcttgggagaaaggagcctgaggagagctgagatcctggtgctgcatttggggtcttttccatgctacttgcggcattaagttgccttggtcatctaaagcagaccaaggcgttggagacctcgttttgagtggagatgctggttctaaatatggaccaattcttaaagagccagagtgggaactgttgatccaagtgtagcctgaagcgaaagaggagccttccagacccatgccatatataaacacacgtgggtgtgcattctccccccacaccttctgtgcaaagctgggagctcactccactgcgtcttgctttttttcacttggcagatcttggagattgttccacatcagtacataaagtacataaagattgtcaccccacaaatacacaccaagtcctattttcatcagcgataaaaaagaaaagttcttgctttccggaagcttgcatgcggctctgagtacccagtgacaccagatggtactcagcgttttgcaagggattaccacaaggccccgtgatggtgcctgccatggttaggacaggctggtggctgggtagggttagtgagacccggtggagaggatgctgtgtgtcacaggctggagaggtgagaccattgaggtagtcagttgtagaggaaagaaaccagcaagaggggaaaatctgttgggatgctgcttttagcctttgatggcgtgttccaggcagagggaataagcaaataaatgggtcctgagacaaggggttactgtgatgaggcggcgttggttacatgccaaaccttgctagggattttattaataacattgaatcttaacctgatgaaataacagtactcctggggaggcgggagggatagcattaggagatatacctaatgctaaatgacgagttaatgggtgcagcacaccaacatggcacatgtatacatatgtaacctgcacgttgtgcacatgtaccctaaaactttaataaaaaaaaaagcttgcaaaaaaaatataacagtactccttaaattgttaaaagtcatgaaagccaaggacaggagattaaggaggcgtgaaaactaaatgcccattgtggtatcctggattggattctggaaccagaatggggtattagcataaaaactagtgaaataggataaaggcagggcacagtggttcacgcctataatcccaacactttgggaagccgagacaggaggagggattgagcccaggagtttgagaccagcctgggcaacacagggagaccccgtctctacaaaaaataaaaaattagctgggcatggtggcacatgtctgtactgccagctacttgggaggctgaggtgggagaattgcttgagcctgggaagtggaggccgcagtgagctgtgattgcatcactacattcagcctgggtcacagagcaagatcctatctcaaaaactaaataagtaaataataaattaaaaaatatgaataaagtctggagttaaagtctggaataaagctagtagtaatgtaccagtggtttcctacttttggcaaatgtatcatggcgatgtaagatggtaacaggtgaaaccgggtgagtggcacacagaaactgtatctttgcaactttttggtaaacttaaaattattccaaagtcaaattattagggaaaaaaaatgaggggtgcttttatactgtcagtctggtttctaaggcaggatgtggtgcacagaccctcaggaggcagacacacctggaggaaaatcctattccacagcttcagaccgttcaaccttaggcaaagtacttaacctctcagccgtttagtggaaactcctgtgatgatggctgcctcaaatggaatcacacaagatcaaagtgtttagcgca

SEQ ID NO: 16260 - DNA, 15117 bp, Human
gggctttcagccaccagcatttcctgaatatataaaaaaagacattcttctcactctggagatacttttttttttgagatggagtctcactctgttgcccaggctgaagtgcagtggtgcgatctcgcacctccgcctccagggttcaagcgattttcctgcctcagcctctcgagtagctgcgattacaggcacacgtcaacatgtccggctaatttttgtgtttttagtagcggggtttcactatgttggtcaggcttgtctcaaactcctgacctcatgatacacccacctcgacctcccaaagtgctgggattacaagcgtgagccaccgtgcctggtctttttttcttttttttcttgtttttttttttttagacagagtcttgctctgtcacccaggctggagtgcagtggtgcgttcttggctcactgcagcctctgcctcctgggttcaagcaattcccctgcctcagactcccaagtagctgggattacaagtgtgtgccaccatgcctggctaatttttaaattttttgtagagacagggtttcaccatgttggccaggcaagtctcgaactcctgacctcaactgatcctcccgcctcagcctcccaaagtgctggaattacaggtctgagccaccacacccaggcttactctggagactctttggttcttagtggtccttgtgtcaggaaccagggacagagaccagagacgtttttcactatgtcacagcacaggagccttgccaacacagtcccatcctcccaggcaccctttcccaggctgtcctcttccctcccagcacaggcccccattctcctggatctgaaccacacaaggaggcagaggggtagagtggttaaaaatgcaggcgctactactttctggaggtgtgatcctggacaagagcccctgtgtccctatctgtaaatggagatgataaaacactcctcaaagggcctccgtaaagatcacaggaaacaaagcatggacaacgtgcctggcacgaaggagagcttggtaagtggaggcaagtctgagtgccagagccttaaaaccatggactcttaggtttgaaggaaatcaaaatattcctctctaaaaacctgcggattttagttaaaggtaaaaggttaaaacccaggggcaccctctgccccttctctctgtcttgatcagctcagaagcagagctcagaggatcctggatcagacttgactgttcccatacattcaccttcccacatttccagccctttggaaccctgaagatatcctcttctctgtcctgtcactctatgggacttacggctctttgttaaaatactatttaagcaaggcccctaagccactgccttgagagagaaatacttctcaactgaggcctctactgcataatgggtacagcatgtgttaatcaactttggctgatttttcttttgttaagttgacttttgtttccaggggagcgtgtcaactaagaacctaaacagggaaagaaaagaaatgttttcacccctgcacgtcgtccaaacttcctcctgcgtgtttgagacgacataacggaggccagagaagaggacttgtctgagctcaccaagggtgcacagcccctttctgcacccactcatctgtggatgagaaggggagacaaacaaaggtgtcttctgtttcaaagtgctttcctgtctagggagtggacatttgcctttttcttgaaacattcaaagagccttatgaatccaaaggcctgcccagaaacaagtgatgagggccctgggcagccaatgggatcgtgctggcctttctacctgcctggggagcccccccgccccacatcctgccccgcaaaaggcagcttcaccaaagtggggtatttccagcctttgtagctttcacttccacatctaccaagtgggcggagtggccttctgtggacgaatcagattcctctccagcaccgactttaagaggcgagccggggggtcagggtcccagatgcacaggaggagaagcaggagctgtcgggaagatcagaagccagtcatggatgaccagcgcgaccttatctccaacaatgagcaactgcccatgctgggccggcgccctggggccccggagaggtatgtgtgagcaccaggaaagggcacaccgatcctggactgcagagccgtgcgcatgtgctgggaagaagcaccggccaggagtcacaggaaagagggattcaggctctgactctaacattgactttttgggtgattttgagcaagtctttggcctgctctgggctccggctccctctcttgtcaaatgagggggttcctttaagagcaggagtttgtaactttccttgcatcacaccgcctccttctgaaaagcagaagagagcatgggttctctccctagagtttcacatgctatgcaggggctttgagatcccactaaagctgggctgtgaatgctaggttaaaggccttggaacaggctgtgcctggtggctcccgcctgtaatcccagcactttgggaggctgaggcgggcagatcagctgaggccaggagttcgagaccagcctggccaacatgttgaaaccccatctctactaaaaatacaaaaattagccagatgtggtggtgtacacctgtaatcccacctacttgggaggttgagacatgagaatcacttcaacctgggaggcagaggttgcagtgagccaagattgtgcaactgtaccccaccctgggtgacacagtgacactctgtctcaaaaaaaataaataaataaataaagaccttgcaccagattttgaaaatgttcaagatcccagtggagaaagagtttctaaaagaggatggtagaagcagttcttcacagaggagttccctcctaattaccacggatcaagggaatgatagttgcaggtgtctgtagagtagatggagacatctgccatcacaggagggattgtgagatgttgggggcaggcaagaaaggagggacaggctctggttaaatttctggagggggctcagggttgacgggggtcatgtccttgcctgtgcccctctcccttgcagccagaggccagcacagccatccaggggacaccaggcccccacttcccagccccaaaatagcctcacccatgtgtttccctcaaaaagggctagaaggctattaccccaatgcccctgctacccccagtctccaaaaagtaatttgcgatctacagggacttacagctaggtgtgatgtcagctgttgccaggcagaaaggggtttgggagaaccctgcagagatgttatgacaagctatgttctggggaacaaggtaacctgctgcagaccattagagctgtggcctgtgaaaaccccagggaatcccatggcaaggagggagactgttttgtgaggaatggattcaggtctaggccacgcgtgaccttggataaatcactgcctctccctgagtctcagtaataatataatagccataatagttctcatccactgtgtacctgtcaccaggcctcagccactgttagttagtactgtgattatttacatacgtaaaggctaaactcaattttaattcttacagtcaccctatgaatcaggtacttttgttgtccctttttacagaagaggaaattgaggtcatattggtaagtgacttacccaagtaatcatagctagtgagtggttggaggcagaatttgaaccaggactagtctgacatcaaagtgttagctcactccaccatttggccccctttcagaggtgcattttgtgggaaggggaggtgagacccctctgagctcagaccactcagtgatttacagacccaggtgggctcagtgttcagagtgcatgtccccttgtctaatccttgtctagttttccctttattcagttactgcttctaaagctggctatgtgtgcttaggccattccagactggagcctgttttggaggcttttgtgaatgcttctgcctggcaacatctgtgtcacgattcctgctagctctggttggctcctgactttggcttttttttttttttttttaattgcagaagaaggtagtgtaaatgaggaaataaagaggggggtgacaagagttggcactctaccagaaccaggggacaggcgttcaagatgcataaagaggaagaaaagcagatgctaaacttaactacgaactcccctgagaattgcactgagtgtaatttatttatagagtgctaacaatgtgctaggtgtggagccaagagctttaccctcatcatcttatttaatgtaacagcccttggagcagatgttttacccgattttactcacacagagggttaatcaacttagatggtcccagaactaaccgactccagagccaggattccaatccaggttatgtggtctcgtcttcagggtgaatctctaggttcttaggcctcctgaggaactgtggtgcagagaggggaaggtactgtcccatgtcgtgtgtgggaggtagagctggggctagaattgggtgtggggttgcagaagcactgaacaggtggaggatgaggctggagagcctgaacacaggctaggccacccgtgttccttgagaaggccaagaagtagaatttgttttcccttcctgtctggtctccccacttcccccccgccccccgcccaccgtcgggtttttgctgtttccttcccgaataactctcccttgggctgggccttatcccagaaagcacagactggcacgcagcaagccaatgagaatgagccagtctgtgatgtcatgagttaccaggcacaagggactcctggagcgtcctaaaccatccttgctggttgctggagtaggcagggtgcagcctcatccttgcagttcccaatgggtctgttttagtccgttttgtgccgctttaacagaataccacagactgcgtaatatacaaacaaacaaacaaacaaacaaaaaacacccagaaatttatttctcacagttctggaggggctttcttgttttttttttttttttttgttatgttttttgagacagagtctcactctatcccccaggatggaatgcagtggtgtgatcttggctcacagcaacctctgcctcccaggttcaagtgattctcctgcctcagcctcctgagtagctgggactacaggtgcccaccactacgcccggctaattttttcttttttttttgagatggagcctcactctgttgcccaggctggagtgcaatggcatgatctcagctcactgcaacctccaccttccaggttcaagggattctcctgcctcagcctcccgagtagctgggattacaggtgctcgccaccacgtccggctaatttttgcatttttagtagagacagggtttcaccacgttggccaggctggtctcgaactcctgacctcaggtgatctacctgtcttggcttcctaaagtgctgggattacaggtgtgagccaccgcgcccggcctagcttgctttcttttttttttctgagacagtctccttctgtcacccaggctggagtgcagtgacgtgatctcggctcactgcaacctccgcctcccgggttcaagtgattctcccacctcagcctcccaagtagctgggactagaggtgcacgccaccatgcctggctaagttttttgtatttttttgtagagacggggtttcgccatgttggccagactggtctcgaactcctggcctcaagtgatccacctgccttggcctcccaaagtgctgggattacaggcgtgagtcaccacacccagcctggtgaggggcttccttgatgtgtcctcatatggtggaaggcagaagggcaagagagaaccaactccttccatcaagccgtcttacagggcacctaatcccattcgtgagggagaaggccttgtggcccgatcacctcccaacaccttcacattggcaacacctggactagggtcttagtagtcccacccctggggtcgtcaaagaacagatcagaaactcctggggtgtaggggcaggatccttacatcccctgtactgtaacatatgcatgcaccccccagtcgcatccaagtcccacagatacaagggcttgctgaggtccgagggtctggatggtgagtccagggagcatgagaaattcatccaggccacacaggctcaggcacctatactcctgcccaccccctgcaggatggatattaccatttgaaatactttggcgcttgcagtgagatcttgcttaaaagaagaaacccaccaaattctagaatcgcagaggtgggggcacctatgtgacaaatgagggaacagaggcacagagattggcagggacatgctcaaagacatggagagcctgggcagaggatggccccagagtgggtggtgcctggccctgcttcagcctgacattgtccaagcctcccccagcccactcctaaaatggccaggccccacttcttcccaggtgggctacattttctgctgtcccggtcccacttccttaccttttctccttaaatctgatttcactgtgagggtgggaggttgggcagaggggtgaaaaccctcttccccttacttggtaagcacatacaattttttttggttttgtcaattaaaaaaaataacatacctggttgatcctgccagcagaaaaaaaaaacaaaacaaaaggctgggcgcggtgactcacgcttgtaatcccagcactttgggaggctgaggtgggtggatcacgagatcaggagatcgagaccacggtgaaaccccgtctctatcaaaaatacaaaataattagccaggcgtggtggcgggtgcctgtagtcccagctactcggagaggctgaggaaggagaatggcataaacccaggaggtggaggttgcagtgagccgagatcgcgccactgcactccagcctgggcgacagagcaagactccgtctcaaaaaacaaaacaaaacaaaacaaaacaaaaaccaaacctgttccccttgagggcagccctgatcatcaggagatccgcacggcaaagggagcctgggaagacccccccacctcaacccctcatcgcacaggcaggaccctaaggtccagagaggacaaagagcatgcctctttgctcttctctgttcaactcaggcccgtggcagctgcagggtctctgccagggaagacttcaggcacatcgatggttggaaggaggggtggggtgaggtcttcaagctgtgtttccatagccagcttactgtttgtgcttcaaatgcattgtttattaggggtggcttaggggtctaatggagatgggggtatacatttccccattcctagccagcccttggggcagccaccactgtggatcctcctctgacctatcctccccacctcccacagcaagtgcagccgcggagccctgtacacaggcttttccatcctggtgactctgctcctcgctggccaggccaccaccgcctacttcctgtaccagcagcagggccggctggacaaactgacagtcacctcccagaacctgcagctggagaacctgcgcatgaagcttcccaagcgtgcgtgcacccctacatcctgataccccccacctcccaccatccctcaactcagagacccgcatccctgcacccagctgggcccactgtcctctccctccggtttggaattccagcccttcctcatctgggtctgataccctcctccctgggcaccggggccacacttaccctcgttcctgtccccacagctcccaagcctgtgagcaagatgcgcatggccaccccgctgctgatgcaggcgctgcccatgggagccctgccccagggggtaaggacagccccagggtggtgggaggggcaaggttatcccgcctggatggaggacagtgccaaggggaggggcagggaagagagcccacctggggaggggtcctgactgctgcgggagggacagtgcctgcctcaggaagaatcgggctccccaggtgtggagggcacaggtgaagagtctcttggtgccatccctgggaggaaggctcagccctctacagtttacaaagtgcttctcatttcctatagcatctcactgtcctctcccattctcaaagaccttgctatcatgcattgacaatatttatattcacaatactgtgctgtggacaaaaccctgggcaggaaagcttatgccagtttgaccaatgaggacattgaggcaggaagctaaagtgacttgctcgagctctcatgtttggaggtggcagagatggaaccattgaccaagtgcctgcgattccagtctcttacctagatcccagcaaccggctcctgctccataccccctgctccagggaccagctctggtaaccttctgttacttcctcccacagcccatgcagaatgccaccaagtatggcaacatgacagaggaccatgtgatgcacctgctccaggtgagtgcagggagctagctgggtggtcctgcctgcccacccaggaccctggccgggccaagctccaaggcctgtatacctggctcatggcagactttcaacatgtgctctctggattactgaatacaagggtgacccttaaatgttatatgtagtctggcctctgcatttttgagataaacaggctcggctgggtgcagtggctcatgcctgtaatctcagcactttgggaggcctaggcaggcagatcacctgaggccaggagttcgagaccagcctggccaacatagtgaaagtctctactaaaaatacaaaaattagccggatgtggtggcagtcacctgtaatcccagctactcatgaggttgaggcaggagaatcgctttaacccgggaagtggaggttgcagtgagccgagatcatcacgccactgcactccagcctgggtgacagagtgagactccatttcaaaaaataaaataaaataaaaataaaaaaagaaactgaggctcaaagtttggaagtgacttgctcaagacaccctttttttctccccaaatttgtactgcgtgtctgtcctatgccagcactgtgcaaggctctgggcccacaatggggagcaattggacccagctcctgaagccatggggatcccaggctagtgtgggagacagacaagtgaccaggtgatgacagaagtgcagggggctttgtgaagaaagaggcagaggactcaacctagctgggggcagtcaaggttgggtcctcacctgctggagcaggtaagacctgaaagctgagcagccatccacagggaggacactggggcttgttggtagagctggcctggaatctggaactcgactcgcaacgctgcagtctcgtagctgaacagctggactacccttacccgtaccctcccctcccctcccatcatggctgaagtccagggtttaggcttggtgtagctctggtccattcctcagaatggaagaccaagggaacgtgggctacacatttcacactgcctgccagggagctcttcttgaaccatccttcctgccctgctaccctgtagaatgctgaccccctgaaggtgtacccgccactgaaggggagcttcccggagaacctgagacaccttaagaacaccatggagaccatagactggaaggtcagcaggtttccctgcatgggaactctctctttcctctggtgtctagggcagggctaggagaggtggggtgagggtgggctggggaagccattctcaggaagctgaaggggtttaccagcacttccaaaacctggatgctgcagagtatgtggggttcagccccaggggtctttaagagggaaccaggctgcagctggacccgggtgttggggccctatttggccctgcatgtttctgtccccaggggcaaagccaggcagtgtaggggcttggtggtggccatcgaacctgacctccacctctatccgtattaggtctttgagagctggatgcaccattggctcctgtttgaaatgagcaggcactccttggagcaaaagcccactgacgctccaccgaaaggtacagggagtgggagctttagcgtgccagggcttctggaccctcggggctctcctgaagctgctgaggccggggcctccagcactccctggtcccagcaccgcggaatctcccatcctctcagctctcacttctttctcacttctctctctctcctgtctgttccttcttggtttggctgtccccctcccctgacccacccccatcttgtctaagggttcctaagggcccacagaggcctgtcaccacagggtacaggtgacctctctcatagaggatggtacagcacagggtgcctggggtagaacctgcccgaaacactgcagaaaggaatccttgtaatgaccttgccccagtgctgcccgcaatccagtgagggcgccaaggtcacagctgctgccaagagagccttgggcgtttcccacctcatggacaatgcagactaggatgtttttagacccaaagacagagtgctgtttctatcccggtgctgtctctaatttgctatgtaactttggacaagtccccttccctctaggattcagggtcctgaagtagaaggtcaaagggccaccctgcctggggcctcagtttctgcatcagattcatagaaggcaccttacatgctatctccaactcctagctgatgcttaaacccctctaagacatctccaacaaacggtaaaccccatttctacttgagaactcccagtaacaggaagcttagacttaccaaggtgcccattgcttttctctagaatcagaatcgcaagtgcaattccaaactgtaatggtgtttttttgtttgattgtttgtttttgagatagagtctggctctgtcgcccaggctggagtgcagtggtgcgatctcagctcactgcaacctcagcctcccgggttcaagcaattctcctgcctcggcctcccgagtagctgggattataggcatgtgccaccacgcccagctaatttttgtatttttagtagagacagggtttcaccatgttggccaggctggtcttgaactcctgacctcaagtgatccgcccacctcggcctcccaaagtgctaagattacaggcatgagccactgtgcctggcccaaaactgtaatgggctttgagtgtcagaagaaaccatcaacttctgaggtgaattggacacatggccattcacttcctttttgatctcagaccttgttggtctaggcctcagttttcccatccgtgtgatggctggagtgagtaaagccacttgggaagaaggcattaagcccacagcagtggtgtgtgggtctttagctctgctcagaccctggttcagagctcactcactcactgtgtcctcatcatgcctgtcgcttcagtactgaccaagtgccaggaagaggtcagccacatccctgctgtccacccgggttcattcaggcccaagtgcgacgagaacggcaactatctgccactccagtgctatgggagcatcggctactgctggtgtgtcttccccaacggcacggaggtccccaacaccagaagccgcgggcaccataactgcagtggtaagcagtggcactgtgccagtgtcagaggaccaggaaggactaggaaggttgaggggcaagaggtcccctctgaagcacatgggaccaggacacccaggatggcagctcctgggggcagtgacgtagtcatgcgtccagccctttatccatccacccacctgtgcattcctatttgtccatttatcatctctcctcttacatgcactcatatttgttcacttatccgtcagtcctttcatctgtgaatttcatccatccacgcgccatcctctagcatccaggagtcctacagacccacccatctcatttcatcacccccttctcactcgagcccccattacacctctttgttgctgcttgcagctgtccttccctgggtacctgctttcccaggcactaagcctgtggctaggtgggaagcactgccctcaggcatcttgggtcaggtaggctgcacttcaagtgacaaacggacttgctgctcctttgcagagtcactggaactggaggacccgtcttctgggctgggtgtgaccaagcaggatctgggcccaggtaagggccttgcagaggggcatctggtcaccagcagctcatccccagcagggccagctcctttgtgggcaggtgaaggagtgtgacgctgggccactctccaacattcctgggatgtccatttcacagacgaaggaacagggttggggggctgtggggagttacacaaatccatgatggtcattattggacctgagcagggggcaggggagggtggacagtccttaactgctctgcaggtccaggatgttagaaaggggcagggacaacaaatgggtgaccccaacctcaacctgctgcttctctctccagtccccatgtgagagcagcagaggcggtcttcaacatcctgccagccccacacagctacagctttcttgctcccttcagcccccagcccctcccccatctcccaccctgtacctcatcccatgagaccctggtgcctggctctttcgtcacccttggacaagacaaaccaagtcggaacagcagataacaatgcagcaaggccctgctgcccaatctccatctgtcaacaggggcgtgaggtcccaggaagtggccaaaagctagacagatccccgttcctgacatcacagcagcctccaacacaaggctccaagacctaggctcatggacgagatgggaaggcacagggagaagggataaccctacacccagaccccaggctggacatgctgactgtcctctcccctccagcctttggccttggcttttctagcctatttacctgcaggctgagccactctcttccctttccccagcatcactccccaaggaagagccaatgttttccacccataatcctttctgccgacccctagttccctctgctcagccaagcttgttatcagctttcagggccatggttcacattagaataaaaggtagtaattagaacactctggctcctggctcttctgttgagatccagttcatttatcctaaagaggtaactaaagacgctaaatccagtcactgaggtgggagaacgcagcccaagtaacccacagagatgcctgcggggccaggcaggcctgggggggggcttgtagtctttggacacagacatacttgattacatgtttaacacacacgaacactctacttccaaaaagaaataggctcttgcctagtttaagcacaagctcttcttggtacagctttcattttcctatgtccccaatttcatttctatactaagaacagtgtgaatgtgatgacagatggcaaccgacatagggcctccgtgtcaggatggacaggaagtaggggactgtggagaactgggtgcccatgccttacctaaggggctgactgctactcagctctatctggttgctgccaggaggaagcacagcccccgttgccagatgttatctttttaagaggagccagaaatcaagaactgcagtgaaatcaccccatttttaagtttaaagtcttgctgtgggtcaacaaggcccaatgaggacactactctgtagttctgttctagagcaacatgcttgagaggagagaggccagatggtggagggtctggccccgggccccgagtcaagggtgcagctggatgccaacctgggtctccgacacctccagccatgcattccttttctgcactgcctctggctgtttccagcatgaggctaaaagctctggagaccatctccaggacccctggtgttccacatggctctgggcccagggaagtgggcttctgcatttccaggctggagcagcagaccacctcctttgctatccctcccctccctcagtccacacccaagacatcatcctgtctttcatgttcatccacttcttgccctcaccaccacagaaccatggtgagctcgatttgaggggcaactcacttccgattttcctagacctgctgtgcctgccacagctgttcaccaggcacctccagggagcctgcccctagctcgaggcctaactcgaggattctcagccccttccatttcttgtctttgggtatttacatgacttactctggcaacaggaaatcaaccatgaccatcctttagttccatcctttagtttagatgccacctcatccaggaagccttccccaccaattcggcactcaggcacttcactgctcactgcctgtcccactaaccacggtcacccatagcctcaacatgcaggcaagagggaatcccgagtgtcggcgagacagtcccttccaagaaacatgtgccccagatgcactgggagcttgcacccttcctccaagtcttttattttttttttgagttattaaaaaaaaaacaaaaaacacaaccaaaagaactgacgagaggaagacaaagcctcgggatcagccagagaccgagcggcacgggatgaggcacaggtcaggcctagctggatctgtggagcaaggtggtgggaagtcccgaggcctttgggcatgtggggtctgtggaaggagaggaggtcacttaaaaaaatacatatactgtacacatctatatgaagcgtcctgtgttgggggagtggggtgaggtcatgggagctggtccactttctccttggaccagcctccccgcaggctcactggcttggccagcacagggacccctgaagctggctgtcttcttctgtggagcgagggaaggtaacagtttagttccaacccatggtgggcagaggtcggtggaggtcagaggcatggggatggccactgctcggctaggaaatccctaggggaaggaaacacatgcagatgtcaaatttcctgacccttttcccctgcaaggaaaatgaaatctggcatctccaatgcaggggggaggcattaaccacagtggacattttttagcacttggaatgttctgagaactgggctgagtcctttagtgtttagtttagc

SEQ ID NO: 16261 - DNA, 8907 bp, Human
aaaggacttcccattatgacctttgtccccaactcatgagtgtgtatatgtgttttctttccttttttgacatttaaaaaattatttattttttagagatgggatctctctgttgcccaggctggagtgtactggcatgatcacaactcattgcaatctccaactcctgggatcaagagatcttcccgccttagcctcccaagtagctgggactacaggcatgtgccattacacctggctaatttattttattataattgttacagccaggctctccctatgttgcttaggctggcctcaaactgctggtttcgaactcctggcctgaagtgattctcctgcctcagcctctctaatagctgggattacaggcaagaaccactgcaccaggcaactctttttcttttttgtttttttttgttttttgtttttttgtttttttgtttttttgttttttgagacggagtctcgctctgtcgcccaggctggagtgcagtggcacgatctcggctcactgcaagctccgcctcccgggttcacgccattctcctgcctcagcctcccgagcagctgggactacaggcgcccaccaccacgcccggctaattttttttgcatttttagtagagacggggtttcaccgtgttagccaggatggtctcgatctcctgacctcgtgatccgcccgcctcggcctcccaaagtgctgggattacaggcgcgagccaccgcgcccggcctctttttcttttttaatgaaataatagagctagtagaaaatagtttgctttttaaagtgcttacttaataaaataaaaagtgggcaactcgaaataaaaaatcaaacaatatctaacatgtttaaaagatttttaaaaatcaaaatataaaataatatcaaaatttaaaaactgggattctgttccccaaagttctgttcaaatctgttagatttatcttcccttgaccctaagtaatatcttgggcaagccctagagcttctttcctgacccttagttaataagatgttatctggtcacattcagtcacaataatagactcattttagtaataaacatcttaagactagtaattaaaactctttacttcacaccaagtttcctccccaagcttggcctgttcctggctggcagcctgaagtagggaaaggagagatatggtgaccttttctttgtacctttctagctaccctctataccctgaccccacatacataattgagctgtggcttctgactctactgggtttggggatgagaggcagtgagagtaaaatgaaggagtggttttaattaatggcacagctaaaactggattttgttctctctgcacatggcagatgtttaaagctcattctttcttttatgcaagtttttacaccatccagcctcatttgtacctcttgaatttttgctcagtggcctatcaccattcaggatcaagacaaaaatcaatgagcacttattgtgtgtcatgcaccctacaaagtgccaggatatttatccaaactcctggcaatgctaaacacaatgcaaaaagacatattagaaaacgaatcttattaactttaacttttcaactgtatttcatcataaagtcttactttacaagataattgctgttgtgaaaaagggaaaggtcatggtctcatttcccagatgttatttgatatatgctataaattatattacctccaacatagtctgcactttgaacttagaaaaacaatcttcagacggcatgcattctaattcttgaaataagtatgcccacaaactgtagtttaagacagaataggtatgcttctcatgttttaattcagttgaatttcagaagatctcaggaatgtacagaacgagaattaagaattaataagaataagaattaattaattgcttgacatagagtagttaggtgatttcctgaactttaagcttccacatcacagtatgaagttggttcaagataagaaatataataaattctcgcccaaggacagacctgaatctctagctgcctagaggctgactcaactgaaatcatggcgtttgacagcacttggaaggtagaccggagtgaaaactatgacaagttcatggaaaaaatgggtaaagactttatttctttgtggctcattctttgctttcttacaaacatttttctttctaactcctaaatctctaggagattacagatagcttacagatagctcctgatgtggtagagaggatccagaagatgttcagaggagggaaaccatattctcccttcttacattaggaagaatccactatctcactaatggaagaaaagattctttgagtgctgttctctgaaacacaccaaaaagatccagaaatgtttccttccctctttaactgaaaaatgactttttttgttgtttacagtaagaaaatggcagcgtgtaatgataacttccagatctgaaaatgttaaattctaggagatggaaaaacaaagaccatataagaaagtaatggaaaaggttctcttaaaatttatagcgctgaataagttagatttaattctgatttcttctaacttaaaaaagttttggaataatcttgagaagctgtgtagttttctccagggcgtttaatttaactgatttataatttgataccaatactctggcagcccatatactatacaagataggcaaacaaatttgtgtcattcccctaaaagaaaaatctgcatcaattatagcttacagtttaggaactctaagtttaaatttataaaagttgtagattcttatagtgattttggcttaatatttgctaattttctcatttttgtgtcagaaagaaatgccacaagaagcaaatagaactataaagttcaaaatgttaaagccactaagaaaaacaaaggggcatttaagaaaaaagaatactgtatatgtggaattaaagatgtgcttccttataaatatatgaatatacattttaatccttcatttgatatttctagaatttgatttacttaacactgaaatgaacagtttgttaatcttattaaggttgctcagctctaagattctataattctgtactctacttaatttttctcaagttatggaaaaacaactttaatcagttctcttgatcggattgaacctgaacttctgtagaagcaatctgaatgttcttgtgcaaaggcaatgctaccgagttttcttcccaccctcaaaataaacaaacaaaacataacttggaaaaataaacacttcctatgggatttgactttattttctccattgtcttaccttttacaggtgttaatatagtgaaaaggaagcttgcagctcatgacaatttgaagctgacaattacacaagaaggaaataaattcacagtcaaagaatcaagcgcttttcgaaacattgaagttgtttttgaacttggtgtcacctttaattacaacctagcagacggaactgaactcagggtaagaatttttttttttatgagcaatgcattcttgatttttctacccaatattaaaatgatttctgctctatttcattggatggtttaattaatgcaggtctccttcactaactgaagaagccaatgaagtttgtctacattatatattgcacaaattggcaggatatttaaatatgcttttatttttatacgcatctgtgaagaatctgaattgaacagtaagaattagaaaactatcttttgaatgactgaatatagacctattcataaagaaatttaaaactgtgtttttaaacagtacagcaaaagaagcctttagagttaatatgtaacttaactgtaacatgttgaaataataaaagaaatgaatagatgaacaaatgagtgagttaccaaatggaaagatttgatgtattgtaggtcattgggagtgtaccttttcatgtttaagataacacattttaggaagtcatcattttcaacaaattttttaaaaactttttttagcctcaacatttttctatttaaattacatgtttgtaatgacaatttaactactgaatgttttatcataagttatgtctttctttaattagtaccacaatcacacaaattaaaacaagcacagagttgttaacatctccatgaaactaattttaaccatgactatatttctggacacgtaacatgaaagattcagaaagaagtgctgctcatctgccttaaaattcagcgtatggaaattattgaagagaacaagcataatggttatcaacacatactctgtagcccaatggcctaggttcaatcctcactctgtgactttaggtgaatcactgtgccattttacagtctcctcttctgcaaagtagagataatagtatcagtttcatagggtcaccatgaagattaaatgaaaaagtgtgtctacagaactcagaacagtgcctgacatgtgtaagaccctaataaatgccattattattattattattattattattattattatgtaggggacctggagccttgagggaaataaacttattggaaaattcaaacggacagacaatggaaacgaactgaatactgtccgagaaattataggtgatgaactagtccaggtgagttgtcaaatttatagctattttcaaaaggcaaaaattactacaaaacaataatttttgtcactgctgagccagatcttcagtaaactgactacttcttttctcataaatcttactgattttaaaaatattgtatagctattttctgatgcctatttactaaagacaacttatatatgtcaaataatcaatgcctattttaactgaaaatataaatgactacaaaccaacatgtgttttaaaatggctgtatcccatatctgtataaatcttgctatcaagtacaagaaaaaattgtataaactcatactcatataatatatatgaatatataatataaaaatagtataaactcatatagtataaaactataatactactttttcttaacttagatgtaaaccttaaagataaattcttctgtttgttaacacctttcagacttatgtatatgaaggagtagaagccaaaaggatctttaaaaaggattgagcattattcttggcgcacagtccaaaatacaaattggacagaagatctatattgtaccagaactatttatttcaccccatcaagtataaggttactgattgattggtccttttataaacattggtatatttccattcatgccaaagcaaaagaagtaaaagctaattaggatttaatttgttttatattctctaagatatatatttactaaaagaatttgtgacattttaaaaaacaaaaataaatattgcgtccatgttgctttatatgtagccttgccttttaaaagaaaaagtatgtgaatatgaattgacagattgttttcgtagagagagggtcttactctttcactcaggctggaatgtagtggagagatcatagctcactgtaacctcaaactcctggactcatgcaatcttcctgcctcaggcttctgagtagctaggactatgggtacattccacagtgcccagctaatttttgttttgttttctttttattttttttagagatggggtcttgctatattgcccaggctggtcttgaacccctggcctcaagcaatcctcctgcctcagcctctcaagttgttttttttctttacatttgataaactaaaagcataggctgcatatgagtctttaacatcttgaactggttgtgaataattttctggcactggttgtaagtaatatctattattataaaaataatatatgctcaaccagaaaacttagaaataagaaacacaaatgtaaaataagtatttccataactcataatccagagataattgccattctgattttgatagatatcctctcagctctcttccctgggggcagatatttcccaatacataccactttgaataggatgataggaaataaatgatgtactacattaaattaaattattgtattacatttttgtacacatcagtcattcccacgcttggctgaaaatcaggatcatctgagaaacttaaacaatttctgcattcttaatctccactgttattctattatatcagaatcgctaatagaaccaagaattctagaaaatttcctggtgattctgatgcagcctgtccactaacttgtctttgagaacaatggagatatcagttatcaatgttatttttaaccacccccttcttttttgttgttgtgggttttttcacataaacacatacattgccaattttccagggctcaaaaagtttccttttattcatattttcacatgacgtaaaattttatgtgcttcacataattgtattttagcagggtacatattaggggatggagagggggtacaatttttaagcatttgcagctgcaactctatagacttttgacaaattctttttcacactgatgtagataacagcttaacatttacatagttcttactacttgccacacactgttctaagtggtatatacatatgacatatatattaaaatgtaggaagaaaaatgtttgagtacctgatgaaaatgaatagagagtatgtaatctttgaaaggtgaatactgcgtgttctcacttataagtgggagctaaataatgtatacacatggacacaccagagtgtagaataatagacactggagacttggaagagttggagggttggcagggggcgatgataatttacttaatgggtacaatgtacattattcagggggtgatggttacagcccagactttaccactatgcaatatatcaatgtaacaaaactatacttgtactccttaaatttatataaaaataccttaaatctatgttcattttataatttcataaaaatcttcacataggaaatagtaattatttagattttcacatgcttctcttcataaaagctcaatgtatttttatccctctaatcttatgtgtctaccatatatgaatcaggaaaaggcaggtattaatctcaatacaaaaactgagagagacaaaggcacaaagaagtttattagcttgtctaatattgtacaaagtccatgatgaacagaagaattaaatgtaggtcttgactttcagcctagatcattatgatctatgctattactcagcctgttataaacaaaaatatattaagaaaaaaaatgtccttaattcctcagtggcacccaagaatagcactctaaatgagtcaggtcagactgtaaaataatggtgttgagtgattagacacttatctatttctagtctcattgcaggctgacttttttcaccatttatatcctttctagaattaaatttccactatttattagtattggagaacagcctattatttgttaagtgacttccatttcaacaaccgtttttcgggaaaaccaaccttgtcattacaccaccctgcttggccaaaagagggtccctgacccaagagcagccaatctaccacaatttggccagatcatgagctctgtgtagaaggaaaaatgacaactaactgaacctgcaagaacctctttctagggagtttgaatttgagaagtacacagttagtagttgatagcaaggaaaaaggcttaaagaggacaaatagagcagacaataagtagaagtcatgagtacctgaaactatgaacaagcagtaaccgtagggtagatagcagaatgtcggggcagtcagaagcagttggagtagtagaagctgaaatatttacacatgcaatatggtatctgggatatgcttcaaattgctttctccccaatctaggattggggaggaagattgatacaagttggcaattcttgcagctgttgcaaagtgcctgacacataataacatatgataggttcactgaataggaacacaggaattcattatattcatctctgtacttctgtatgtatttgagattttccataacaagaagttaaaaatatagtacttacatacacatataactccagaatccaaccacttcccatcacttccactgctatcaccttagtatgagccaccattatctttttcctggattactgttacaactctctaaaaagcccaagaacttctaccttccctactccacccctttagtctctttttctacacagcagccagaaggatcctttaaaaatctaaatctgatcacatcgcttatctgctcaaactgctgcaatggcttccattttcactcagaggaaaaagccaatgttcttacaatgacctgtaagaccctatatgatcagatgccctgttacctctccaacacgtggtcctgtttttcatgaaatatctgggggaagagtgtttcaagcagaggaaacaccctggagcaaagacaccaaggcagtagcaaacctggtaaatttgaagaacatagcctggaaagagtccccaaatcacccagagctgaccaaaaacaagaccaatgttcaggaaacacaggctgactcagctttcctaaaatttaggaatgatgtggtgaaaaagaatgggttttagaatcacagacttgcccaaattcttgtctgcccatttactgactaaaattcaagttctgattctctatttttctcatttgaaaaatggggaaaatgtaatgattttctgagcttgttgcaattgaggtattatgtataaaacatcgagtgtaatgcctggcatatacctggtactcaaatgtaacataaacatgtacccttctcctctagagaaaatggggcaaagtatatcctgagtagatgggaaaactcttttcttaaaatacctctcatggagtctgcgtgagagagtgagccttggcctggtagatgagaat

SEQ ID NO: 16262 - DNA, 45571 bp, Human
ccttggcccctcccaaagtgctgggattataggggtgagccactgcacctggccactatttctcaccatatacaaaaatcaagtcaaaatggattaatgatttaaatgtaagacctgaaactgctagaagaaaacataggggaaatgcttaagaacattggtctgggtaaagattttatggagaagacctcagaagcacaggtaacaaacaaaaatagataaataggattgtatcaaactagaaagcttctgcacagcaaaggaaacaatcaagattgaagagacaacctacagaatgagagaaaacatttgcaaacttttcatctgaaaagggattaatatatataaggaactcaaataactcaatagcaaaaatccaaatacttcaattttaaaatgggtgaatgagctgaatagacatctctcaaaagaagacaatacagatggcaaacaggtatatgaaaaaatgcttgataccaccaatcatcagggaaatgcaaatcaaaaccgcaatgagataccacgtcaacctaattagaatggctattatcaaaaagacaaaaaaaaatgctggcaaggatgcagagaaaggggaattcttatacactggtggtatgaatgtaaattagtacagccattatgaaaaacagtctcgtggttcctcaaaaaactagaaatagaactaccatatgatccagcagtctcagtatatatccaaaggaaggaaaatctgtatgtcgaagggatatctgcattcctatgtttattgcagcactgttcacaatagtcatgacatggaattcagtgtacgtgtccatcaacaggtgaatggattaagaaaatatggtatatatacacagtggaatactatttagctgtaagaaagaatgaagttgtgtcattcatggcaacaagaatggaaatggagaacgttatgcaaagtgaaataagccaggcacagaacgataaatactttctgttctcacacatacatggaagctaaaaagttgatctcatagaagtagagagtagaatagtagttattagaggtggggaagtataagagggaggcaatgacagatagccaacggttggttaacaaatacaaaagtacagctagataggaataaggtttagtgttctgtagcactgtaaggtggctataattaacaatttattatattttttcagatacctagcagggtggattttgaatgaacccaacacaaagaaatgataaatgttcaaggtgatagatatagtttgatcattacacattgtatgcatgtattgaaatatcacattctacgccataaatatgcacaattataacgtgtcaattaaaaatagtagaagcaaaaaaaagatggaagttatttgtttttgaggagtgaaattcagaggagaggagagatggcttaggggactgttgtttttcacgtattgatctgttggcactgttcgaatattttaaaaagtgataaagtatattgatgcattagtggagaggattaaaaactaaaacaaaatatgtattaatggcaagttcctttaaggagctttaggattaaagtgtccccagtaaaagggaatcagatatagagaaaaagaaatgtaagtttattttttgtatttaaaagggcttttctggctgggcgcagaggctaacacctataattccagacttttgggaggccgaggtgggtagatcacctgaggtcaggagtttgagaccagcctggccaacatggtgaaaccccatctctactaaaaatacaaaaaattagccgggcttaatggtgggcacctgcaattccagctactcaggaggctgaggcaggagaatcacttgaacctgggaggcagaggttgcagtgagccgagatcacgccattgcactccagcctgggctacaagagcgaaactgtgtctcaaaaataaataaataaataaaagggcttttctttatttctgattttatttttgttttgttttatcctagggtttgaaaaacaaaccgaaaaagatgggccacataaagccagacttgattgacgttgacttaatcagaggttagtcttaaaattgttttttatgtacattattatattatttcacagggatgcttaattttcaatatcttctctatatgatggtatactttaatttctaaatgtaacactttactctcatcattcaggctttagcactttttccacctcttagtactgtgtgactctataaattacatgcatacatgtaaaagagggatgaacgtagagacttgctgttgtgtaattaagataaatatgttgtttaacattcaagtaagcctgacttattttgagcttctgtcctagtgattgaggcaagaagttattacatttaacaaacatctaagagggtttttttttttaactgaacaggttttgtgctgatttttgcactcacctatttttaatgtagtgctacaggtggccttcaatacagtgtatataaatgtttgatgttttgttttattgtatgtttaaagggtcaacatttgccaaagcaaaacctgaaattccatggacatctctgactcggaaggggcttgttcgagttgtattttttccattgttcagcaattggtggattcaggttacctctttaagaatctttgtttggctgttactactttatttcatgcaaggtaattggagaaatgggaataagcaatgacagtttctttttgctgcttttgctattaaataatgaagacctactgattttacatttaccctttcatttgacagtttaaagtacacagaatgaagagacatatgccatttggggttcatattaaaattatctgctatgagagagcaaacatacttgtgtaactctttctcctcacttgagtttctttctacctgtctcactggccaggccttctcagtcttttcttgtgtctgacctttgagcctttgaaattgggtatgtgtgttttttgtttttgtttttgagacggggtctctctctgtcacccaggctggagtgcagtggcatgatcacagctcactgcagccttgacctcccagacgcaagcaatccttccacctcagccacccaagtagctggcactacaggtgtatgccactgtgcctggctaatttttgtatttttttgtagagacaagatgttgtcatgctgcccaggctggtcttgaattcttaggcccaaaagtgttgggattacagatgtgagccaccacgtttagcctgaatattggattacctaaagtttgcaccctaggttctattctctaagtagtctcattaaggcctattgctttaaatacaattgatatacaggtgattcccaaatctatatcttcaggccagatctctccgctgcacttcagacttataaatctaattgcctgctttgacatttccatatggagatttaattggtatcttgaagttaattatataaaaaatggaactcttcacttgtgtgtgtgtgcgctgcacacatgtgcctgtgtgtgtaaacttgttcttctttttgtctccagttcattaaatgatactatcaatcacccagtattcaggtgaaaaattaaatcttcctactctaccctaccatcaactctcacatgtaatatgtcaccaagtctgtgagttcttcctccaaatttttcactatatttatctcagtctctactgccatgatcattgtccacagcaccagcatttctttgcttagaccactggaataacatctactctgagccttctttctaccaatcattctttccacagcaattagcaaaatcttttaaaaacagaagccatataatgtcattttcctgcttaaaaccctgtagtgacttctgttgaccttagaataaaaatccaaagttcttaccatggcctataatgccctacaggacctggtgcctgctcttctctcagacatcatctcctatttcttaccactctgctcgtgctggctgtagacataatatcctttttttgttcttcacacggagctgttttgttttgtttgaagcattcggagtttggctcttttttcccaggctggagtgcagtggtgcaatctcagctcactgcaacctctgcctcctaggcttaagtgattctcgtgcctcaacctcccgagtagctgggatacaggtgtgcgccaccacgtccagctaattttttgtatttttagtagacatggggtttcaccatgttgtctaggctggtctcgaactcctgacctccggtgatccacccgcctcagcctcccaaagtgctgggattacaggtgtgagccactgtgcccggctgtttaaagcattcttaaggcttttcaaatggctggcttttttctcacctttaaatctcagctgggttgtaactttcataaagaggccattcctatctacgtatctttttttttttttttttgagatggagtctcgctctgttgcccaggcgggagtgcagtggcgcgatcttggctcactgcaagctctgcctcctgggttcacgccattcccttgcctcagcctcccgagtagctgggactacaggcacccgccaccacgcccagctaattttttgtatttttagtagagacggggtttcaccgtgttagccaggatggtctcgatctcctgaccttgctatccgcccgcctcggtctcccaaagtgctgggattacaggtgtgagccactgcgcctggcctcctatttatatttctaagtagtcctaataccctctagtcactatcataagaatcaattttaatttctgggttacacatcgctacctgatgttttctaactgtgtgcagggacccaatatattctctttacgactgtatccccattgtctaccaaggaagtagacagtatatactatggttacatctctgcaaaaagatatgaattagaacaaagagtgggagaaagttgggttaaggtgaaagaattatgggttcttctatttgtgtcagttaaaaatttttttaagatatagagtgaaaaatatatgtataaatttacaaatctataggtttaatttttttaaagttgtgaaagtgtcatttattagaatatctgtaatggaaatgttccgcgtctgtgctgcccagtatagtagctacttagccatatgtggctattgagtattcaaaatgtagttagtgtcagtaagagactgaattttaaattttatttgatttaaattaagtcttcataatgatcattttaatggctgcataataattcatcatatgggcataccatcatttaaaactatcattttaatgtctgtacagtctatcatatgtagagtcatatgtagagtctatcatatggatttatcataaacatctttgtatagctgccttttttttttttttttttttttttttttttgagacagagtctcattctgttgtccaggctagagtatagtggggtggtcttggctcactgcaacctctgcctcccaggttcaagtgattctcttgcctcagcctccgaagtaactgggactacagagacacactaccatgcctggctaatttttgtatttttagtagagacagggtttcactgtgttgtctaggctggtcttgaactcctgaccccaggtgatcctcctgcttcagcctcccagagttctgggattacaggtgtgagccaccacacctggcctatatagcttttaatagtccattatgtaagagtactgtaatttacgtaacctttctgtatgaatctgttcaggctgctataagaaaaataccatagactgggtgttttatcaacaacacaaatttatttttgacagttttggaggctgtgaagtccaggatcaaggtgccagaagatgtggtatctggtgagggcctgctttctgattcataggtgtcagtcttcttgctgtgtcctcacatggtggaaggggcaagggagctcttaggagtcattttataaggccacatctataagggcactcatccccaaactataaccaactggttatatgtgactggggacctctctaacatgctttctcactttttacaatgtggataggctaagaacttttcaaatctttaagttatgcttcctttttgcttaacaattctgtcttttaagtcatttctctcttctcacattttactataagcacataggaagagccaagctgcacctttaatactttgcttagaaatagctccagctaaatatgcaatttcatcacttgcgagtttcactttccacagaatcctagaccacaaatacagttcaacaagttctttaccactctgtaacaaggattgtttttccttcagtttctaataacatattatttctcatttctatctgagacctcatcagaatggactttacctcatattttaccaatagtctgttcatggttacttaggtattctttaagaagattgaggctttttctctagctcccctcttttctttctttgtttttgtttgtttgttttattttgtttttcaagacagagtcttgctctgttgcccaggctgaagtacagtggcgtgatcttggctcactgcaacctccgcctcccaggttcaagtgattctcctgccttagcctcctgagtagcggggattacaggcacctgccaccatgcctgactaatttttgtgtttttagtagagatagggtttcatcatgttgaccaggctggtctcaaactcctgacctcaggtgatccacccgccttggcctcccaaagtgctgggattacaggtgtgaaccactacacccggcctcctcttttctttctgattcctcaccagaatctcttttaaaaatgtttaaggcaatctaggctttttctactatgtacttcaagtattcgtctagtctccacccattacctatttataaagctgcttccacatttttaggtatttgttatagtaggaccccccattctcagtaccaatttctgtcttatgccacttgggctgatacaacaaaaatatcatggcctaggtgctttataaataacaaaaagttatttctcacagttctgaaaagttcagatcagagcactagcagattcagtgtctggtgagggtctgcttctctctgggtcctcatgttgctgaagggccacaggagctctctggaatctcgttaataaggttactaatctcattcatgagagctctgccctcatgacctaatcagctaccaaaggccccatctcctaatacgatcacattaaggattaagatttcaatatgagttttgttggggacatatgttatagcatcttcccatattgtgggcatttaggtggtttctatgtgttttttattaataatgccagcaggaacaaagttttccttattttatattatttatttaggatttgttctttgaaatagaattaacagatcaaagaatgtggacatttaaggcttttagtacatataatgaaattgctgatggcacagttgttttggaaagcaatagatgagagtacctgttttaccatggtcttaccagcattattataattttaaaaattgttatctaggtggggggcagtggctcaagcctgtaattccaaaactttgagaagctgaggtgggaagacttgaggccaggagtttgagaccagcctgggaaacatagcgagatcccatctctccaaaaaaaaaaaaaaaaaaaaaaaaattagccaggcgtggtgcaagcctgtagtttcaactacctatgaggctgaggtgggaggatcacttgagcccaggagttcgaagttacagtgagcaatgattcatcactgcactctagcctggctgacagagtaagaccctgactgcatctctgcccgccccctcaacaaaagattgttacctaatttgacgtgcaaaaaatatttagcttgttgaatatgaatttccttggtcacttgtaagggtaaaattaagtattttttccacacatttattattaaattatttattccttccttgttgatagatactgcatcctatatagataaaatttccatatatgccatggtctgtttctggactgcatattctgtaccatcagttttggttattctcatatctatgccatatattaaatttttgtatttgccatggtatgtttctggactacatactctgtaccattaatttctggttattctcatatctatgccacactgctttcattactacacagctgtttaatatggattaacattgagcaggaaaattgttttttttcttttgagatggagtctcactctgttgcccagactggagtgcaatggtgtgatctcggctcactgcaacctctgcctcctgggttcaagcaattctcctacctcagcctcccaagtagctgggattacaggcgtatgccactacgcccaacaaatcttagtatttttagtagagatggggtttccccatgttgaccatgctggtcttgaactcctgacctcgtgatccacctgcctcggcctcccaaagtgctgggattacaggcctgagccaccgcgcctggccaagtatttcttcattattctgctttcccacattttctctcatgctttcttgtttatcctttccaaaataggttagcattattttatcgtgattaaaaccaaaagaccccccaaaaccaacaatacaggaatttggattggaattctctgattatcccctttccccagcacacatacacaaatgtagatgtatacatatatttttggaggatggacagaaaatttgacttctttacaacattctctttgctatacagaaatatgatattgctctccttttactcaggacttcctttttttttttttttttttttaaaattgagacggcgtcttgctctgttgcccaggctggagtgcagtggcttgatctcggctcactgcaacctctgccacccgggttcaagtgattctcatgcctcagcctcctgagtagctgggactacaggtacccgctaccatgcctggcaaatttttttgtatttttagtagagacgggggttttgccacgttggccaggctggtctcgaactcctgacctcaggtgacccttccgcctcggcctcccaaagtgctgggattacaggtgtgagccacagcgcctggccttaatcaggacttctgtttatccctcagtaaacctttgcaggatttttttctttctttctttctttctttttttttaaatagagacggggtctcactcttactcccaggctggagtgcagtggcgtgatggtatttcactacagccttgagcccaggcaatcctcctgcctcagcctgttgagtagctgggactataggtgtgtgccaccatgctcagctggtgttttttattttttattttttagagatgggctctcgctatattgcccaggctggtctttgaactcctggcgtcaagtgatcaaatgatcttcctgcctcaacctcccaaagtgtttgagttacacgtgtgagccaccacacccagccctggatttttttcttataaggcctgcttagatcttgttaaattcaattttttttattgtggtaacatatacacaacatgaaattcaccatcttaaccatttctcagtgtagagttcagtggcattaagtatactgatactggaatacaaccattacccactgtttatttccaaaattttttcatcttcccaaactgaaactccatacccattaaactccctatttcccctacccatcgtccctggcaaccaccattctaccttgcctctatgattttgactactctgggaacatcatataagcagaattatataatatttgtccttttgcaattggcttatttcacttagcataacatcgtcaaggttacccatgtagaatgtttcagaattcttcctttttaaagctgaattgtattccattgtatgtagataccatgtttagtttgtacattcatcttctgagagatacttagagatttccacctgaaattaaaatattttgtctttgttgctgctgctgaaaatacatgactttttaagtctatttttacaagttttaagtggtttttgctgtcacatttgaaagctattggtttataattaaaattgttataaccagccgctttattaaactctttgtcatcaattctaattgtttttcagtgcttgtattagattttataatgatacaaccatatggttggcaaataatgacaatttggttttctcctttcacatacatttcatttactttcacccaatcagtcaacatttcagagtaacgttaaatgataacagtgagtggtcatccttgttttgttcctgattcagaatatcttcactaacatataatatgtattgattttacttatatattctttagcatgttaaggaaatatttttattcttaatagtttagaaaatatgggcatttgagatgaattacaaatcaagaacaaatgtatgtatgtgtttttttttaatacaatgctttttttttttactgttacctggagttgggccagacttcacaggtttagggcacaatcctctacaagactgctctcccttcagatatcagcctccagtttgggggtccccaggatcactctcacttctgaccaggtagctatagttttgggtcccccaggcattccctcaggtttgatgattggatggaatgactctcagaacttcagaaagtgctaaacttacaattatagttgcattatagcaacagaatataaatgagaggagaggtataggagtgtttgggatggttccaaacaggatgcttccgttgtcctcaggtagcaatatgcaaaatattgccacccagggaagctccccgaagctttggtatgtagagtttttattgagactttattatttaggcctgattgatggaatcattgacatgtggttgaatgcagtctccatcacccttcagtcctcagaggtctcctaatatggctcaaagacccaagcctttaatcacgtagttggtctttttggtgtgaccagcagccatccttaggtaccttgttagcataaactatcaggcctggcacaaggggcccacaatgaatagcaaaggtacttctgtcacttaggaaattcaagggtttagaggtcacttcccaggaactgggatcaaatgccaatcaaattctttttttttttaactttttaatttttgtgggtatatagtaggtatatatatttataaggtagatgagatactttgatacaggcatgcaatgcataatacatcatggcaagtagggtattcatcttctcaagcatttatcctttgtgttacaaacaatccagttatactcttttagttcattttaaatgtacaattaaattattgactataggtcagcctgttgtgctatcaaatactaggtatttttcgttctgtcccatgaaccatccccacatcccctactccacccccactacccttctcagcctcagagccttctactctctgtctccttgagttcagtcattttaatttttagctcccacaaataagtgagaacatgtgaagtttgtctttctgtgcttggtttatatcacttaacataatgtcctctagttccatccatgttgttgcaaatgacagaatcttattcttttttatggctggatagtactccattgtgtatatgtaccacattttctttatccgttcatctgctgatggacacttaggttgcttccaaatcttggctgttgtgaacagtgctacaacaaatgtgggagtgactctttgatatactgatttcctttctttcttttgttctttttgtttgttttgagacagagtctcattctgtcacccagggactggagtgcagtggcataatctcagctcactgcaaccctttgcctcctgggtacaagtgattctcctgcctcagcctcccgagtagctgggattacaggtgcctgccaccatgcctggcaaatttttatatttttagtagagacagggtttcaccatgttgcccaggctggtcttgaacttctcacctcaagtgatctgctcactttggcctctcaaagtgctgggattacaggcatgagccacagtgcccaaccaccattttcctttcttttgggcatatacccagcagtgagattgctggatcatatggtagttctatttttctttatttgaggaacctccaagctgttcttcatagtggttgtactactttacatttccaccaacagtgtacgggggttcccttttctccatatcctctccagcatttattattgcctatcttttggataaaagccattttaacgggagtgagatgatatctcattgtggttttgatttgcatttctgtgatcaatgatatgagcaccttttcatatgcctgtttgccatttgtatgtcttcttttaagaaatgtctattcagatcttttgcccgttttaaaatcagattattaggttatttcctatagagttgtttgagctccttatatattctggttgttaatcccttgtcagatggataatttgcaaagactttctctcattctgtgagttgtctcttctcttggttgattgtttcctttgctgtgtagaagcttccctcggcccggccctccgccccgccatccctgagacggagtcttgctctgtcacccaggctggagtgcagtgttgtgatcttggtttatcttgatgtgaccccatttgtccatttccgcttcaccaaccaatttttttttcttttttgagaccaggtctcactctgttgcccagtctggagtgcagtggtgtgatcttggctcactacagcctcgacttctgggctcaagtgatcctcccacctcagcctcctgagtaggcttggagtgggaccacaggcgcgtgccaccatgtttggctaatttttttggagtattgtggagatggggttttgccgtgttgcccaggctggtcttgaatttctgggcttaagtgatctacccaccagacctcaaaaagtgctgggattacaggtgtgagccaccatgcccagccgccaaccaaattctttattacataactgtcaattgagatgatttgtatagatgtgatcaaaattacattgtatgaaattattacattaattcacttgagtcaacaaatacttaagcttattgtgtctgtgccaaatattcttctaaacgctgagataaattttctacttttaaatgtcaaattcactttggtagtatttcaatcatttatccaacaaatattgagtgtctattctgtgctccaggtactggtttccagcaaatattgagtgtctattctgtgctccaggtactagttttagatatagcggtgaacaaatcagacaaaaccccttgtcttcatggtgcttactttttagtggcaaatttatatttacattctcaagtcaacaagatctatagtttattgtctgggtactttcattattgtgtttgagtattgggattttattagggcatggaataggtaactttctttttctccgcacaggaatagtttgtatagcacaagaattactatttatgtgaaaatctgaaatatgttaaaatatggagatactttttgatatttttccatttcatttacttctttaaacattttatatatatgctttgatttgcatttcatatatatatatatatacacatatatgtatttcttcttcattatatatgaaatggaaaggcaacatagcatagtagttaagagtgaggactctggagcctgactacctgggttcaatccccatctttgctgtttgctttctgtgtagccttggaaaatactcttcctttgagcaacacagcacttcaaaatgtgttttatatacagcatctagttgtttttgtggtggaaacccttttgaaatatctaaattatcatgctgctagaaaggtaaatccttttaacacagtattcttcacttgccgagggatctagggcttcagtttttcacttggctaatgtgcatctggatgggcattgtaggaaactatttatttgtgtacttttttaaatgatggatttttatagaaacaatttgtatagtttttagaattaattttaaagaagagctctaatgttttacatcttaaaacctcttcttttcagttatagcaattgtcttatatttgatgatgcctattgtgaacataagtgaagtacttggacccttgtgccttatgctactcatgggaactgtccactgtcaaattgtgtctactcagataacaagaccatcaggaaacaatggaaatcgaagaagaaggtaagatgagaaattacactgtagttgtatattttctgggagagttattgtagagatttataaaacctttgattaatttaaaatctccctcttttgtgtttttcattattttttggcttagaaaatgaatgcattactttgcacttttctccttgatgctgagaaaaccttgttacaaacttttagttccagtttgggatttttgtcattcagtacagttgtttaaaaggaaaatttctatactatattattctttataaaatttatcatatattggcttcaaagaaaacattctctttgaaattcagtcttaatcaaaatttggtgaaaattcactgtaaacaaggatcttggtacatttggttagcgctaccaaaattttaccttttttcaaagatgtgtaataagaattgatttctaagtggtctaaactttttttttttctttttgagacagagtttcgctcttgttgcccaggctggagtgcaatggcgcaatctcggctcactgcaaccgatacctcctgagttcaagcgattctcctgcctcagcctctcaagtagctgggattacctgcgtatgccaccacacccagctaatttttttttttgaatttagtagagatgggatttcaccatgttaatcaggctgatctagaactcctgacctcaggtgatccacccgcctcggtctcccaaaggactgggattacaggcgtgagccactgcacccagccgtctaaacttttaataaggatttatttggcttttctttacatattgaattcatgttatattttaatcgattatatggtatatgtgagttttggaactgttgaaatgttcttaggtatatgcagtgttattttccaaaagttatgttatcttccctcagaatatctgtagatttttgcctgcgtaagcaattactaaataagaattttccattaggtgcaatgaatttcaacatattcttatttttgaatgttattttaaaaactttttaaaaaagatttcttgtaaattcagttaaattaatggaatgttttctaaggaaataaaatgctatgctatgtcttattgatatctatagtatatatcttttgtctaggatatcaataaaaagtgatcagttgctactattctatgttacccttataaaatgtgccataagaggtagattcctaacatccatatttaaagaaattgctccttctgctagtggtgttgaatgtgcctgaacagactcttggtcatacaagtagaaatttttttttttagtagattctgaatagcggttctatttctttaatgactgaacaaaatggtagcataggactttggtttggaatctggttttgccctcaaatcagaaagttcttgcatagtttatcctcagaatatgaagttaaactatacttgatttaaggtagtaatttgtcagtataattttctgtagggatatttttggcagaaatagaaagggtcttgaataatctgaagttattgaaatttttttttgtagaaaattacgaaaaactgtaaatggtgatgggagccgagaaaatggaaataactcctctgataaagtcagaggaatagaaactttggaatctgtacccattattggtggtttttgggagactatctttggcaacaggtgggagtcttttttacttgattttgtattcacatagtgtttacagaatgtatagtatcatcaggccataggagtaagtagtatagacttatcttggtgtgatttttaagggttatcagagggcttgcttactcaaaatgttgtcttcactgtctgttttgttacctgtgaatgcagtaatctatcatggaagtattctgttttttttttttttttttgaaatggagtctcattctctcacccaggctggagtgcaatggcacgatcttggctcactgcaacctctgcctcttgagttcaagcgattctcctgcctcagccttctgagaatagctgggatgacaggtgcccgccgccacacccagctaatttttgtattttattagagacagggtgtaaccatgttgcccaggctgatatcgaattcctgacctcaggcctcaggcatgagccatcacacctggcctgatttcctttcttttggttatatacctagcagtggggttgctggatcatatggtagttctatttttctttatttgaagaacctccaagctgttcttcatagtggttgtactactttacatttccaccaacagtgtacgggggttcccttttctccatatcctctccagcatttgttatcgtctgtcttttgcctaaaagccattttaactggagtgagatgatatctcactgtggttttgatttgcatttctgtgatcaatgatatgagtaccttttcacatacctgtttaccatttatatgtcttcttttgagaaatgtctattcagatcttttgcccattttaaaatcagattattagattttttctatagagttgtttgaactccttatatattctggttattaatcccttgtcagatggataatttaagactttctctcattctgtgagttgtattttcacttggttgattgtttcctttgctatatagatgctttttaacttgatgtgatctcatttgtccattttgctttggttgcctgtgcttgtggagtattacttaagaaatctttgcccagaccaacatctggagagtttccctaatgttttcttttagtcatttcatagtttggggtcctaggtttagttctttaattaacttttatttgatttttgcatatggtgagagataagggtctagtttcattcttctgcatgtgaatattcagtttttccagcatcatttattgaagagactgtcctttctctaatgtatgttcttggcatctttgtcaaaactgagttcactgttggccgggcacagtggctcatgcctgtaatcccagcactttgggaggctgaggcggggggatcatttgaggtcaggagttcaagaccagcctggccaacatggccaaaccttgtctctactaaaaatacaagaattatccgggcgtggtggtgggcacctgtaatcccagctactcgggaggtggaagcaggagaattgcttgaacctgggaggcagaggttgcagcgagtcaggatctcaccactttactccagcctaggtgacagagtgtgaccctgtctcaaaaaaaaaaaaaaaaaatgagttcactgtagatgtatggatctatttccggattctcaattctgttccattggccgatgtgtttttatgccactaccatgctcctttggttactatagtgctgtagtacaatttgaagtcaggtaatgtgattccttcagttttgttgtttttacttacgatagctttggttattttgggtcttttgtgattccatataatttttatttttatttatttatttatttatttatttatttatttatttatttatttgagatggagtcttcctctgtcatccaggctggagtgcaatggcgcgatcttggctcactgcaacctctgcctcccaggttcaagcaattctgcctcagcctcccgagtagctgggattacaggcgcctgccaccacgcctggctaatttttttttttttttgtatttttagtagagatggggtttcaccatgttggccaggctggtctcaaactcctgacctcaggtgatctgcccaccttggccttccaaagtgctgggattacaggtgtgagccaccatgcctggccaattccatataaattttaggattgttttttctatttttgtgaagaatgtcattgttatttttatagggattgcattgaatctgtagattgctttggttaatatggatatttttaacaatagtcattcttccagttcataaactatggaatatctttccatattttttgcattctcttcaatttcttttttttgagacagagtctcgctctatcgccaaagctagagtgcagtggcatgatctcggctcactgcaagctccacctcctgggttcatgccattctcctgcctcagcctccagaggagctgggactacaggcacccgccaccgtgcccggctaattttttgtatttttagtagagatggggtttcaccatggtctcgatctcctgacctcgtgatccgcccgtcttggtttcccaaagtggtgggattacaggcgtgacccactgcgcccggctgcgttctcttcaatttcttacatctatgttttatagttttcattatagagatctttcacttctttggttaattgctaggtgtttaattttatttgaaactattagaaatcgtgtaactttcttgatttcttttttagattgtttgctgttggcatatagaaatgctattgatttttggctgggcgcagtggctcacgcctgtaatcccagcactttgggaggccaaggcgggcggatcacgaggtcaggaggttgagaccatcctggttaacatggtgaaaccctgtctctactaaaaatacaaaaaaaaaaattagccgggcgtggtggcgggcacctgtagtcccagctacttgggaggctgagacagcagaatggcatgaatccgggaggtggagcttgcagtgagccaagatcacaccactgcactccagcctgggcgacagagcaagactctgtctcaaaaaaaagaaatgctattgatttttatgtcaattttgtatcctgcaactttaatgaatttgtttatcagttctgatagttttttggtggaatctgtaggtttttccaaatataagatcttattatctgtaaacaaaggtaatttgaattcttcttttccaatttgtaggcctttcatttctgtctcttgtctgattgctctagctaggacttctagtactatgttgaataacagtgatgaaagtgggcatctttgtcattttccagatcttagaggaaaggctttcagtttttcctcattcagtatgataccagctgtgggtctgttatgtgacttgacttttattgttttgaggtatgttccttctataccctgatttttgagaattcttatcatgcagggatattgaatgttatcaaatgctttttcatcatcatttgaaatgattatatggtttttttccttcattcttttggtatgatgtgtcacgttaattgatttgtatgtatgttgaaccatccttgcatccctggtataaccctacttggtcgtgatgaatgatctttttatttatttattttatcttattgttactaatatttgagacagagcctcagtctgttgcccaggcttgagtgcagtggcatgatcttggctcactgcaaactctgcttcccagttcaagtgattcttgtgtgtgagtcccccatgtagctgggaccacaggcatgtgccaccacatccctccctccctaattttttgtatttttttgtagaggtgcacagaagtcaagtattgagatttgagaacctctgcctagatttcacaggttgtatggaaatgcttggatgtccaggcagatgtttgctgccggggcagggcactcatggtgaacctttgctagggcagtgtggaagggaaatgtggggtgggcacccgcacatagagttctcactggggcacttcctagtggagctgtgagaagagggccactgtcctcaagaccccagaatggtagatccaccaatagcttgcattgtgcacctggaaaagccgtagacactcaacaccagcccatgaaagcagccaggagggaggctgtaccctcccggtgatacttgatatcattttaattttctggaatgttttaagacttgttttttggctataatatggtatatccctgaaaatgattcatgcactgaggagaaaaatgtgtattctatagccagtaggtaaaatgtttagtaaatgtctgtcaggtctgtttggtctgtagtgtagattaagtccaattttttttgttggtttttctatttggatgatctgtctaatgctgaaaatgaggttgaagtctccagctattattgtattggagtctgtctctctctttaactctaataatatttgctttatgtatctgggtgcttcagtgttgggtgcatatatatttacaattgtttgtcctcttgctgcattgacccctttatcattatataatgacctttaactctttttatagttaaagtctattttgaccaatataagtatagctacttgatatggtttggctgtgtccccacccaaatatcaacttgaattgtatctcccagaattcccacgtattgcaggagggagccagggggaggtaattgaatcatggggctggtctttcctgtgctagtctcgtgatagtgaataagtctcacaagatctgatgggtttatcaggagtttctgcttttgcttcttctttctcttgccgccgccatgtaagaagtgcctttcacctcctgctgtgattctgaagcctccccagccttgtggaactgtaagtccaattaaacctcttcttcttctcagtctcaggtatgtctttatcaacagcatgaaaatgaactaatacagtaaattggtaccagtagagtggggtgttgctgaaaagatacctgaaaatatggaaacaactttggaactgggtaacaggcagaggttggaacagtttggagcgctcagaagaagacaggaaaatgtgggaagtttggaacctcctagagatttgttgaatggctttgacagcaatgctgatagtgatatgaacaataaggtctaggctgaggtggtaacagatggagatgaggaacttgttgggaactgaagcaaaggtgactcttgttatgttttagcaaagagactggtggcattttgcccctcccttagagatttgtggaactttgaacttaagagagatgatttagggtatctggcggaaaaaatttctaagtagcaaagcattaaagaggtgatttgggtgtggttaaaggcaatcagttttataagggaagcagagcataaaagtttggaaaatttgtgccctgactatgcgatagaaaagaaaaacccaggccaggcgtggtggctcacgcctgtaatcccagcactttgggaggctgaggtgggtggatcacctgaggtcagtagtttaagaccaatctggccaacatggtgaaaccccatctctactaaaaaaatacaaaaattaaccaggcatgatggtgggtacttgtaatcccagctacctgggaggctgaggcaggggaattgcttgaacccaagaggtggcatttgcagtgagctgagatcacgccactgcactccagcctgggtgacagaacgagactctgtctcaaaagaaaaaaaaaaagaagaaaagaaaaacccattttctggggagaaattcaaactggctgcagaaatttgcataagtagcaaggagcctaacattaatacccaagcaatggggaaaatgtttccaggacatgtcagacactttcatggcagcccctcccttcacaggcctggaggcctaggaggaaaaagtggtttcgtgggccggacccagggtccccatgctgtgtgcagccttgggacttggtgtcccatgtcccagttgctccagccatggctgaaaggggccaatgtacagctcaggctgtggcttcagagggtggacgctccaaaccttggcagcttctacgtggtatcgagcctgcaggtgcacagaagtcaagaattgaggtttgggaacctctgcctagatttcagaagatggatgcccaggcaatagttttgctgcaggggcagggcactcatggagaacctctgtgagggtagtgtggaagggaaaaggtggggtcggagcccccacacagcgtccctactggggcaccacctagtggagctgtgagaaggccaccatcctccagaccccagaatggtagatccaccaacagcttgcactgtgctcctggcaaagcctcagacactcaacaccagcctgtgaaagcagccaggagggaggctttaccctgcaaagccataaggacagagctgcccaagaccatgtgaacccaccttttgcatcagcgtgacctggatgtgtgagacctggagtcaaaggagatcattttggagctttaaaatttgactcccccactggatttcagacttgcaagggccctgtaacccctttgttttggccaatttctcccattttgaacgtgtgtatttacccaatacttgtatcctcattgtatctagaaagtaactagcttgcttttgattttacaggctcataggtggaagggacttgccttgtttcagatgagattttggatgctggacttttgggttaatgttgaaataagactttgggggagtattgggaaggcatgattggttttgaaatgtgaggacatgaggtttgtagaggcaaggagcagaatgatatggtttggctgtgtccccacccaaatctcaacttgaattgtatctcccagaattccagtgggttgtgggaggggcccagggggaggtaattgaatcatgggggctggtctttcccatgctattctcgtgatagtgaataagtctcacgagatctgatgggtttatcaggggtttccgcttttgcttcttcctcattttctcttgcccgccaccatgtaagaagtgccttttacctcccgccatgattctcaggggcctccccagccatgtggaactgtaagtccagttaaatctctttatcttcccaatctcgggtatgttttcatcagcagcatgaaaatgaactaatacactactcctgctaatttttagtttctattgggatggaatatctttttccatccccttattttcagcctgtgtgtatcttttataaagtttgtttcttgtaggtaacagatcatggattttgtttttttaatgcattaagccactctatgtcttttgattagaaagtttagttcatttacattccatgccattattgataagtaaggacttactcctgccactttgttagttgttttctggttcatttgtgatctcttctttctttccttcctatcttcctcttagtgaaggtgattttctctaggggtattttaaaatttatttctttttattttttatgcatcttttattatttttttaatttgggggttacattgaggcttgcaaataatattttataacctatttttttaaactggtaacactgattgcataaacaagcaaacaaactcataaaccagcaaagagaaaagtaataaaaactgtacactttcactctgtccccttgctttttaactttttgttgtttgtatttatatcttattatactgtctatgtcttgaaatgttgtattcttttaagttggttcatcttttagtcttcctattgaagatatgagtcgtttacacatgacaattacagggttataatattctgtcttttttgtgtatttactattactaatgagttttgtaccttcagatgattgcttattgctcattaatgtcatttctttcaatttgaagaactctcttttgcatttcttgtaggcaggtctgttgttgatgaaatccttcagcttttgtttttttctggggatgtctttatttttacttcttgtttgaagtttatttttgttgggtatagtattgtaggacaaaaaggtttttcatttagcagtttaaatatgtcagaccggctggacatagtggctcaggcctataatcccagcactttgggaggtcaagatgggaggattgcttgaggccagaagttcaagaccaacctgggcaacattagggagacccagtctctacaaaaataaaaataaaaaatcagctggatgtggtgacctgtgcctgtggttccagctatgctggaggttgagacaagaagatcacctgagcccaggacgttgaggcagtagtgagctgtaattgtgacagtgaactccagcctgggcaactgagatccccatctcaaaaaaaaaaaaaaaaaaaaaaagggaaaaataagtaagtaaataaatatgtcataccactctctcctagcctgtaaagtttgcactgagaagtctgctgccagacatattggagtatctttgtatgctatttgtttcctttctcttgctgcttttaggatcctttctttatctttgatctttgagggtttgattgttaaatgccttgaggtaatcttctttgtgttaaatctgtttggtattgtatgaccttcttgtacttgaatattggtatcttactctagatttgggaagtttcctgttattatccctttgaataaactttatactcctgtctctctctctaccgcctctttaaggtcagtaactcttagatttgctgttttgaggctattttccagatcttttaggtgtgtttcattcttttttattctttttcttttgtctcctctgtgtctttttaaatatactgtcttgaagctcactaattctttcttctgcttgatcaattctgctgttaagagactctgatgcatttcttcagtatgtcagttgcatttttcagctccagaatttgtttgattttttttttttagttatttcactctctctgttaaatttatctgataggattctgaattccttctgtgtattcttgaatttgtttgagtttcctcaaaatagcttttttttttttttttttttttttttttttgagacagggtttcactgtcattgctcaggttgaagtgcaatggtacaatctcggctcactgcaaactccacctcctaggctcaagtgatcctcctgcctcagccttccaagtagctgggactacaggcacatgccattgcacccagctaatttttgtaaagacgaggttttgccatgttgcccaggctggttttgaactccttagctcaactgatccacctgtcccttggcctcccaaactgctgggattacaggcataagccactgtgcctggctaaaaatagctattttgaattttctgtctctaaggttgtatatttctgtctctctggaattggtcactggtatcttattagatattggtgaggtcatgttttcttcgatggtcttgatgcttgtggatgttcattagtgtctgtgcattgaatggttagatgtttattgtagtcttcacagtctgggcttctttgtacctgtccttcttgggaaggctttccaagtatttgaggggaattgggcattgtgatctaagtctttggtcactgcagctgtatctgcattagggggcaccctaagcccagtaatgttgtggctcctgcagacttgtagaggttactgccttggtggtcttgggtcagatctgggagaattctctggattaccagggagagactcttgttctcttccctaactttctcccaaacaaatggagtctctttctctctgtgctgagctgcttggagccaggaggagtgacacagcacccctgtggccattaatactgggactggcctgggtcaggtctgaagccagcacagcactgggtcttgcccaaggtccacatggtgaccacttgcctgtctaccacctatgtttactcaaagcccaagggcactacaatcagcaggtggcaaatccagccaggcttatgtccttccttttagggcagccagttaccctagctctgggcagatccagagacgctatcagggcctggcgttgagaaccttaggaatcttcctgtcattctattctacagcagctgagctcacacccaaaccaaaagacaaactccttctcattcttctctcccgtttcctcaagcagaggaatctctccccatggccaccgctgccccaggcctgcagcaagtactgcaaggctgttgctgatattcactcaaggtccaagggctctttggtcagcttgtggtcaatgctgataggcctgggtatctcccttcagggcaacgggctcccctctggcccagagtgcgtccagaaataccatccaggagccaaggcctagaatcagggacctcaagagcacacttggtgttctaccccactgtggttgagcttgtaccctgcctgtaagacagagtcccctttactcttccctctcttttcctcaagcagaaagagtctctccctgtagccaccacagctgggaatatactgggtccctcctgaggccagcatggctctgagtctcacccaatgcccacagtgagtactgcctggctaccactgttgattatacagagcccaagggctctttggtcagcaggtgatgactcctgccaggactggatccttcccttcaaatgtgctggttgcattttggtccaaggtgtgtctagaaatgtcatccataagctaggtcctggaatgggggcctcaggactctggtcccttgttctactctggctgagctggtatccaagttgcaagacaaagtcctttttactcttctgtctcttcctgggctgtgaacaacactgcctggctttgcagtaagggtggcaaaaatgcactccctggccacccagctggtgtctcaataggtcatgtgcacctaagtctactgggctagtggagtggcaataacacacgatataaggtaggagttgcattgtgtctgagaagatgtggagaggactgtgaacctacttttgtgcaacactgaaaagtatatgcttcctttcagttaattgacatgagtctttgaagaatagactcacattctgagtctgtgagtgagtattttgtcattctacacccttacttagcaagctaaagtcctgaaaaatatgattcctgcattttcttgatttccagaataatatagcgtattccttaaaagaaagtggtttcatgaaaggtgttactttcaaaaaattaatcttcttttccttttttaaaaaataggattaaaagagtaaaattaatatctaacaaagggactgaaactgacaatgacccaagttgtgtccatcctatcattaagaggagacaatgtcgaccagagattagaatgtggcaaacaagagagaaagcaaaattttcagatggagaaaagtgccgtagggtaagatttagatggatttaacaaggggtttttttccccatgtaacattttcctattaagattctgttagagatataaaataggtactagtaggtttataaatttgtcctaacaagtaaaaccacaggatatgaaaagaagataccacatgaagactggaacttagtcttaaaatttatagtactggacttgttattaattttgcgagttctgtaatcctagcactttgggaggccgagacaggcggatcacgaggtcaggagatcgagatcatcttggctaacacggtgaaaccccgtttctactaaaaatacaaaaaattagccgggcgtgttggcgggcgcctgtagtcccagctacttgggaggctgaggcaggagaatggcatggcatgaacctgggaggcggagcttgcagtgagccgagatcgcgccactgcactccaacctgggagacacagcgagactccgtctcaaaaaaaaaaaaaaaaaattttgtgagttatccagccttagcagtaggctggtagatttaataaacagattagtgaagagggtgctgggtcatattccagagaagcagtgatagtatagtaagagtttgggaaattattttgtaggtttaagtagacatggtctgctctatgtctaaaactagctacacacttttatagtcttaaactgttttcttattggttagattgtggcatttagtctaagaattattgagccgttactataaccaggcattgttctgagtactttacgtatactaacttatctcatttattttcaacaaacctgtgaaatagatgcttttattataatttctttttagatgagggaactcagctccaaacagatttagtaaattgctcaaggttatgtatctagtaagtagaagagctgtgattcaggcttagagtttgacttgagtcttggtttttgaatactacataacactgcctcttcatttaggatatttagtttcaactaaatatttttcttaattgagattaagtaatatatggatttgttcagttttgggttagtttacttttgctgcttggtagtttttgtatgatttttttttgtttttacacatgcagcttattagaatattttgggctgtcccctgtgaaggtattgctgttctctttgtaggaggcttttaggcgtttgggtaatggggtgtctgatgacctgtcaagtgaagaagatggtgaagcacggacacagatgatattattgcgtaggagtgtggaaggggcctcaagtgacaatggttgtgaagttaagaatagaaaatcaatactttcaaggcacctaaactctcaggtaatttctattttagtttatgaaagtataggactgaatcattgaagttagtaacaaagcatttaacatattttcctattgcttgttggtttgatttttggcaggtaaagaaaaccactacaaggtggtgtcatattgtgcgggattcagatagtctggctgaatcagaatttgaatcagcagccttcagccaggtaaagtatccctttgagaaatcaaggtatatttttgagggtaataactttatccattcctttttttattggttgccctaaagtagcatttacattaatatttgccagcccttccctgtctccaattacccatctccttatctagcagcttttaatgactacacacctagaaagaatattttcctacattgaccctaagcttaaaagtatcacagatgatgcccagcaggaggttacttaatccctaaataatgagattattaaatattcacttggcatatgaagtttatttttaaacatcataaattggattgatgctgatgaagacagatttttgagaaaggagttctgaaagatgggagtagtaaatctcatcatgagagctaaagggcatattatattatttggaaaattgtaactcagaggtgagcagagtagatggtggtggtgtggttttttcttttattttgattaataaggcaattgtggtcatggaataactttcatatttatgttggtacttttctttgactgattatcctttaacgttttggagctgaatcctgttcacgagtaggtctgtagtcaagttcacaatatttagagttggggtcactttgtgtgtgtcaaaaagctcagctaagccaattgagtgggtcatcttggtgtgcttacaggaatcactcccctcccagaacaccttagttgatcagttccataacatggcaatagcttcttagagggagtactgcttgctagagacatcagagtttaacatttaaatattaaaatctattattggctggacatggtggctcatgcctgtaatctcagcactttgagaggttgaggttgttggatagcttgagaccaggagtcggagaccagcctgggcaacaaaatgagaccacatctttacaaaaaaaaaaaaaaaatatatatatatatatatatccgggtgtgatggtatgcacctgtagtgccagctactcaggaggctgaggcaggaggatcatttgagcccgagtttgaggttgcagtgggctatgatcatgccactgcactccagcctgggtgacagagcgcgaccctgtatcaaaaaataaaaaagcattattgttacgtgaagccctgtgaaaaaatgaattcatggtgattgacttctgaaggctttcaagccattgctgtagataagttgttttaattttatttcacatgtaattatttttaaagatgaataacattttttgctttttgttttcctttaaagggctctagatcgggtgtgagtggtggctctcgaagcctcaacatgtcaagaagagactcagaaagcacccgccatgactcggagactgaggacatgttatgggacgacctgctacatggcccagagtgccggtcatctgtcaccagtgacagtgagggggcccatgtgaatacccttcactcagggaccaaacgtgaccccaaagaggatgtttttcagcaggtctgtgcagacatgataagaatagctagtatttattgtgttcttactgtgtgtcaggcactctgtcatctcatttaactttacaatcatcctgtagggtagatactattattatccccagtttagaggtgaggaaactgagcatagtctataagtgaagatgttgggattagaactcagggagaagtaatctagagttgccctaacctaaatttttctgtatattactttttcttattattttccttagaatggtcctttatgtgtattttatattttatatgagtagagtttgcatatagagaatataccttatattttcatgaacatcacagtgttacatatgaattactaggaaatggtattgcttgctttttgaacaatgcataaaataaataatgcttttaatttcaggttttatattaatatcataaagtcagatagccattagaaggtatttcaaccttccaaccaatgtagagattcattctacatctgtgtaaattttttaccatctgttatgtggtgataatagttcttacttcttaggaatagtgtgaaatagctaatgagataatataaagtacatagcataatacctggcaagagtaaatacccaataaatgttagcattattatttatatctccatcagatgatcaattggcctcttaaatacttctggagctggaatgcttgttatttaatgatacagcttattccacttctggatagattgaatgatgaagaaatagttcacttatcaacctttcagttgcttaatgtcaatgattgttatgattcttaggtttttgttctttaggctaaatatttccacattgtcttgcaaatagtggatgatggatatatatttgtttaattgtcaaatattcttgattcaaaaataccattgatttaggttatacattttcatttaaaaaatcgcttcattaaatgtatataatttttaaaaaatgaacaagaaacagtgtaaattttctcattaaagttttcttttttgggacagagctcactctgttgcccaggctggagtgcagtggtgcaatcatgactcacggcagccttaacctctccagctcaagtgatcctcccacctcagcctcctgattagccaccatgcttggctaatttttaaattttttgtagagacagggtcgcactatgttgcttaggctggtcttaactcctgggttcaaacagtcctcccaccttagcctcccaaagtgttgggattacaggggtgagtcaccatacctggctctcattaaaattttatgctactttttctgattttgcagtgaggctaaatattttttgcattcagtctgaagattcatctaaattacattagttttcagtagttatgcatagtatcacgatgatgttgatctccgtagcactcccctcctttgagatttgcagtataattttaagacatatataagaataattgagtgtggtaaactcaccatgtcaaatgcaataaatcattttccaatcctgttcacgtagcctattcttttattccctgtatttcttaataccacactacccacccaagtcaaaaagcttgaagtcattcttgaccccatttttttttttagatggagtcttactctgtcacccaggctggagtacactggcacaattttagctcattgcaacctccgccttccaggctcaagtgattctcctgcctcagcctcctgagtagctaggattacaggtgcctgccgcctgccaccacacctggctaatttttgtatttttagtagagatggggtttcgctgtgttggccaggctggtctcgaactcctgacctcaagtgatccactcacctcggcctccgaaagtactgggactacaggcgtgagccaccgcgcccagctggccccattctttccacccttagtcgcttatgttcttttgattcagctgtctaaatacctgcatctctctgtttctggtcaccctgcttggtgcaggccatcattttatctcaactggatcattacagtagcttctgtagggttgcctctgttcctttcattttccttgctacagccagagtgataattctaaaatacaaatctgataatgccacttcctttaaaatccttttttcttctttctggattgcttgcttctgttcctttatttgttctaatacagtctcatctctgaccattccctccctcctcctcacatggtgaacttcgactcaactaaccttctttgtttctgatgtgtaccaggcctcatgtgcctcttgggcccttatgcatacaggtttctttgcctgggacataattttctctaatgccaattcttttggttcattcctttttatttccaggcaggtcttggcttgagtgatgcttccttcaggaagcctttcttatatactcctaaagcactcttgcctttccttaccatgctgtatagtaacttccttcagaagtctataagctccttgatagcaaggacatctatcttgttctccattttatccacatgcatgatacatagtaggtgcttaatatgaattgtataagtcagtgaatcaatcaagtcagtgattcaaatcaataaatacttgttggcattatgctaagcatggtggtagaagagaaaaaatatgccagatggtccttttctagaagattatcttttagtttgggaacaagataattatataggaaacaaatagaggacaacataaaagcaccatataataagatgttaatttgtctgatacagactgtagaagtttttcatttcagagaagggcaaagttagtaagactgaggctgtcagagaggaccatgttggtgaaatgggacttgagctagtatttaaagaataagacatgatatggcagaggaggagagggagctgttttcattgtgactgtctccacttgagcttttctaagcctcactaattttgtgtcctggttagaccagaaacagacttaactcctcagtcattcatgtgatttataaggccttttagtatctctcttcctttacttcctattactcccagtgtaatctcgtagctctagaaattctttcttaatagcccatgactacactaagcttatcctcacttccatacctttagagagggaagcaaccttggagatcatggactatctctcctcataacagaagacatttagtctctctctagatgagagaatggcttagtaaggaaaaatggacctagcgagccatggtggtatgtgcctatggtccttgctacacagaaggctgtatagagggaggcagatgggaggattgcttgggcccaggagtttgagaccagcctgggcaacatagtgataccctgtctcaaaaaaaaaaaaaaaaaaaaaaaagaaagaaagaaaggaccagcattatagaggtggttattagagtgttggcaaatgaatggagcctgggaaagaaaaactaatggaggcaagaaggcatggatagaaacaattttatatttttcttctcagaatcatttattctggcttcagaattcaagtccttcctctgatcgagttagtgcaataatctgggaggggaatgagtgcaaaaagatggatatgtctgtgttggaaataagtggcatcatcatgagcagggtaagactgaatatgttttcagatttttcaaaaaatatacgaagtgatcaggagctattttataagaatctcttagtgattaaaacagtatgactctgcttttgaagcacatatatatcatattatatataataacattattaacatatatatgtaattttgtagtcagagtctttacatggtagtatatacattatttgttatacctggtctctattaacataatcaactgttcaggtatgctctacagatattccttatctcattgaatcccaatttttaataagatttgaaagtcataaatctgtatgtcatttgtatttatacttttagaatgtgtttttaatagtctaaatagtgtttgataaatactgctttgtaactccatttagctaacacaataatggtggaaattttaaattaattcacaggtcaatgcctatcagcaaggagtaggttatcagatgctgggaaatgttgtcactattggattagcattttttccattcttacatcgacttttccgtgagaagagccttgaccaactaaagtccatttcagctgaggagatcttgactctcttttgtggggcaccacctgttacacctattattgttttgtcgataattaatttttttgaaagattgtgtcttacttggatgttttttttcatgatgtgtgtggcagagagaacatataaacaggtcagtggagaaataaggaaaattttttacctgtttttgtatatgatattccattgagttgcttttgttctcttgatttggtctctcttcaagttgatgtgggcaataaaggattgataagtggacttttgatatttgtggatttattgtttgtgttattgactatttacatattacacgttgtaatctgaaattttgccaggcctcatgtgtagaataagtggcttagccagtgagtgagcctagccgactgcttagcatctgcacctcagtgtcccttttttgttttttatccatagaataaaataattatctacatgtgataatgtttttgtgaaaaatggccaagtgagaaataaatttattgaaatttgataaaaattatggatggagggtttaaaatattggtgatatgcagaagaagtgtgatttattttattttattttttgagaccgggtgttgttctattgcccaggttggagtgtagtggtgtgatcacggctcactccagccttgacctcctgaggatcaagcagtccttccagctcagcctccccagtagctgggactacaggcctgcgccaccacacccgactaattttttgtatttttgtagaggtgaggtcttactttgttgcccagtcttgtctcgaactccagggctcaagttatccgcccgtctttcctcccaaagtgctgggattacagggcgtgagccaccatgcccagccccagaaatgtgattttgaatggaaatttaatttgagaataagccagaatcatgtataaacatttgagtttgtgaagtagtggatccataaatgccaaccattctttgggggtctccaaagaatattccttgcaaatgttgagtgtaccacattgtgaagaagtatgttactatgtaatgtgctttggaaacaacagggtaacgagctattaatgaaaattttcactgcccatcttactgaacactgattagaacttcattctttttaatatttttgtattctgggaatatcgttggcaattatatgaatacacagacacatacatacatttcactgtgattttttttaaatctcttctagagatttttatttgcaaaactcttcagccatattacttctgccaggaaagctaggaaatatgaaatacctcatttcagacttaagaaggtggagaatattaaaatatggttatcactgcgttcctatctaaaggtgagttttatttgattaacaatagagtatgtgcaagaatatgctcactgaagctcctggcagcagttactcagtagacagtgtagttctgggtgtcaggcagattatagcagcagctgacagacttgctggacagcaagttggatgtcatctctctgcaaagctggtaggggtaggtaaagaagagcttagaaagggaaaagaaaatctaaatttcctaggggcaaagtgacaattaaatagtttatatttttctggcttttttgggaaatactccagccgaaagtatgtcaatgaatcagtcacccttaatttggaaatgcatggatttcagtacttaaagttgatgacgtccaaaatatgttaaaatcctatctcagaaacttcttataaacattattttcacacgaatgtagtacaattcagagtgttaataatgtgagggcggttgctgtctgccagtaactaaaacattaacacatgtgtctcactccacagagacgggggccacagcgttcagttgatgtggttgtatcctcggttttcctactgacactttcgattgctttcatttgttgtgctcaggtaaaagtttcacatctgctttaaggaaaaatgaaaattctattatagagttcactttctgttttagacttaggtcactgtccttaagtatgtatttttaatgcatctacattttttactattttggatgtttggtaatttttctaacttttcaaaatgggaatacaagtaattctgaagtcctttcaaactgtaagatcgctctaattttagttggtaattattaattgataataaaactatcatatggttgcaaaataactgattttctgactacattattccttctgtatttattagttatcactccaaggtagatctttcatttctttccctcttatttattcattcatttatttattatactgtggaatcatgtattctcatttttatacagtgggttaaaatctgttactataggctgggcatagcagcttaacacctgtaatcccagcactttgggaggctaatgtgggaggattgtgtgaggccaggagttgaagaccaacctgggcaacataatgaggacccatctccatgaaaaaaaaagaaaaaaacaacaaaaaaaacctgttactatatttgctttgctgcctacattgtcctaaatttggccagtgggagcccctagaaaccccctcctgtacccttttgacagggtctgctttttgtaaagcacttccgtgctttctgcattaaaagaagttacaggtttatcttatattttttgaattttattgaattttaatgtaattctactgtggtcaaagcatactctgaatattttcagtcctttgaaatatgtagaggtttactttgttatccagcatacattcagttttattaaattttccattagcacattgacaagatttgtattctgtcattgttgagagcagtgtcctttatgtgtcaaattacctacatccttactgaattttttggtctgcttattctgtcagccattggtggaggtgtgtttaagtctgattgtggatttgtctgtgtttcctcttctgtcagtttttgctttatgtgtaactgggtacatccagatttagctttgttatccatctttttgggcagttgacttttatgtcctttatagtgatttatttattttttctgaatccaggatccaattcagaattacatattgcatgtaattgtcatgtctctttagtctcctttaatctggaaaaatgtcaggctttgcctttcatgaccctacaaaatgtctctatttgtaatgtttcttattgatttgatgttaatttcattgcaccagctgtcttgattcatttctacatgttatatctttgtctacctgtttttattcttttgttctcatattttaggtgtgtctctcataatcagcatttcctcttatggttgcttggtgtttgttcattcgttcttcttcttccttttttttctggtagccgggactacaagcacatgccacctagcctggctaatttttaaatttttcatagaagtggagtctggctttgttccccaggctggcctcgaactcctggcttcaagggatcctcctgcttcggcctccaagagtgctgggattacaggcatgagacactgtgcccagttggttgcttttttttttaatccatcctcacagtcttagattttggagtgtctggcccatttaaacttaatgttattactgtaaccacaaatatatttggttcttactttttctacctgctaattttcctttttcattcctcttgtcatctttttattaaccaaatatttttaaatattccacctaatcctattaacttgttatatgttcttttgttgtaagtagtaaagagattacaacatgcatgcttaattttttatagtctaataaactgattaatttatcactctcttgataatgctaggcccttagaacagtttatcccatttacctcttcaccttttgtattattgtccttcaccttaattttacatatattttaaaaccgcaagatgtaattattattgttttgtgtaattaatcatatttactcacatatttaccttttccattgctttttatttcctgaatttctgtgtttctctctgggattattttccttctacctgagtaactcctttagtatttattttagtgccagtctgctggtgatgaattccctcagtttttgcttgtttgaaaatatattttatcactttcacttctgaatgattttttttttttttttttttttttttttttttaccaggaattgaattccaggttgccagttatttcctttcagcacttttaggattctattgctttctgatttccacattttatcttgagaagtctgctgctagggtgccatgacaagccaaagctaatatgagtcaaactcagtggggaggcagaaaacaaaggtcttgtaaggcaatggagctggctaagaggagtggagatgggagcctacgtagccctgggggaagcgagatggagagggcagctgcttggtgacttcctgtttttcacaaggtttctgtgagcattatctgtatgtttttcagtaaattccatcttactttgggcttgagtaaatttctttacttttaaatcaacaaatttaaaaacaaaaacaaaaaccttttaccggaaaatttgacacataataggcactcaataaatggtagttgctgctgctattgttatttggagcctaaaacagaataaagaactgatccttaggattttctagtcataccagtggaatgagccacatgttttagggagctcacttgacataaagcaaagttattactttgaataatggttgccatatagttgtgagtggacacactgatagttaaagtagctgcaaatgcatttgtcttattttatttgtggtattttccttctttgttacttctagacccttgctaaaggagaaaatctagaaaacttagagaaatatatagtgattaaataaataggtaatagttaatgagtattaaagctcttctgctttcagtattaaaatattggatttttggaaatgttcttaaattgacagagtaaaagagtaattacatgattttaaggtaaatgaaaaacttaacttttttttgatcctttgtataggttctccaaggacataaaactttcctgaatgatgcttataactgggagtttttgatctgggaaacagctttactactttttttattgcgtctggcctcactggggtctgaaaccaataagaaatacagcaatgtttcaatattacttacagaacaggtattgatcagtcctgtcaattgggtttagtggttaggggtagcgtaatacgctgtaaggttcctgcagaggattcagggtttaatcactgtctagctgtcactttctagctacaggacctcacaagtcagtttgctgctctgtagttgcttatccctaataaaatggatgtaatatctcctcctgctctgtgagaattaagatctaatggattgaaaagactttgtatactatggagagatttttattggtggtaatggagcatgcttttaatctcatattctatgtcaagtattagatctttagagtacttgtcatttagcatgtataataagcttcttgaattcttctgtattagacatagaatacattattcagtgtttggaagatacttggttttcagtatgtgaatagacactaagattgagaaatatctcttgtaaatacagagtagtataaagtttttttaattttgtttttaatttcaagtttttccataaactttgaataaaaacatttatcattcgtttctgttttttttttgtcttagaatcgtaatggagaattcttcctacaaggcaaaatataaggaattagtaaagtaaaaggagctatcttcttctgttccataaatgtttaatgaggatgttagattatctagggggatagtgagatgaataagatagaggttttgaactcaaggtgcttacgtgctaattatgttatgttgcaagtaatattaaaatttttcattgttttgatatttaaattgcttcatcattaatttttcatcactaaatagtttttctttgccagagggagactgatcaggaatgggggctagagcacatgacatatgttctctgtagcgatagctattggaatttcaaaatttattttacttgaaaacatgacctttgaaatatgccagattttatgcagtatatatatttttttccaagaaatttaccttaatttctattccttcccttagattaatttatatcttaagatggaaaaaaagccaaataagaaagaacagcttactctagtaaacaatgtattaaagctgtccaccaagttgttgaaagtaagtcataggctatgatacacttttactatcatttgagttaaatcagtcttttctctaagaaaacattaaatggcagatgataccttgggttgggaggggtcctggaagtggactcttccacagtggcatcaggggtaggggtcacagtggtggttaggaccagagctgaggtcacagagctcctggaggcaagattaaggacaaagagtggctccccatcaccaagttgggccatctggtcaaggacatgaagatcaagtccctggaggagatctgcctcttctctgtgcatcaaggaccaggttcaaggcatttgtcaccattgaggactacaacggctatgttggtctgggtgttagtgctccaaggaggtagccagcaccatccatggggctataatcatggtcaagctctttatcctccctgtgtgaggagactactgggggaacaagattagcaagcctcacactcacactacctacccttgcaaggtgactggcagcctgcatctctgtgctggtggcctcatccctgcctccaggggcgttggtactgtcttggcccctgtgcccaggaacctgctgctgatggtggttacccaccactgctgcactttgactggggactgcgctgctaccctggccaattttgccaagggcacctttgatgccatctccaagacctacagctatttcacccccaacctctggtaagagacatgttcaccaagtctccctatcaggaatttagtgaccatggcctaaagacccataccagactctccatgtagaggacccaagctctagctatggccaccatgtggtggttttataccagaaaaataaagtgagttaacctgttttaaatacattaattaatgttttacttctcagaacccagtaagagatagatgctaggctgtgtagattcaaaatgctgacctgatggttttgggttaataactactgtgaaaaaatttccaattttgttacccaggttctgatgattgctgatgtctgtcatattttatatatgtgtgtatgtgtgtgtgtgtgtgtgtgtgtgtgtgtgtgtgtatatatataaaactacaaatgacatattgctcaaatccacctaaaaaaatcttagttagtagaaaagtaggtgagaacacgttatggattttttgaaggtagctctttgaatattaaggaaagacagccttaagcattcatctatacccaagacaaaacacagcaagaagtcactgagtagctatgagaaaacatgtatctcatttcaattctttgatgttttttgtaggagctggacacaccatttagactctatggactgacaatgaatcccttaatctacaatatcacaagagtagttatcctttctgctgtctcaggtgttataagtgatcttctaggatttaatataagagtaagtatcaccaccactctgtagcatcctagtcttaaaaattactatgtacagaaatctgtgttcttcacacgtgtgtgtgtgtgtgtgtgtgtgtgtgtgtttctagcatgcaaataactcttgaggtaaagaaataggcattttgattggtggtccacaggcttttcagcttcagttttctcattttacacaaatataacagacagtgctcttgaatggaacaaaaaaaatcaagtttgaatttcatatcagtttaatagcctgagctgggtaatggtcttactctgatcctggggaatgtacagatgtagaatgaatgaaaaccagtacatgaactgcattgtattatttttgatcctggaagttttaaatgttttttctctatgatgttctatggttgctattgccagacttgatacattttcttcttttataaaggattcttagtttatagtcatgtaagtgtacctataaatcccacctggttttcctagaactaacttattttggtgattttgttctcttagctgtggaaaattaaatcataagctgagttaaatgcctggactctcccctggctggtatcaaaacttacctatcaaggaaagtgatgactgcagaaaccagtgagatacccacctgcttgttcacatgcacaggtgctctcagctctgccaaagcgaatgaatggtgtttccggaggagcaagtccttttccaactgggtgtgcatgctaaaaacctgtattttcatgcttttcaaacaacatgaatagtcagctgactaaagactgtgtgtgttgtggtaacacaaagacaattttgtaagtttgcgcttcagtactgtgacagttatgtttactggacatagtcttttgggcaactatgatagatgcccaaagcatgaagcaaatatcttttattggaaatatgcaaattcaatacttttccattatagtctatagaactggagatttcatttctctatcaaagagagatcaagcgaactattttaggttaaatccgaataaaagaactttactggagactttcagtttctaggttttctttgttgttgaaggaagaaaattaacttttaaactgtgagtttctgttaaactgtggagaaatgttttgttcgtttacgattttgggttaataactgtatagttgttggcaaacgatgcatgcatacaatatgccatgtaattcagcatgaaaaatttaagtatatgcctactcatccatttccatcatacaacatggtttccacgttctatgtggaagccatggaagcattgtttccatatagatcatctgagttgtggttcctaacacagtgctatgtgtcctatcacaagcatcattgatagtttatcagttgtgcaacttaatgtattaaaccctccgtacattttcaggtcctcagtgtctataatcggccatgccatgcctctgatgatacaggttctgtaatgcagcatcctgttatacacatgcatatacatatgttaatgaaagctctaatagtctacttataattcttgctcattaagttacctgctttgaagaatctctcttttttttttttttttttttttttgaggcagagtctcactttgttgcccaggctagagtgcagtggcaccatcttggctcactgcaacctctgcctcctgggttcaagtgattctcctgcctcagcctcccgagtagctgggattacaggtgcccgccaccacacctggctaatttgcaagaatctctttgaggcaaattgaaagcttgaacattttaatgataaggttttgtgaagttttaaataaacataatttagaaacttggttattacatgtaaagcatgtattcatttaaaatcagaggatcagttgcacattttctaataagcaggaatatttgtgaggtttagaggtggatctctgaagagtccagggattgaggtcagacctttctgggttcaaatctttggccctgccacatattagctctttgtatatcaattttctcacttgttaacccatttatggggataataactacaagtggggataataactacataataaggttgttaagattaaatgaggttgtcatgtaaggtacttgcacagtgtaaagtatttagtactcagcaaatctacaataaatgtgttactactatttaaagtccttaaaaaaaatctcactgataattcctaactgtgaagatagaaacatggaaagcaaggttgctgaactagaagttgattaccaaaaatatgcagccttttatacatgagttataattttttaaatggcaaaactccattatagtgataaacctttagaaggcagtgttctgtagaagcacttcagcatctcaacagatggttcatagaaaccatgcttttactgtttccatagggaacagtagcagtgatctcaaatccaaaattgagctcactgcagatttcaaatgaaaactgatgccttcatctttttcttctacaaaaatgctgttctatttttatgtacaacttttacacagttaattcttagtttaaaagcagtgtttagagtatattaattcaattgtgtggattgcttcagttgtggttttgatggtgtatattggtttaaattatttttcaggtgggtaaaattatgtgtaagtatagttaatcatatcagaaacttaggaatgattcttgactcatttttcttcctcatacctcacatccaatcaatcactgagtctttgaataattatcttctagatatctttctcatcagtccactcttcttcctccccactgccactgctcttatttaagtcagcatcctttgttttttgagcaagtttctgctatctctgctcttatgtatgcttgattcctctttcccccacacctaacccactcatctcaaaaatgtaatatgtcttttctgaaatgtaagtctcatcatttagaatccatcagtggcttactagcactttgaagataaaaatccaaaatccttttagcaaggtgtgtaggcct

SEQ ID NO: 16263 - DNA, 29291 bp, Human
agaattttggcattctattctactgtgaaactacatttgctttctaagagactaggtcatgacagctcaagaatgacccgacatttctcttcatccaaaataagcaggcatattgctcaatgggtaccctatgaccacctgaataaaaccaatatcttttcataacctcatcctgaaacattctccaagcctgctggtgggtccaaagctggtctgtcttatccatggacccattctctggaattcaagaggtgctgcaaaaatgctgcctcaaatagctctgcctgtggccctatatcccctatttgagattagttcacttaggtgcaaacattagaggctgatattagagtgtgttaccttgtagagatgatgttctttaactcagtgcaatcatcagatttaaaaggtctccaagaaggtcattatttcaaacttgagaatctctcatgagaagctctactgttctttctatctactgccagcatcttttaagtattaactcacttacttctcattacagtgtgggaggtattatgaggaaactgaggcacagagaatttaagtaacatgtggatgttagtgagtgagtggctgcagtttggagcttgagcaccatgttccagtgtgtgctcatcaccaggcttccttctggaagggagagacagagtcggagtctggaaaacagcaagggagggtctggatcaggggactgtgagcaggccaggtgttgtgagagctgaccgaggacatggcctagaggctgattatggagattgtgaaaattgctatggaaaagaaatttccagaacccagattttggctacttttgaaagcatttttgaggtaatactgtcctctagtggctagatagcaggtagggattaccctccaaataaatagccaatgagccttgagtggagatggtatgacaagtcagtggtaaattcatcattttgctctctaactacaggttctaaaggaaaggcaaaccccactgctatggtcatcggtacagctcaggatttcggcctcctctgctccgtgtgttggctacaggctaggttcaaatcccaattctgctctttactgctgaaaggctttgggcatgttcgttaatctcattttctcttctgaaaaagagacaatcttgaaaagattgaccttccgtgaagatcaaatgaagtaatgcgtgtagtgtgtctggcacgtcgtaagcgcatcacacacgtgagctgtggcaatactaaggagcagtggcaagagctgggggaggagtggagacgaacagacctggacaaattagtgacctttctgggacccctacagaactcttctggagaaattaattctatttttccatgtacttttaagtttgcttttcctagcatttcttctacattcctgaataattttccactcaaaaatttcactggttctccctgactcccatattaatctagacataattacttccccagaacagttctgtgggcagggagggctctacactatgcaccctccaaaatccccaaagctcggaccgtcctggcctgggtccccactgctgtcctgcccatgggctcccaggctgtgcttgctcttctcccaccccaaccccatcaccacaaaaagcccctcctccaacccggggacttttgtaatttcctacctgaaatcatccactccctacctctaacaatctgtgatgagcagaggacaacatcaagtttgaatttagaggtagggaatgggtgatttcaggtaggaaattacaacttcactttgaagtttaattttgtaataaacttcacttaattttgaagtaaatttgcaaagtcagcaaaattctttcaaagtcaaccttgctctggcctagttgcttatttactgctaagctggatgttttcattaaaagattaactttgagacttcagcctcttctttagcctgaactgtgggtagtgatgtggtgtgtttcctaacacctccggcagtgagccaggctttgagtggctgcgtctaaacacttctttccctgaggactggaagacattagaataaggtttgtcattgagtgtgttctgtgtgcttggaactgagaagggtgatgaagtgccagataggatgggaatggaagatatcgtggaagccaactatgagtttgcaaggcaaggaccttggcaaagatggtcctagggagacaggtgttagggaactcagagggcatgggcaaaggaagatttggtttcaaaaaggatacagacagagaaggttaagtctaggaagttgagtcttagaattgtatggtggaatattcgtgggtgtccataggaggaaaaatgggttaaaatgttttcacttgacagcgttctgaaaacctaaaaggtattgctattgccttcagggatatatttagtattctgaccactgcttcccggccacaagcaaaagaaaacagtgacatggctatgctcctaaaaaagtaaagaagttaatgtgtctcaaacaatgtagttcctttgagcaataagcttatttggaacaaatgggttacaaagtcccactaatgaagagcctctgattgtgttaagttgaatctacagatcaacctgcggagaactgccaagaacgctaatgaagacagggaggtactggtataaagatagataacagatcaatggaacagaataaagcgtccattagcaggaagcaaaatccgcaaacttttattcttaactactactatattctgcattttacaagatccttcaattctcacaagatccctatgagatagacagtaataacctaatttaaagatagatgagaattggagcttgtctagaatagattgagtggaacatcacttgtggtatatcatttgagaggtaatgggaatattgccaaattcccaggtaactctcccctcaaagggactcctgttgtactctaaatcgtatcagctatcaaatgatgagctatgaaagtctgtcttcttcgactgtaagcttcttgagagcagaaactgatgtgataaaggtccccccccatatctctagtgtttagcataatactttgatatattatgttaaatcaggctatgttatagtaaagaataaaccttaacaacttagtgagataacacataaatatttatttcttccttacacaatatcagctgatctccagggctacccttttccaaatggcgttttgggaatccaagtggcctttctcttacagctttgccttcttgaggatggaggatcgctgtagaggaggaaacaaagctggagggtcacataccagctcttcaatccttggcctagaattcacacctgctattcccactcccaggccattggccagaagaactagtcacagagccatgcctgtatttaagcaacagcgaaatgttaagcatgtggggagcagtatatgcctccgccaccctggctgagagtgtgtgtcaataaaccttcttggataaactaatgagtaaatctgacagagggtttaaattatactatgacagaaatactcaaatcctgaagcagctttccacttccagagcctcagatgaaatcacacatgtcatcaacaggaggaataatgaacatggagctgcctttattaacaatctagtctatacaaggcactgttctagaaatttcaaaggggccatactgcttagtcctcatggcagccctatgggatggatgttaatattctcctttaacaaataaattttgcacagaaccgtggtgagccagtagtagagctgagatttcagcctatgtttgccaagtgccaaagcttataatatagtctgtcttctctactccactgactccctcagtcattagttccttgggcacagttgatcggtggaaagcaatggccttcagaaacacagtctgggtagttgccgtagacagagaagccaggaggaaggcaaagagagaaaaaactgcactccatagctgggctcttccatccccaactgctctgccttttctcctctctctcctgctacaacccagtgattgccactgtgagatataggtacacctgcaagacctgaagtcactagtggacagagtagacgtcagagcctgttttggagctttgtgtgaattctgatgtctgttttgcacattctatccttgttgagcagatgaagaggcaggtgcagtgatctcacagtgtcacatagaactcctttcccaatggcctggattttgtgggaattgaccaagctcattttatgcaactctctgaccattcagaacagagacttaaatgtctcccccataccagtaacactccatactggctcaaagacattggaaacaagtcagaaggattccaggtcaggctttgccatttctgttgcattagcttggatactcacgtgaattatccgagctttaatgtttttatctataacatggggctcatacatacactctctgattgcccactggattgttgtaagcaccaaatggaataacgtatagaagagtgctctgtagactgttaagacagatttaaacataagaagttattttttagtgattggctgaataattaagattttttttaactttctgattgagttatgattttttgagggaagaaagcaaagttgcatatgtccatgacattttaatcctctaaggtccgtgccaactctgtcattccataaaccacacttggctgtgcccattttcttctttctatagtgcttaagagccaggccactggaatcgtgacacattactagatatgtaatattgaacaaagtattttaacctcttgaacttcaggtttctcacccgtgaaatggggatgataatatttgtgttgaacatttccacaaggattaaaacagtcatgcatgtaaagcaatttacacagtgcatggtacatcatggagtacttgaaaaatggttgcaatattattgtcgttattattattcatattaaggaaccatcatgctgcctccagggctctttgcataatcaaattattccactgtttgaaagaataagaaagtccttatctttcaaaacactatataaacatttggatcaatgtctcccagtatgccctaaactatgttcaacgctctatggacagcacacagtttacaatatggctgggttccaaaactctacttggagggcatttgtttgaaactcagaacagattttcccacaaaagaatgctattaaaatagcggttggattcccaggtgactgaaaatacccacttgatacacaaaatagcagaagatctggcatatttgcaatgcaaattactgtaaagcaatgttattgtattgctggtcattaaccaaaactgaaaactaagaaaactgtgtaataaatcatttttaaaaatttcttgtatatgcaactgatgaagaaaagtaggcttaattagaggaagagataattcagtggaaatgtaagtaagaaatgttaagatgcctttgagggtattttcaaaggtttttgaagttctttgctaggtctaatgcgacttcaaaattgtttcactttgttcttcttgacataagggactacatagcacaattatttttggtttgcaaatgaaaaaggaaatgagatgggagagattaggaaaagagaagaaggcgtgagaaagatttccctgagaaaggcactcaatagtttggagaaatcgagaaaggaggaagaggcacatctgtgtagtaaaacggatttcaattacctggtctgagaacaggaaaaacagctggtgtgacaggccgtacctcttgtaaaagggaatagtgacaagactggtcaagtagttatccactgaaaccataaggtggtgccacgggaccagaaaagttcttgaaaagaaagacctccaggctggggaggaggagcaaaggcaggcttgagcacccagctgtttgttgttggcaaatatgtctaaatattgtgctggttccctgttctatactttattgccatgaagtaaatgctgaactagaatgttcatatgacctcatctaaacagctccctgtgtttatgggcaaagaaagcacagaatatgagtacttgaaggacctcagctcagcttttaatttcaggtggcttcaaatctatcatggattaagctgaaatacacaaaaatgtatattttctcaaatgaggaaactgagacttggagcgaagacatgtagcctgccactgttcaaataagtgttagtagctatctctcttgaagcagcctgcctctcaggctgccacacacaccactccactgactggatgaagcaaaagtttattccgtattccaacttcaagtggagctccttttactggcatggctaagcagggtcagaaggagtagaggtgaaggtggaatgataaaatctagtgtagatgagttgagtctctagaaatcttgggtctgtgctgagaagctaattctcatgtaaggagaagctaattctaagttatattgccaggctatccagaagcaatttcaagagtcatatcgtatttcagaaagaaccctaaatgcagagacagaagacctgagttcatttattagctgtgctgccaaacttgtgcacatctctctgtctctctagggtccttcttggctccatcaagcaagttattctcatagtcttccaatcctcaataggcaggatgtgtgggaggcaggacaatggtaggtaattgcctaattaggtcacaataacttcagagtgagcatgtccttaacataaacatgccccaccacggcaaatctcaaaaactctttcaatccgtgacacacaaagctcctagagtaaagcaaagatatgagtcactccctatcatgactaaagaagccactctgaagaactcaagcatcatactcctcatggtagaacatgcttacaggttgagaagggaattttcattagtagaaacaaaaaaaggctaatgagagtggttgaggagtggcagcctaaaaaggagagattattatataaatcagaataaaacaaacaaaaaaagggccattatggttcagaaggctcctgcatccttgattcacaatgtgtgagagctcagggaagaagccagagctgattctgggctgacaggcaccaggaattaatccttgccagatctgaactggactggcttcttttcccctcactcccatacaaatgccatccttgattcctcagatcactgcaatgttagaaacactcagttccctttttactctgagggctgacctgctgttcctgggcatccaaattcttccccctgccctctcttccccatgctgggggctcatctgcctcagtcacaggagcattttccagtgccattgattcatgtcttccctgaacccaacactgccatctgcacatggctctcctagtctccatcagctctgggacccttctcctctcccatcacctctttcattctcagggtctcctctagcttcagcctctcccctgacagtgctgttgttgacaatgccatggtgatggctataccctttgtatccactatccttgaggggaagactgattacagcattttcagccaactttgaacagtctaatctctcaaactaggcccgtaaaatgtagccttgatattatctgacattccattgggaaacttggcataagttcctaaagaactaggccagaggttctggaaggacaccatcctatagcaccaagcaagtgtaccttaaagtgagtcatcagaggctgacttttctcccccattgtatctccacagcctaccctgcaattttcacgctgagatttcccacagactgtgtagggggtttccatacaaatataagctgtgataaccctgagttcctaaagcaacaccaacatgaatcatatgaatcatacaaaatcttcaaaggaagacaactttttatctgtctggtgttaaatcagattgcaatattaaagaaaaccacgtcttccttgaaaagcctgccagcttctctacttccttcctccttccctcagtcaggagagtttgaacttcagattgttagcaacaggtactcctgaatgtccttgccctcagatttcctcctctttgtcactggtctgctaattttacctcactgttttatcagacaaaaagcctaaagaggttcaaggagctaaaatgagctaaaatttctagaacaatagctggcaattggtcaatttgctattttattcttttctcctctgtctcttcttcttgagcagtaggaataaaaaaggaaaaaagaaaaaacattgaaatggagacaaaataaaatgggaatacaagaagacaaaataaagtgggaatacaagaaaaccattagattacttgaatcttccctttaatttctggtggcttcaaggctggtagggatcaaattgaaagaaagtatatacaaatatattgtgctaagttcttcacttccaaatttaggaaaagctttgaacaaggaaggtatccttttctttaattataaaccttatattaaacctctaaccaaaataatagactactaagatttacatatattatattaaaaatatataattgtatttttcaacctacaaaattatctcgagttcaatatggcaagtcatttatgagaaccaactattgtgttctttacctgaaattgaaaatgagaatgtctatctttagaagctaccaggacacatgagttcagaaccatctctcataataacttactacctgattgtattagtccattttcatagtgctatgaagaaatacctgagactgggtaacttataaagaaaaaaaggtttaatggactcccagttccacatagctgaaggggcctcacaattatggcagaaggcaaaggaggagcaaaggcaagtcttacatggtggcaggcaagagagtgtgtgcaggggaactgccctttataagaccatcggatctcatgagactttttcactatcatgagaacagcatggtgaaacccgctcccccatgattcaattacctcccaccaggaccctcctatgacatgtggggattatgggagctaaaattcaagatgaggtttggttggggacacagccaaaccatatcactccactcctggcccctcacaaatctcatgtcctcacatttcaaaaccaatcatgccttcccaacagttcctcaaagtcataactaatttcagcattaactcaaaaattcacagtccaaagtctcatctgagacaaggcaagtcccttctacctatgagcctgtaaaatcaaaagcaagttagttacttcctagatacaatggggatacaggcattgggtaaataccgccattccaaatgggagaaattagacaaatcaaaggtgctacggccccatgcaagtctaaaatccagcagagcagtcaaatcttaaagctccaaaatgatctttttgactccatatctcacatccaggtcacactgatgcaagaggtgggttcccatggtcttgggcagctctgcctctgtggcttttcagggtacagcctctcttctggctgcttccacaggctaatgttgagtgtctgtggcttttccacgtgcacagtgcaagctgtcagtggatctaccattctggagtctggaggatgatggccctcttctcacagctccactaggcagtgccccagtggggactctgtgtgaaggctccaaccctacattttcctgctgcactgtcctagcagaggttctccattagggctctgcccctttaagcagatttctgcctggacatccaagtgtttctatacatcctctgaaatctaggcagaacttcccaaatctcagttcttatcttctgcacatccacatgcccaacaccatgtggaagctgccaagctttgaggcttgcaccctctgaagctacaatctgagctgtactttggccccttttagccatggctggaacacagggcaaccagtcctgagactgcacaaagcagcaaggccctggtgccctgcatcttaggcctacagtcctatgatgggagggtctgcagagaagatgtctgatatgccctggaatcattttccccattgtcttggcaattaacatttggctcctcgttacatatgcaaatttctgcagccagcttgaatttctcctcagaaaattggtttttcttttctatcatcacatcatcaggctgcaaattttccagacttttattatgctctgctccccttttaaaaataagtttcaattttaaaccatatatttttgaatacataaaactgaatgctgttaacagcccccaagtcacctcttgaatgctttgctgcttagaaatttcttctgccagatactctaaatcatctttctcaagttcaaagttccacagatctctaagggaggggcaaaatactgccagtctccttactaaaacatagcaagagtcaccttcattctagttgccaacaagttcctcatctccatctgagaccacctcagcctggacttcattgtccatattactatcaaaattttagtcaaagccattcaagatgtctctaggaagttccaaactttcccacatcttcctgtcttcttctaagccctccaaactgttccaacctctgcctattattcagttccaaagtcacttccacattttcgggtatctttatagcagcgtcccactaccaggtaccaatttactgtattagtccattttcatactgtaaaagaaatacttcagactagataatttataaagaaaaacaggcttaatggacttccagttccacatggttggggaggcctcacaatcatggtgaaaggtgaaggaggagcaaaggcatgttttaaatggcagcaggtaagagagcacatgcagggaactgccctttataaaaccatcagctcggccaggcatggtggctcatggctgtaatcccagcactttgggaggccaaggtgggtggatcacctgaggtcaggagtttgagaccagcctggccaacatggtgaaaccccgtttctactaaaaatacaaaaatgagctgggtgtggtggcacatgcctgtaattccagctactcaggaggctgaggcagaagaattgcttgaactggggagacagaagttacagtgagctgagatcatgctaagctttacatacattataaaaagaaaaaaatgcataattgtatttttaaacctagaaaattctcttaaatatagcaagcaatttatgagaaccaactattttgttctttacgttaaattgaaaatagagaatgtctatctttagaagctaccagaacacatgagtccagaaccaactgcactccagcctgggcgacagagtgagactccatctcaaaataaataaataaataaacccatcagatctcatgagactcattcactctcacaagaacagcactggaaaatccagccccatgattcaattacctcccaccaggcccctcccatgacatgtggggattataggagctataattcaagaagatatttgggtggggaaacagccaaaccatatcactgatctttcacaagttattttatttctgaggcctcagtctctttaaatgcaaagtaggaagactaataccttctctgtcttcttcacagggacactgagaaaaagctgtagatagaaaagagtctaaggaaaaattagaagaggtatcgaaatgagataaaatagtgtttgttatatataagatgctagggttgattctttatgtccaagcagctttcaaatcacataactgacactattctagacacatgactctgagtgagcatgagccatttcttctggattagacataatgtttgtggcatttatatgctagaattgtgtagaacagcctttctatgagtgtgtaatgtataggatatgtgtatttattgagatatcaggagttgaaacctggtggagaattctcatccaataatgaagataaatgacaggcaggggaatgttaaattcaagtaatgaacatttgtaagcagcaactcagtgccatgtactatcctaatgcctgggaatacaaagtgtgttgggggtcccaggtttggttcttcattaggaggaacaaatagtcgaggctatgctttattactgaaaggatgcaaagcaaacttagcaaagggaaaaatggctctggcagcaaaatctggaggaaaccaggggtaagcttccatgagtcctctgccagtggactcatgcgggatgcagttaattcccccagcaacaagatgtgatgacacatgtaaaatgttacctacctgagcaggtcagtagagattcaatgcccagagtttcatgttggaggctggtcatatggtcaccctctgcctagcccataccaaaattctagagtcccagaggagaagcaaatgttcatcataaaccacattgtttatacaaacagtttatacacagggaggcactcttatcagggaacactgggaaccctgttgaaatccaagttcccagacaccaaccaaggtccaatattgcaagcagatgtctggaagaataaaattcccaggcatcatatattagttcttttatgcttttatgcacacagagttgtaaataagcaactgtgatataattggtacttgcaatgattaattcatttgactaaggtttattaaccctttgaagggtggagtaagaatgagctaaattagatatggttgtagtaatttgtcagactcaactccatacctcaatgttctctcctcactcactggcagactactttttctataaaaggtgctatggctgggctccaaattactcctcgtagcctccatctagagcccaatgcacttcctgggggctctgtttcctgtctgtcatataatttcttcctgcttggcccttaagtacgtgctaaggctacttctctgtttgacttcaacagaatctggcttgacagatcctggcttgacttgaggtatcctcaagcaagttctgccccatccctgctccagccaagattcccagcacctcacatctcatctggcctctgtgtcccctttgtccattagaggaactaacccattcctggttgaagccctagttactgcggcctatcttcttcctttagataatgacttaaaagccattcagtttccacccaaaacctttggttaattttcacatggctgccaactgcctgggagttggctggagcttagaaacttcaggtttctctgtttttccttctggaatcctctcatgcaggagctctacatgctgtaactgaaagcaactagtgtcttcagcgtctctgctgctgtttctactgccctgtttctactggagagatttattcattacccccaagccctgtcctctttcctctttcagggtgttgtatcaaaagtaccaagctctgcgtttatagggctcaaattgaagatgggaataaatggagccaacatacattgtttctcaggtacccaaattagcaaaaataggaaaaaggtagatggtgacccttgagcctcctaataatattaagcaacatgttcagcgacccagccaagaattacaaagtaaactttgtcttgtcctttccccactctgtaatccacagctccagacaattcaaacattgagattcctgggaactaccagatagtagcatcagttcaccaagaaatgaagctggtgaggcagtgaaaatccagggcctagaaagctgggaatgccatgacgtgggcacattgaaagacaagaggcaggcatgatcagccttgaactttaggaagatcccaggaagctgatggaagacaagatgtggagtgaatgtgaaggcaagatacaaaaataagaattttttgtaataagcttttaagaagtggtggggcctcaactaggtctaaggtggtgtgtgtacagtggaggagaagatataagaaatactcagaaggccaaataatcaggatttgggaatgggaatgggaatgggagaatggaagggtggacgattactctctgccttctggcttagggatcactggctttagcaataactctgttaagataagaatacagggagaccaatgttgaatccaaacaatttcatactgcagcttccccttcatttccttttctgcatctgaagtgttctcactgggtttggtttggttttgttttctccttggaaggtccagaaatgtccttggtgtgtttgacagactttcaggcccatgcgcgagagcagctgtctaagtcaactcgggattttattgaaggtggagcagatgacagcatcacgcgggatgacaacattgcagcatttaaaaggtgtggtcttctgtagcctgtctattgttaggttaaggtgcactggtggagagcaacttggacagtagtagtcctggtttctgcctccaaaaaacacagatcactcaagacctaataatgtggatgattttgttgttgttttggtttgttagggcaggggagggagggctgatgggaagatggaaaaagagggaatttctgttatagccagcataagtgagtcattctccttcatctcagcaactttgcaacctgacaagatagaacaagagtcccagaatgaccagttccctaggcagggaggatgggcctgctgggaggcctagatctcctgagttcctaaactctggcttggagaagaaaatggaagacaggagagaacactcaggtttggagaaaatatggagatccaaggagtctcaaagataataagagattgagtcaggggagaagagttggtctgaaaaagtaggagatggagcatcggtcaaccaacagcagtccacaggcagaggctgacccgccacttatttttgtatggtccatgagctaacgatggtttttcatttttgaatggctgagggtggggagtcaaaagaagaataatttgtaatacataaaaattatatgaagttcaaattttggtgtccataaataaagttttattttaacacaaccatgctcagccatttactattgtttatggctgcttttgcacttcaagagcagtgttgaataactgtgacaaagattacatggcccacaaagcctcaaatatttactctctggccctttatagaaaaagcttgctgattcctgtgatacagaggtcaggagaaaactgaaaaatggtataaaagggagccctatattctgtattttcatacttagttagcactatacgaggcaccttacatcatttatttcagtctgtcttcacaaaactattaggaaatttggattattattcctatttcagatgaagtgactgaggctaccttactcaaatttgcacaattaagaattttcagaaaatttttctaagtttatgtgcaaaaataataatattgtataaacaatgaaaatcttagacacctgaggctaagtatgcatttatttaaaaagtgtgttttgcatatttattatttgtaaattctcctaccttcttctaaagcagtgtttaagtcaaatcttcaaactaactagcctctatcacaaaagcctcaatcactccctgggatttgttctcattcagtgaccttttcttactttctggagacttgggcctaacctgagaggaaaagagactggaacctcttcctacctattcttttctttttagtccttgttatgatgaaccaaaccatccaagtgctgcagtgtagtctgggaggcatgactcaaagacacagacttctgacagagcaaagcaggaatagtgtggacttggtatgcacaaagtggttcagagaaggttgggaaatggggaatgaggtgttggaagcggctttctggagataagtctcctcctggatcaacataggttactcagctctcagccaactgaacccaccaaggttccacaggaccctgtctggtttagacttgtatcaggaatcaggggggtccaccccagacaacgcctccctgctgcagaatcatctcaccaacagaagatctctttgttgtccggcacagaattcgcctccgtccgcggtacctgagagatgtgtctgaggtggacaccagaaccacaatccaaggggaggagatcagtgcccctatttgtatcgcacccacagggttccactgccttgtctggcctgatggggaaatgagcacagcaagaggtatgaaccatccccacctcgaggctcctttccgggaggaggtgtccctcagagcagtggcagaggctccaagattctctctagaagggccttaggaacataatctggttaacactaaggaaggcaggaaagggaatgcttaaagctacgtttgtgtaacctaagattgagaaaacattcattttccataataaagaatagttagagtgcaagggggtttacagatgaataagaaggtgctaaaatttaaccaagtcatccctcagaacaggggtgctggcccttctggctcacaccatctgtagggaaagggatgcttaacgcagccccaaggctagggccctctttggcccctgatgggccagggctagggctgaatggcagactctgaatttaggatgaggagagaatcacgacattaggtcctaacacaaggccctggaagctgctgttgcccaactattccattttccttctcttcaattgaccttgtcatcttgtttgacaaagattttattgttgggttacatctccttcccagtcaacctaattctcatcccacattctccaccaccaccaccaccaccaccaccgccaataataataataataataataaatagaaaaggagagatggggctgaaaatgctcttgggactctttcgtaatcttcactctaagtcacatctgtttttgtgaatttctcagcgcttccctgaggtcttttcctttgactccatgatgaaggaagctatggattcaaggattctagagctgaatgtgacatccatcttgatggggtctagggaccaggtctagctaggttgagatattaatatcctatatgaatgtgactagtttactaagtcatcatggttgaatgtgttgtttgggggtaggatgaaagaatggggtatctcctgttgacatgaaaaattgaaaatgttaatttttgattagcccaaattctctgcccatgagttatagtgggacagtgacattaacctgttggagatttcattgaaatgaataaagtaggaaatgggaaatctgccagtcagcagcagccatatgaacgtcatcaccatcaacttcattagcactggtatctatgcagtacaccactttgcaatgtaaagaatgctgccatagctagtatcttattcagtctcccaacaatcctaaagacatgtattattattttccctattttacagataaagaaaatgagagactcaatgccacacagcaaagaaggggtagaactagcattcttctaatttcatatgctatgctttttccaccatgaagttcaggattctccactggaactacattccctcatcctctgccctctctaattctcttctgcttcattaaggagttcataagaggcccagttgcctgtctgaaggctataacacaaccaacatgattctggagattgcatggcatctttagctggaaatattttgttatcgagtagagggtttgtaagacaggttatacagaggagaacccaaaaaggtttaggtctctcagcctgatcaaattgccttccatccctttcttacaaggaagcagaatgaaattaagctttatctgcattcatggggcaagatggccagaggctacacagactcccaaggttttcagcccagtccagaggcctctgccctccagcctgagtcatgtcctttgctttacagctgcccaagcggctggtatctgctacatcaccagcacatttgccagctgtagccttgaagacattgtcattgcagctcccgaaggcctccgatggttccaactctatgtgcatccagacctgcagctgaacaaacagttgatccagagggtagaatccctaggtttcaaagctttggtaataactttggatacacctgtatgtggcaacaggcgacatgacattcgaaaccagttgaggaggaacttaacactaacagatcttcaatcacctaaaaaggtaagaaagataccaaattcgatggacaggcattacaagaggcaaatttccttccctcttttctcctttcctccattctttctttccacaggcatttatcgaacacctgctctgtgccagacactgcggataaagcagtttcaaaaagcagatatggttcctgctccctagagtttccagacaagcacaatcaacataagaccaaatgttctcacccttggagctgcccaacttgtcaccagaagtgttctggccagagctggatgctgagaaataggaaagccacggaaaatatttttgcacgaactggagagtaaactaaaaaagttcatgtaacattttctactttatgacacactcagaaaatgctaattttggatggcatacatagacaaactgactctccaaaggggatgttcatgaccaaagtgactggccagacagtctagacaggccaggttctaccttactgccttgaaactgaggaatcaatatctctgcacacatagagctcatttgtggagcaccaggatgctatagcacatttgtttgtaatctctgaactaggtgactacaaaggggaccttccccattaaaatcctacaattaaatggcaagaagtgcctcagagagagacagccatgataaagtgggaatccctggctatagtagagatactaaagccagccttttcaaccagtgggcagctgtgacaccaagccaagtaactcaacagttctcattaatcacagattggccttgaggtgctccaaaatccttattcaaattccagaagcacattgagatttataaatgtttgatgtacatggtgagccaagagtaaatattgggtaataactgatttagtattgcttagttcttatcctgggtatgcctcaaccgtaacatatcacattgaccaataaatgcttttgcttatccatcttatatactaaactctgaattttttaaagtagaaactttgtcttatttgtctttgtgtccccagatcctagcacaattactgacaacaacatgattcatggtcaatgataagcaattgaagtagaaattcttttatacaaagtttgttagacaaaggagctagaaacgttgttgggttttgttgctcctgtttctttttgttttctttgttgtttgtttgtttgtttgtttttgagacaaggtctcactctgtcagccaggctagtatgtggtggcgccatcactactcactgcagtctagacctcctgagcccaagcgatcctcccacttcagcctcccgagtagctgggactacaggcatgcaccacgatttatttttttagaggagcagcagcagggtctctgtgtgttgcccatgcttgtctcaaactactaggctcaaaagatccttccgcctcagccccacaaagtgctgggattacaggcatgagccaccatgcccagccctgttcttcctccttccagtttataaatggcagctctctaaatgtgtctcatctttggaatgcatcaagtagccttgtgagagctcaggactaagttccctttttatttcctatagggaaatgcaataccttatttccagatgactcctatcagcacttctctctgctggaatgatctctcctggtttcagagcataactcgattgcccatcatcctgaaagggattttgacaaaagaggatgcagagttagctgtgaagcacaatgtccagggtatcattgtttccaaccatggtgggaggcagcttgatgaggttcttgcttcagtaagtaggattacttcagagaagggtgtgtttgtgagtgctgtgtgtgtatgtgtgagtgtgtccacatcaagggactctgtgaaatctgagcatatttcactcctctgtaccacatgtgttggtatgtatctgtgaattttaaggactgttaattattattagtagcctactgtgtgctaagctgttttttcaacctttacatatagcatctctaagtctcatgccaatgctgcaagatgggtgttattatccctgatttgcaaatggggatactgtagtttagtgatgttaaataacttatctttagttcacttaagataataaataattaatgttgaatttgattagacagatgttctaaagtaaacacgtttcatggcaaaactctaaaaacaccctgatgtgtcttttgctaaaatctataaaagtccataattttttcccttaactcataaatttatgttcattataaatgaagtttgagggcaagaaagtgagagaaagtaaggcagggaaagaatctttacatgggaatttgttgttgatttgttttcattgagttatattttttcaaatgttctattgctgcttgacttgttttaagaaagagaaatgaggttttttcctcttcagtttcattgacacttatataaataaaacatgttcactgcagataaattagaaaacatacataagcaaaagataaaaattaacactaattttatcactatcactaacgtcaacattttggtcactgttaacatcttcttaatgcaaatacaatttttggtgtttaagaaaagtataaataatattgtgtttttttcttttacttagcattatattaagagcaactttttgtttcagtatatatgctcctcttatttttaatggtatgtagtatgaacagacaactatataaccaacctccattgtagaacatctgtattgcctctaatctttccctattttaaacaacacatcagtgactgaatccatagcacaatctcaagtacttctttaagataaattccaggaattagaaatttgcactagctggttggtacattccaagacacgtgatgcttggaagcctaagagccagccactcacctcctcctctgcaccagctctaactgctaaaggcagtggaatgcaagcccacgtggagagcaggggtcacccttcactgtgtctctctggtaagagctgaaccgaagtggttgggtctcctgcttttcatctcacctattgacctgcaaacttaggagaaagtggttgggctgagcacacactgagctctctcacccaacccctgccaggatgcctacaagccatccagtatttagcaaaacagagaaagcaaaagagcatagcatgccctgggtcatcccaactatgcctaaataggagcagaaggcaatgaagagcccattaccaacaagcagcaaacagtagaatataggcttttgaaagaaagctaataaaatacatcatacaataggtgtcaggctctcattaatcaacttagctggtcttgttcttttggaataactgagtaatgagtagacaaagaggaagactaattctcccattgtgcttccccactagagaatgagtattggctaaggtaggggccagggagaggagaatttctcctatcttattgtgctaatcaacttgatattctcccaagccatttggcttcacatccaaactcaagttcacttggagacagcacaaatatcagtgtgagtctcgtgagggttttgcttcaggtgaaacctgaccctgtgcttgtataaccctgcctcacttgcctcaccttaatcctagccccaggtctatttatttataaaaacaaacttccagctcacaggtcagagtttgccatttgtttttttaaaacattgtgttcaaacatcatttatctgagtttttttaaaaaaattatttccacaggttattaaggaacaggtggtgtctgctacatgagtaagttctttagtggtgatttgtgagattttggtgcaaccatcacctgagcagtatacactgcaccctatttgtagtcttttattcccacccccttcacaccctttctcccttagtccccaaagtacatggtgtcactcttatgcctttgcatcctcatagcttagctcccacttatgagtgagaatatatgatgtttggttttccattcctgaattacttcacttagaataacactctccaatctcatccaggttgctgcgaatgccattaattcattccttcttatggctgagtagtatttcatcatatatatatatatatatatatatatatatacaccacagtttctttatccactcattgattgatgggcatttgggtgggttccacatttttgcaattgttaattctgctgctataaacatgcgtgcaagtatcattttcatataatgacttcttttcccctgggtagatacctggtagtgggattgctggatcaaatggtagttctacttttagttctataaggaatctccacactgttttccataatagttgtactagctcacattcccaccagcagtgtagaagtgttccctgttcactgcatccacatgaacatctattattttttgattatggccattcttgtagcagtaaggaagtattgcattgtaattttgatttgcatttccctaatcattagtgatgttgagcactttttcatatgtttgttggctatttgtatattttattttgagaattatctattcgtgtccttagctcactttttgatgagatttttttttttttttcttgttaatttgtttgagttcctcgtagattctggttgttagtcttttgtcagatgtatagattttgaaggttttcttctactctgtgggttgtctgtttactctgcagactgttcctctgccatacaaaagctccttagtttaattaagtgccagctatttatctttgtttttactgtatttgcttttgggttcgtggtcataaaatccttgcctaagccaatatctggaagggtttttcctatgttatattctagaatttttatagtttcaggtcttagaattaagtccttgatccatcttgagttgatttttatataaagtgagagatgatgatccagtttcattgtcctacatgtggctagccaattatcccagcagcattgttaaatatagtatcctttccctactttatgtttttgtttgcttcaccaaagatcagttggctgtaagtatttggatttatttctgggttctctattctgttccattggtccatgtgcctatttttataccagttccatgctgttttggtgactattagtaacgagagagaattcatgtccaaataaaagacatttttatagtcccagcatggtattatttggatttatttttttttatttgtagtttcactcttgtcacccacgctggagggcaatggcgcagtctcagctcactacaacctccacctcccaggttcaagcaattctcctgccttagcctcccaagtagctgggattacaggcactggccaccacgcctggttatttgcatttttagtagagatgggatttcaccatgttggccaggctggtctcgaactcctcacctcaggtggttcacccgcctcagcctcccaaagtgctggaattataggcatgagccactgtgcccagctggaatatttttatgatgttgtgaaagagaaatacatttgtacaaactcttctagtgagccatactatgcagtggagttgataataattgtgaaataaaatagggagtgaattttaccttagggtgaggctttagagttaatttttaataggacagaacaggacattcattagagtcttctggggacaacagctgacttatcctttcccctggtcctaggaggaagtacaagaacaatgttagatatgaaacctcatagaggtgggaacttttctcaaaatccttaccttttatagcactggcaacaacctgcagggagtgggacactgacctcaggcacagactctaggggagtgccaaaaactcagatactatagtttgaaatcaggtgatttcaaagttcctcatagaagttcccacctctttcacaacattataaaaatactccaaataataccatgctgggactataaaaaatgcctcttattagaatgtgaattctctctagttattacatgtaagttcaaaacatattcaattccccgccctcacctataagttaaagtagaaaattatttcctcactattttcttatactgttcagtctcagccaaagtatcccattcaggtagaatgctaatggattcctttggcagcagaaggcctcatagggcccagttttgactcttcttctcaggccatccctcagagaagcacagacaaaaaccctgagggtgttccagaactccctccccaaggatcttccgccttgatccataaggggcctgtttgtcactcctctttacagacttgtaggtgcctagaagcatagatcggcctggggcaccttgtgtgctcaaggcctatttgcctgttccctggaattgaagaggcaacataagagacaaagttccttaggaaaatcaggccaagatgataagatgtttttattttgtctgtcaaaggctcaaactttagttttaccgtgttgtactttagtcctatctcattttctcagatacgccatgaggaagtcagggacaagttggtcaagtggtgcatgagaaataatgttcaacccagtttcccaagtcaggatgcaatccagacatgcaggccatggtcaagtgtacttgtcttgccaaaaagacttagtgcctttgcagtggagagcctttctagttgtgccaccctagaaacagagagagtagaagaaaatcaaaagtcaaaatgtttgaaaagaagaaagttgaagtaaacattataagtggaaaatgtcccttttaggatggaaagaataaccaagcagttcttccaacttgtaagacagttaagtgagtcagagagaagctagactggagtcaaagcagaaagtcaaggcaggagggcctcaggaatgtgactgccgctgcagttgatcagcgctagcagcctcaagcatgggaggggaagaaattgtcaagggcgtctcctcagcttggttttcctggtcatatgccaggaagaccaagtctgagagtcaaaatagaaagccctccagcccatgtgtatctccttttcagattgatgctttgacagaagtggtggctgctgtaaaggggaaaattgaagtctacctggatggcggggtccgaactggcaatgatgtgctgaaggctctggcccttggagctaagtgcatttttcttgggagaccaatcctatggggccttgcctgcaaggtgagagtggcaaagcaaaccagcaagaagatacagagcttctcattcatttctgtgctttcctgtggttcattttccaagcttagacattttcaaaatgattcctaaaggatagttacacctaagctgcatctccatgcttcttctgaagcccattgcaaatgttcaatagctttcatcccctatctttgtctctgtgctttcctttattcccaaggtaattctcacttcacagataatccccatctttcccattatagctctgactacatctagaatttatactagtggatggtcagaatgttcctttatgtctctttgtgtctctgtctgtctgcctcgggagcagggtgaacatggtgttaaggaagttttgaacattttaacaaatgagttccacacttccatggcccttacaggtaagttaacatgttttccctgatttggaacttaaagcaggatggctaaagaataggagcagcagtccttccctctagcagaccctttcctgatgtggtagctgtccaaaagataggacaggcaggcaactttcaagacaaagattaagcactattctctgcacagtggaaaccagagctgtcctcaagatcattgtcagctctggggagtgtcacctctggctctgaattcttgcttctgttgaattcgttcaatttacggactattgacatatcccatgcctgctgtttctgtccactccagtcaacccaggcatgaaactcaactcttttctatgcttccacttttaggaaaagaccctctcattagtatatttttgtgaataatacattttgccaaagttatggtgcacacatcataaatatggaaagaactcccagttaaacgttacgcagcctgttattgcattctttcagccttctcatcaccagggacttctcattgcctactcaagcccacaactccccagccccataacatcatgccagcttctctttctcccttcttttacttatctggagttactctcttcaatccttatgtccaatctgagctacagtcataattttacatattaattaatatcttcttctaaagaagagtcttttcctttgacagaactttcctttagaaggcaattgtcatgtggaatactcaccccatctcttttgctatctgtgtgtcatattcctcccgaaaagatacttcctatatccctgagccttatcagaaccaagataaagatcaaagacatctattgcacacaagagttgatttagaaaatgctaaaatagggtttttacatgtttaccctgacattttgacatggccatgttcagagatgacctgggctcaggttcacagaataatacccaatgcaaacagaattacattattcattctgtatgtaaaccattttataagagtgagcacaaagatcaagtcagacttgctccccttcatcaccccttacccatgatgaggtgagttgcttgtgtttgacaaaaatgagcttgtaaccacattgttcttttaggctgccggtcggtcgctgagatcaatcgaaacttggtccagttttccaggctgtaagaaaaaagggccaataaccagactgctgaggttgcccacaggaggatcacaaactcacagcacagtgtgtgatgctgtccttcctggaccccattctgtccggaggctcatggcccatatttcccacatttctaataccaccacccctgtgcttcaggccctccaaacccctgtgttccccaaatgttccatgcccttctttgtatcactgactattatatgttgctctcttgcctaaatcttcctctgaagtaaaagatctcaaaaggacagatcattaatgactggaaccactagtgggtgatattttttgcatactctatacaactctatgaaatgactatctaactttgcactctggactgaggagctgtatatacaaggcatttttccaataaaaacataatcctatctgtagaaaatagggaaatagttaaggacatggactttggagccacacagacatgggtttgacagtcaggactactgctggcaagctacgtgacttgggcaagttttctgatctctctgtgtttctgagtcctggtgtataaaatggggattatactccctcagccagtaggttgggaaaaagttagagtaagatgatgtatttgaagttcagaacacaatgcttagcacctagtaggagtttaagaaatagtagtgtttcatacttaatgagtatatatacatatgtactcatatatatatatatatatactcatatatatacacactcatatatatatactcatatgtatatactcatatatatatactcatatatatatacttatatatatatatactcatatgtgtatatatatatactcatatatatactcatatatatactatacttattgtttggaaaattcctattaacttttcaaggcattgttcaactttcaactatcatcgaatattaacccaggctattttctctgtccttcctattgtactttgcacattccaatattacaacccttattacacctggtcatatttctttatttgcatgtctttctccacaaatagactatgaatggctccagacaagaaactgtatgcttgattctggacttggcatataggaacatctcaatgaacatttctgggatagatggatggatagagggatagataaaggatagttggaaaatatataaatgacctatcagaataaaacctcctgagaccagtagtcagctagaatagatttctagagcagggatactcagctgaataagatctggcacttgaagacatcaagaaggttagagatggctgggcatgaaggcgcacgcctataatcccagtactctgggaggctgaggcaggaggatcaattgagcctagaattttgaggctttcgtgggcaacaaagggatacctctgcaaaatttaaaaattcgttaaaaacctagccgggtgtgctggtgtgcagctatggttctagccactcaggaggctgaggtaggagaatcacttggtctgggaagttgaggatcatgccactgcattccagtgttctgggtgacagtgcaagaccccatctcaaacaacaacaacaaaacaaaaaaaaaaatagaagaagaaggttagagaaaaaaaatctaagtctaaactaatagcttcagcaacggcttccccatcatctctcctgctgcttgccacactgttctccatacaacagcctgaaagagtttttaaaagtaaaatcaaatcctatgtctcacctatttaaaacctttctataccttcccattccactctaaactgatctctagctctctcgggcactgcatgatctgctcatccttccaacgcatttcctcatcactctcccttttactcataatgccacagccagattggcctcccttctattccataaacaatcaaaactttcttgcctctggatcttcacatttatcattcccttttcataaaatggtgttcctcaccttctcatgattggctgtctgttggcatgaagatctcagctgaactgtcaccgccctgatgagatgagacatccctgaccatcctctcccaaaaacaatctgcttcactcatcacatcacactgtttctcccctcctagctgttaccacaacctgcaactaacttatcagttgtctactttattgtttatctgtacctgcatagggaccttaggctgtcttgcttcctgctacgttccaaaaagcctataatcatgtccaatgtcatagagggccccatacatatttattaaataaattaatccaggaaggcaaagct

SEQ ID NO: 16264 - DNA, 240157 bp, Human
  misc_feature (1)...(240157): n = A,T,C or G
tccaattcatactacataactatgtcagatgaatttcctgccctaaactatagctccaaatatggcagttccttgcacaaaactactgtcgcatttcattatgcttgcttctttcctgtatttattctttctaaaaatttatcgtttgttttccccatcctaaaattgtaagctcagtgagggcagggaccagttgtagctccagtgtttagctgtgctgtcttataacacacattcgattatattgttgccaaactatgtaaatgattactacaagaatttggacaatatggttttctttcaacttttaaaagtgagatataatgaacgtaccataagactcacccatttaaaaagcataacacagtggtttttagtatattcataaacttgtacaatcatcaccactaattccagaatattttcatcacttcaataggaaaatgcatacctgttagcaattacttccatttcccctctcccccagcccctagcaaaccactaacctactttttatctctatagatttccctatcctcaactttcatttaaatggaattatataatatgtggtcttttgctcctggcttaacacgatattttcgagattcatccatgttgtaacattttgtttacccttttagacaagataaagtttaataccctttctaactctatgctcagatagtcaagtgaagagctacaaccaaatttctttttcctttcttcctttcttctctctctctctctttctttccttcttttttttttgacagaatcttgctctgtcgcccaggctggagtagagtggaacgatcccggctcactgcgacctccgcctcccctgttcaaacgattctcgtgcctcagcctcccgagtagctgagattacaggcatgtataaccatgccgggctaatttttgtatttttagtagagaaggggtttcaccatgttggtggccaggctggtctcaaactcctgacctcacatgatccaccaacctcagcctcccaaagtgctgggattgtaggcgtgagccacagcgccctgcctcaaccaaatttcagaaagtatcataatatcattatgcttcatagtttctctatgccctgaagtttaccaattttatcttctacagatcccaggaaggcagcctgttaagactcaccaaatttacttcctcagcctccagaacaataaaatcaaactccctaccttgattttaagattctgcttccccccaccccgccccaccccaatcttctccttggatattcgacagtctggaataatgcatttttacagttctgattgttttcagcagatgtgttggctgaggttggatggggtttcttcccacctatctctcctctctccttccctctgcccactgcacgtgcaacaacttttctgccatcaaaacgtgcaaaaaagaaacaagaaagaaaggaaagagaaagaaaagaaaaacagaaaaaagaaaagaaaaagcagccggaagtcttcctttgttttccaaggaaattcaggtaaaaggaggggtggggaaatgatatttttgactttgctcacaatccagacgtaggaaagaaaaaggatttcctttgggctgctgccacgactctgatgttttatgctgataaaatatttccttcttaaaaaaaagttctgggaaaatcatgccccttcaacttggaagcgaaacccaccctaactttcgtcttaaaacgcagcgaagtgaaaggtttgctcctctttcacgagggttttgttccttacagttcgggtcttgctaccaggagcgagctgggtccgcagcgttcttcggtggctggcgcgggaggaggactacaggatccagagatctttggaaactccagcagctccaagcttgttggctactacggtttccctgaggagtgacgctacgaaaacaaaccctgattggtcaggcctgagctgagttctccatttatggacagattgcccggcccgagccgagactcagccagaggagtacggattaagtggccgaagaaagaggagtgaggcaggggagcgaggcggacgctccgagcgcatcggactcacctgggccggcggcgagcggcgagtacgagtggactcttgccctccgcagcatgcgccccgcctgctaagtcgccgccgtctcgccctcacctagcaccgccaatcccgcctggatggagtcccctctgggttcccattggctcctgtgagtgcttgggtgtcgggagcctgtttttggcgaggggaaccaacttttgaagttcgcccagaagactgcgttccagccccagttccccggcagcgggacccggcgaagacgcgaccgcggcgcgagtcaccatggtgagttggccgcgccgcgtcctaggacgccggacccggggacggggcaggaaaccccggcgtggtgcacccaccttgggcgcgctgcctgggccaggggtggagaaggtggacgcgggagccggcacgtcgcgagctctgatttcctgccgctttccgtaaacccgggccgggggagagcgagcgaggggccaaggaaaactttattccaagtcggtttctgcgtcgcgaaactttctgtggccgggttgctatggctgccagctgtcggaagccagggtgtgggcgcatcggctgcgaggggcacggcgcgggagggggtcccctcctcctgctgggacgtggggggcgcagccggcaggggaggtgctcggagactcgcgccgcagccgctggcggcgtcccctgccctccccgcggccgtgcccgccccgccccgggcaccctcgcgccgactccctctcctccccgccgccgctccgctgcccggcagcgcccgcagctgtcccgcctggcagcggcacgcgggcgggggcggtccctggcccgccttggcgaggggcggcgcgggccgcacaaaggcaggcgggggcgccaggtagggcgagcacctggcggccggcgggctgtcaagagccagggagactcgggcgcgggcggcaaccacgccgccccggacctgtgccgggcgccggccccgagggtctccgcgccccggacgccaagtaaacacctcctgaagaggaccccaccccttcccaagcgcgaggggatcggggcttttcggggatccaggggacgcttcgcacgggaagacgccctcgcgagtttcgagtttgttgctgttttccctttggcactttgggaatgtgtggaaggggccgcctctttgacttgtgacttttctgctattccaactccccagtccagctacactcccctccctccctgtataaccttagccacctcccttgggctttggcgtggtgtacttttctttgcggggcacgaaagcaaggactctattttgaagagatcggcagttcatcaaaaaaaaaaaaatctattacaaggcttcatagtttccacacttgcttcttttcaagtagtcctgcttaggtggattatctcgtcctcttctggtttgctgttgttttctaatggctgtggaagagaagccaagtcaaaatgataaccagcacaacactaattaaaaaatcgatatcccggtgagcagcctgagggaagtgcagtagaggcccatcgaaacctgcacacaaagctcagaagcccccttgccccgtgctgtttattccaaagaatgattacaaacaaacatcaacgagaaacctttcaaggcatcctcggccaaagccttttctttttacatagtccaaaattaagtcacttttgccccatctaagagaacactttgtctatacatttcctcttctagttttaaggtttaagaagtcagtctactctacgttacttttggaccccttccctcaccccagcagagaaccattcccattgggcatgtgtttgggtgaagctacctcactgggcacctggtcccttgaagcagtgtgatagtcctggtacttgagaattgctgtaatcattttccgtgggtcaatatttcttaaaaaaatcaatgtgtttatgtcaagaacttaaagaatcttactgaatttaagtacttgagtggtaccttgaggaaattaacttcccctcagttaaactcatttttcatgctgaatggactgaaatatactctaggttgccttttccgaaacctgtgataccatgcttaattcagccccattgcagatgaagtagagggttggtcaaatgcatgcgaagaaggcatgctgtagggaagaggtggttctatctgaggacagtgtgtgacttccctattgatgggctccctgccatcagcacagatgggcatgttgtgtgcccccaggcgactatctgtgcatcagatatggttgctgaagtcacaattcactgatggaaaagttgaaacagctggctgtcctgaaacaggagatgtgccattgatagatctactggatccagagtgatttggccaaagttaatcatttctttcctgacttgaaaaattgttcattatgtatgtgaagttgccttagaatagagcatcatcttaaataatcagaaacccaagttacaatatttaatgtttatgtcagactctgtcaagccaaatgatacttcattttgtgttccacatctgcccaggcctgcccaagttgtatcccttcagctgcttagaacaggaagggaaaggacattaccttctttgggtgtggctgaagattagcatggaggctaaaattcatcagaaggcccttggcggccaggcgcagtggctcacgcctgtaatcccagcactttgggaggctgaggcaggaggaatacttgagcccaggagttcaagaccatcctgggtaacatagtgagaccctgtttcagttaaaaaatattaagaagaagaagaagaaaaagaaggcccttggctgggctatagggagaacacctataccgtggacttcttctgtgtgagtgtgtgtgtgtgcgtgtgtcttttaggaagtctggtagcatagtaggagggctctccatctgtacctgaggccctactaagactcattcagttgtgactcataaggaaaatagccattttcattttctgactcatgaacacagtgtacagcttgtagttcaccttctatcttcctcctgaaaactcactttgggacacttttctatcttgagaaaactaggaacactaccaggcaatagttacttgtgtctttttcctaaggagacttgaagaagttaaaaaaaaccctgcacatctttataatttagtggaggttgtttagcagagtacaaaaaaatctctgttgactttaaccgtaatacccatctaaggcttccttcgtagaatctgggcttatcatcatctgcaaaggaagttctgcttttgtggccatgaccagtttggactctctgatagactgaaacccatggctgtaggtccgctatgtgctttggatccagaaattgtgattcatttttatgcaaggtttctgtgcattaaatatacagaaatatttgagcaaatctgaattgaccatcacctcaaaacatgttcaagagctgttcccttttccttacttgcatatacttgtgaggaaattatagatatgacacataagaatacccaggaatagatttacaacctagaaatctgatgaatagctgatgataaggtaggtaagttcctttaggtgatggcatggcatgtatttagaaagtctggaatacatttcaaatgtttcctgggaaggtaacctacttgatttccacagattagtttatcagattgctagtagtctcctagtcaaaacaacacaatacaacaaaacaaaaccagaaaggaatgggatcaagcacaaaaaaagttttgatggaggcaaagggttggggaaatacctagagtccgggacattatctagggacaagtgtgagtgggccatcctagtgggaaatatttgacagcccaggcatctccttggagagaaaatgggtggagcagtggatggagagggatggagaagtataagaagcagacatttactgaagttgaaagtcacctccaccacacttttgctgaggactacagtcttgtcagtggttgcaaactttttttttttgagttggagtctctcactgtcgcccgggctggagtgcactggcgcgatctcaactcactgcaacctccgcctcccggtttcaaacgattctcctgcctcagcctcccaagcagctgggattacaggtgcctgccacaacgcccagctaatattttgtattttttagtggagacggggttccactatgttggccaggctggtctcaaagtcctgacctcgtgatcctcctgcctcggcctcccaaagtgctgggattacaggtgcctgccacaacgcccagctaatattttgtattttttagtggagacggggttccactatgttggccaggctggtctcaaagtcctgacctcgtgatcctcctgcctcggcctcccaaagtgattacaggcatgagccactgtgcccggccagtggttgcaaacttaaatgtcttataatttggtggagggaggctggcctctagagagtaaatatggaatatatgtgccattctaggaggcaccactacttgattctaggccatggttatatcgaccatattaccaaattatcttgtttttcaagagaaactagaaatctagatttttatgctatatctgccagttcttatttttatttattttgagacagagttttgctcttgtcgcccaggctggagtgcactggcgcgatctcggttcactataacctctgcctcccaggttcaagcaattctcctgcctcagccccctgagtagctgggtttacaggccccaccaccacacccgcctaatttttgtatttttagtagagacagggttttaccatgttggccaggctggtctcaaactcctgacctcaggtgatctgcccgcctcagcctcccaaagttctgggattatagacgtgagccaccacgcccggcctctgccaatttttatatgtgatttgatcatctcagaggggccaaacacagctgcagattagctgtttgcagccactttattgtaagtcttaacatggtgtccttctgtgaaccacagtgattcttctcattcactcaccaggaagaatgtctaaacgttcactacatacccagtagtggcattcagtatttatccatacatccacaccttcctactgggtctccctaaagagagggaatagcctggtattttcagcctatgcattctctaagctattataacagggaaaatctgcatccagctgctactgtttggcgctatctcaacacctgtgtaggatggttccacgagtggtgaggctgcaaattgagcttttctcttcaacccttcaactccttcctccactgaaaatgccatggcctccaatgtcacatgatggacttcttgtttttcactcctttttcagttgaatctcatgaattggcggtctgtctcaggcgttttcctgagggttagataatgagcagcggcgtgcattctgataacttagaatacaacattttgcctctgtgcctagtgtgggcatgtgatgagcccctgtgagactcagtgaaagaacatatagtaccttgcgtttcctcatgagccaagtgtggggccttattattcattaggaatttgagaaatctctttttatctgcttcaacaagcagaaatattttaaatcttctgtgtaagtgcaaggtattataagcttcatggtaggatatataggaattatgtacagtcatggttttccaagtttgagtcatctcttttttttttttttttttttgtgaaaatgcagcaacttgtgtttttaccaatctgtgattaaaatgtttcttaatggtgagtttttaaaaactttttttttctttttctcaccatgctgaaatatttacaaagtaaataagaggttaaaggttaaatgccaaaggtattaaaataaacatctcagccttataagcacattctgtaatagtggtaaacaaattgtgttttgaatttcagtttcagaatttatgttggcagagacaaaaggttttggggcatcctagcaaagtatttttttcatatatctttgggacagccacacttaagagaagtacaactgtaaaagccagccctaacatagtgacatgaactttgacaacccatagaactcaaactgtacatgtgaatgaagttggcccgcccttctgagttaccaccatgagaatgacgtcattgccattgttcaaagcacttttgaatggtcatttatgagctatgtaataaaacctatttttttgccgggtgtggtcgttcaggcctttaccaaaaaaaattttaaaaattagccacgtgtggtgtcatgcactatagtcccagctacttgggaggctgaggtgggaggatttcttgaactgaggagttcaagtatgcagtgagctgtaactgtggcactgcagcctgggtgagagtgagagagagagagagaaagagagagaaaaaaaaaagaaagagacagggctgggccctgtggttcacgcctgtaatcccagcactttggggggccgaggtgggcagatcacctgaggtcaggagtttgagaccagcttggccaacctggtgaaaccccgtctctactaaaaatacaaaagtagccaggtgtggtggtgcatgcctgtaatcgcagctacttgggaggctgaggcagagagaatcacttgaacttgggaggcggaggttgcagtgagcctagatcacgccattgcactccagcctgggcaacaagagtgaaactctgtctcaaaagagagaaagaagggaagaagagggaaggagggagggccttattttttattttttaactccttagtgcccagtgtgatcattcctattactcaccagactttgtattacatccctctcaggtgtttccagaagttacattgtgcctcaaaggcggaacaattagccccactaaagatatgcagtatccagcaggtccctttttcctggaataagtataagaactgctctgaaggaggcacactctcttgggtcttttgagctctgataatgtttgttacaaattcatttatagcactttatggtcatacgttacattatagaaagtaaaacataggctacattgtagaaagcccagaagagagcttaaaaattctatcctaaatccatttgttaacttcacagagagatctagagaggttaaattacttccaaagtctcatagctagtttttagctgagttggtgccagaatccaagttagatctgatccagtgcagatctaaccttattagatcccagtctaataaggtttttcttaccaaacagtggtgggaataattctttaagagtctggacgtgaccagatagttttctttctgggacttttcaagaaagtctgcttgtaggtggaaggttactgtactaacttcattataagaaatttagaagaattcagccgggcgcggtggctaacgcccgtaatcccagcactttggaaggctgaggtggagggatcacctgaggtcagaagtccgagaccagcctggccaacatggtgaaaccctgtctctactaaaaataaaaaattagccgagtgtggtggcaggcacctgtaatctcagctacttgggaggctgaggcaggagaactgcttgaacctgggaggccgaggttgcagtgagccgagatcacaccattgcactacagcctggggcacatctcaaaaaagaaaaaaaaaaagaaaaagaaatttagaataattcacccaaagtacccccacaccctaacacagtaattatttttgtctctgggtttcctttcagtctgttcaaatgcattgtttctttgtttgtttgtttttcttgagatggagtctcactctgtcgcccaggctggagtgcagtggcataatctcggctcactgtaacctccttctgcctcccagtttcaagcgattctcctgcctcaacctcctgagtagctgggattataggtacacactaccatgcccggccaactgttttatttttagtagggacagggtttcaccatgttggccaggctggtcttgaactcctggcctcaagtgacccaccttgacctcccaaagtgctgggattataggcatgagccaccacaccgggcctcaaacacattgtttttatgtggttataattatggggcaaatatacaatttgtgttctgttatttttccacttgttttacaaatcctttttcttgataagcatatttgttatattttggtggcagtattataatcccatgtagccggattactcactgtgtgtcataactgtatggagacttcctccagaagtgtgtacaggggagagttcctccttccacccactagaaccgctgtggtcagtaatgggctgcttaatctttggctcctgagataagaagccccctctttgggtgagcttgggatgcatactccacattcccaggttctagcccaaaggtacctaccattggtgctccccctggattctggcgttgacactcaaatatgtgacaccagtgggtactcagacctctaggtcttccttggcaaatatgagtggtcttaccagagaacgggagtggatggagatggagagctttgaacctcaaagtggagagaagacattgccatggcaaaggaggttagcatacaggcttggtgaattagagctgggcatggtggctcaggcctgttatcccagcactttgggaggccgaggagggcagatcacttgaggtcaggagttcgagaccagcctggccaacatgtcaaaacccccgtctctactaaaaatacaaaaaaattagctgggtggggtggcgggcacctgtaatcccagctactcgggaggctgaggcaggagaatcgcttgaaatgggaggcagaggttgtggtgaaccaagatcttgccactgcactccagtctgggcgacagagcaagattccgtctccaaaaagatgaattagtctctctgcctctgcttatgagaagctccccatatagtggagaaatgataacaaaaggcttccatatacatgatttcatttcattctagcaccagtgttggtttttattgccattttacaggtaagaaaatcaaagtgtagtgaggggaggggaattacttagggccacacaatttgtatgtgaccagccagatctgctaagtccatgctctttgaaaagtggttcaataaattatttctaaatttgacaatgccgagtccacgtatttgtatactttttcattatttcacatactcctgagggaaggtaaggctgatagaaaatcaccaattttggttgattttattcagtaataccagaggggataatttagacttaagaacattgtctgttatgaatagtagtgttctgagttttaatttccttgctttgggactttgccaaagagactagaagatgtcatagtgagagcaagcataaaagtaaaagaaagtaatactggccgggcatggtggctcacgcctgtaatcccagcaccttgggaggccgaggcgggtggatcacgaggtcaggagatcgagaccatcctggctaacatggtgaaaccccgtctctactaacaatgcaaaaaaaattagccaggcatggtggtgggcaccagtagtcccagctactcaggaggctgaggtgggagaatggcgtgaacctgggaggcggagcttgcagtgagccgagatcgtgccactgcattccagcctgggtgacacagcgagactccgtctcaaaaaaaaaaaaaaaaaaagaaagtcatactagaaggctctctaatcttaactaggattaaaaaaaatagaaaataggaaaatgtgagaacaacagagatttagttgtttaattcttaaatacattacagaatacaacaacaaaattagaatatcacattgttagtctcctaataatttcttcggtgtgaccaccatttgatgttgacagcaatttaggataacattacatggtcacagaatattttggacagtattatctgattctaagaaattttcaatgaaaaaataatagggctgtttttggtgtcctaggaagatgcagaccttatagaaaattttagatttaaatgcagaagaatctaataagctattttaagaatgtaagtaaagatagcttccttcaaggcttgggaatgctgtaatgcagaaatatgcatcaatgcaaaatgatgacagtgccctttctccacatcagattatcagagattcctaacatttggatgggagaatgtcctgagtcctctgagaatatgttggaagctactgaccttttccctgacagtgtttataataacaaataaacattccgcagatcacgagaacaaacaaaacaggaacaatctaaatgttcattggaagagaaatacatgtggcttgtttgataatatggtatcaatatgcataggtgtcacaagggtagtgtttggtaaagaagcaagttgtagaaagacgcatatctgaaaccatgtaagaaaaatgtcaaaaacacaaaataagactgttatttgggggtctatacatttatttgtgtatgtgtacatatatgtatttgtgtggatattattttaaaaaatataggctgggcgtggtggctcatgcttgtaatcctagcactttggaaggccgaggcgggtggatcacctgaggtcaggagttcgagaccagcctagccaacatagcgaaaccccatctctactaaaaatacaaaaattagcctggcgtggtggtagacgcccgtaatcccagctactcgggaggctgaggcaggagaatcgtttgaacccaggaggaggaggttgcagtaagctgagatcattccactgtactccagcctgggcgatacagcgagactccatctcaaaaaataaataaattaattaataaattaattaaaaaaatccacagactagaaagatccacaccaagttcaaaatactgaagggggaaagaggaaagggagacgactgagtcagtaatgttttatttgctttacatatagaaaaatccaaagcaaatatgatgagatattattaattctaggcagttgtacatatatatttctttgttatcctctgtagttttaacatcttttctcagttcagatgaaaaaatacatataattcttcatttaacttcaggaggtttataaacccctgaagcccatacagtagcattccaagaattacaactaacattgtcttgaaatgagtattagggagtatggtcaattttggatctatgtcaggttatttcaatgacagttgacatacagtcgcatcaatagtgagtcccactgactattgtgtaaagagccattaggggatatgtctcccaatgttcaatacatcttagctctgcttagccaccttttcttgtgttagcttttggtgtgaccaatcacccaaactcagtaacttaaataataaatgtttatactttcttatgattttgtgcactggcgtggcagttctggtctcagctggttcattcaatcactgtggtcagctagtggcttggctgggaatggatgatctagggtggcctcactcacatgtctggtagttggtccagtctcagctggggccatgggatggcttggccatgtgtctcttgtcacaacagtctagctctggcttgtttacatagtagtggtcacaccacagggttcccaagaaaagcaagggtacaagctccagggcacacacatttttcaacccttgcttgcgtcatgcttgctattatccccattggctgaagcaagtcacactgtcaagtccagagtcactgtggaagaggactgcccaaaggctcagattcagttccctaccctcaaccttttctgtcaactttcctacattgcgggaatacttggaggcaggaatagattgagtggtagctccagttttctctggctgatcccctgaacccctttgtttgacagaagccagcatggctcctgctctgtctgctgctgctttcccaagcaaggcatgaggaatcggagctgaagtccttttgtagtgatgaggctcagtctcattctaaaactgctgtcttttgttgggggaaaaaaagggcaaaaacagaagctaacaacaagaaggaaaatcattttctatctgctaaagggtgctttacaagaataacaaacattttacattaagtccaaagttagagagcaatgaatcatgccaaaccatgctgggctcgatggcctgctggacagaaaggggaatgcaggccttccaaggtggggacaatacttcttgctgcccaattctgcattttcgcccacctctgagctgtccatgtgaagaaagacattccacacacagacaaaaattcttttttttttccccttggttgaaagtcatgtcttttggactgtaagatggttctcaaaataaccctgtgtcaattccatattctgtgagccacagattttgctatctgtgggctcgtcaagacgtgaatcgagtaggattagtttagcttcgtgcccaggacttgtacaggacgtgaaaaattccttgacctcctgatctttcactttgactttctgttctgtctttcaatcaaaaatgtaaaaataagtaagttggagagaaaacaaatccctcaacttcagccgttgacaactcatgaccaatcttgatttcactgttcttatcttcccctggtttctttagaagcaaatcctagatagcataccatttcatccataaatatctccatattatattggctttcacatagagcaaagctagacactaactgctcattggactgaaagaagagatatactcagagaaccaaagcaaatagcttccctttaagttttaataggagtggctttgttttatagaacgctgtaggcatctccagccactgaggggacttcttcaagcttggcccagcctcatccacagaaggatctggcagtgatatcttggcattcatagtttcagtgtgcaggacagcattggttccccaccctacagtcccagctctacctaggcagtatcatatgtatcatggtaatggctatggaaaataatatccctccctccctgcctcccttcccctcttcctctttttagagatgaggtcttgctgtgttgcccaggctggtctcaaactcctggcctcaagtgatcctcctatctcagcctcccaaagtgctgggattacaggtgtgagccaccgcatgcagcctctttcttttttgacagggtcttgctctgccatccaggctgaagtgcagtggtgtgatcttgtctcactgtagcctcaacctcctaggctcaagagagcctcccatctcagcctcttgagtatctgggactacaggcatgaactgccatgcctagctaattaaaaaaaaaaaaatatatatatattatatatatatacacatacatatatatatatgtatgtaaaatatatatattttttacagggtctcactttgttgctcaggctagtctagaactcctggtctccagcgattctcctgccttggtggcccaaaatgctgggattataggtgacagctactgtgcccaaccttgtttctttcagtgaccaaatagctttaaatatagaatgtcaagatgagaagtatcctggagaccacttccagggtagtctatgaaattgtttgtgtccatattcattcttaagtgaattttttcctgggaaaaagattcataaatccccaatgtggttcatggtctccccaagtgaccctttaaggtccagggaactgtggtagcctgacctaggtctctcagttacttggcaagttaatagcagagttgtccctagaatacaagtctcttaacccacagttcaggaattatggtcgtaaacctgcttttactggaaatgtttgaaaatcaaacataatggtgtattagaagagaggttcaaagtggtaaatttttctgtgatcacaaagagaaatgcattcaatacagactccaaataaatatgtcagggacataaagtttttactttatataaataattgaaaacccattttcctggtgaggatacattgatattaattagaaaattagtatttaatagttgacataagaaattgctgggccttaatatctggactctggagcagatttctgtgctttgtttctatgatctagaactagggcttggggtgtagaaaaactgggatggccttttccttctagctctttctctcacacaccctcacaccccaaacccatcttccaactagtgtccttttctttccccacaaggcctcttgtccatcctctccttgaagcattcatctggacttggaaaggatgaggagagctggagaaggcaggagacatagtttgcacctgctgagaagtgaggaaacataagtaaggccagtaaaccaaagggagctctctcctcctcctcatcctcctcttcctcctcatcctcctcttcctctttctcctttttgtcctcctcctcctcttccctaaggctctcttgatactccttggtccagccctgcttagcaactctccaagcaagcatggaggacaatgtggcaagcattgtctgctctatggagacaaggagacatcatcctctttgtttggggctatgagtcaagagtcttcagttttttgcagcagttgtatttaagtgtcagttgacaaaagtgaattttatatgctccaattaagatgtagtgaattgtgacattctaccacttgccaagtcctgtgattccacctctgcagtgtggctacactcacctatatcagctgaccaaattcatccacttggtgtttccctttcaggcttagatgttctccatcttcagcttgtgtctggctggaatcaattcctccccctctccatcccgtcagtctaattcttcttttaaaccagccttaactctgccttcttgagcctcatcattgaaaattacctccttggcaaggtatggtggctcacgcctgtaatcccagcactttgggaggccaaggtaggtggatcacctgaggtcaggagtttcagaccatcctggccaacatggtgaaaccctgtctctactaaaaatacaaaacaacaacaacaacaacaaaaatagccaggcgtggtggtaggcacctgtaatcctagctactcgggaggctgagacaagagaactgcttgaacccgggaggcggaggttgcagtgagccaagattgcaccactgctctccagcctgggcgacagagtgagactcgtctcaaaaaaaaaaaaaaaaagttatctccttcttcaaaatctcatgagcactttatctataaagatcttataattgctaatgtgcattttgtctttccttctgatcagttacttttcaggtagaatcctttctcgttcagctttgtatcccagcctctcctctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaacagggcgaaacctcatctctactgaaaatacaagaattagctgggtgtggtggtgggcgcctgtaatcccagctacttgagaggctgaggcaggagaattgcttgaacccgggaggtggaggttgcagtgagccgagatcgtgccattgcactccagcctaggcagcaagagtgaaactccatctcaaaaaaaaaaaccaaaaacaaacaaacaaacaaacaaaaaaacttaacaggaggcagggcacagtggtgcaacgcctgtaatcccagcactttaagaggccaagggaggcagatcccttgagcttaggagttcaggaccagtctgggcaacatggcaaagacctgccaatacagaaaatagccggttgtggtgttacacacttgtagtcccagctacttgggaggcttatgtgggaggattgctggagcccgggaggcagagggtgcagtgagccgagattgcagagagagaccctgtttcaggaaaaacaacaacaaaaaaccccaaaaaacttaatgggaaaaatgtttgtatttctttttgttatgcatcagtatacaatctttaaaactacccccaggtcttttccttgagggacaaaagtaggatgcagaactgcctacaaggtggagcattcttaaaatctactccaaaaaactgctgctcgtgggtactcagctgatagaatgaacaggagtgaatgaataggtgaaagcaccctgtgatttgaatgtcgcaagcctttcattttcgttggaaccttgtctgatgtgtgtcactccccactccgttgtgcttgcccttcggaaagatggaatggtgaggacagagaggagacaggtgataaaaagacacttaaaagggcacctgaaagccaggtggcttgtccctggaaggcagtagaaagcaatctgcagtcatgatgcctttcttcactcagcagcagctataatgttgaaaatggggcaaacgccttccccgtgcaactgtttaacaaaaggtagttctcctagaaaacagaatctgttgtatatgttgccagtgattttcacaagtgtagatgcctaagaaataggcaaatatgctgagcgtggtggctcacacttataatcccagcactttgggaggcctaggcaggtggattgcttgagcccaggcattcgaaaccagcctgggcaacattgtgagaccccgtctctacaaaaaaataaacgaaaattagccagacatcgtggtgtgtgcctgtagttccagctacttgggaggctgaggtgggaagattgcttgatcctggcaggttgaggctgccgtgagccctgatcatgccactgtactccagcctgggtgacagagtcagagcctgtctcaaaaaaaaagaaataggcaaatacaagagatggaaaaaggaatcgaaagaattgccatgggattgcgcattagacaatttgctttttaaaattgcatgtggttttgaaggacaggttgaatttggatgtttaaaatgcttagtgaaactaagactggcagggtcaaactgtgcgcataaaatctttgttctggaactcaagtgaaaaattggcagatttgcactttttgagctttttagagtccatttccagctccaggtggctgggtgaagtatcctaagctctacagaagggtaaaagaaatagcctcccacgtgagtggcaggagtaggtaacctgtagtatctggaaagatatgtagatcaccaccagttagaacatttggaaggaggaattgccagtggcttgtagacaaggaatggaggagttgagacaggcaaggtaaattggggccctcctgccaattggaagtttttgagtgatatttttaatatttattattccatcctccttggttggaaagtcacgacggagagggacactgtcatgctcatggtttgtgtttgtatttctggcatggggtagaattggcaactttgctgaattgaacaactgttccccactagaccaaaagtgcccagaggactgaaaaccctccaattcaacttggtggcagcaaggcagccgccagtgaatgagtgattgatgagagccagcggattaaaggagacaactaattgtaaactggaaatagttttcaaagataaaagtagccccctcagataaaaccactagggcttccttttgagttttcttttcacagaacaggatattagtggttcggtggggctcctgcaggagggggtagctgtggagggaagctggtaggctgggaaggtttctacctgtttctcactcctttcctactaacgccccttcagttgagaggctaggtaattataattacctgagatcacacaaccagtcctgacctgtccccacaaggggtggagctactctttccaggtcaaaatggaaaccaaattcaccactatccgttcaaaagctcccaactccgaacaaagagccattgcaatggtgcccacctgggcaccattttggagcctgatatttattatcacatttaggttcacatgccaggtgcccacctggcatggaggcagcagtctgttcgagttctgccacctgaggacacccaggcctgtgaccccaagcgagggcttttctgacgtttgtgggggagtggttaggctgcttttgctgatatgaaagatcactgctagattcatggccaggataagaaggttttccttgttaggtgatacggactttcagaatgtaaaatttcctgaccaaggttgtgtctgttctggtttaaagacgaggatttgctgcctttgtttttccttaagccaacgtgccatccacctgtgctagaggaatctggtattgctctcctccaaaggccaggacggtctcaaaggagacaggctaatggcttaattgttttgtttattctgctccccacaaattccagtagcttcatttacattcagagaacttttttcaactgtattgtcatttcccttggttttgaatggctcttaatgtttgcccttcatgttgttttgaaaggttgatcgagccgttagtgaagggtgtggctttctccaaatgggggtttttcttagtgtgtggtagagaaagtgagagtaattttaaaaataaaatatgcacattttttctatctgtacacacaaactctagattattttggagcctatttatgttcacatgctttaggttttgggagttaaaagattaatgtgtacaagggaatggtgatatttaacaggacaaaaatttcgcttttacagagctgtggtttgcttttcaaaatgtagaggtttctttacctttgcgtttttttctttctttcttttttttttttttgagacggagttttgctcttgttgctcaagctggggtgcaatggcatgatttcagctcactgcatcctccacctcctgggttcaagtgattcttctgcctcagccttccgagtagctgggattacaggcgtgcgccaccacacccggctatttttttgtatttttagtagaaacggggtttctccatgttagccagatggtcttgaactcctgacctcaggtaatccacccgcctcagcctcccaaagtgctgagattacaggtgtgagccaccgcacctggcctgtttcttcacctttgacaaagaatccagtataagactattctggttcgtgttgtaaatggatttttttttcttttttttcttttcttttcttttcttttctttttttttttttttttgagacagggtctctatctgtcacccaggctggagtacagtggtgccatcacagctcactgcagccttaaactcctggggtcaagcaatcctcttacctcagcctcccaagtagctgggactacaggcgcgcaccactacacctggcttaaatgcatttttataattttagtataaacaagacattttagattgaataactttgtaatgtgctaggacagtagtttttaatgcaggtgggatccaacttttgagaaagggaaatgtgaaggttgaagaaacttaaaaatcaactgctgttggctagatctaggtgtgctgacttccttagaaaagaaatgcttcctttccctgcaaaccggagtttgggaaatttagagctaggaaatcatgtggtcgatcttaacgttataaatcactcagacaaatacaggataatgctgttttcggaagtgcttgtgattgtacaggattacatggtgataaagagttttcaatggctcctccagtttctgagggagttctgtgctttgctttcttggtaattccttctgcagaccttagagcctttgaggggggctgggtatgcttccgtgaatttaacagtttaacacactgttgaatagaagagaatctgctattggaactagtgattactaagaaaccacttctatatcatccagcatttgtatctactttaaagtacatattagtattttccttggtttacagatgaggaaaatgagttaggtaccgtgtttaaggtcacccatctgaaaagtggcagagaggggatttaaactcctggtcatctgaatctaaggtctgcttagaagaggagctgtttgcttctagacacatgcgtatttaggttgtgggtccacggactaatagcgtgggcatccctgggatattattagaaatgcagaacttcaggtcccacccacacctgattgcagatctgtgttttaacaaggtctctagatgattgcaaagcactacggcacagggacacttccccagaggaagtgtgatggccgccctccaggatatcatcttccaaggttagggacgtgccaaatatcccaagctttcagatatgcgactcaatcatctctaattatcctgctcaaccaaaaattaaagagcgattcttccaagtggaatcgagggaaacttttctcctggacaattctggagggagtccagctatccttaaggagatgcacagaataggctgttgccgacagcatgcttggaaaacctatcaacccggggtgcctcttccacggctgctgtccatgctatactttctcccattactgatccctctgaactagtctatcaaaccttctcctaaagagggtgagaacagattttgtcaggccagagaggaagaaagagatccagaatggggacgatcaatagcatgaaaatagagaagggcattgaaaagagcccagccttcagaacactccagtcctggcgctggagaactgcaccttaccttttactcctacctggttttccttttagaattcccccaggcatctatgctggagacagtagtgtctttgtctgttgttcccatccctgccttgctcctgccatttccaacgtcctgtgagtatatcttcacaggactcccccttccttttcacagtggccaccctagtttggatgtgcattgtcttacactgggaacattataagcgtttcttaagtggtcttcactcttatcccccggtaattcacagaaatagcatcagcgcaatcatcttctagtaacacggctttgcatctgtcactcttcctcaaaaactctcagttcctactgggaacagtctaaagaccaaaatgcattacggtctaaattaaaccaattactggttgcatttatccaactctattttccagtagtccttctcaaataaattccgtgagggcagcctacatgccttgttcctgctattagctcctagcacagtgcttgtacacagtggattttcactaaatattgattgaatgaacgaatgaacttattctcaggtttatgttttatagtctgcctagaatacactccttggtcaggccatttcctgtgactagatttcccttcccttttttcctgttcatctgaatccttaaaaaaccaagtaaggccgggtgcggtggctcacacctgtaatcccagcactttgggaggccgaggtgggccgatcacgaggtcgggagatcgagaccatcctggctaacacggtgaaaccctgtgtctactaaaaatacacaaaaaaattagctgggcgtggtggtggacgcctgtagtcccagctactctggaggctgaggctggagaatggcgtgaacctgggaggcggagcttgcattgagccgagatcgcgccactgcacgccagcctgggtgacagagcgagactccgtctcaaaaaagacaaaaaacaaaaaaccaaccaaccaaacaaacaacaacaacaacaaataaagactcatttcctggaagcctctgatttaactcgtggagatcattcccttctccaaattgtggcccttaccatagagttatttatttgtgactaaactatgtcatcttgcattgttatctgttttcacacagtctcttacagcccaagtagactgtaagcctcttgagatcagagataatttacatttctttatatttttcagaattcaccatctttccctttggccttcccacattcctgtacactctcgacattccctggttatctggcagttcatattggggaattatggttagctgtggatcaggcctcctctccccactttcctctcagtaatgcatgtagtctctgagggcagacactacattctcctgtgtcttttctggtttattcaatgatagaggctgtaccctttatccttttcaatttcatctacattcttttccttctcctgctcagttcttggaactcccatttctgagtgtctacgactacagtcatggtgaatagaaggtaatgaaactgtgagtcagtgtatcctctagctggagtgtgaaggtgagtcagcagacagcagcagtggatctcttccaccctgaggaaaggcaggagcctgcctggtgatcagggaaggaggccctcctccccacattgtttcctggaactgagtagaacaaattacttaactgtacttcagtttcatttgttaaaaaatgaagtaagaatagcttccattctcttttcattcaagtggtgatgtattgacaattaataagaaaattataaaatgccttagataccaccattgggactatgtaacgcaccacaacctggttgtggctgaggctctgttctagccacccctcctttctgactaccacatcgccctaaagttagaggcaataatagagttaccgcattagtgtttttctaacaaacctgttcaagtcctggctcactaaattttagggaaatgatatcatttctctccagtcttttaatagattgtctttgaaagagttgcatgttgcctgttaaggaaatgcttcagttggaaataattgagtaaggttagaaatggttcaagaaaacagacacatccctgcttgacctgctcagcctcaaactttcatatctcctagtttggggagggatggatggcagatgtagagtgcctcagtttttgttttgcagaaagttatatcatcatcatgtagaacagacatcacagaacgaaattaattagtaatgcattcactgaatttgggcaggatagtttgcttatttgaaaaaattcttggcaaggatgaggatgatttctcatcatcctcctccctaactcgctgggtaatttaaagaaggtttgtgagttgaaattttctgaatagagtgggttcagtttacccttttttatatggtagattgctaatagtgcattactgggagtggaggaaagacacccttttctgccttaaccctgagctagaggaatcacagccttgtctagaagctaaagacataattatatccatttcatatgcagtatgacaaaatcattagaaaattataattgcaaatagaaaaaatataggaggcatatgcatatatacctaagatgtttatatgggaagttatgggaggaaaatgaaataattactaattaataattactattaataaggtttcaaatgatccccttttttccccttgcctgggtgtccttccatcatgtccaagtcttagatcagtttctagatctaggctcaacaaaattccctcccctggacccccaagccttcccagatagtcaccttcctcttccatatgtccatggcacctagtttgaaatgttcttacctcatgcatcatgttctgccttgtgttagaccctttaagcttttgtgtctcattaagatattgaactcggctgcgtgcggtggctcacgcctataatcccagcactttgggaggcctaggtgggcggatcacctgaggtcaggagtttgaaaccagcctgaccaacatggtgaaaccccatctctactaaaaatacaaaattggccgggcatggtggcgcatgcctgtaatcccagctgctcgagaggctgaggcaggagaatcacttgaacctgggagccggaggttgcagtgaactgtgatcgtgccattgccctccagcttgggcaacagagtgagactccatctcaaaaaaaaaaaaaatgatattgaactccaaggagcagaagttgtttctgacatatagccaatggtctttatccagctaaaattcacccgtagtgctttttaaaaatgacaacccttgggcaccatcctagaccaaaaggattcagacacaactgtattacttttcaaagcttcctggatggttcctaaaagcagcctaggttgagagccactgttgatggatgtttaagcattgtgggctatgccataatttgatgcaacaccaaatgcaaactgatcaggatgtatttttgccatgctgcaacacaccatgtaacttaggaagttttgtggttttggcgtttttggttagggagggtattatttaatacagctgacttgaataaataggaaactagttcccaggggactttacaaaaggtaagcctttgtgtgactagcacctggggggtttcatcgctgtcaaggctatggtagttttaccacctgcattctcttacctcctccccactgtggcattgaccctagaccagaggcctccaaaacatggcgaggcatcaaaaccacctgaggaggtgattcagcaggtttgggatgaggcttcaaaatctgtttttcaccagggttccaggtgattccagtggaaaaactgataggagagccgctgctttacagctgtgtggaattgaaaatgacgtgggtcttggatcataagcagcagggtgtttttcttttcctagattgtcttccttaaccccaaattatgtaattacatacatattttctctagaacttttttgtatttttaaattttagctccttatgtcacccgaaatttacttttctggtgtgaggggtataattttttccaaatgcatggttagtggtcttaaaaataatttattcactggtgcattctttgtctcctgttgtgaagtgccacctttatcttatgttaaattcatatctatcatatgtttctagcctcttctgtttccttgatccttttctttattcctaaaccagttgctagtaccacattctataattactctagtttcggaatatgttttaatttttatttttggcaagactttactaattaaattcctttttaagtgagttcttggcaatttatactcatttactcttccagataaaatttagaatcaatgtgtcaaagttccataagaaaatctctttggaactttggttggagtagcatgaaccctctagagcagcagtccccaacctttttggcaccagggaccggtttcgtggaagacagcttttctgcagcctggggtgtggagtggggatggttttgggagaaaactgttccacctcagataatcggtattagattctcattagaagcgcgcagcctggatcctgcgtatattcggttcacaatgggctttgtgcttctatgggaatctagtgctgctttgatcttacaggaggcggagctcaggcggtaatgcttgctcaccagccactcacctgctgctgtgcagcccggttcctgacaggccactgccagcacgggtccatggccccggggttgggaacccgtgctctagagcactttgagaaggtgaacgtctttgtaactgatgccttatacccacagacatggtgtccttccccatcagcccttctttcaggggcctccattcatctttatgcttttctttacacaattctttcacttttttttttttttctttttgggagacaaggtctcgctctgtcacccaggctggaatgcagtggcatgatcagggctcactgcaacctccacctcctgggatcaatcaatcctcccatctcagcctcctgagtagctggaactacagctgtgtgccttcatgcccagctaattttatttgtttattttgtagagataaggttttgccatgttacccaggctggtcttgaactcctgggctctagtgatcctccaaaagtgctgggattacagtcgtgagacaccatgcccagccatcttccccatttcttaagtttattactggcattttataacccttgttactgatttgaatgggatatttcctaaaacattgtcttttgaaaatattaataattttatccatagttcttataatttaatggatatcatgtcataacccacagaattacaagaatctccctcacctgaatatagagggattgtagcattttgaggcattccattttttactcttgcttcaaaaacatgagacaaaacaggttctcctcaagtgtcccagtgcactcttcttcattaatagagtggcctgggctatggggccgtcattcgtaggctctttggcagggttgcagaaggagctgagtctgggctgaatgtgatccatggtgggacacagcctgcagttcgtgcttctgaataggtccctggtcgggggctggatgttcagtgatgcacctcgtcatcctgaggtcaagaaagcacaagtggaagaaggggaaagatgtgttaattctgcctagctgaatgagggattcagaagtgggagccagacctttgcttacaatctcagaaggaaaaaatgttgattccaggaatcaagtaattctaagaaccaattatataaaaagtgttttgcaaactataaagtgatattcactcacatgcattcggaagtactacctccacgtgttttagctgcatttgaaagtcttttagaaagaaagcaatgcaactgctggataaaacctcatccctctaccccagaattgttgtcacagctttaaggaagttttatgtgaaagcagaggaaagtaacagtaactctttaatccagacatgtgtctaaaccatggataactcacagaaggccttagagactctgagaattggtaaatattctatacatccttagcatccacaggctaaatacccctccattccctgagtcagggcatgccagctgttaacaatgttctattcctggtacctctctctttgcatttccctgtctttcctcaatcatcttgtatcacaggaagtataaaagtagttaggcagttctattttttgacagcagatgaaaagccaaagttaaaggtcaatgcttaacccactggcttctaataagctggtaaagctgggcaatatagtaagacccctatttctaaaaacatttttttaattagctgagtgtggtggcacatgtgcctgtagtcccagctaatcaggaggcagaggcaggagaatcccttgagcacaggattttgaggctccccaagagaaagctgaggctcagagagggtaatgtgtggtaagagttaaactctcagtcctgatacctttgcttttttatgctgtatttcttctgcaatattctgcactttgcttaggttttttttttttctccctctctcatttaaatacttcaactgcctgtctgatctgttagccattctgtgtaccattatctgattgcttttagaaaagagcttccagtgggctcagtgtgtttaatctgctgtggcttctgaagtccctcatcttcagggagaagtggctcttctgtctacccgattggtcaagcctctttctttcttgatgttttttcttcataaaaagttaggcatttaaaattttttctgtttgtctttctaaataaagtacttcaagttattttgaaagctctggtcatatcctatcaatatgcaaacagatgagttgatttttaaaaaatgacatgctggtttgagttcttggtcttttagtacctattgattctagtgcctattgactggctaatggctgcttgtatttattgaatctaaatattatgctctttgattggtggtgccctggcagcactccccgtgggcctgtggggtggagaacacgggaagagatacctgcttggggaaaggtgggaggtaagagtgggaaggactttggtggttttggtgccagcttagccacagtagaataaagtactcagtagatttctaacatttctgactccagaccctggttccctgatagcatctctggacctacctgggcccagggctgtcctgaaggaaaggacacaagcctagctggcttcactacttgatgattgtagagccctagggccttgagggaacataggccagataattatacaggccttgggcaagacccagtgttgtgctggcttcaggtcagacctgcagtccccagtggtggtggccataggggtgcttttgtcacccttcccctagctccacacatctcagcacagagagcaaaactctgtttgggaaaaagtaaaggaaaagaacaagagtctctgcctggtaatccagagagttcttttggatcttacacaagaccaccaaggcagtacctctacgagtccgcaagaactacagtgttactgggcttggggtaccccataatgcagatacggctgtggtgtccacaaacttagatcataacaaccaagtccctttgaatacttggaaagccttcccaagaaggatgggtacaaacaactccagattgtgaagcctacaataaattcttaactcttcagtgcctagacacccatgaatatccacaagcatcaaaaccatctgggaaaacatggccttaccaaatgaaataaattgaccaggggtcaatcccagagagacagagatatgggacctttcagaaagagagcttaaaatagctgttttgaggaaactcaaattcaaggtaacacagaggaggaactcagaatattatcagatacatttaacaaaggaattgaagtaagttaagagaatcaggcagaaattctcgagctgctgaatgcaattgacgtactgaagaatgcgtcacagtctgttagtagcagaactgatcaagcagaagaaagaattagtgagcttgaagacagactatttgaaaatacacagtcagaggagacaaaagaaaaaagaataaaaaagaatgaagcccacctacaagatctagaaaatagcttcagaagggcaaatccaagaattattggccttaaaggaggtagagagagagagataatggtggaaagtttattcaaagggataataagataacttcccaaacaaaagatatcaaagtttaagtacaagaaggttatagaacaccaagcagatttaactaaaaggaaattacctcaaggcatgtaataacaaaactcccaaaggtcaaggataaagaaaggatcctaaaagcagtaacagaaaataaacaaataacatatgatggagctccaacacgtctggcagcagacttttcagtggaaactgtacaggccaggagagagtggcataaagtgctgaagcattaaaaaaaaaaaaagagttcactctagaatggtatatctggcaaaaatatcctccaaacatgaaggaaaaattaagaccttcccagacaaacaaaagctgagggatttatcaaccccaggcctatcctacaagaaatgctaaagggagttcttcaatctgaaagaaaaggatgttaacaagcaatgagaaatcatctgaaggtacaaaactcactggtaatagtaagtacacagaaaaacacagaatattataacagtataatagtagtgtgtaaactatacatatctcaaatagaaagatgaaaggatgaacccataaaaaataataacttttcaaggcatagacagtacagtaagataaatagaaacaacaaaatgttaaaaagtggggagacaaaattatagagtttttattggttgtctttttgctttttgtttatgcaatcgatgttaagttgtgatcagtttaaaataatgggttataagatgttatttgcaagcctcatggtaacctcaaatctaaaaaacatacaacaggtacacagaaaataaaaaggaagaatttaaaatgtgccaactgagaaaatcaccttaaaggaagataggaaagaaggacagaaggaagagaagaccacaaaacaaccagacaacaaataacaaagtggcaggagtaaggcctcacttatcagtaataacattgaatgtaaatagactaaactctgcaatcaaaagacatagaatagctgaatggataaaaagcaagacccaaggatctgttgcctacaagcaacacacttcaccaaatcaaatgaaaatggattaatgacctaaatctaagacttcaaactatgaaactactaaaagaaaacattgggaagactccaggacattggtctaagcaaagattttttggacaaatgggatcacatcaagttaaaaagcttccttccacacagcaaaagaaaaaatcaacaaaatgaagagacaacccacagagtgggagaaaatatttgcaaactttccatctcacaagggtttaatcaccagaatacagaaggaactcaaataactctgtaggaaaaaatctaatctgattttaaaatgggcaaaagatatcaatagacatttctcaaaagaagacatacaaatggcaaacaggtgtatgaaaaggtgctcaacaccactgaaaatcagagacatgccaatgaaaactacaatgaggtatcatctcacccaagtaaaaatggcttttatccagaagacgggcaataatgaatgctggcaaggatgtgaagaaaaggggaaaagggaactctcatacaccgttggtggaaatataaatgagtatagccactgtggagaacagaagggcggttccttaaaaactaaaaacagagctagctaccttatgatccagcaattccattggtaggtgtataccttaaagaaaggatataagcatatggaagagatagctgcactcccatgtttatcctagcactattcacaatagcaaatatttggaatcaacctaagtgtccatcaaatgatgaatgaaatcattcatcacataaagaagatgtggtacagatacacaacagagtactaatcagcaataaaaaagaatgaaaccctgtcatttgtcatttgcaagaatatgaatggaactggaggtcattatgttaagtgaaataagctaggcacagaaagacagatttcatattttcttacttatttgtgggagctaaaaattaaaagtattgaactcatagagatagggaatagaatgatggttaccagaggctgggaaggagaactggggagacaggggttatggttaatgggtacaaagaaatagttagaaataatagaatgaataagagctagcatttgcatgctcacagtaacacgtatactaaaattggaatgacacagagaagattagcatggctcctgagcaaggatgtcatgcaaattcatgaagtgtattttaaatgttattgaaaaaaaaaatctagtatttgctagcacaacagaacgactatagtcaataataatttgtgcatttaaaaataactaaaagagtattactggattttttgaaacacaaaggataaatccttgagggtgtggataccccattttcgatcatgtgattattacacattgcatgcctgtatcaaaatatccatatacacctacttatatatgcccaaaaattaaaaattaaaatgaattttatgttctttgaagatttttctttttttcttttttttcttttttttttttttttttgagatggagtctcgctctgtcccaggctggagtgctgtggcgggatctcagctcactgcaacctctgcctcccctgttcaagcttttctacctcagcctcccgagtagctgggattacaggtgtgtgccaccacgcccagctgatttttgtatttttagtagagatggggtttcaccatgttggccaggctggtcttgaactgctgacctcgtgatcctcccgcctcagcctcccaaagtgctgggattacaggcatgagccaccatgcctggctgaagatttttcttaaatccttcctgattttattcctgaataaaaaccaaatattataaagttagttttactttggacattaaatgtccaagcaaattagaaataaaaaatagtaagaggagtaatgaacttagaaacggcagttatttgcaaaggcaattgtaaacatgtcatttgatgctactgttatttgatactacacatggtaaaaacacagtgagtgacgtcatagaaaaccaactcaagtattactttttcctgacaattttcctcctccttccaatagtccatagaaattagactgtctagagaaagtaaaacaaaaacacagcacatcacggaaatagaacctcaaaaaaaaaaaggttaatgtgaaaagtttgccttatttaatttaacgatccggctgggtttaaaaaattgctattttttttgagacaaggtgtcgcttgtcatcctggctggagttcagtggcacgatcatggctcactgcagcctcgatctcctgggttcaagcgatcctcatgcttctcgattataggttgcacaccaccatgcccagccaatttaaaaaatattttgtagaggtcagatgcagtggctcatgcctgtaatcccagcactttgggaggccgagacaggcagatcacctgaggtcaggagtttgagactagcctggccaacatggcaaaattctgtctctactaaaaatacaacaacaaaaaaattagccagatgtggtagcggacacctgtaatcccagctactagggaggctgagacaggagaattgcttgaacccagaaggcagaggttgcagtaagccgggattgtgccaccgcattccaggctaggcgacagagcaagactctgtcaaaaaaaaaaaaaacaaaaaaaagtatgtatatataaaattttgtagagaaggtatctcgctatattgtctaggctggtctttaactcctgggctcaagcagtcttcaggccttggccgcaaaactgctgggattacaggctggagccaccatacatggactgaatttttaaaattcttagtagggagaccttttaattggaagttgactataggaacgagaaggaaactgggtgactgaacaaccctattaggagagaaacacagatgaatcaacatgaagaatgtctgggatgggagcctaacatgcccagagctgcccttttgtgtctcttgggaggggctgtgttctggatgaaggcagtcaataggaggctggactactgtgaatatcggggtagtgaagttgagaaataccaattctacagtatggagtcagttaggtcaaaggttttgtacgtcaaataaccaagctatcttacatttctgtctccatttggaaaccagaaggtcagtcaaatatttggttagaaaaccaggaacaggaaaacatctcttgttacacataaaatctgtatccaagcactgtgtatcattccacaccatccattagaaccagtggagaggaaggctctgaaaggtttctgtctattgaggtttgataaaatggaagagtttagtacccattattactacttcaagttgaataaaatgtgtcattgacattttctttttttgagacagagtcttgctctgccacccaggctggagtgcagtggcacaatcttggctcactgcaacctctgtatcccaggttcaagcaattctcatgcctcagcctccccagtagcagggattacaggcatgtgccaccacgcctggctaatttttgtatttttaatagagatgaggtctcgccatgttggccaggctggttttgaactcctggcctcaggtgatccacctgcctcggcctccaaaaatgctgggattacaggcatgagccacagcgcccagcctgatgttttatttatagggtgcactcttcattgtttaaatgtctatttttagatgttgatagacctttgtaggtagtttcacccctgtctttggttctcttgcactgtttgccccatatcattctaaatttttacccaaatgggttttcaaggaccttgctcctcctgcctgtgggaagtggttacaggttagcaatagttgaaactcccctactgtttttcccagcttagcagggtggttggagaccagccccaatactcctgagagcccatagagacagtcctggctcagcactgaggacatcttgcaggcagggttggctgagtgttttatggagcgagcttaagaggagatgttctaaaaccagagaggaaacatttttctctgttctctgcaattcagcaggtgatatcccttcatggatttataataaacacagtcctctcattgaccaaggttgaaaaactcagaaagtttgctcagcacagatctgggagtcaggaacgtactatgtgctgtggaagacatttcaactcctctttcaagcaaaaaaaaaaaaaaaaaaaagtcaatactgatctagtttatatagctattataaaaaattatattaatgaaaatagaaattcatttgtaagtagagacagctaccaaattcctaagcaatctattcatttttgttttttttttagacttgaacactttttcttgccttgcctcacaatgcagttgtcaatatagggccactttagttacacctattacctgactctgcaaagaccacagagcttatttcctttagaaggattttgtttgattaatttacactcttcgctgacatttctcagttgagtaggaggaaaaaaaggagtttaatttaaccatattagccacatcatggacagggaaatgtatggaggatgtttaagtgatttgccttattgagtaaagatatatctaagcttagattttactttgtcctataagaactctgtgagcgagatttttttttcttttttgagatggagtcttgctctgttgcctaggctggagtgcagtggcacgatcccagctcactgcaacctccacctcctgggttcaagcgattctcctgcctcagcctcccgagtagctgggattacaggagcaaaccaccacgcccggctaattttttatacttttagtagagacggggtttctccatgttggtcaggctggtttcgaactcttgacctcaagtgatttgtctgccttggctgcccaaagtgctgggattacaggcgtgagccactgtgcccagccgagcgaaatatttttgactatagtagtctgaatgttcttttaagtttcataatgtaggctaaagctctattttctgccaaatgcgaaattgtagaacagaataaaaccatgtgctttatattatacgaattatatctgatgaatgttcatgtttagaaaaatcacaatcaagctcagcagttgtagatatggataacacaactccattcctgagcagagcaggtttcatcataattgcctgccttatgttttgttttcatacctgtagtaaacttaggaaacttaaaaattattcaatagaaatttagagtgtggagccctggtttgaatcctggctcttgtcatcttaatcagttccctccatttttacatctgtaaaacggaaatattcataataataaaacacctccataagaatcaaatgaaataaagtagaagtgctttgtaaaagataaacaattcaataactgtacaattcagtaactgcaaggaggtattatataagcatagatttttttttaaaactaggagttgtcaacccaaatgtccatcaatgatagacaggataaagaaaacgtggcacatatatactgtggaatactatgcagccataaaaaaggatgagttcatgtcctttgcagggacatggatgaagctggaaaccgtcattctcagcaaaccagcctaggagcagaaaaccaaacaccgcatgttctcactgacaagtgggagctgaacaatgagaacacgtggaccagggaggggaacatcacacactggggcctgtcagggggtggggggctaggggaggggtaggagaattatctgatgtagatgatgggttgatggatgcagcaaaccatcatggcacgtgtatacctatgtaacaaacccgcacgttctgcaaatgtatcccagaacttaaagtataattaaaaaacaaaacaaaacaaaaaaagaccaggggtgtactatgtgaattactggaggtatcagagaattctcagatgatccaacacatgtccaaaattcaagtactattaaaaacacataattttaaaaataaaagatacttatgaaagcctgactgctagttttaaagggacataaataaaccttatttaccttatttatgtatgtccctttgaatctagggttttttcttttcttttttttgagacagcgtttcactcccatcaccgagactggagtgcagtggcatgatctcggctcactgcaacctccatctcctgggctcaagcaattctcctgcctcagcctctgagtagctgggactacagggccacgccatcgcacccagctaatttttgtattttttttagacatggcgttttggcatgttgtccaggctggtctcaaactcctagcctcaagtgatctgcccgcttcagcctcccaaaatgttgggattacaggcctgagctactgcactcggcctagtttttttttaattccagaaaaagtttcaagatttttttttttttttgcttttgtgttaatattttgggtgtagtgggagagggggtagcacacttgagttgctgcaggacttgtttttttgtgtgaccagagagagcccacagcacacagccgggttctcattggaaaggcatcagaacaagtgtgtgcagacagcaccgcttatagtccgtgacactcattcctccgcatgaatcagggccacacatggcttcagatgatacaggttctttcctgacatctcaaggggagtcatttgaatgcgtccgtgtctctcccactacctctcaaaatgccggactaagttaattggtaaataaatgctcaggctgcttagcagtggcctatctctgaggcatgaggtctaatatagtttaaatgtaagtccatcgtggcctccaagtagctaggaaaacaggtgggggacttcaaagagatctgagagcaagcctggccgggtctcttgtacttttccagccctggcttatgtgtgggacaatggtgaaaagcagcccttgaggtagaaccaagtgggttttttttttattcatattcggcacagatttattgatgcagaaaacatgctctcctgatgtggccacagaatcatcacttgcttctttcaaaatccgtaaaatcttgcattctgtggtatttggcagattacatctcatactgtagcagcctgcgcttgccagctgaagtgtctgaaagtagcttggagtcgttttcacactctttgatgctagtccaccttttactacataccaaggatagtacatatatccaccaagtggtgccaaatcttgttctttattcttcttaaatttgaacgtcaaaattgcactttaataataaaaatataaagccatgagctatgcaaataatgaataaagattattctgagtaggcttagatgccacaagaatgcccttgtttttctctttcacggtttgacccagtgtggtgtgaatgttctctttgagacaatctttgtgttaaatctttacactaataaatgtgttagaacttcttcagggatattcttagcgaggaggagttggtggatgtgttttttgcaaataggcttcctttgtctgcttggcaattctctatgaggtttctgaaagtgtgacctgtacgtgagacatctaagtggatggagcaaaatgagggagacatatatgccagtctgataagtaaatcattcttgtagtcagtgtggaagagttggcaaatttctctctgatttccttctgtttttgaccctgccaggctgaacccaaagacccagcattgtgactggaagggcctgcgaaagaaagcccttgccaagtgatctctgtataatcgtctttcagagacttaataagctttggagaatatttggatgaagttggcagttttattgataccatctgattctactttggtcctgtagcagtttctgccactttgtcaccagtggggggaatatgctgttaccataatggaaaaggaggacatttggtagcatttttctgtgtttatgtcaggagtcgtctaaaatggtcattttttttttttttaagaaaaacaacatatgcgtacaaagtaggtgtatatatttatggggtacatgcaatattttgatacagtcctacaatgcataataatcacatcaggataaatggggtatccatcaccttaagcctttataatttctttgtgttacaaacattccaattatacttttagttatttttacttatttatttattttgagacagggtctcatttggttacccaggctggagtgcagtgatgcaataatcatggttcactgcagccttgacctcctgggctcaggtgaccctcctgcttcagcttcctgagtcgctggaactacaggcgtgtgccaccatgccaggctaatttttaaagtttttgtacagatggagtgtcactatgttgcccagccgggtctcaagcgatccttccactttggtctcccaaaacattgctattacaggtgtgagtcattgtgccccactgacgagaggttcttcatatttcttttatatccactgccacaaaactgagtgcaattggtctattcagtcaggaagtcgcttacctttcatgtgcttccctattacctgggcatatttccagggggtttcagaggaagaagtagctctttcctatgaggatatatgctggttctgaagtgtttacttagatgcatagtggaagctcaaaaaatatttactgaactcactcttgtggtttagctttcaactataaacataggaataaagggagaaaaaagcatgaaaaactagaagctgaaagccaggcaggaagagaatggatctagaaagaagtaggaagtccatttgctcagaggaaggatacccactcaccaatgggaaataggtccagtgttgtgtggtagggttgtgggtagtagtagtaatttcacaatgggtgtgggaggttggtgagtagatggactagattcaaaagtagatacctcgctctcacctatagcctagcagtttgggaggccgagacaggaggatcgcttgagcccagaagtttgagattagcctggccaacatggcaaaactccatctctacaaaaaatacaaaaattacccaggcgcggtggtggagtgcctgtaatcccagctactccgggggttgctgtggtggaggatcacttgagcctgggagttcaaggctgcagccagccaagattgcaccactgcactccagcctgggtaacagagcgaggccctgtctccaaaaaagaaaaagaaaaagaaagaaagtagatagtgatgaagctggatagttaaaacagaaacttgaaaagcaagatgtggaactgggatataggatttcagagtttaaaagaaatgtgacatttcttagtggattgtccttcagttgtgtttactaagcaactgtcagctagtgagattactgtgtatggccaatccagataaataagacgatcaagtctttatgaaaaggaaagaaaaatttggaatgcacatctctgtccagctcaattcctcactccttttttaagatggagagctgttaggtttgtctacacagtaggaaacacctgattaaataacagcatggagccaatcttgacaaagaaattggctgcatccaatagaatcccagggccggtcgtggtggctcatgcctgtaatcccaacactttgggcggccgaggtgggaggatcacttgagctttggtctcagggctttgagaccagcctggacagcatagtgagacctcgtctctaaaaaattaaattaaaaaaaaaaatagagcgccagcaaagtcaattcctgaactctcttctgttcagtagtagcaaaaatgcctgatctaagtgatggggaaagttagtttatgtggctgtagcatcagacacatcactgacaatcctgctgtggatttatagcacaggggacactacatctagaaacacctgtctgtggactgctgctgctgtcaggttagtaatctgtgtattctaatgagaatggacgtggcctccctagtgtcagccacataatggaaatcctagatcagcatgcttacttcttcccatctaattgcaagttgtaatttgtaaataatgggtttactttttaattttgagaaggtaaatgtgttgctgtacaaaagcccaggattccttcccgttaaatcggcagcattcttggacacagtaaatcctatcacacacttttgtctcacaaaagaagtagcggcagttagaagactttgaattctcccttacccgtgactttgagcaagtgatttaacctctcagacaacacagttcctcatttgcaaaatggaaataatgtctacattatctatttctactcacagagttgttttaggacacaaaatggtaaaggaaggaaaagctaagttactgcaacatggtaggatacttttgcttttaaatttaatttatacgcatcccaatttttatctagaacctagatttcaggctaaagaagagagccgttgggcttcattccacttgtagtagcctcacgttacccttactgtgaaattagtctttgtttcctttcatctcttttgaatatcacccttgccctgcaataataaaagagagctgcatgcagtgaaatcaaaccatgaaattatagaattgtagagccagaactagctacatataaacagaaaagaaaatttgattgaaacattaataattttcatcaaggtgaaaatgactgacaggtattactttaacagagttatttatactttttaaagatgtgctactgacctgttaacctaatgaaatttagatggtggaagggatataagttgttgaaaatttgggattcatttctttccatcttagtatttttggagtggtagagtgctgtgtctacatacctttgtaataaaaaacaatttggggctggtgttgataatcaagttgattgcgatctctaggagaggagagtctatctgatctttttcttgccgtttgtatatattgttctacctctcccatctcatctgaaatatggggcagtttcttggttctcagttgtttcttttctgatatgttgctgacctctgatttctcatatcagtgctcttcccttagttcaaagatgtttccccagttgtagatgggggttggaaaaggaaggtgcttgtgatttaaaagccctgtcacttactgtgtccataatatagtgagtccacctgtggactgagcaaggctgctgtcacatctttcaaggttttcctcattgatcctacatcggtttagcaaaattcttctgtaaaaggctagatagtaaatattttaggctttgtggaccatacagtctctgtcacagctactcaactctgccattgtagcatgaaatcacgtggctgtcttctaataaaacttggtttacaaaaacaatcagactgggcgtcgtggctcacacctgtaatctcagcactgtgggaggacgacacaggaggattgcttgagcccaggagttcgagagcagcatgggcaacgtagggagactccatctccgcagatttttaaaaagttagctgggcgtgatggtgcatgcctgtggtcccagctacctgcaggggctgaggcaggaggatcgtctgaggttgggaggtcaaagttgcagtgagccatgattgcaccactgcacttcagcctaggtgacagagcaagactcggtctcaaaaaaccaacacaaataaataaaaattaaaaataatcattgagccagatttggctcacgggctgtagtttgctgactcctgttctacatgattttcataaaggtgggacaggtgcacttataatattaaatggaatggagggtgctattgtaaatacctgcaagttgaatcaaggatagctttttaaagcagtttgcttagaaatttacctacaaaagactattattacagtacctccctgtgccatgtacctatagattgacttaggcaaaaacctgacaacagaccttgggaatatttggggatatttactttttcaagtaattgagttatacgtactttgcctgccactttttacattgcattgccaatttaagttaacatcaccgacctaatgtcagcaatgttccactcttaaagctggaaactggattcgagggtgagcaaggaaggatgaggagagggaagtttaccttaaatgatccttgaagtcaacattaggtaccttgagaatgccttgctgcttgattttaagatcttcaattacagcactttgattcttaaccttaaaaaaattctccttcagccatttcaagccatgtggaatatctcttactgcttaggaatttgctgtggtttttcattgaccgtggccccagactctggaatatgtattaatttatctgggcagagaatacagaaatccacatgcagaataaagtgaactttatgctgaagcagaatattgaagctgggaatggttaattcttaaaaaataaagcatcagcgttaataaatattgaattctaagaaggtattttgcagtttgcttcttaaagtactgagataatctgactgggttcccatttaaaagagagaagttttttccctccatgaataatattcgtttacagtcattggtaaattattaatctgcattccagtgtttcatgtttgaaataccagtccgccctgtccatggggatttgatctcacgctgtaatcagcaaagggttctgggaagtgagaatagctgtggtttgctcttttaaagaccttaggagagaatcaaaaagtggtggttattcaggaagttggcctgtccagcatttgacggctggcagttttcatatggagtcatatgagaccatgaacttggaaggcacactagactgtgggaaagtttgggtgggctgctcaccaccctgtgattttcagaggtcctagaatgttctttagagtattcctgcagtttttgaatggatgtcaaatctcttttggtttggggctacccgaaatgtttacattctgagtcgttggtccattttcctccaacaatgcacatttaggattgctattgggtacctaatgaactggattgatcataagattctcaggatctctggccccagctcgacaccactttctagctatggcacgttaggtaagtcctttaaccactctgactctcacactgaatataggttagaacagtatctacgtcatagtgttgcttgaggattaagaggaataattcatgggacttggcatgagtctttactagattgtaagctccatggaggagctgtcttcccagtgcctccagcagtgtctggcatatagtgaggagctcaacacacatttgttaaattaacagtaagcattcagtcaatgttaattgttactgttgtcatgaataatattctcattattacttacattacccattttgagtcctccgtaccttctgttgataacagtcatcttcgtgaagcagctatggtgtcattgataggatgctgagttcaaattctaaccctgtcctgattagctgtgggcaaagtttcttaacctctctgaactagtttccttgtctgtaaattgtgatgataatgccctcccacagagtctaagagggtaacacacccctgccttagttttctcaaacgtatgggtagaagtagccctgggacctactcacttaccagtgtcttagatttttcacatgccctaaatgcttaactctataggccttgcatgctccacaccagagtcttctacagattgcccaatatattgagggctgatgaggtcccctccacacagaacagctatgtgtagcaggttgatcaaaacatctgtattctgatcagggtcatctctgcacagctggagttgtgtatgtcctttaagtttctataactggtcattataaaatactaagtatagtaatactaatttatgaatttatgtctcatgaaatgaagagataccaacaacacaactggggtttcatagaggttgtaaaaatgaactttttggcccctctcccagtaccaagcgtgtattgggagaggggccagaaagttcattgtctggtcaatttgccaccccaatgaaggtgggttccttttcagaagtcttgaaggtttgagcctggcaatggatcaagttctctttcctcctgcagaatctctcttctggtccacactctgggaggtagacgggactaagcagaaggtcacttccccagtgcaagaaaatgtactactccactctcacattctacctttggtttgagcaaaggccacattttgcaagcccgtttgctgcccagttaatctgtcagggtgaactttctctcaccctctgctgacacctctgccacccagccccatctcctttgagagggggaacccccccaccatggagctttgtgttttcctccacttcctccttttagcagggtaagcctccacacttctgcccaggctgttgggcccaccatctcctcttttaacacagcttccgaagtgctggggatggagagggtgtcaatgtggcaaacgttcctttgcccactgatgagaagtttcagcccttcccaagacatgtctggaaatggcagtccaccctggcctttccttaacttcactccatccctcagccccttcatgtacaagttgtcagcacatcttgttatttctgcttataaaaatacatcgaatctgacagctttgccccactctatagctgccctcctaattcagcgagctggagaggcaattctcggtcaggatgatttaggatattcctaactggtctctctgccatcccactataccctcctgcactgtccacttaacagtgatgtttaaaaagtaaataaatggctgggcgtgctggctcatacctgcaatcccaatacttttggaggcagaggaaggagaattgcttaaggccaggagtttgagacaagcctgggaaacatagggagaccccatgtctataaataataataataataaaaatagccagatgtggtgatgcacacttgtggtcccagctactcaggaggctgaagtgagaggattgcttgagcctgggaggtcgaggctggcactgcactccagcctgggtgatagagtgagaccccatctctgaaataaaaaaaaaaaaagaaaaatgtacaaagtgccttttaaaaagcaggtatatggagatgtaagcaggcatcaaggctagcagtgcccagcggtgagccacggctgcactggtgggtccatgggaatagaaagcaaagtcttgggtccacacaaggtggaggattacatgggagactcctgcatggaggtgtgcactctgtggaagagtcaagtgagaaaacgccttacccataaagggagatggtatcattacctcttcagttctctttccctactgcaaccccacccgaaaagccccacctaggttccagttcctctgggtgcaggtgcctgattgcctgaagcctggtgctcaggattgtcctacattctccccactgttccctgagtggttccctgacttgctgttttataaaacctttttacatacagtagagtcgggggcagggggcaggtcttggtcactcagcccataagaggtagactctgaacaggtcgctttcgagttgtgtttccaatgtcctttttaccatattgacaaagggaagaatttatgtaggaatacatcatctttaattaaagcatagctataaattatgcaagtagcagtacatattttaacacaaaagcaaggttcatagacaaaaatggaatggtaaaatcatgaaaatgtaaatctcttggttaggagacatttaggctcaaaataataattaaaaaatcaacagttatcacgtgtcgatacgacattgaaaaacatcttgtgattttaaattgaaaaatgggttcagactgaccacccaaataatcctttttttgagatggagtcttgctctgtcgccaggctggagtgcagtggcgcagtctcggctcactgcagcctccacctcccaggttcaagcaattcccgtgcctcagcctcctgagtagctgggattataggcatgctccaccacacctggctaatttttttttttgtattttagtacagatggggtttcaccatgttggccaggatggtctcgatctcctgacctcgtcttctgcctgcctcggcctcccaaagtgctggaattacgggcgtgagccaccatgcccgtcccacccaattctactgtgcgcttttccagagaagtgtgaattatttgtgtcttcagggaaatacatagctgtctgggttttttttttttctgttttgtttttcctttaagcatctgataatacaaatgtactcaaatggaagaggaactgaacctttgagtttaatgagagttttggtgtttaaagaattcaggatcatgaagaatgtgtggtgacttccctcttcctattcccattactttaaatgtcgtagctgttgctttttgtgctttgggaagattcttgatgcctccacattctgattcactggacagccctgattataggccatgggggttagagctggaagggtctgtgggagtcaatccatgtcccgcatttgacaggtcagacactgaaaaacagatattgagagctcaaggacttgcgtgggctgacattgagcactacagatgccatggaaatggacacctgctcctgtgctcaccaagcacagcagtattcccccagcctgggccagtggatggaggaattaatggtttaatcttaactaatttaattttaaaaagataatgaagaaatgctaaattaatttttaaaaatcttagtattccttcatggaaaaaagctaacaaaatgattggacatgtatacattttagtgtttattgtttaaaagatgtgttattggattgcactatcaaactccataaaatctggagttgaaataaataaataatctcaacctgtggtgcagttaggtgctggtcagctgatgtcacagcctactgactgggactcattgtgcacgaatttaagtcctttagtcaagctgtgatcacttccacgaaatccctggttatgtcatttggagatcttttatcccctaactaaaaaggacaattggccgggcactgtggctcacacctgtaatcacagcactttgggaggccaaggtaggtggatcaacgagttcaagagatggagaccatcctggccaacatggtgaaaccctctctctactaaaaatacaacaattagctgggcatggtgacgggcgcctgtagtcacagctcctcggaagggctgaggcaggagaatcgcttgaacccaggaggtggaggttgcagtgagctgagattgtgccactgcactccagcctggcgatagagcgagattctgtcccagaaataaaaaaaaaaaagaaaaggaaattgaattcatttaaattgttaaaccctactgaagggaagatagttcttcagtcaaaaggcttttttttttttttttctaaaaagccttagagtgctaaaagtaaaaacaaatccagctattacttgaagttttgtaaatgggaaatgtacttgtagttgagactatctggatttttctttgtgtcttaattactccctgatagaagcaaggcctttaggagtcttttaatgtctttaggacataaggctcaattttactcctcaggtcccctcagtctgaaagaagcaggtgcagcacttgagcattcatccaaccaataattctcaggctctgctgtatgctgccctctgtgggggggggcttgggatggggataaatacggcgagacacagctctttctcccacctgggtttcagggagaagaatgtcaccttgaacttgaggagctctatctggcagcatctctgaggtgtgcttcttctctaccttttcctccccttgaaccaacccagatactctagcatccccgatgctccccagaacatgcccaactccaaagacagcctgatttttttcttttaaaacccagacccagaagcaggtcattttggggtggtttagcacaaggctctccacagacttgtgttgctcataggcgaggggtggccccctttccgatagtgtcattgattttcttttggatattctccctttttttttaatttgaaaacatattctctcttaacggatgtgactgatgcttgcacttttggatgcttgcagacctaggacactgcagaatagaattaattggagtctgggttttctaacagtttagatgtcattcactgcctcactgcccacacggatatatgtacttgtctcacgttctgtcggctgagccttcttttcttacttatgatttgtggccaaagtgggtcctgttcttgagaactgagggcacaagggaggatccctcactttgcccagattagatcttgaatctcagctctctcgaggattccgtttttgtttttttttttcctgcctttggtggctttctcaccatggagctggagaagtcactgtgggctcatgaagggtctttgctgcttcaaactcagaacacacatcccgcaagctctagtaataatataaggtgacagccccccaggggctcttatgggcagccagacccctctctggctgcaccctttgtcccaagcctgctattttcccttaacttccaggtcctcctcccctccagtgtgctggggccctgtagcacacagcaacatcagtgcagtcatcagacaaatgcacacagccgttctccaaatcacccttaattttttttttttcttttttgaggcggagtctcattctgtcacccaggctggagtgcagtggtgcgatctcggcttcttgtaagctccacctcccggggtcatgccattctcctgcctcagcctcccgagtagctgggactgcaagcgcccaccaccgtgcctggctatttttttgtgtgtatttttagtagagacggggtttcaccatgttaaccaggatggtctcgatctcctgaccttgccatctcccacctcggcctcccaaagtgctaggattacaggtgtgagccactgtgcctggcccatatcacccttaattttaaatctgaatgtcaattcccttgttgaaattgtttatgtttcatgttcagaaattaccatatttcatcaaaaccattggtttagtttggttttaggaacagatgtttcttttctgtcaatcttatttccatttttggttgccattgatatttcaaaaggcaccttttttttttttttttttttttgtgatggggtcttgctctgtcgcccaggctggagtgcagtggtgcgatctcggctcactgcaagctctgcctcctgggttcacaccattctcctgcctcagcctcctgagtagctgggactacaggtgcccaccaccataccaggctatttttttttttttttgtatttttagtagagacggagtttcaccgtgttagccaggatggtcttgatctcctgacctcgtgatccgcccacctcgtcctcccaaagtgctggaattgtaggcgtaagccaccgtgcccggccagaaagcaccatttcttatatacctttaaaaaagaaaaatattgctaactaaattaagacatgtcttctgttgtaagacatattctggtttaagatatgttaaatggaaaaaaaacaaacaaactcaaaacccatgtacctttttctttttcccaatgtgctttttagaatcaatacaatctgtgtcaggactctattagatttcactttccctctgacagagccacttatgcttttgaaatagccaggtaagcaggacaatttcctttcagcccatctctggctctcatggcttccttcttacacatgctaggtaagcactttgaacttgaaaaacacttgactaaacactcatatgatctggattgtttaaccacaaaagatttggtcttctctagtgaaaaatgctgtgggtttcttttttacctttaattttacttttcaagttaaaaaatagcttttaaggtcaaaattttcagagcaatttgtaagtatagatacagtttcatggtgacagtttcttatgttgaaaaggtgacacaaaacacattatcttttactttagattcaaggggtacatgtgcagatttgttacttgggtatattgcgtgatgctgaggtttggggtactgtcatccaggtactgagcataatacccaatagttagtttttcttttctttctattttttttttttttaatttttgagacagagtcttactctgttgcccgggctggagtgcagtggtgtgaacttggctcactgcaacctccacctcccaggtccaaacaattatcctgcctcagccttccaagtagctgggattacaggtgcccgccaccacacccagctatttttttcgtacttttgtaaagttggggttttgccatgttggccaggctagtctccaattcctgacctcaggtggtctgcctgccttggcctccccaaagtgctgggattacaggcacctgccactgcaccctgccagtttttcttttcttttctttttttgagccagggtctcactctgtcacccaggctggagtgcagtggtgtgatctcggctcaacctcctgggctcaagagattctcccaggtcagcctcccacatagccttctggcaaatttttgtattttttgtagatatggggtataactagtttttcagttcttacccacctccctctctcctgcctctagtagtccccatgtctattggtgccatctttatgtccatgagtacccaatgtttagctcccacttttaagtgagaacatagggtatttgaatttctgttcctgcattaatttgcttatgataatagcccccagtttcatccatgttgcttcaaaggacatgatttcgctcttctttatggctgcatagtactccatggtatatatgtaccacatttcctttatccaattcactgttgatgggcacctaggttgattccatgtctttgctattgtgaatagtgctgtggtaaacatacaagtacatgtgtcgttttggtagaacaatttattttcttttcgatgtatacccagtaatgggattgctgagttgaatgatagttctgttttaggttctttgagaaatctcccagctgctttccacagtgactgaactaacttacactcccacctacagtgtgtaattgttctcttttctcctcagccttaccaccatctgttgttttttgactttctaataaccattctgactggtgtgagattgtatctcattgtggttttgatttgtatttctatgataattagtgatgttgagcattttttcatttttttaacagtttgtacgtcttgtttggagaagtatctgttcatgtcttttggccattttttaatgggattgtttgtttttttgcttgttcaattgttaaaagttccttaaggattctggatattagacttctgtcagatgcatagtttgtgaatattttctcctattctgtaggttgtctttttactttgttaatagtttcttctgctgtacagaagctctttagtttaatcaggttccacctgtcaatttttgtttttgttgcagttgttttgaggacttaatcatagattcttttccaagattgatatccagagtggtgtttcctaggttgtcttctattattcttatagtttgaggtcttacatttaaatctttaatccatcttgggttaatttttgtatgtggtgaaaggtagggtcaagttttattcttctgcatatggctagccaagcaccctagcaccatttattgaataggaagttctttccacattgcttatttttgtcaactttgttgaagatcagatggttataggtgtacagctttatttctgggttctctgttgaacagaacagagaacagaatattggtcaatgtgtctatttttgtactagtaccatgctgttttggttattgtacccttatactatagtttaaagtcagttaatgtgatgtctctggctttattcttttttgcttaggattgcttttgtatttgggcccttttttggtttcataggaattttggaatagttttttttagttatgtgaaaaatgacgttggttgtttgatagaaatagcatagaatctgtagattgctttgggcagtatggccattttaacgatattgattcttccaatggatgagcatggaatgttttttccattcgtttgtgtcatctgtgatttctttcaacagtgttttgtagttcttatagttgtctttcacctccttggttagatgtattcctaagtattttagtttttttgctattgtcaatgggattgcattcttgatttggctcacaacttgaatgtcattggtgtatagaaatgctactgatttctgtatgctgatattgtatcgtgaacttcactgaagtcacttgtcagttcgaggtggaggagtctctagggtgtttctttctttgtttgtttgtttgctttgagacggagttttgctcttgttgcccaggctggagtgcaatggcatggtctcggctcactgcaacctctgcctctgtgttcaagtgattctcctgcctcaacctcctgagtagctgggattacaggcatatgccaccatgcccggctaattttttatttttagtagagatagggtttatccatattggtcaggctggtctcaaactcctgacctcaggtgatccgcatgcctcggcctctcaaagtgctgggatcacaggcatgaacccccgtgcctggctgtctctggggttttctaggtgcagaatcataacatcagccaaaaaaaaaaaaaaaaaaaaaaaaaaaaaaaaaggtagtttgacttcttttcctatcttggtgccttttctttctttctcttgcctgatagctctggctaaaacttccaagcctgcttatttttgagcagctaaacttactagaaatgtcagggcaattgcattattttataataattataaaatatgcatttattttcttttcaaggtagaatacagaaaagttattacagaaacttcatgtttgaactaaattttctttttttcgttttttcagatggagacttgctctgttgcccaggctagagtgcagtggcacgatctcagctcactgcaacctccggcttctgggttcaagcagttctcctgcctcagcctcccaagtagctgggattacaggtgcctgtcaccatgccaggcttttttttgtatttttggtaaagatggggtttcaccatgttggccaggctggtttcaaactcctgacctcaagtgatccacctgccttgacctcccaaagtgctaggattacaggcatgagccaccacacccagccactaaaatatattttaaaatgacacttacccattcatactggttctgcttctctagcatgagccagtcatgcaagtcttcttaacccactgtcatgtcttctctgaggcttaaaatgcccagtttctataagacaggaagtcagatagacctgggttcaagtccagctttgcaatttactcttcgtgtaatcttgagtgactttctcattttcctcatctttaaaatggggataataacaacatctgtctcaaagagttttgtgaggattaaattaattggtgcacgtgaagtccttagtacactgcctggcaaacagtaagtactcaataaatgttagtatttttagtcaacattctggtaggcttctactactctctacccccaaactgcagtaaaacaaaaacatcttcctcttttgtaacttccaaatgtctatgactggcaatgcaagtcttctagactaataattttgaaatcttttttgttttttggttttaatctcttgtatgattttcatgtctgatcagttatcaagtctaccatcctttagtcctccagttctcatgaccacttgctttgacaattataaaaaccactacctagtttgttgtgtctagcatttccaggacagtgtggtgggaaaagcaggggctttcatggtagtctccgttgggctcaattctattgcatacaggagtgtatgggcaagacattgaagcatttcgagacttagttccagcactaggaagatgggacctccatgtctgcctcttctagagtgattgttgggtaatgaggtaggattgtaagataatggctggagaggcctgggtataccagaggcattcattaaatgccatttatcttccatttcccctctggttcgtcctacatgtggtgaccacatgcactcatgaaatcgcaattgtaattacacagtgtcttgattaaatatcctcagtgactccccatttactgtttaggcagatctaaactcttctgccccactgaactagagaaccaggctgaatgcgtttgaattctggctctatgacttactagctaccttgaaacaaatttcataaccttctacctcagtttccacatctgtagaatggaagtgacaataattgtgcctgccttatgaggttatgtagctcaattgtaaatattgaattagcccacatgaaggacttagaaaagttcctgactgtttcacgccctcgctctgtcacaccagcattctctccatctcttcttccattgctcatctttagcacccctaggccctgacaagccagaaaatttgttctcctaaatctgtcccccagttctgcctccctttcttacacagggtttactgttccgaagaacagaaattccacctgtacccagactttcacactaatatggggcagtcctgaaactgaaactatcagcactgcccctctgataacagtttgtatagtcatcctaggtttggcctgagtggtcatcttgcatatgctaccacaagagccttctttatggaggtctcttgttgctgctgtcttcccaaatcactttctctgttgcgttgcccttagtgattgtgagtttagagtttaccctaagcatcctacatgttatcatgactcatgccagattaaattctacttagttaccagcttttggcaccttgttccaggtttctttagggaggagggagaaaagggtatgtcttagcatacacagctcttatcagactgttagcattgcttgtttacttctgtgtttgccttattggactgtaagctctatgagggcaggtaatgtgtgtgccttgttcatctctatctgccaacttatagcaaagtatctggaccattaattggcattcaatatttatcgagtagatggatggatgatagatagacggataaagattggaatgtacatgccccttttggcatatacaaacatcaggtgaacttttttctctgcctagggaggaagctattcctagcaagaagacaacttaatactctagattattcctgggctactgaggttactaaataagagcatcttatttagctctgctgctgataagaccatgggaagttatttacatttaggagtggtatcttactaataccaactttcacaggtacttgggtggattccagatttatttccctgctatagttgcattatttgctttgtatgatatcttccttacaaagcacagtgttttcatagaaatattttgaaagacttgctaacggatcctgtagacctcacataaatcctctgtgaagttcgctatggaaagcaagaggattgatgtctaatccgtacatgacaagataaattttataattgaaagaccagtttatatgggcaagaagtgatcagacttccgaaaaataaaaaataaataatgtaggaaagacaaatgtaaaaaagcgtatgcagttatttggtcttaatatcagaattctttctggcttttattcatttccattcgttttctttctttctcttctctctataatactgctataatagtgactgctgggaagaaagagtgctgcccacaaatttttttggcagacttgggtatgagttaattagcattttggcctccagtctggagagcagaccctattctctttgtaatgggtgccggcaaggaagcttttcaaagccaagggaaaaatggcatccactctgctgtcaaggacttttatgagggtcaagtggtattggcaagaattcaggccagaatgatttggcttcagcaaagaaagccacagcccttgtgacaggttagattagccataaacctggatacactaaattcttcagatggtgagagattgttgcactctggcccaagaatttcttgtatgctttttcggtttttgcaagtggaggtttgatggtttgacagctgccctttccttacttgctctgtctcctgctgctcaggctccttctcagaatcaccacgagccaaaccactctggtacttgttggcccacgggtgcctcagtgcaaaagtattcctcagtgtctacaaaatgttacaaaaacgtgtctgagtaagctgatggatcgcagcttatttgtcactgagaaagttcaagttagtgctctaattccacctttgcaagtttttatgctaagcctcagacaaatataaacaccaatcttaatctaagtgtgcttattttaatatttttattaacagcaacagcagcagcattggggcattatttccaaaggcaaagaattcaaggaagaggttaatgtgatcattttaactaatcattgcacatacaagagctcattcaatcttcctcacagtctgatgaagtgatataagtatcatgtctgttttacaaatgaggaaactgaggcacagagaggttaagtaacttacccagtgttatttcttggcagatcagaactagactttttttttttttttttaatttttagttctagggtacatgtgcaagatgtacaggtttgttacataggtaaacgtgtgccatagtggtttgcttcacctatcaacccatcacctaggtattaagcccagcatgcattagctatttttcctaatactctcccccgcccaccctaactagtagacctttcgtaagaccccttccagttctgagattaaaatgttttatgtggatggggatggcaatcaggtcaaaacatgtagccaaagaagtgagtgggagagaaacaggtaggagttgtgtactagttaaggcttttgggggcacatgtaatggaagctattgtttaggcaacacagagaacttacttaaaaaaatcatggtctgttgcctcacaacatccaaggaaggggagaagccagatagcttcaaaaagctcaagtaaaggagactttgggtctcctctccccatcagaagctgtaagctggtggcccccaggctccatgaggcctggagatgtatttatttggcccatacgtttattaaaaattgagctggtgcttaaaaatcaaaaggttactcatggaaatccagatttccagcttctctagaaaaatcagaccaggcaaccttgaggcctcattccccctgccaccccgcctgtggtaacaattggctggagctagatggaagctgcctcctcctcagcccctctacctccagcagtcacctaagccagggttttacaacattgacactactgacattttaggccagagagttatttgttgtggaggtttgtcctgtgcacaggaggatgtttagctacatccctggtatccactcactagataccagtagtaccccctcctcagtctgaccaccaagaatgaatccatattctgccaaatgtcctctggggagcagagctgccccggagtgaaaatcactgggttgtataatgagcctaagccactgaccactcagtccctaaatctttccattataccatttctgggagtgagatcacttggtctggcttgggtcagaggccttctcctgtgaccaggtggcagggtggcattaaccatcatggctgctacctcctgcagagagggaatcagggcaggcaactcaataggtatccctcacagtatgtgggaaggagggatgcaaaagacactgtgtgaaaacaagagagtccaggaataactatcaatagtataacaatcttcacttcccagaagttctttgaatctgttttctcaagtttattctctccagcattgtgtgaaatagttaaggcacagagttgtcattcatattcaggggatggggaaactagggtgcacagaatggtttaagtggctgcctaagtgcacatagcgaggtagagaaaggattctggagcccacctctgcccctctggctacccctaaaatgacagtcctctgtaacatactctgccctgtctagtccagggagattgaggaagaaaagcaacaccggccatcatcagactcagcccaggcctgaaagcatgaatgatgcagtcacttgtgtttgcagagcaggtttagctggcaggaggccacgctgtctaactcctgttccagtcagtctgggcgtaacccagccattatggtctctctcaggtttcgaatgcacaggagcaattaagtcattctcataatttcatgtggtacagaaagtcccaagccaaaaataccatccttggttcctacttttagacttccagggaacttccccctccctctctccctataattcactttgattccttctatttttctcttcgtgaatgcattggccagacacagagtcctagtttacttaacaaggggctacagagccaacacaaatcaaaataaatccagccttcatttggcaggaatggtggaagttgggaattgctggaggttctcagaaacaagagcttgaaataaaagagcatgtaccctcatctctaggatgtgagcataggagataggagaacatgccacagaatgatcactgaaagatgatggagtgttggaggtggggcgggggtggggtagttgcatctgtactcccattattatttcagggtcctagataaccacaattaagtcactttatcgttagtacagaagatttcttgtcccatagaaccatgacatcagacctgtgttgcttccttaaataatgaatttttccaaatatccttcagatgcgtattaacagttgcttcctggcagtcaggtggctgatttggtctgtgtgtgtgttgggggatacatatgtccatatactgactctcccttcatgtggacccccatttgggttatatcaagagctaaatgaaatctagttggagatgatttcaatgtttcttctgtaggaatagataattacaaacttatttataagtcttctcactaaagcagtggttctcaaaagccttagccagcaccagaatctacgggaggacttgttaaagcacagattgctgggccccacccccatgcccagagcatctcatttagcaggtttagggtggggcccaagatgttgcagtgcaatggcgtgatctccgcctcccgggttcaagcgactctcctgcctcagcttcctgattagctgtgactacaggtggcatgccaccatgcccggctaattttttgtattattattattattattattatttttagtagagtcggggtttcattgtgttagccagatggtctcgatctccagacctcatgatctacctgcctcggcttcccaaagtgctgggattacaaggcatgagccactgcgcccagccaagactttgtatttctaacaagtttcctggtgttgctgatgctgctggtttgggggccccattttgtgaactagcatgatcaaggatggtgttctcgcctaatcccagcactttgggaggctgaggcaggaggatcgcttgagcccaggagtttgaagctgcagggagctatgatgccattgtaacagccagggtgacggagcaagattctgtctcttaaaaaacaaagaatggtgctctaaacgcaaggtttttcacagcagtagtgacagctgctcctttatgcttctgtttcttcatttgtgttgtccctggaaagtccccctcgtcccagtggctgagtcctctgcttcctccaggctcggcccaagttcctgttcctccacggaacctttcctgactagtgcacacgatcttttctcttctctgaactctttcagttgtaaaaatgaaaccctaaaatttcttttgttgccttgtagtatgctcagattgatgcatgataattgttttcccaactagactgaactgatttgatttgtgaacacgatcatcccttagatgctcttatgtgtgttcttgaacttagcacagagccaagcacaggactcaattatttattttgtgatgaaagttcaaagtgaattaagagagaaaatatattgctgagtgttgtagtccatttggtttgctatagctgaataccacagactgggtaatttataatgaaaaggaattttatttctcctggtcctggaggctgggaagttcatgatcgaggggctgcatctagtgagggccttcttgctgcttcaacacggcagaaagcaacatatggcaagtgcgtgcacgagaaagagtgagaaagtgtgtgagagatagcaagacagggccacactcacttttaaaacaaacccactcccacaataacagcatccatttatttatgagggcagagtcctcatgacctagtcacttcttaaaggttccccctttttctaccttcagcactgtcgcattggggattgagttttcagcacatgaactttggaagacacgtttaaatcataacgttgcctataacaccaactgggcttgcctgatatatagtgccagagatacccaccaaattaagctttatggttcttatatggtaaactcatgtgatttctgtgcccaaagctgcaggtccttctgcctgcttcagaactgcccaaacttctggtcttctagagcaggggtccccaacccctgggcaatacggtccgtggcctgttaggaactgggatgcacagcaggaagtaagcatgcatgagtgagcattactgtctgagctctgcctcctgtcagatcagtggcggcattagattctcataggagcccgaaccctgttatgaactgcgcatgtgagggacctaggtgacgtgttccttattagaatctaatgcctgatgatgtgaggtggaacggtttcaacnnnnnnnnnnnnnnnnnnnnnnnnnnnnnnnnnnnnnnnnnnnnnnnnnnnnnnnnnnnnnnnnnnnnnnnnnnnnnnagtaagactctgtctcaataattaaaaaaaaaaaacatagaaaggttcccactccctatgactgtcatggaaaaattgtcttccacaaaacctgtccctggtgtcaaaaacgttggagactgctgttctagagtaaggaccttgtggttttgctcgttatgatggacatccagggccaccctggatggttgccttgaccatgcctgttgtctactgtgcatgagaatcagttgctggactccagggcagagtgatggctggaggtcagcatgcaggcagggaagtggagggggaagatgatcatgagtacatgagtacgtgggacaggcaggttggggccagacttgagagggcttacatggcacactaagggcttgcttggaatttgtcctacagaaagtggaggtttttaacaaaatcacatttgttctttagaaccataattctgagaccactagcttcttacagagtatatatacgaaactaccaaaggcaacttggtgaagcagaggaatttgggcacgaaggcttgtttcatcttggtggtcagcccttcccacctttctttagatactataattcatttcctagggctgccttaacaaattgctatgaactggtggcttaaaacaacagaaatgtgttctcacaattccgaaggctaggattcaaaatcagcatgggcatcaggaccatgctccttccgaaggttggggagattctgttccatgcttttgctcagcttctagtgttgctggccagccttggcattccttggcttgtggctgtgtcgccccaatctctgcctccatcatcacatgaccttctccctgtgtctgtttctgtgtctcttctcttctttaaggacgtgagttatcttggattaaggcccgctttgctgacttcgtcttaacttgattctatccgcaaagactatttccaaattaggtcacattcacagatactgtggcctaggacttcaacatgtcttttttggaggcaacacagtgcaacccacaacagatacacacttcgctgcaccttatcattttaggactcaagggggcagtgggtttgctgccacactcaagctggtcaacttggcagtgtcatgtgttcttggtgagcgctaggaagctgcctggacctagagtaagtaatactagcagctcacttaagtaattatgaagggaaggtgcacaggacctaagcagcaggctgtggagaactgaccaaaaagacgagttagggcgctattgcaggtgagaaataaggggaccttaagtaaggcagtggctgtgagaacagagaggaaaggggagtagtcgaggggtgggtctgaaggagaaccactaagatctgatgtagtgggaggaaggatcaagggtgattcttagcctatttacaaatgtggtgggtggggtatataatccctatcagtatatacgaaggcctatccagacaagcttctctttgactctacccacttaagttatgctttatgtgctgccaagaagggtaaaaaggtgaaaatgatatggaagaaaccgaagggcaaccttagaaatgcatgtgaataaagatattttaaaggcagaaagacacacatttggcctttttgggaagatttctctaaacggagtgtagatgtctcagggaatggcagctactgccatactgagtggacttctcacaaggcggttctagggccgtcgtccagcctgagaatacacagctggctgacctccagggagactcaaaaattcttagtgaacctgtgttgcaggtcatggcatcaccatcatgatgtcctgttattcttcagtagcatttagtaaacagtttttgcatctgtttagtttacacagcaatcttggaacaatggaaaatcctttgacaagtcagaaaattcaagtcctgtttgttgttgttgttgttttagttgcttttttgggggttgtagtattgtgaggagacacttaacttatggaagcttcattttgttttcagtaaatggagcagcaacaccattcttatagcattactctgaggatagacatcagttaatgtatgtaaggtgccgggctcagagctagtgcatagtacacagtcatcccttttctccctccccatcaatcttccttctcttctttcttccaggtttttttcttttaatttatttttagagacaaggtctcactctgtcacccaggctggagtgcagtggtgtgatcatggcttactgtagcttccgaactcccaggctcaagctatcctcccacctcagcctcccaagtagctgggaccacaggcatgcgtcaccaagcccagctaatcgaacaggttttctgactctctgaggcccagagctctttctgcaattctgcctctctggggctaaaatataaatatataataaataaataataaacaaatccctctagaggattttttttttttttgagatggagttttgctcttgtcaccaggttgaagtgcaatggcacaattaccgctcactgtgacctccgtctcctgggttcaagcaattctgcctcagcctcccgagtagctgggattaggggcacctgccaccatgcccagctaatttttttttttttttgagatggtgtcttgctctgtcacccaggctggagagcagtggtgcaatgtcggctcactgcaacctccacctcccgggttcaagtgattctcctgcctcagcctcccatgtagctgggattacaggtgtgagcccccacacctggctaatttttgtatttttagtagagacggggttttgctatgttggccaggctggtttcgaactgctgacctcaggtgatccacccgccttggcctcccaaagtgctgggattacaggcgtgagccattgtgcccagcctaatgtttgtatttttagtagagatgaggtttcaccatgttggccatgctggtctcgaactcctgacctcaggcgatctgcccccctcagcctcccaaagtgctgggattacaggtgtgagccaccatgcccagcctattttttttttttttttttttttttttgagacagagtctcactctgtcacccaagctggagtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgccgttgcactccagcctgggcaacaagtagcgaaactccgtcttaaaaaaaccaaaaccaaaaacaaaaactaaactcattggaatcatttacaaataatatactcacccaaatagctagattaggggtcttagagtctatgaagcaaaccctgagagtgaaggtgggaaggaaatgtcagaattataagcaggattaacgtagattaaagttgacagaatctggttcttgctctgtccctttcccatggtggccagccccagctgcccagctgctgttgtctgtaagccaaagctcctgcgtgttctccttccaatagaaaacgactgtgcggaacctcatcctccccgggcccagggtgttggtgcagctgctgagggatctggtgaggtagcctatgctcatgtgccactggagatgcccggagagttccaatgcccaggccataccagcagctccctgggtgatgtccccttggacttagtttcactctgaagctgggaagcaatagcctacattttcagttaaataaaagctggaaatgatgatctcgttaggcctgcctcctgtacttcatgctttggtgctctccttcattttcctgccaggaagactttcccagtgcctctttctatatgcttgcatcccgttctcaagtctctgaccagcggttccactttgaagtccatcccacagaagtattagctcaaggctgcaaagatacaggaatgagaacgcttgctgcaacgctgctcataacagggagaccaggaaaataacccaaagggccattcacacaccaggtttttgagatgaatgacatcatgagcaactcatgagcatgagcaccaggcgtgcctcaccatcttggctccttgttgataacgtgtcagtccctaatatccagcctgactccaaggactgagatgatgagtgtgaaagtactttgtaaattgcaaatggttttgcaaacctaagggatatgatgaatcaacaatgagcaaagtcctttgagacctttcacaaataaaggcattttatatatttaaatccttggcactcacaaatttagcatttgaggttttgccaacctgtggagcaaccccatggcaatttgccatttagctgaggcatatattttcctccatccacaacctgagtatctcagacgaggatgaggagtgagtgaatgaaggagaaatgttaaaatatgattacattatagagtctttaaatgctcattaaaacatatattcgttcagtatcttttatgctttcattaatgtgccctaggctattgagaaagaaagagtaagacaaaaaggtgaaaactagaaatattctatgtaatggaaaagaccataaatatactcataaaacaattagtgagcacagaaatatacaatcaggtaatctataataatgtacatgtaataatctacaacagattttttcccttattttggattctgagaagtgagcactaacatattgcaaagggatttaattgcaaatgatttgtgtaaacctggtgccatagaaaaacttctggggttgaatttaattttatcgcatttaaatagaaaaatgcccacctgagaatatgcagctgtaattacgagggagttttattggttgttactgtggcatgtgtttatttctctcccacttaacattctggatggagggagttcaaggctgctgtgtagctctgcagttgtctggttttcctgctctgccatccttagggtatggccttggtctgtcctcatccttatgggcccccagtgaagctctgatcaagacctcctaattttgaatgtcctagaacttgaatacaccccttccacttatgtcacacggccacatctaaactacatggtaggctgggaatgaattttttattctgggtaactgtgtgtccaataaaaagcccgagattttataactcaaggaaaggaagcacagctcacaattgctgccacaggtcagcctctgtctgtccatgagccagttgttcagatgggaggaaatctgaatagaggaagagacaagtcaggcaagaaagttgtgactcagggtttatctcatctgctggggagttcaaggggcagtttaatactggctgtatttttcgtttctctaagtagaagtttcatttaagttactgtggagtaggctgggcgtggtggctcatggctgtaatcctagcactttgggaggctgaggtgggcggatcacttgagctcaggagttcgagaccagcctgggcaacatggcaaaactccatctctactaaaaatacaaaaaattagccgggcatggtggtgtgtgcttgtagtcccaactactcagaaggccgaggtgggaggattgcttgatcccgggaggcagaggttgcagtgagctgagatcatgccactgcactccaacctgggcgacagagtgaaaccccatctcgatagataaataaataataaataaattgtggaatgatcttctttgacattctgctagatatgaaggctgcttagaggcagttgtttgagaaagaaaaaagcaagccctgacctccaggaactggtgacagtggacgctatacaccactcgttcacagtgttgctcgacgctggtcaggtgctcacagctcggccatgttgtcttcctgttggccataagccgactcacagagcactgaccttggacaaggtcatggtgaaaccatggtaaatagagacaaagcaaagccacttcatatttttttctgagcacagacacaaaaaagtttcctgtaggacccataattttgattatgacagggtaaagacaagttccattttctaggatttgatttgagccaaggtcaatgaatagcttattttgtagcttaattgacaacagtaaatacttttgcagtcttaggtcccgcttgatctgtactagggagggtaatttgaaccaagagcctgattcccgggcatttctgccctaaccagatcacgggctaaggatgcaacagagcatagtttcagcagagcccccttgaaaaaaaagttatgctgaatccatgatgcaacatccatttgaaatgaggaaaaagaaggcaaagatgacatgatttattttgtgtcatacctaaataattagaagaaagcccctttttctagtagcacctataaaaatttcactgggctttggaggtctaaagggaaattctagcacatatttcagctccagttaatccaaggttaccatcatctcagttttgtgaagagatggaaagaagccaactgaaacagtagcgtaggaacccagccctgccttttgctttatatgtgaccttggccacgtacctgaccttcacctttctcatatagaaaaagaaaataggcgggccgcagtggctcacgcctgtaatcgcagcactgtgggaggccaaggcagatgactcacctgaggtcaggagtttgagaccagcttgaccaacatggtgaaacctcatctctactaaaaatacaaaaattagctaggcgtggcggtgtgtgcctgtaatcccagctactagagagactaacgcaggagaatcgcttgaacccaggaggcagaggttgcagtgagccaagattgcgccgttgcactccagcctgggtgacaagagcgaaactccctctaaaaaaaaaaaaaaaaaagaaagaaaagaaaatgaaaatagagacgcctgcctgatactcctccaggcatcactttaatgtgtatggaaactcttaactgtgaaaggccatatatccaggaaacgggccattatattcctgctgttgttgttaattttatcagaagagagtcctacactgccgactcagtagaacaagtagcttttgagcaatggttttgtgtgcagtcactgtgcctggtgttttgtgccaccgcctttccctgtcacatttgtgagccagggagaggggcaaatgcgagatgatcacacttcagtgccactactcgcagataccatctcgctgtgggattatgctgcttactccgaggagagatctggaaggcactgttgcctcttgcttttgcattttatgtatctatttatttatcttttttaatttcttcctttttatttatttctttctttatttttagacagagtctcactttattacccaggctggagtgcagtggtacggtctcggctcactgcaacttctgcccctcgggttcaagcaattctcctgcctcagcctcctcagtagctaggaaagggtctcactgtgttgcccaggctgaaggactatggcacaatcccgtctcactgcagcctcgacctcctggctcaggtgattctcccatctcaggctcccaagtagctagaactacaggcacatgccaccaccacacccggccaatttttgtatttttggtagagacagggtttcgccacgttgctcaggctggcttttgcattttagatgatggattttatcaagctgacatctaattctaacaatcaaatttagacttgatgagggtctgaagctgaagactttatttgcagcatggaactcacctgccaagctggcttctcaaaataccagccaggcattacattttcttctgtgtgggaaccagttaatatgtaggtggcttggagtgattctgaggggtattctcaccagacaacaactgaaagtttcctttctccactctagagatgccttggcctaagagattgtattcataggtgccctggtcaaaatgtccttctcccctgggcaggactggagacagctttaccagtccttaacttccaatgccatttttagcttctaaattggcaagtgtcttttatttactttcaataatttttaacatatttgtataatttatatagtgtccagagtttataatgtattactttacacctcatttttcagttgtaaatggaataaaattgatcaagccccaaggtgtgtcaggcactgtgttagatggactctggagattcagagaaaaagagacagatttctttgctcaggtggcatgcagcgcctagtcaaaaaatcagttgtgttatgtctaattaaggtcaagacgacatgtgaaatccaataatacagatgagtcctagacacagaacttttcctcctggcctcatgagttagattgtggcacccttgtcatggatgaggaaagtgagactaagcggccttaagtgactgcagtggtcacccagctaaggtgttctgacttctaaatactggccttgtctacccagcacactgccccgcgtctcaccttgtcagcattcttttgcagtatgttgccatttcaagatggcatgttaatgtctgtgatcatatagaaggtctattttggggtgccttttttctcaagacatttaggacagtgccttcgttaattggacatgtccctaaatcttacttgagtcacaaactgatcccctcattggcacgctggtttctgttagcctcaaggtgtactcttttctaacttttcctgcctttttttctccccacatctgatgctcatggtgcctgggactttcctgagaattggccagaccccatgttcttattacctccaacagaggctttagttctgccaggcaggggacgaacctacctttacgtaggtgttctgtttgcattagtttgaaaatgggtttgagggcaggggaaggtaagttatttgagtgcatagcaattaggatgagggtatgtattaggaaaaacgaatcagtagtatcacagatgatctcttgatgttatcaaaataactcattgatatgacatcttcaggttagctttcccgttctctatcttggaagtcaaccctgtgaggttggaaacaaaagagttaaagagaatcccctgggccacccagccagtagtaagtcgcagaagaggaatttggagtccgctcttcaggctccagcaggctccagtgctaagcctcttctctctgccaggtcatggcagaatatggacttagccacaataaagctgcctcaaggaccgaggagagtggttgttactgactgactttattcctctcagcatccaagaagatctcttcaattaaacattatagccttcgggcattagcccaggagacacagttgagggtcctaggtgctttcacttaaggcagggctgttgagtcggtgaggggatgagggcatctcaaaagaaggctggctttcaggattgcacagagatgttcctgctcccagcagactggggtaaaatttcctgggaatgagggcatttctgaggaaaagagaagggaaattttgttgactacaagttgctatagtataaatgggagaattaatctatttttaaatgctcagatgtaaagatacattcttattgttgaatccatattttcctcaaaagagagtggagacattaattaggaagacatttttaatacatcttgaggattcagaggctgccactgataaaatttaaaaaggaaaacaaatgtgccaggtgcggtggctcacacctagcactttaggaggtcgaggcagacgtatcacctgaagtcaggatttcaagaccagcctggccaacatggtgaagcaccatgtctactaaaagtacaaaaattagccaggtatggtggcatgtgcctgtaatcccagctactccagaggctgaggcaggagaatctcttgaacatgggaggcagaggttgcaatgagctggcatggtgccagtgcactctagcctgggcaacagagcaatactctgtctcaaaaaaaaaaaaaaaaaaagaaaaaaaaggaaaaaaagaaagatatacaataagctccctcctccaagagtttgttatgattgtgattttatcgtttggctagcttcttagagctagcctgtgagaccttcaagaaagcctgtcaggatttttcataatcatagctccaacaaaagaggggcagtttgggaatttcttttttaatgggaaccccggaagatttatagctagaaggcgatcacaggtttctagatcagtgcaccagcgttcagcttccttttacaacatgtggcccacttccaggtttcaaaaagtgtgaccgcatcatgggtagactcacttcctcttgtgcttaggtctgagaatgagcgggcagagtggggaaatagcagtgggtggggagggtggtgtctgaagatgtttgtgggagtgtccagtggttctaagcctctagaagtatctttgccaataaagactcagaaatgggaatgggggtgtgtgtgcacaccagaaatggccgtgtgtgtgtgcctgtgtgcaccagaaatgaccgtgcgtgtgtgtgtgtgtctgtgtgtgtgtgtgtgtgcgcgtgctgggcaggcagagccatgggaacaggaaaacccagcacccccttcagccttttcctagggactggcattcattgccaggcatgctggttgggaagaactgcccaagattttcatctagaagagattcaagaggacccaaagcccaggctcttaggatttcaccagatgataaattataaagtagctgactggtttgtggtgaacagttgctcaaatgcccttttagcttctcagtggtgacaaagtatatctcacggagatcttacattacattaaagatttaggggttccagttaggatatttaaaacctttgccagataggagatggtatcacatacctcacaccaaatttgtgcgtctcacagctgggcattgagatttttaaaatagcaacttctgagtggaaaattgttagggaaaatctaatcaacttaatttaaatggcataaatgatgattagagctaattatcgtcagaatttgggctggtgtttctaaaatgaaactacagagtttctttaaatggggtcatcaggttaggattcagttgtcaagaaagatcaatgatttgtgtgaactcacagtcttctcagcttacctggtagccaggggtaatatttcacacttcggagtgaattgcatttatattctttttcttcatagctcactcaggatttttagaagatgaaagaattgaatcttatggcaacaaagcccatttcttcacagtggaactataaatgcagacttaagtaattaatttgtaaacctttgtatctttttaaaacatcatcctatccccaaggcctaacataagttttgttgactaggtgaaatgattgaatcagtgaatgattgaataaatgaaaaatataggatgcagttcaggaaagaaaaccacaagagtgcggcggctatttaaaaaatgccatccctgtaattactgttattgccaattcctgtttgtgtttatgaagcctgaggaattttggagggcactaccagtaatttgtatctcattactcaagctaagggagggataaatgaatcctaaatgtaaaccttttaccgtcaaaatggaaaacctgtgtttttccagtgatgtgtcagcagtagctattaatattaaaatcacgaacctacacacatacctttaagaaatggactccaggcttgtaaaacatgtggccgtaatattggcagagcaagaatctttggcctctgaataagctcactggccttcatgtctgtgataatttgccatagagaccaggctttttttctgaggatctatcccagtcactgtagttgtggaagtggtggttcttgtataacaaagtcatctgaggtaatatttccacacaataatttttagcaaaaagaaaatgtttaatggttatcccaggtggcagcagattcccttgtggaaacaagaatggcgggaatcaaaggttgggcatagagaagaactttcctctttgtgattcaaggacagatgttggcaacctctttgaactgaatgattggactccatccttttcactcatgttgtcctttacccccagtcctcacctggatttaagcgatctggtctgaaagaactccttccatttctaccctttaaataggttcttatttaatgccactgtagtcaaggaagagagggggaacaggattggagcaggggtgaggttcacaggcaccccgagggaggaaaccagacgtgaacatcccacacatagcagctttgcatatggacagacctgatttccttctatgcctcttcccacagtgctgtctgggccattaagaatcaccttgactcatagttctggttttcagttcagcttctaggaatgcatgatttcacaccttgtggaggtagaacgcagtatcactgatcagggcacagctatcgggcaacctcagcctctctggaactcagcgggctgtgaggaagtcatgtatctaagaagcccaaacacatactccatggcccttgactgtctgaaaaactcagtttcggagtttaatacattcccccagggtaccaaataactagatttgtaaatgtaaattttttcagtcagttcttaaggtttgatgaggaacaggatatttacatagtcgcaaagtatctcaccacaaatcactttgcatttgtaataggaaaaattacgcagtggggaagttggaaaatacttaaccaaatgatgaaagtgaatatcacctacaaatatcatgtacctctggacatcatgccctcagaaggacacaaaattatttgcctagaattctagtcaaaaatgtaaaagatgaatctaagtatgacaaatatcaggcaaactcaaatggagggaaattctataaaataacttgcctgaactgtttaaaatgtcaccatcataaaagacaaaggaaaactcatgcctgtaatcccagcactttcaaagcccacggtgggaggatcactcgagcttaggagttcaagaccaacccgggcaacatagtgagacctcatctgtactaaaattcaaaaaaattagccaagcatggtagtgcacacctgtagtcccagctactccagggctgaggtgggaggatcacttgagcccaggaggtcgaggtggcagtgagccctcatcgcaccactgtactccagcccaggccacaagagcacgaccctgtctcaaaaaattataaaaattttaaaagccagacatggtggctttttatcccagcactttgggaggctgaggcaggcagatcacctgaggtcaggagtttgagactggcctggccaacatggcaaaaaccccatccctactaaaaaaaaaaaaaaaaaaaaaaaaaaaaaaaaaaaaattagctgggtgtggtggtgcgtacctgaaatcccagctactcaggaggctgaggcaggagaatcatttgaaccaggagacggaggttgcagtgagctgaaatcgtgccactgcattccagcctgggtgacagagtaagaccctgtctctaaaaaaaaaaaaattctgacaaatgtggtacatgatcctgcaccaggggaaaaaataagtaataaaggacatgattgggataataaaattagaatattgacttgtataaaaagtattctattgatgttaaatttcctggccgggtgcggtggctcgcgcccgtaatcccaacactttgggaggccgaggcgagtggatcatgaggtcaggagattgagaccatcctcgctaacatggtgaaaccccatctctactgaaaatacaaaaaaaattagctgggcatggtggcaggcgcctgtagtcccacctactcgggaggctgaggcagaagaatggcgtgaacccgggaggcggagcttgcagtgagccgacatcatgccactgcacttcagcctgggcgacagagcgagattccatctcaaaaaaaaaaaaaaaaagaaaaaagtatgtgaattctttgtatatttgtgtaactgttgtgttgaatttaaaaatagatggtttaaacagccctaccttcattgtcctgcactcaaacacaaaacaaacagaaaacccagttgtctgctttactctgggatggatcagcaatcactaaaaggactggaagaggtctccatcccctctgcccctcacccttcctccaaaatcaagtcactccagttgatgtggacagtgcctgcagagagacacctaccagcacgtcccgactgtgtttcaagggcaattaagcccagggaactgctgggcaaatgagctgttctccctaggccttcatgctggcctgtgttggtaggagcccccgctctgccatgcagagccaagaattttctcagcaacagtaatggtggccgcaaattgaggtcagtaggaaaacagatctgttttggtttgtaatgttgcacacaatttggtgagtgaacagaaaagaatgtaccccagtgaagggacagcctgtgaaccctgtgtttggttctgaatatccttatgatgcccagcatagaaaacaggaagcatcagttaaaatgggaaattgctgtgggctggattactgtaattcctcgtcttacttagaagttggcatagagcagggtcctttatccacagcgtgatgtctcttgcttttctatgccttgataattttgccctttctttagggtggtgcattgctaagctgacaggcttttaggctggaattgctaccttttagtatgcttagaaattgtgtttttaaagagctgtttgttttttctctgtctctaggttaaaagcagtctagctccactgctggttctggttccctcctcctgccccctctttaggtctaagtaggcgagattgagcacacagagggactcacagctcagcttaataataaccccgcagtaagtgacatagccattgttacactagacagatacacagaggtaagttctccaaagcagatgagctggaccggaaatttgcacatcagtccttccccgtctcttccactcctttggggtcctccaaagcaggaggggaattttgccagcctttccacgctgtaacaccgagataattatacctgctctccgccctcctggcagagttgttttaggactctcctgggatgattaacggctaagttgtgaaacactgggagcaaatgcgaggtggcattattttctctcgctggatggggatctgactacagtagttggtccctttccctctggaaagaagacagtttttctgcatgacctgggctgcaccctctgatggagattccatcttggctgcctgtttcctgtctgtagtgccaagtactcagccttgccttcctggccctccttcggtcagctctattttcctacttaaccgaggctaccgtttcctcaacacaaatccgcctttctagtccagttggtctttttagggggttttcacgtggtgaaaagctcagtgcaaacacaagcgatgttgttaccctcgtccatgcctttactctccttgtttccctctcaggaatgccttttttttcctcctctctcccaattcagtgcttaagcttttttcagtcctaactcaaatctgatctccctgaagcctcctaggatgactcaacttttagtgattttgtctcattcattacttcattgaacaggcatttataaagccacttatgtgcatggctctttattaggacaaggagagttcagagatgaggcatgccccatcctcaggtcacttacagttgagaaagggagggagaggagatataaataagccaacagtgggggtcagaggacagacaagattaccgataatctgggaacttgcaggctttaaagaggtagcatttgcatggggtcttcaaggatggactagattgaacatgcaggatatttggtccaggtggtgagaacatcatggactaagatgcagaggtcagatgttccatgcaaagagccccaggcagactggtggcaggagcatgaggcattgtgggaaatagcactggcaaggagagtgggctatgagctaggctaaggaatttgaacctcactgactggtagggaggagctcccctgagggcaagagaaaccctggctgttaggaagagtcaaacccccgtcctgtgggggctgaaacgacaggggcaagggagccaagaaggcctgtgttctcccttgagttcctgtggctgccattgacaattgaaagcgggagggcaaagatactggcatttccaggacattttgtggtatatggcatgacgtgaccaagcacagctatctctcactatccaaagctgtttatttccaagttcaatggggtttgggtaggacatttgggaataaggaatgctcctttgtccaaatctatttggaataggaagtagtgagattccagataagaggtgatttatcaaaaattttatacagatctatttagttcctgattttggacctcagagaatgagggatatctgcctttgaagcagctggcccaggaaaatccgagagacctctaaggggcacgatcatgagatagaactcacaccaaaccatctcagactgttacagtttgtctagttggttaacataagcaggggtgatataaaatgtttaaatagttagcaacatgaataccgaacaatcagggtggaagccagccagacgctctttccagtgggaactgagtatcagttctgtatatatgtcagggtttctgttgttattttgttttgtttgagacagggtcttgctctgttgcccaggctggaatgcagtggtacaatcatggctcactgcagctttgacttctcaggctcaagcatttctccacctcagcttcccaagtagcagggaccacaggcatgcgccaccatgcctggctaacttttgcatttttagtagagacagggtttcaccatgtttcccaggctagtctcaaactcctaggctcaagtgatccacccacttcaacctctcaaagtgctgggattacaggcgtgagccaccacagctggcccatatatcagggttttttgttttgttttgtttttgctacatcagatgaaaaaacttttgagggcttcatttaccttttctgaattcactgtgatgcctaaaacaacactgtacatatgttaggggcttaatattttagattcagctgaatttcattagctttatacatattttttaatttcacaaaaattatttattttattttgtttttttttttagagggagtctcactctgtcacccaggctggagtgcagtggtgtgatcttggctcactgcaacctccacctcccaggttcaagcgattctcctgccttggtctcccaagtagctgggattacaggtgcctgccaccacgcctggctaatttttgtatttttagtagagatggggtttcaccatgttggccaggctggtctcaaactcctgacctcaagttaataatcatgccagcattatggactgttgggacaattgaatgagttagtataagtaaagtgcttagaatgttgcttggcagatagggaaccctcaataaacttaactgggagggggtttcattctaagccagtgtgccttccatctggtagatgggggtgattgtccgttgcccttcttttcctagcagaataaaaagggtgccttgctgaattctaaactgttttctcccactcagtgcagacttattccttacctgtggtgtttggaccaatggtacccccatgcctccctgtgcaactccagaaaagtggcttccccagcccagcacacaggacagcttaaacagtttatgagccgaggcctcccctttgtctacaaactcccatttgcctgccacctcaaatcctatgggatagatccccctgagactttatacaacaaggtcacctctcaagctctggcttgtagaaatttagtcccttctttggcaatgtggatgcctgaagtagtagatagtgggctatgttcagataagaaagaccccctaaatgggtagacccacgctcatttcgcggtcttgtttgtagctgtagtactgtcgcagttcagttgagattttcatcacactggtcaggaaattcatagtgaaggttactacagcaaccttaactctgctctggaaagcatagcccttacaatggggcctttcagaggctggccctgaagctgggcagtgattcagtctattcagaacacaatggggcaaaccagaatagaaaggaactgcacattgttttaggcctcccattgccatctgtagcatttcgtattgttgtccatccttgcggccaacatgagttttagtttctctagtaacgcactttaaatttcagaactcatatgcctgccagtcgtagtacatttcatgggagttgaaatagtaataataattctgtagtggtgtacaaactcacagccagaagatgctgtagaaacacatgtaggaaaaggtggattaaggcttttcatttggagacaagggaaacacccattgggtgtgtttgaaacaaaactgatgaatttgccttgaaatcctgtaaaactatcatagatttttttctttaaaaagaatgtaatctttaaatgaccagtaaaataaaatcaccccttgcctttatccacagccactcaaaacaaatccactcaccaaacaaaatttacttaacaataggatctgaacggtttacttacatttttaaatctagagagtgttgggtagattttaaaaagctgaatttagctatttagcatgtgaactatagttatactaagcaaaagagctgtggtttccttagaatgagagttggaaggaaactttttaaaatttttttttcctttagagcatttatggtatttgatttattcatactgcttgccctgtgatcaaacaacttttctttgttgtctatttagatccctagggttgttttatttccttcccttctttaatgtttccctcatgtttaatttaaatcatttgctttttatcttcctcggcatctcaagctatttctctttttgttaatctttgttttctctctctctctctctttttttttttttttttttttttttttttttagtatttttagtagagacgggatttcaccatgttggccaggctaatctcaaactcctgatctcaggtgatccgcacgccttgacctcccaaagtgctgggattacaggtgtgagccaccacgcctggccacctttgttctctttttgctgcactaaatttaaaaaataaataaaaaataattgaaatgtgcttttgtttgtttgttttagtgcaaagctagcagctacttctgtatcttaaacacaccagcctccaacaaacaccaacaaacaatcggtgaaaccttttccttttaactccggtgaacttgaattgacatgtagtcacacccaggtatctttgggtgttggttatttgattaggaggtaatactgtgtttttggtccaactccaaggaaaggaaggggtcacagaccagcaaagaatatcaggagtactggtgctgcttttcttcatattttgggtcgctgggctcaggtagaaagagacttttgtgcacttgggaacagagtatcgtacaaatcctttcagcatttttgcaaccagaaaccatgcaaatgtttttgcagatatgcttgtggtcttgctggcagtttgtgagcacaacgctctgtttgaggtggtgatgttgacttctgttttctattcactgtcctgccccaaatcgagcatgccgtcttgtactttaattgtgtgagcacactcttttctacctaatgcggagagtgggtatcagttggtctccattccttgcataaaatgatttttactattactgctttgagataatttgtgtgtttatctcagcacctttgactctcattcctgtcagtacagcaagggaacccagcatttactaccagctctgactttgcagggttgagagtggcatgctgtttgactttggaaactatgttaaaaattcctccagtggatccctagctgggactgttttggcaattgatgtctatcttgcctactttttctgaggatttctgcaaggttattttaaacatattcaagttgtctgattgtgctgaggcaccgttgtcacaaaagaaagtcacagtctattacctctgcaaaatttttgaatgagaagcccgctgttactgaacaccaggcatggggagtctgactttgaagctggctacgaggcatgctttcaaggagacaaggcagaggcccaaagatgtcgcagggtggctccaaagctctgatctcagctttgctgaggcatctcctgtgcccatgatctttctaagagtcagtcattcaaggtacccaaaatgtccctctgtttagaaagggtagctctgttccgtagccaaggtaacacttcatccagtttaccactgtgggatctaaaggcagcttcaagggttgcatatgaaacctggctctcagaggacatctcccgtgagatattttcaccgagtggggaatccatttcttctgtcttctaccgtagccttaatagaagctgccaggtttctaaagccaccaaaccagtacaaatctggattccatggacacacacactctgtcaccaagtttttcatctgttaaatggggatcacagtacctccctgtttctagaattcttttgaaaccaaatgaaacaatgtacgcaaagcacctaacgtagcattgggaacatggttggtgctcaagaaaagtgatgcccgttccccgatccccaaacattgtggggcacacttcttgatgtgggttgcccttttgatgccatattatatttcacagatacaatgagaagtaagtattcttggagaaggaaatccaaaaatttccttggattttctagggagttgtgagttttaaactggtgtgacccaaccatgtccataatcacatcagacatggtcagtttgtgttttgctttcagttttagtgattctggcaggagagagttactggcagaaggaacaccttgaaatgctacagccagagatctctaactagatgacagctttctaatttctgctggcattgcccctcatcttctggagattgcctttttcctttctgtctgtcttgtttctagatttcaagccaatgccttaactcttactttcttcccataagcagagacctgtgtcttgggtggatgacaaggggttctgggaaagagatctccaaagtggggtctatgcacttttatgtgcaaggaaactcactggaaagaaaatattaaaacctaatttgtatttatctttacattaaaaactaagatgaaattgagctgctcccatatataatatttggatggaccccagtctcctcatgcagtttgattgccagagggtcagggctcacaaatggtattacttattatttgagaaattcaaattatataaatgcctggattcagctgattattttatggtaagcatccaaaatagtgccttatttttcttcccagaaacaaaaaacttttggtacagatttgctcaggagggactggaagcagagagctgcacagtgctgggctgggagtcagaggacccgagttctagtcctggttccagtccaggatggccccgtggacacatcctttcacctctctggccctcaggtccctcatctgtaaagtaaaagttttgcactgcttaatcgataggccaggccccttccagctacaatattttagggttctgaatgtaaatatgtaagtattctgccccttccttatccctgccactttgttgtttgtttaaacaccttaattttttgcctacaaggcatcagtctgttgctcaaatggtctttgtcactggcttccattttggttagcctgctgaactccctatgtatcttctctgcagctactgtctgtcgtcttcttttctgtggcggatccctattctcagaatcccatattcaaattgactcacatttatagtgtccagttatacatcacttgagcatcatgaaactttaaaagttctatattttttatttgaatcctgtccctcctattatcttattagccagatgagatgacagtacccagtctctttcttgaaatatcatacatccaatcagagctatattagtggctagtagtatcccagttcacttattaataaccaatgcaaaactttactcatctggtactgtgagcttgggtaatatgaaatctctgtgcgttatctcttttaatgtactcaaaagcactgaacggggctgggtatgacagctcacacctgtaatcccaacactttgggaggccaaggcaggaagatcgcttgaacccaggagttcgagaccatcctgggcaacatagtgagacccccatccctacaaaaactaaagaaattagccagacatggtggcacacacctgtagtcccagctactcggtaggccgaggcagaagaatcacttgagcccaggaggcccaggctgcagtgagctgtgatcacaccactgcactctagcctgggtgacagagtgagaccctgtctcaaaaaagaaaagaaaagaaagattaatttaaaaaaagtaatagaattatttgcccaatatttggtgagtcggtgagtgacagtggtagtagtagtggggtttgagttaaggaataattgtttgcaaagtgagaactgtaaggagtgcctctgtgcaccatgcagttcaaaacccatcaggaacatggcaggctcgctgagcgccttcgctgcacattgttgattgtcatgtatttgtatgactatcatctactttaaaagttttcatttgacaataacttataatcattcattcacgcattttctgatccactccttctagttgagggttgcaggtggccagagtctatcccggcagctcagggagcatggcaggaaccaggcctggacaggaggccatcctatcttagggtgctcacacaatcccccacattcactcagactgagaccatgtcaacaccccaatgtactcaatgtgcatgtctttggcatgtgggaggaaaccctcacagacatgggaaaaacatgcagactcctcactggctggaccaggaatccatttttcttcctcattatctttatcacaaaatggcgtcatccgaggacctgctctattggcttgctgttgaacctttaataaagatctaagctgatcaaaggaaggcagaatctacctatttgtggccaccctagaagcatacaacagtgagggtcctggtaagatcagtgaagccgtgctgatcttccaaattggtttttattgcaaattcattctagagcttgctgattgaacttggggctggggaggtggcagcaactgcaggtagccctcagaaagtctgtcgggaaggacacatcaatagaagataaggctcccgtctctgcatgctgcattgcttgccttctgcaaactgggcttgcgatttgggtgtgggttccgagagacaagcccctagcaggcccattagaagacagtgcctcccttcatgtctatcctagggcttttagttgaattatcaagcttgttcttaattttccccaccccttctaagttccccaagcccactcctaaagtccaaggtatggatcagaagaaacagcaagatagccctgcatcctctgtcaggtggtggaagggagtgagaggatgaacttgtttgtgatcacacattgagcggccctgagcctgcaggacccttggcgacactgatctgccatgtggattagtggctgctcttgtggcttctccctgagatgtgcccacgggactctcatctctgccacccatcaaccagctgtggtctgagatctctgtttgtaaacatgtgtcattgataccctaaaggcccctagaccaatgcccttatggttacattttgccccaagagggacatggtgccactgtgccatagatcagagcagatcaggcaagccaagggtccagaagtaaccatgccagaaacaggcattcctcacttctgcatttggttcagcgttggctagtggttgttcagggaatgctccttgcccctgagcttggcttgtttccctggactccgtatccctatagcaaacccacaacaaaggctgtgcccacatcaagacacccctgatcacatccagacccttcccccgcttagcacgtccagacacagtacccctaagtgagagatgacacaccaacaccttacctgtgtcaccgctccttaaaatccaactctttatactcttgtggagtttccacgttggcttttaaaagacagagatgagaaaataatttcatcaaccttataaaacttttaaaaattgagttcttattcagatatgccccaaacatttttcagaaaaatagggcaatctgagaaaaccataacatgtgagtagttggttaactcatgtcagcatacctccagcattttgcatgacttataaataatgcgtattttgcaagcagtataggagagattcttccaaggataggaagtcctgactttttggcaggttgatatcaactctgccacagcctgctgataactctttgcatactgttctttttctcagaatagcatttaaattagagtttctttgttccatggtacagggtgatagttcatattatgtcacaagaaattgttcagttacctccctgtctttatttatatgcacagctgctggtgtttctagctagtcttcctgcctcattaccttggctgtgtaattgaattagaaaaaggtattgagcagctactacttcagagactatcattttcaaaccacaaattaggacacagagtctggtaggatttttgacttatgaatctattaggccggtgccattaatggcaaaaaccgcaattacttttgtgccgacctgtatgattaataaaaatcttaatggacatgcacacactaatttggtatgcatttaataggctgacttaattttttcttttctttttcttaaaaatttttttcacttttatttttaaaattcatttcagctaattaattaattgattttattattttttttaaagacagtgtctggtcgggcgtggtggctcacgcctgtaatcccagcacttgaggaggccaaggtgggtggatcacttgacgtcaggagttcaagatcaggagttctctactaaaaacacacacaaaaaagaattagctgggcgtggcggtgggcaccttctgtaagcccagccactcggggggctgaggcaggagaatggcgtgaagccggggggcagaggttatagtgagccaagattgtgccactgcactccagcctgggcgacagagccagactccgtctcaaaaaaaaaaaaaaaaaaaaaaaaagagacagtgtcttgctgtgttgcccaggctgttctcaaactcctggccttacgtgatctttctgtctcagcctccactgagatgaaggacatgaaccgccacaccttgcaagattgctttaaaactgtaaataataaaattctgtgaaactggccttgcccaaggcacagaggcatgtgagaggtagagcttgtacccaagtctgttgattttaatcagtttgctagattaggaagaaaagttacattcctgaatcgtattaccgaatgtctaagagctttgcacttaaaaacaagagtggtgatgtgggagctctcttaagggactgttaagtgcttgatgtatgtgacatgctagcagagccacagctgaaaagacagggactaacatcagtgtgactctcttgtcacttgtttgattaaaatataatcagagcagaagtgaaatgagcatttgtcatattaaggaatctcaagcatttgattcatattattctgtagcttgaaatgtccttacctcactaatgatgtggtgaagattaattgcctgttattctgtttaaaaagttaatcatccaggctgggcacggtggcttacacctataatcccagcactttgggaggctgaggcaggaggattgctcaagcccaagagtttgagactagcctgggcaacacagtggaaccccgtctctacaaaaaaaaaaaaaaatttttttttttttggtagagaaacacagccaggtatggtggtgcacacctgtagccctggctactagggaagctgaggagggaggattaattgagccctggaggttgaggcctcagtgagctatgtttgcgccacagcactccagcctgggtgacaaagtgagaccctgtctcaaaaaaataaaaataaaaataaaatagtaatcatccaacctcaaatatctgttactcttaactggactacttacatggttaagagaaggagaactgtgtttaggggcaatatctcttccctttgatctcctgagttgggggcaaataggaacgccttggaaacttatttcttccttggagcagactctgggcccaggactcctatttgccccacgatagctgctgccacagtgctgccgtgtacctacagcaaacatgttgtgaggtgagtcagtgtagcctggaatttattcacccagctagtaaagattgggcactcccatgccccaggcaccaccctggtggggacatggcagggggcagacatcatcccaaggctgactccagggcacggaacttcctctgcattatgcaaggctgtgcagagccaggctgctccgtgagctcctagcttgcagggctttgtaccaggtattctgtttaccacgtggtacttctttttcttctgtaaaaaaaaggataatacaagtacttggtggtgtcattgggcagatgaaagaagttgatacgtgacacatagtaaacatgcaataaagcagttactatgaactttagaattattgctgtttccaactgctgttactttattatgagaggcagtaggtacaatgtttaagggcaaagatctgaagcagactgcctgggtttgaagcccagctgtgggagctgagcaagttacttaacttctctgtgcttcactcagtttcctgcctcgtgaagttgtaaggattagataagttatatgtaaaatgcttagagcagtgcttggtatgtaataagaattagctgttacgtgagaataataataatgtatttcattcattcaacaaatacttgggggctgcccatgccatgcatcatggcactctactaggtcttggggcagaatggtgaataagacttggtcctaggggtcagtttaatcagggagccaggcactcaggtaatgctgttagagcaggcttcttagcaagatgatgcctgacctgtgctgggtgagagtttagtaggcatagagttgggttgaggtagggaggagttcatagaagaataccctaagctgggggacagtgggaatgtaggtactgaagatcccacctcacacacacactgtggaaaaacagaaacaaagcacagcatggtatgcacagaaaatggtgtggtgggaacctcaaaacggagaaagcaggggttagagatggacaaggacaggtcagggaagcctcgctaagatttgcacttcaaatgcatgcgcagctaccttgaggggttccagaccaggcttgtgaaggcagccactgtcctctgaccgcccgtctccctgggatgagggcaaccagagccctttttgtgccctggaggatggatgccctgagcatctcaaagagcctgggctgcccaggcctttccctttcccctttcccctttcccctttcccctttcccctcccctctcccacttcctcgtgcctttacttgccttctttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttgagaccagcctgggcaacatagtgaaaacccgtctcctactaaaaatacaaaaataagcttggtgtggtagtgcacgcctgtagtcccagctattcgggagactgaggcaggagaatcacttgaaccagggaggtggaggttgcagtgagccaagatcatgccattacactccagcctaggtgacagagcaagactctttctcagaaaaaaaaaaagaaagaaaagaaaaagaaaagaaaaggaaaagtcatggggaaagtcagacatcatagtaatcccagggcagacatatcgcatggagggtgggacacctttctgcttcaaatggtgttaatattgaaagaacctgtaggctgaaagagatacaaacttgaacatgtctttacaaagcgaagaggaaattacgtaaagaccttgctttgcgagctgtggtctggtgatgggtggcttctcttgggcagcttgtcatccaggacccttgtcctcatcctctagtgggttggaggtgaggatgggggagggggtggcagctacaaaaatttctgcaacaaagcctctaaaactgggtgatcatcagcctcaccagtaaagccactacacagttcctgacgtgagattagtatttggtacaatgcttccagagtaatcaaaatttttataatattttttcatctgtgatgatattaaacagtgatatttgaagagtacctggcccttagtaaatgtcatgcgccagaatatatcacacctaagatgctactggttataaaaggagcatcattattttatttacagtattgaaaaataaaaaaaaactgccagttaagctataacacatcattgattataagacatccttttttttttttttttgagatggactttcgctcttgttgcccaggctggagtgcaatggcgcgatctcagctcactgcaacctctgcctcccaggtttaagcaattctcctgactcagcctctggagtagctgggattacaggagtgcaccaccacgaggctaattttgtatttttagcagggacggggtttcacaatgttgaccaggctggtcttgaactcctgacctcaagtgatctgcccaccttggcttcccaaagtgctgggattacaggcatgagctgctgcgtccagttgattataagacatcctaatttcaaaatgtgaaaatgtgaaaaagaatgcatcttagagttgatggaatacattaactgttcatttacaacatcttatctttgaactgttcattgatatagaaaatgatccttttgagattgacatttcaggcagagaaagtaaaagaaagctgtcgtgtctcttctttctgggagcctattgttaaaaaaagtttgctatatctgcaagctggaataaacaaaaagaattggagactgagttgacatgaaataataaaaaatatggaaaacagtgtcagacatttatatatttcattctgcttagcaagactttcacatccattatcttatttgatctaacttttttcacaatgaaaacagctctgtgtgtgtatattttatatatacatactcagaaaaataaaacagtgcagaaagtacactgagataaacaaccacaacattttaacaactgtatttttgtacagagatagtgcatataaatactatcatatgttcaatcaaaacaaaattggggctccttaccatcccttgttattttcaacaaacctttttttccctcccccttctaacccactcagccaatgttgctagcttggtgtgcaccttccatgcactggatcatgtcatcatgtaaaaccagctctacccctaaaaggattgggggtggtttgatggtcagtcttatttgatcttcccagtggcccaggggggagtgtagtgttatgaacccctttttgctgaggaggggacaggctccaagaggttgactgatttgtgtgacaccctatggctaagtggcacagggtcttggctgggagggctagtctttgagagttgtccttggcttttttgagatcaagttggtcacagatgcaacctagcagcctgagacagtcccagtttatgtgccttcctccagctttatcattaacaacactctcttctgcatcaaaagtgtcccgggctgaatgatacattatatgtttgctctagtggtggaacacttctccaccgggggccagctcttctaggaaggttgattccaggcaccactgactaagagatcactggacccacagtagacctggagcctgtgtctacacttggacttaacgatgatattggaagtgagctttggtatcgcagaaagagcagagaaaaggaagtcagaaatccctgtgtcaggtctcagggatgaaaggagaccacgtgtatgtgaaaatgctacacaaataatgaatctgtggtatggtcacatatatttaaatggatgaaactttatgaataagcacatactccatattcattgagtattcccttccccgagcttcacgtgccaccccctcagtgcacttttccacccactccaagcagaggcaacatggtacattatgaccccaagcttcagtttctccatttgtaaaatagtgcagaaattataatacttgtgtcttgcaagtgttgtgagaattaaatgagataattatgtaaaaagcattggcacgtatttctggtttcagtaaatgttccaattatctaggagtgtaaggggttgagagtgggttgttggctactgactaccctgtcccccatgcactgtttcaggaacactttttcctcatattgtactctgtgcactgaagtccagcacacacatacttgcttcagagacacatcttcccatcaccaaaatattaggggtttaaatttcataaagttgaaataaagtgcaagcccaatgctggtttgtagaccagtttgcaagtccagtgccttgtatgtagcagacagacaaatatttttggttgatttttcatcatttgcagtggaagtaaatgtttcagtccagtaaaatggcagaaatgtaaaaggtggaattccagaatgtcttaaaattaaaataggtagtccctttcctgttattactcacggagacagaaaaatcccattacaaaacaagctcagtttgactgcaggccagagtgttacccattgtccattgttcaccgtaagaatatggtttatctgcttctcagggtgatctacttataacactgggggcattctagtcccaggttttctgaaatcaaatctgctgtcctgttgtgctcatgggccaactaaatggctcagacatgatactatcttactgtccacacagcgtcttccaatcacctttcaaacctggacttagcatagaatccagtcttaggacagtcctggcttttgactttgagagcctggtcagtgcccaacagcaacccagaaaatgctcaattatattgatgtttctatttattttaagattttactaacacatgcatatgattaaaaaatgtaaactgtacagaaaggtctaaaatggaaaataaaggttacatttctcctaaaactccaggtcttctccccaaaagtaccaacaaaacaattatagcaaacatgccgttttaaaaaaattacacaaattcaataattccatatgtattccacatattgactactctttcaatgaaacagtatcttcaagctctttccatatcaggacatgcaagttcctttaatgactgcaaagtactcctttgcagagcattctgtattctaatcagtcccttaatgatgcttctgtttccctattacaaactttgctacagtgaacaaccttgcacatgtatcttttgcaggtgtatcttgaggtagtttcctaaaaaatacagttgctggctcaaagaggatgaggctttgatgtttttttttgttttttttttgttttttttttttttttgtggggggatggagtcttgctctgttgccaggctggagtgcagtggcccgatctcagctcactgcaacctccgcctcctgggttcaagcaattctcctgcctcagcctcccgagtagccgggactacaagctcatgccaccatgcccagctaaattttgtatttttagtagaaacagggtttcactatgttggctgggatggtcttgatctcttgagcttgtgatccgcccaccttggcctcccaaagttctggaattacaggtatgagccaccgcgcctggcccagactttgatttttatttagttaactatgtttatatattggtctgtgtgtctaaaatttcaataccgatttctaaattgctacctaaaaatactgtgcagtttactctttgtagaagtttgtaagagtattgatggtcacctcctccccactgccctgtacggggtgggggaccttgttgtatttacacaacacacttaattgtctcccttttctgggcatttgaaggcatttgaagatagtggttaccaagtatatgggtaactcctcctttctcccagatgcatcaaagaacagtgctccctgggacactaatgaagtgtttgcagaaccgctgccgcgtggggccaggcctaccctggggctgtctcctgggcaatgaaggtggactttcaggagagaataatccttcctgtgtatgctgactcacctttgctcttcctggtccccaccctggtaaacagacaccagtcagtgaggttccacctttgaaaaaatcagtcagggaatcacccatctgaggttcccagcctcaaggccgagttcttcctgtgtgtgagggactctggtgtttgggttccacctcttaaatgttagcaacaaaccaggctattatgtggataggggcgtaccctactttccagaacttgcacatgaatcaactgctttttaataaactacgtcatccttagaaacggaatgtggatctgagagtgtctgcactcaatctctatctaatggaaatttctccgtcataatttgtaggaagtgtcagggataagagtaacttttcattattgttattattacgttcatgtcgtagctggcacgcccgccactgccctcctccctttgtacagtgtgctgcgctcaccaggagctgctgtaaaatgcaataccttgctgagtatccacctgtttaaaatggtaccatttttagtgggggaagcaaaagggaattactcaaaaatgaagctcgcctgagagtcatgaagtagtagcccaataaacaatgcctttgccctctgaagagaatggctgccctcacactgatgaggaaccatctctgctgcccctctcccagcacacatggcagccaaacctgcccctgcctctcagcaggggtagaggaagaaatgaggggcaaaacgggtgcgaagggttagttgccccagagccctattgcatattctcacaattctagggcggtagtttgtgtcttagaacaactttcagcctctgctccctagagcgtaggatagtgcgtggtaacaatgccccaccacaccgcccatgtaactcctggcattcagcggctgtgtgcagaggctgtgtgcctctggacaagtcacactagtagcaaattctgttgtcccctacccagcaacagaaaatggtttttgtttcactgtggggaacttttcagcttccctggctgggctgagggtctgcacatccatgtttggtttccagctttgctgataaccatatcaccctctgctaaagcttcccagctttcattgatccaccttgtccttgacgatctgggcaggtcaggttctcccaaaggctctgagttgctcccacctccaggttctttactctctccctttgcctcatctgggtgggtttttaggggagtggggagaataaatgcatagtgaggagtggtcactaaagacagaagttaccattagaaaaccttgggcagtttacagttttttcagcagtaaaatagagatagtaatacatagtatggggggatggttgtgaaggttgaatgagttcacatatgtaactataattgcctggcagagggagggagagacggggaagggagacagggagggagggcggaagagagagagggagagggagagagagatacagaaactgatatgtgacctattggatataaaaaacgtatcaaatcaaaaataactttggtgttttagtctctaatgctaagaggaggtggtcatgaataaaaattgtatgtctttttaatgatacattgggttttggagacagtctgtcattccattgtcatgttaaacttaacgggtagaaatatccaataagtcagtcattcatgtatgagactgtgaagaaaccacgtttggatgcgtccatagtcatcgaatcttcggttcacatcttggcttttgctacttactagtcgggagatctcagtttcctcctatatggcatgggaatgttaacccctctctcctaggattgcttgcagtagtaagtagaacaccctccacaaatcaaataactaattcctttgcatattgtaaccactgtcaccttgttatatagacagcagactggaaaatgagtcctctttgagcattagagactggggctaggaatcttcagtatcgagtgatacttggaactatgagaatcaatgaactctaccgtgagtgcttttctgctaggaaataactaccatgagaaaaaggaggaaacagcctctgaggtggggcagtcaggaatgtgtctctgtgcagtgagacagagaaagaccaatgggtttgatactgagacaaacttgggttacgctaggaaggcagtttcttcggatcaatacaaacatacgcaccatgacacagagcttctctgtttcttgtcctttatagaagttgaataagtacttattaacagcccttgtgttttattcaactctgcttccatttttagatgtctatgggggttaaaaaccaaccaaccaatctgcaggttggttactctgggaccctagttttctgtgcagagtaaccgtgggtgcccagaaagctggaaaaggtggggaggtgaggagaggaggaatcactgggaattatctggctggaagtagaccatgggcattcaatggaaatctagtgagtcatgctgtggccagtgcttttttctctttctgctttgccacaagaggaagaaggagtggtgaggtctgaggtaattttgtagaattgatgctgtatgtggttctgagaatgccagatatagagagtttccttctgcaagacagcatgggtggcaggccttccagaatccctttccagagcaggagcccatgacactgtacacttttcctgtggtagctccttcttggctgattttaaaagatggcttttcccagagcttcttagaacttgctcttagcaaaggatctgtgtttcccatcgaaaaaaaagtaaaccatttaataaatttttaaaataaaatttggaatggcttccatcttgtttcttgtcatcttctcctctcaaaaagcctccttttcccttttttcatcctagttttgatgtctgagcagttggcctttctagatacccttatttagaatttttctcttcttcattcgaagtcccccgagcagtgagcagggagggggcaggggcgagtctcacccagtgcagtgcccactgcacttacccactggcgacactcccagtagaatgcaagcatttgaaggtaagggaggatcttccaatattgtcatgtaatatttgccattacttcatatttattagcttttttgctgataagtgtagattataatgaatgtccttcctcctctggtctcctccggcatagattataatgaatgtccttcctcctctggtctcctccggcaaattctaaatatcttagacctacttcaaatggctccttttctgggaagtcatttcttctgcctctcccaggacaaagtggcctaacctccactcctggaacacccattttgtgtgtgtttatgttgactgttattgacgcatgaatcactttattccatcattatctaggtgtccttcaagggactttgaactgcccaagtgctcagctccccaagtgctcatgagtcactttgttccatcattatctaggtgtcttcataggactttaagctccccaagtgtgccataagaacttgtcacgtagctgaacacatgggggaccccactacagaaatgccaaatgaaaggaagccctgcagcccacagagtgttcagaggccgcccctggtgtgaagctgaaaaatcccagacgtagatgagggccacagcttcatctacccaagggggccatgcggggatgaggccttcccctcctgggcatgttccgtgatctcgtttcgtctgtcctgtccacatcctcgttattggagcagtgatcagtcataaaaatgtagcctatcttttgaatatggaaagccagtattacacgtatgacagtgataagtttatgaagggaaagtaatttagatgacttgagaaattatgaccgtgtgacatagcctttgtgtgatacatattctttccatttctggattctgtcatgtagtttgcaaaacgagactagaaagtttctatgtcgttgcttattttcaccgacaaattcaacacaacagtatggttgaaggatagtctcatccgagactgtcgaccgtgtgttgtgctgtattcctgacactgtttagcacttcacacatattattttatttaatccttacagcagcgttgtgaaatgggtctgtctcccattttacaaatgagaaaagagaagtcactttgtgtcacttcagggacacatgagcttaggtagcttttccccacttaacttagtctgtaggtagcaaagctggaacttgaatcctcatcttattgattgcagaatctttctctgcactgctctttctgctacattttattttaagaatatttgggaaattaacagcattttgtctttgttactacaggggaaaacaaactatcctagtaattgtatgttttatgttcccagggaagcaaaggtgtctaccagtaccactggcaaagccacaatgtcaagcacagtggtgtggacgacatggtgctactgtccaagatcacagagaactccatcgtggagaatctgaagaagagatacatggatgactacatttttgtatcctttattggctgctttggacatttctaagtgatattacagtgtccacagttaaattgtggctttatgctgggtgcagtggctcacgtgtgtaatcccagcactttggaaggctaaggcaggagttccagaccatcctggcaacacagggagaccccatctctattataaaaaataaaaataaaaactgaacttgtggctttattcctggcttgagaagagctatctgaaagtccgaacagatgctgtgtgctcacattgttttcaccgtttcagaatgaggttttgtatgtttatatcacttggttcaggctgtgcaaagggcaaagatgatgcccggttattctcctggcatttcacaaagtaaagatgcagccagtattcatctactttaatctataatatcgtccctttgacatgctctagtcatgcacgtggtatctgaaacctctgctcttcctagaggaagtcctggtttgcaaagagttctatcaataatgcatcctgactgcaaagcagagacatttgagtctgcacttaaaagacttaaaaatgttgccagtttttctgcattttaatgtttactaaaggaaatgtgagaagtgaagatggactattgaaaatgcttgacgttcttcagttgttctttatgtttcaattttagcttgccggatgccattttttatggggctttaaaaaatgcagaatggaaatttgattcaaatatgggttgacttcattatcaacagggaactgtgatatttgcttaagttctataggaattttgtttgatgcaactatgtaaagatatcctggtggaactattgtgagagttagtcatggacatgcaaaactctgtgtcaaatctatataatagtaccaaaaagtttaactttgatgccaatagtgccttctgaaagtatggtatcatggatgacttattaaaaagtggagtctttgcttctgatgtaatatacatcttagatttttacccaaaaagcttggggaagaatagttttcacatcagtggcttattatgattacttaaactggttttttgactattagctaaaagcacgggaacctttgcagtaataacttttgcagcggctgcctatcccatcactggtaagtcgtggggggtcgggttcaacttatcaggtatttaacaaacaatactgttaaataattaacagcattattccaaggcatttggaccattctgaccagtactctgctgtttcttatttactataagggaattttaccaatatctgtagttaaacctctgaacctctgttttcaaggattaacagatatagttggatttattggctacattataattgcatcatttaaaacatttattttctttttatagcactttgggaggcagaggcgggtggatcacttgaggtcaggagtttgagaccaggctggccaacatggtgaaaccctacctctactaaaaatgcaaaattagcggggtatggtggcatatgccttgtaatcccagttacaaggcataacttgtaacttgggaggttgaggcaggagaattgcttaagtttgggaggcagagattgcagcaagccaaaatcgcaccactgcacttcagcctgggtgacagagcaagactctgtctccaaaaaaaaaaagtgaatttattgtatttttaaatgacaaatagtaattgtatatagttgtgggatataatgtgatttttttttcttttttcttttctttttttttttttttttaagacagggtctccctctgtcacccaggctggagtgcagtggcacgatcccagctcactgcaacctccgcctccccggctcaggtgatcttcccacctcagcctcccaagtagctggactacaggcagacaccacgatgcctggctgattttttgtagaggtagggtttcaccatgttgcccaggctggtctcaaactcttgagctcaagcaacccacctgcctcggccttccaaagtgctaggactacacgtatgagccactgcgcctggcaatgtgatgttttaatatgtatatacattttggaataataaaatcaagctaattaacatatccatcacttcacatacttattgtgtgtggtgtaaacatttaaaatctatactccacaattttgaaatatacattacgttattatttacttatataacttctggatcagggtggtgacctatggctgacagacaaaatcttacttaccaccattttttggacagcagttttgttggaacacagccatgctcatttgtttagttattgtttagggttgttttcacactatggtggcagagctaagtagttgtaacagactctctgcaaagtctcaaatatttactttctggccctttgcagaaaaaaatttgctgacttctgctccagatacctgtgcagggcttccttttttttttttgagatggagtcttgctctctcgccaggctgaagtgcagttggcgaaatcttggctcactgcaaccttcgcctcccagattcactccttcctcagcctcccgagtagctgggactacaggcgtgcaccaccacgcccagctaatttttgtatttttagtagaggtggggtttcattcaccatgttggccgggatggtctcaatctcttcacctcatgatctgtccacctcagcctcccaaagtgctgggattacaggcgtgagccactgcgcccagcagcttcatttaattgaattgtacaaaaacagttatgttcagttgcaggtttttattttatttggtcaaaatactgaaatatgcttactttatccggacttaacaccgtcaaaaaatgttaatcacttttacgtgcagcacccacagcacatgaaaactggcagttaattgattagaaggagctgggtggcaggatgtggatctggactgtctggcttcaaaccttgctctgcatagatttggtgaccgaaacgttttgtgacctctgtgccttgctttccgtacctgtaaaatgggagtaataataaaatctcccacataaggctgttgtagggtgaaaccaaataaagaatgcagcaagtaaacagtaagtatgagtcattattaccatgcaggtgtgtaagtgcttcccatatttccgagttattttccaaaaattccactgtaaacttgtttattggaaattaaaatgcattttgccacagaaaccgttataaatggagtattgacaagcccatagaagtcttcatttccgctgaatgtagtagttgtacaaattatattttgaaatgttcttggaatgtgggctggacttactgcattataaagatggaaatacggttttttggtaagctgagtataaaaacaaacaaatgatgtccgtagtcagtccttcataactccaggcggcctcactcctcccaatcacgattgtttactcccaaaacaccagaagcagggactatgtcttatatatcttcttcaaaaagcagcatataaaaaccctttagagcaatgtaggttcatttaacatggctcataccatgcagtgaagcaaaaaaaaaaaaaaaaaaaaaaaaaaaataccaaagtcacccagaacccatcaccaaaggttagttcttattaatctcttggtgtagagctttcagtttaaccacatatggccatgcatatatgtgtgctttcttgttaattttaacaaaaatggcatcatcctgcctcatgtatttcttggttttctgcataatttttggcatggtgcattgtattaagtattcattgacaatttgttgactgttaagacttgctttttaaattcagacaacagaatttttaaatgactcacacagagagggctgtttatgcgcctttgaattaatgcctttgaatcgatgactgactaatcgtgtgttctaccaaggaaatgagttacttgaccactaatgactttatgttttagaaatctctacccactgaatatatgggaagcccagcataaatgtgctttctatcattagcacagagtagctttcagctttgagggagcttgatggatgtttgtgaaataatacaggggctctgctgcaagtcttcctctgctaagtggtaaaagcatcctttaacacttcaatgttaagggaatattataatagaatggcattactgtaagtaagagttgggttttttcctctcctatgtttaattgttaagacgagaagagacttgatttcacattgagttataaaattgctcactttatcccttctatatctaattcctgcacattgtcttgtgttgaaagtcagcatttggggcgatcgattgttaatgcattcaggctgaatgcacatttcttctacattaggaaaaaaaaatccacttagaaaatgctgacatcgtttaccaataaaactccctatttttgagttatttgtcctatgacaaggtttaatttgccatctgtttgtcatcaatgttgccacactttttacaattacattgtaagatctatgaggaaaacattacagtgttgtctattgtgcatagggagagagcacttctgaccacttggccgacgaaaagagttcctgcgcaaagcactctgtgctcattcggtccaactttctccaaacttgtttttactcaaagaccacactcaggtgtgtttggcatttttaatccttgaattaggagtccagattttcgtgccagacccactagatttcaaagcagcgtagttgttccgagtgaggtctggcccttggcatccagttcactggaggggcagcatgctatatagcaagacagatgccgggctggagccaaagcttcgagttccaggccacccactctccacgtgactctggggaagtcaactcacctccctgtgccacctcagggatgaacccaaggaagtccactcgaccagcgtaggtggttttgggaaattcactgactattcaaatagattttaaccggctgggcacagtggctcatgcctgtaatcccagcactttgggaggctgaggcaagtggatcatgaggtcaggagattgagaccatcttggccaacatggtgaaaccccgtctctactataaatacaaaaattagccgggcgtagtggcgcatgcctgtagtcccggctactcgggaggctgaggcaggagaattgcttgaacccgggaggcggaggttgcagtgagccgagattgcaccactgcactccggcctggtgacagagcaagactccacctcaaaaaaaaaaaaaaaaaaaaaaaagattttaaaagttcaactcttagcattgcctaataagactattaaaaacaaacatttgaggctgggcacggtggctcacgcctgtaatcctagcactttgggaggccaaggcgggcggatcacaaggtcaggagatcgagatcatcctggctaacaaggtgaaactccgtctctactaaaaatgtaaaaaattagccgggcgtggtggcgggtgcctgtagtcccagctactccgcaggctgaggcaggagaatggtgtgaacctgggaggcggagcttgcaatgagccaagatcacaccactgcactccatccgggtgacagactgagactccgtctcaaaaaaaaaaaaaaaaagaacagcaaaacaaaaaacaaaatttgaaagttgtactgccatcacatttcataaaagaaaatatttttacaccaaaaacgtaggaaggacataatctaagaataaaggacagtttctttattttgaataaattaagctttatgaaaaattcagtgcattgtttgtttttttgtcattcttgctgcaggtcaatgaaaactgatagatccacgggcaggcatttgggaacccatcagttaaagatatcttgggtttcttctgtctcccagagtcttttaaataattggcatttttttccttctgttttttggtatcatagcttcatatctttatgcagtttgaaaattaaccttaggccacaccttcaccaccaaggattatgtgggtaaagacaatgatccgaacggcttttcccagaggcacacctgaattatgcaacaggagtgggagtgagcattgttggaattacctggagttcccaaagcagcaggagagcacaggtgtccggaaaatagctaaggtctctgcagacatagcaaggtggaaaaggtgagaattgtttagataaacaattattccaaactctcaccggaaataactacgatatgtttattttctttaaatcaattaaattctccttagtttttctgtagaaacagccattttattttttgagacttttttttaaattttttattttattttatttgctctgtcacctaagctggagagcaatggtgtgatcacagttcgctgcagccttgccttcccaggcctaagtgatcctcccacctcagcctcccaagtagctgggactacatgtgaagaccaccatgcctggcaattttttttttttttttttttttttttaaggagatggggtctcagtatattgcccaggctggtctcgaactcctggactcaagcaatcatcccacttgtcctcccacagtgttgtgattatagcacccaaccagaaacagccattttaaaccaaactttattttttaggtgtcttcccaaatagtattatccccaagaaccctactgataaatttagggagcaggtacaaatttccctcttcatttcattctgacctgagtcattgattcacgattggcctagaatagtccaaaataaatttttgtttttgttttttttcctgaatatctccttaaccaggccctaatcagaatttatgtaatctacttggtgaaaaatcaagacttaatgagatatctctttatatagcaaattaacagtttttaaaatgttggtcactttaggagctcatatgcaactgaattcatatttattgagtaaccaagggattggtggggagttggtacctttgtctgttgtcctgagggcagccctttattctttgtgtgcagtgatcaatttgtctaggacaaggcggcagtaaccacattccctttacaactaagggaacaagtaccctcctccatggaaggagcttatttgcctgtttgtttttccctggggatagatgtagacatgaaataaacatcttcctcttctgaagtgaagatggttctagcagtgctgtgtttctttaaaattgggtttaccataagaatcattattacttcattcattaattgtttgtttgttttcttttttgggagccagggtctggctctgttgcccaggctggagtgcagtggcatgatcatggctcactgcaacctcgacctgcgtggcttaagcaatcctcccacctcagcaggaactacaggcacgtaccaaccaacatgcttggctaattttaaaaaaattttttgtagagatgaggtctcactagattgcccaggctggtttcgaactcctgagctcaaggggtccacccaccttattctcccgaagtgctaggactacaggcttgagccaccacaacctgctcgttcattcaattttgattaggtccttaccaattagaaaagatactttaaaaatccacctaagggaattaggttttcgagtatgcaaagcatcagagaatctaagttagaagaggctgccaatttagggttgccagataaaattcaggactgctggttaagtttgaatttcagataaacaacaagttactttttactataagtatgtaccaaatattactggggaacatacttatttggaacatacttaaaaaaattcttgtttgaatgactttccaatttaactagttttctgtgtttttatttgctaaatctggctaccagtaataatattaacgcaacagtacctgcttatcttagacattctagcttttgattaagagtatgggcgtgggatccagactgcctgagtttgaatcctagctctgcaacttatagtgtgtgaccttaagcaacttttaaaaatttctccgtgcctcagtttccctgtacaggctgagtatccttaatctgaaaattccaaatttgaaatgctgcaaagtttgaaatgttttgataatcgacacgatgctcttcagagcatttcgattttggatttttgggttagggatgctgaactggtggtgagtgtaatgcaaacgttccaaaatatgaaaaaaagcacaatctgcaaaaagcattttggataagggacagtcaacctgaagtcaaataggttgttatttggtgctaagatgtaaatgtatatgtgtttaattaattttatgacgccttattgagtcttggctacggcatcatggacgtcttacctgcttgataattttaacagtacatgtatgtgtcctaaattttcactaatctatcattggcctcatctgactttggcaattgggaatacattttccatggcccttcttccataactcttcagtaattttcagttatggctcaatcactgtctcatcagcattttctcttagcactatggcctgcccttagaccagaactgggcactgctgaagtggtcttaaaaccacttcatcttccctaatagcaattcatgttccaccccttcaagtatgaagatctttctggtcagtgacaaagagaagtaaaagcataatcatgtcattctgcatgcttacctttgtatatgcacaataatctaaaatattatctttaaaaaaattatatgattatatgatccatctcacattgatttgtattaagtagtaataacactgtgtctaatagaaactaacaaaccattgcctctaaaacagcacctggcatgttaagccacacttgaaacatgcatcatgatttgagatattacatgataaaacatgtgccttagaggatattaattaaggaaaagccattactatgtgctgtgctcacagtgctgagtgttctataattattttatttaagtaaaatgagactatcaggtaggtcctattttatctccatcagcaccagccaatctgactgaacacctgggctggttttcatggtacacaggtcttaatatgtaaatataaaaatgttctcctgtgggaggaaatctcatagttttaagtctttatctaaaactatatatttgtaaataactttctgtttaacaatttatttgtaaaatttctaaacaccttgaaattgatcattgaaagaaacagttttgaatgtctctgtgtgttgtttagattttttttctccatgaagtcaagaagttatatttattctctccatgaagtcaagaagttatatatattctatttattttgttcactgtcatatcccgagcatctaaaacagtgcctggcatgttaagtaagcacccaattcaaattagttgattgttgaatgaataattggaaatatttttcatgtgatcataagtcttcatttattttcgtatattaaaatgtgtaaaatttttaaggcccagcataagcatagcctctctgagaggccatcttgtattccccaagcagaaataataccttctttccctaaacctgatgtaggtgggtttataattttcttctctgaaaactaccttatttatgattattactgttattttgagacaaggtctctttctgtcacccaggctggaatgcggtgacgtgatcttggcttgctgtaacctctgatctgggctcactgcaacctccgactcctggcctcaagcaatcctcccgcctcagcctccccagtagctgggactgcaggcacacgcccccatgcctggctaatgtttttgtttttgtttttgtttttttagagatggagttttgctatgttgcccaggccggcctcaaactcctggcctaaagcgatccacccccttggccttctaacatgctgggagtacagacaggcatgagccactgcacctggccagaaaattacctcattgatgccttttaattcctctaagcttctggagaacagagctgttagttcatcttgtatccctgtatttgttaaataagtagatgaatatttttttttatttttttttttggagacaagagtctcactatgttgcccaggctggagtgcagtgacatgatcttggctcactgcaacctccgcctcatgggttcagacgattctcctgcctcagcctcctgagtacagtagcagggactacaggcgtgtgccaccacagctggctaatttttgtatttttagtagagacggagtttcaccatgtcggccaggctagtctcgagctcctgacctcaaatgatctccccacctcagcctcccaaagtgctgggattacaggcatgagccatcacgcccggctgatgaatatgtttttagtgtacctaacggatacgaaagttcaaaggaaaaaatgcatatcatttgaggggaggactgataactgcttttttcactctttggccatttttcctttgttttcttttctccttgctgtacgtgtcacccatcttgaaagaatgtgctttagttcatttaaaataatgatttcattttgtagcaccttggtaatttattactcttccttaggaggaataaagcctgtgctagttggatgattgctttcgtctttacttgtaatcttttagaaaacaagtacacaaactttccacttggacagtcattgtgaattcttgataacatctggttacttaatttgaaaaatgtgtagctatgaatattaatgatggaccttaactgagttaaattcagacatatataggatctgtattaatctcagtcaaccctttcaagcagatgccatattttggggaaaaggaaattgaaatgtaccaaggagcggtaagttacgtgtcacataaattactgccttatttagggcttttatgatgcagacatggtttttcttgaagttagcagtacttttgcacttttctattatgaattttttattggagaaacttgagtgacattgtttgatttttaatgatctgctttttatttttattttttaatttttattattttatttttattttattattattattttttttgagacagaattttgctcttgttgcccaggctgggcatgatctccgctcactgcaacctccgccttccgggttcaaacaattctcctgcctcagcctcccaagtagctgagattacaggcatgcaccaccacacctggctaattttgtatttttagtagagacggtatttcaccatgttggtcaggctagtcttgaacgcctgacctcaggtgatccacctgcctcagcctcccaaagtgctggtgagccaccacgcctggccaatgatctgctttttagagcagagctcaaaaaagcttaggactgtctaatatttgagccttatttgcatagaaaattagttaaataggatgtaggacctacagcttagggatcttcctgcttccatatatgccacaaaaatctaaggaataaaaatcagttatgggtaaaaaaatagagcaatgggtactgatttgcagaatcagaaccattgttaaactatgactatgacttcaacatgaaaaatgaatcttgtattacttcatttattaatttgaccctggttcctattcataatcagctccatagccatttcagttgtatagtaaaaatggaagctgtaattctccttaatatattttattctgtggttcatcacttccccaggcctccccatctctgcatctttttcctttccttttccttcccactgcagcagaagcacaagagtattcattaatcctgacccctaaaaagcaaacaaaagagagcccacacaaattcatcagttgaagtggaaggcaatttacccagagcaagagcccaccccattgttgccagatgaatggtgctggtagctggagccgaaggaggctgccacgcgaaagacctttgataatgctgcctttatgggagcccagcacaagggaaacactgtcagcagaggctggccctgccctagtgccctgatcagcaggcgcacagagctggcttggcgtcctcaatgacagccaaggcgctgtagatggtagtgctgtgcatgtgtgtttctctccagttttctgaaaagggttgctgtatacacatcccttttagaccatttatcttttgaagtgttctctttaaggaaatgtagaatttctaaaaaatatgctcaattttactgctaatagtaacagattattgtaaaactggtatttactgagtgccatgtactatgttatacttgcagcaataataaaacagccctggatgctggctgtgtcataacatctatctccatttcacagatgaggaaactgaggctcagagagatgaagtactaaaatctactgagtgatggagctaggagttgaagtcaggtcctaatgactttgagagtctcaggggagggaagaatcaggtaaaggaaatgcccactctatagttttgtcacagatagctgagaggttcagtaagaccacagataggaaacgagtttggaaaatatagagtgacatgcaaaggtcaagtatgacagttcagcagcgttgaagccttactgggcaatgactttcccccactgcccatagcttgcttttcactccatttccttccattttccatcttcgtgtctttcttacagtcctctactttctcattttcaaagagtcattaatgttgtttgtgcacttgagaccagaaacccaaaatgagggtaactgagaggggtgctaagggctaagttttggtgacactctcacctaagtgagaacctgacctaaagaggggaatttttaaacaaaattatgagagtccgttgttttggactgatctcatgcagtagcccctaacagaccagaccaaaccaaaccaacatggaatcactcatgttacatgtgacataatcgaaactttaaagaaacagaccaggagatgccagcaggaggaggtccgctctactctaacccttacaaaaagtaacctagagtctttgttccaatcttacaaaccctactgttctgttatttctcaatgatatttgagaacaagtaagtacatttttacaatggtgacagagtgacatcagtgcctaaagttttggtcagtgtctcaaaattgagaggacgaccaaaagagggaaattggactgggcatggtggctcatgcctataatcccagcacattgggaagccaaggtgggaggatcactggagcccaggagttcaagaccagcctgggcaacatggtgagaccctgtctctatttaaaaacaaaaacaaaaaaaaacaagagaggggaattgttaaattaagtttagcctaaagctgcctccttacatattttaagttggatctaaatgttttcttcttttttttttttcttttgaaacaaagtctcactctgtcacccatgctgaagcgcagtgctgtgatcttggctcacaggaacctccacctccaggactcaagcgatcccccgaccgcagcttcccaagcaaatagctgggactacaggcacacaccaccatgtccagctaattttgtttcttttttgtagagaggaggtctcactatgttgcccaggttgatctggaactgctgggttcaagtgatcctctggccttgcctcagaaagtgctgggattacaggcattagccatcacacccagcgctaaatgtttctctgtgcacagtgaactgtagcctaagcagatgtataaacaaactataacctacttttctgccagtcactgagttttggccaatcaaaggtggccaactattcaaactgtgttcaaataaggcaaattctaaactaatctgtaactaatctggctgtttctgtacctcacttccattttctagatatatatttttttgtttgtttgttttgttttgagacggagtctcgctcttcaccagactggagtgcaatactgcaatctcagctcactgcaacctccacctcctggattcaagcaattctcctgcctcagcctcctgagtagctgggattacaggcatctgccaacacgcctggctaatttttgtgtttttagtagatactgggttttgccacgttggccagactggtctcggactcctgacctcaagtgatcctcccacctcagcctcccaaagtgctgagattacaggcctgagccagggccagccctcacttccattttctgtatatcactttcctttttctgcccaaaaatcttatggcatatggcagcactggaggctctgtgaatctattcttgttccagggcggccttattcacgaagcattctttgctcagttaaactctgttaaattaaaataataattataataatcctgcacaatcttattgtggactagaagtccatttaaaaccatatcctgaggtcctatccaggtatccactcctgaccataaggttaaggcagagatcacatattctggttcctgcatagggttctttaggtgaccagtcctaggcatagcttgcagccctcactgggtagctccccctatgagccccctgcctacagcatgggaagaacactgggtatcggatacaaagccccctcatcctaacccctccccaccaaactctcatcttccagagcacggcagtgagcagcaacttctcagccaggcccccttttctacagtaagtcactgcacaataaaatggattaagtaaattaatccaaagatggattaagtaagttaagcttcacctttgtatatcactctgtcttttcaaattgctttcccatccgtcatttacactgtgagacttgcagcttggacgctattattcccacaattgtagctcactgcgtcctccaactcctggactcaagctgtcctcccacctcagcctcccaagtagctaggactgcaggcatgtgctaccacacccagctaattaaatttgtgtgtgtgtgtggagactagactccaagtcctagggttaaacaactcttctgcctcagcctaccaagtagcttggagtgattacaggctaggagtgttctttctccatatatactcaacaaagtatttctctttttagtaatttttgaggttgtggtaaaggtaggtgtcaagaaattgtataaagcagggctgaagtcagcctgataatttattaagcatggaaaatgtatttagtttgatatttgtgcatagctaagatatcccataagatgaaatcacaaacccaggagaatatcttagcgtggtaggatttttttttccaatagagatgaaacaaactggccaaactagcttatccctttaaagaaccacaccttcttgccctcttcttatggaaagatttaagtattttttctgatccatagataatctcacctaattccctctgaggccccagaatctacaacgtggcctcttagaaaaaattacgtaagagtttagaattctggtagaagtcagatctaggtgtttggcaggcctctccaaagacctgttgcccaagtgtctacagaaacatttagaaatggactgtcacctgcagaggcgtgtatgggtggaagggtggggtgttggagtgtctaaagacacggggcacatccggaaggctgaatcatggatatgcctatgggagactgcttccaaattccgtcttaattttgtgagggtgtaaccttgatgacctaggaagttttatgaattcttgtatcatgcaacctttaagatgtaatgataggcattggaactatagtgcacgattcgtttccaaattcaggaaaagaaattgagtgtattgcctatctgaccatgattttgtttttatttttaaatttttattattatttatgtattattattttttgcttttctaggcacagtatgaaaacccaccacatatctatgcccttgcagataatatgtacagaaacatgatcattgacagagagaaccagtgcgtcattatcaggtatgaaaaagatccttatcagtgggcgtggaagatatgagactatgctgtggttatggatttcggtcgataagcagtggttttgcaacagctactgatgtcacagcctggttaatgtgtctgagtagcaagcaggttagctgctttatcttgctttatttataactctatataatagagctccatatcataaaacttttgagcttccatgggattgcagtaagtataataaacatgttttcactgtttagtcaggtgaattccttttctgtaggtccctattttttcattcccttcataatttagtagttcatgtttgaacatttttggtgaactttgtcatttgcattgaatttgggggaagattactggtaattgccagcattaggtgtctgtagccacatttcataatccctctagtctgacatggctctgaatcctggctgggtttaagtcaagcttgtccaacctgtgggctgcaggccatgggccacatgcggcctaggacagctttcagtgtggcccaaagcaaattcgtaaactttcttaaaacattatgagatttttttgcaattttttttaagctcttcagctatcgtttgtgttagtgtattttatgtgtggcccaagacaattcttcttcttccagtgtggcccagggaagccaaaagattggatactcctgccttaagtgcttttaaaattctgcttatttacaaaaattagctgggcatggtggcgcacgcctctaatcccagatactagggagactgaggtgggagaatcgcttgagcctgggatgaggaggttgcagtgagctgagatcgtgccactgtactccagcctgagtgacagagtgagactccatcttgaaaaaaaataataaaataaaattctgcttactaactccagttggggtggctcacacctgtaagccgcagagtttgagaccagcctgggcaacatggcgaaaccccatctctacaaaaaaatataaaaattagccaggcgtctggtgtcatttgtctgtagtcccagctactgaggaggctgagtggggaggatcacttgagccagggaagtcaaggctgcattgagctgagattgtgccattgcattccagcctgggtaacagagcaagaccctgtctcaaaaaaaccaaaccaaaccaaaccaaaaaaaaaggcttataccttagtggaggctgagacaggcagatcacttgaagtcaggagttcaagaccagccttggcaacatggggaaaccctgtctctactaaaaatacaaaaattagccaggtgtggtggtacatgcctgtagtcccagatactcaggaggctgaggcaggagaatcacttgaacccaggaggcggaagctgcagtgagccaagatcacgccactgcagtccagcctgggcgacagactgagactccatatcaagaaaaaaaaaagctctgcttactattgtgaatattttcaaacactagaaagtataagcatccatattctcatcacctagaatttgacagttcacaatcttatcatacgtatttgtgttcatcttttttagttaatttttctgagacatttttgggaaaaaaaaaaccttttattgtggataattacaaatatacacaaaatgagaaagaatagtagaatgtgtccctgtatatctattatccattttgcactgttgtcagtatatggccaattctgttttatttggtcctcccattctgtcccacttgattacttaaagcaaatctggcagggcatggcagtagattcatttccaaggtcaagaaaagagtatatgtaatactagcactttgggaagccagggggcaggaggatcacttgaggccaggaattggagatcagcccggacaacatagcaaaccctgtctccataaaaaagtttttttaattagctgggtgtggtggtgcacacctgtagccctagctactagggaggctgaggcagggagatcgcttgagctcaggagtttgagattacagtgagctgtgcttgaaccactgcactctagccaggcgacagagatggtgttttgttttgttttgtttttttaataaagcaaacccaaagatcccctttattcctcaataattagtatgtgcctctaagaaatcattcttatcacaccttaaacatgaagaattcttttatagtatctaatatcagtattccaattccatgattttcctataaattcttttttatagttggtttatttttatttaggatccaaacaaggcctacacaccgcacctggttgctgtgtctcttaggtgtctcggtctttaacaattttcccttcccctttttgttttcttggctttgttaaaaaaaaaaaaaaaaaggttgtttgtcctgtagatcttactatacagtctggcattgcctaattgtatcctatgatgttgcttaagtattccattgtcccctacattttctgtaaattaatagttatatctaaaaacttcattagacgccgggagtggtggttcacacctgtgatcccagcactcttgggtgggcagattacgaggtcaggagatcaagaccatcctggccaacatggtgaaaccccatctctactaaaatacaaaaaattagccaggcatggtggcgcatgcctgtagtcccagctacttgggaggctgaggcagggaaatcgcttgaacccaggaagcagagttttcagtgagctgagattgcgccactgcactcaagcctggcgacagagtgagactctgtctcaaaaaaaaaaaaaaaaaaaactcgatcagactcagattccgtttttggcaaaggaaacttcatcagtgatgctgtgcacttcatgcctgttgctctctcttcgtgtgtccagattgtcagtgaacccggctgttataaatcatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacagtctcttcaggggccttggttcttttctttttcctttgcttttccttttcttttgagaccaagtctcattctgtcatccaggctggtagtgcagtggtgtgatctcagctcaccgcaacctccgcctcctgggttcaagcgattctcctgcctcagcctcctgagtggctggggttaaggcatgcaccaccatgcctggctaattctttcgctttttttttttttttgagacagagtctcactctgtcgcccaggctggagtgcagtggcacgatcttggctcattgcaacctccgcctcctgggttcaagcagttctcctgcctcagcctcccgagtagctgggattacaggcacacgccaccacatctggctaatttttgtattttcagtagagacggggtttccccatgttggccaggctggtctcaaactcctgacctcaggtaatccgcctgtcttagcctcccaaattgctaggattacaggcatgagccactgcacccagcctcttttgcatttttagtagacagggtttcaccatgttagccaggctggtcttgaactcctgacctcaagttatctgcctacctcagcttccgaaagtgctgggattacaggcacgaggcaccgcaccccgctaggccttggttcattttaatgggaaatggcattaagagaccactaaactagacaccaagagtgctcactgccctgtgttttcagtgcctatagttctttaaaagtacaaagctagggaatatgagctttttaagagaaaaatgaagttgaaaaattaattgttttcaattaatttttaagatttcagagtttttatttctttgattttaatttttgtatcccatttatcttatgctgaacaatcttagttcctgattacattagcaattatttgcattgcattgtatgcgttttagacagatagaataagtttgttaatgctgttaaagtaacaataccagtattattagtagcaatactgaattcattttaaaatttcttttctggtttttgtccaaatatccaatatttgcagtcaaaatactgggtttcataaaagtcacttaaaataatccttttctatgtcaacctgacctacagttgggttcatttatttcatttacaatttcagttgttttgcatttttaaatgtaattttgtttttataattatgcaaaacatttacatggttcccaagtcagtactgcaaaacatgagcactgaagcatttcaaggtaaatacatatctgaagtatttggaggtaaatatagacttcatgacattttacccctaaatatttccacatgcatctctgagaaattgaaacattttcttactgatccgaagaccattatcataactcagtaattaatagtacattttcaacatcatctaaaaacttcaaacttctctaatagtcgcaaacgtccttttctgctggtttatgcaaatcaagtaacgctgactgcatttggttatgaatcataaatttatttttatcctaccacaattgccctattactgctgttttttttcatgacactgactttttgaagagaccaaaactagttttcctacagacatcatttacatttgtctaattgcttcttcctggtctcactatacttattccttcagttggattttctacaagtttaaggttatatctaatgacttgatcagatgcaggtgcaagttaaattttatgaggaggaacacctgggtcatgttgaatttggttgcttaataggaaatgcttctgtttgatactaagcggaggtcaccgactactagagaggcaggaggtattttcctagctggaatttaatgagggtccaggatgagttttctgatagagtcctctgccctttctctttcctcacattttccctcttctgggtgtgtgccaaaacgagtgggatgggaatggtcttcttacatgagcttgccagtctggaggccccctcagtcttctgcagcccacgtgtctccctccacctgcactgcaaggtccacctgcactgaagcgggatgatgcccacttcagatccttgtttccagctgttcaggtggcagagatttcaaggacctgctcccaaggatttctgttgcagtggctgtgttttcatttaggagatgtgctttaatttaggagctacctggagttgggccaaactccaggttaagggcacaggcctcctcggtagactgcccaccctgcagacatcagctgcatgttcagggctccccaggccaccctcatcaattcaggggttcccactaccccccgcccccgccaggttcagtagttcactagaacaactcacaaaactcagaaaagccctacacttaggattacagtttcgttctggcaaaaggaggatacaaattagagccaaacaaaagaggttgagggcgaggtctgggagggtcccgaggtggagtttctggttttcctctccctgtggagtcatggacagcgctacctcctaccggtatgaggtgtgacaatactcacagtattgccgaccagaaaacatcacctgagcctctgatgtttggcctcgatcacgcaccgcctgcctggcccaccttcagtttccagctgctctcgaaggcttgtgcaaatgcctttagtttccagttggaggtcagaattgcgatggtatgtcccaaagcccccgacataaatcatatcgtcagactctcctatggtcaaagcccccaagaaaggaaaagcactcctcttaggtaggacattccaggggcatagacatcaccgcccagtcaccgagggcaaaagcctgagcccttgagttaattctcttctgcaccagggctgtggtttgtctgctttgagaaagcaaattggaaacctctggcatgccgtggttcatgctcacctgaccctgggcagcacgcctcacacctgtctgggccttggctttttcacctgtgaaggaactggttttggaactcttccttccaaataatgttggagaggaggaaaggcagggaaatcctgttctgggtggaaaggccaagtttgtagcccctgacactggatggggcaagtgctccatctgttannnnnnnnnnnnnnnnnnnnaacgaaaaaaccattttcttggaggctggaagagaagcctgctcctcatgctaagggattctggcatggctggaaagactaggaatctttagtgtcatttaattaggaaataaaaagtgagcgatgacctaatttctatggtggtgttttagacttccacctcccagtttccctggtgtgactttgtctaaatgacactttagatggcataatgcagcccataaaggcggcgtttctagtttcctgtcagtcttactcatattttccaacgcagtggatacggtgacaggatggacaggcacctgaccatttcaagactagaaatgagtgtaacaaatcggatttttttttttttttttgagacagagtcttgctctgtcaccaggctggagtgcaatggcgtgatctcagctcactgcaacctctgcctcccaggtccaagtgattttcttgcctcagccttctgagtagctgggactacaggcacctgccaccacacccagctaattttttttgtatttttagtagagactgggtttcaccatgttggccagggtggtcttgatctcttgatctcgtgatccacccgcctcagcctcccaaagtgctgggattacaggcgtgagccaccgcgcctggccacaaagtggattttgaaagaaataaatcaaggaaggagacgtgctgctttctcaagcacagggctccatggacgcctaggtccatctacaaacttgatttgtcaaaacagctggagttgagcagccttgggtagactgacttgccaagcaaactcacaaggaagtgtgaatcagaccccaattcattattgcataggcagaattctgcctgtggacagccgattatgtgccctggaacacagtccacgaagggagctagattaccacgagaacgctggatagaggggtgaattctgagcgaagggatgatcgtatttgctaaatcagctcacagcagtcacctctatctgaagatgtgaacacatgaactaagggtgttgctctagtctgcagaacagtctttttacttggagaaaaccccccatctctgctgtttactttcctgtcctgactctgctgtaagtcaaccccctttcattaacctacactctctcctgccaagccctgatgtctattaggccaacttctagtaaggaataaacacctggggttgaccttggatatttcctatgccttcctcctcagcccactggcagacaaatcaggaagagtggcttctatggatgctaacttttttttttttttttttttttttggagatggagtctcaccctgtcgttcaggctggagttcagtggtgtgatctcggctcactgcaacctccatccccccgggttcaagcaattctcctgcctcagcatcccaagtagctgggactacaggcgcccaccaccttgcctggctaatttttttgtatttttagtagagacagggtttcaccatgttggccaggctggttatgagctccagacctcaagtgatccacctgccttggccgcccaaaatgctaggattacagttatgagccaccgcacccggcctatagatgctaattttatctaccatgccttgtgttcactaatttatccttttttttttttttttttttttttttgagacggagtctcattctgtcacccaggctggagtgcagtggcacactcttggctcaccacaacctgtgcttcctgggttcaagtgattctcttgcctcagccttctgagtagctgggattacaggggtgtgccatgacacctggctaattttttgtttgtattttttagtatagaaggggtttcgccctgttggccaggctggtcttgaacccctgacctcaagtgatctgcctgcctcagcctcccaaagtgctctgattataggcgtgagctgccatgcctggcctaggttcaccaatttaactttctagggataagtatttctgattcctgaattgccttactagttcagtggctctacagatatgtaggctccacctccagagattctgtttcaactgatttgtggtggccttggagcattaataccttttttcaagctcccccagctcactctgcttaaaagccagggctaaggctcttgaaatcctgatttcaggtcacctcttgctgttagcaccatcagaccccgcaagatagacttcctgagtgcctgccctctgctggttgctttcgtataggttgtctcttaatccttaccactctgttggcattgttttttgaagctgcatctaaaaaatgaggcttaagagaattccaagatccaaaactagtagatggcagagcctctatttgaatttagccctgtctgacttcaaaccttatgcactttctttatacctattagcagtgatgtctctctaggtctcaaatttcccatattttaatggagatgtaatagttaccatataccataggacagaggtcaggacaggttcgccaggttagttacccctggacttgagctcctaggattaaagtctctcactctgtccccacaaatacaggtgcttttttattttagtttttgaaaaagagtctcgctctgtcacctaggctggagtgcagtggcacaatttcaacacactgcaacctccgcctctcaggctcaagcgatcctcccacctcagcctcgcgagtagctgggaccacagatgcgcaccatcatgcctggctaatttttaaattttttgtagcgacagggtcttcttatgttgcccaggctggactcaggtgctttttaaaactaaccctttgtcattgttggccgtgatgctctctgcatacccaggaggatgatgattgggcttgtcatcaacggaggataaatgacgcacagacttagttaacagaagaacatgaccttattgacacattagctttgatttcttaccaagaggtgaagatgcatttatacaccaaatggccatacctgggcagtttctgtattttacctgacttgttatccagtggatttgtctgggggccagagctcagtcttccccttcttttcatggttctctatggcctatttctatattatagcaggcctctgagcagagacatgatagcactgacacctggttcaaaaagataaggttactggtagaaaagagatgggatgttgagggaatatggaaatctattgcagcagtgagggcctgacctgagttagaaaggcgaggaggaagccgacgtatgactttcagtaagcctgtaaagaaataaaggaatgggcaagtgtgaaggtagactctgggcagtgccaacagaaaaatgcaacagcaatagctacattagcatcattaagaatgatagtgaagctgggcatggtggctcacgcctgtaatcccagcaggtgggcagatcacctgaggtcaggagttcgagaccagcctggccaacatggtgaaaccccatctctactaaaaatataaaaattagctgggtgtggtggcaggcacctgtaatcccagctacttggaaagctgaggcaggagaatcagttgaacccaggaggcagaggttgcagtgagccaagatggcaccactgcactccagcctggatgacagagcaagactctatctcaaaaaataaaaaaagattaaaaatttaaaaaatttaaaaaaagaatgataatgagcacctgaaggcttggtaggtacctgtgagcccagtaaatgagccacccatatctgcttagctcattaatctgttctccaaaatccagaatttggatttgtgcattaaaaccacatatgtgatacctttggatgtcaagagacatctctgcaaatctgtttaacaaaaaggtcatgatgtggtaaaggaagaactggcaagctttgttcatgatctctaccatctctccatcaccagacaagatcttgacaatgtggccagaggcatttctgaagcccttgccaactgacccatggagaatcatcgggccttggagaacatttatgtggcagttttattgctgccatcaaaagtgaattcttatcacttttggcctaaatcagctcttgcaccttaggctgtttaaaaaatatgatgtcaattggaaagcatcccatttggtgctgtttctactttttttatttgaagtatcctgacgcagttgttttctggtgagtagaccatctgtcctaaatatatccaataccagtttgcaaagtctttgtcaggtgcatcctgcatagaagctaaataaatacttttttaaataataaatagaggcgagagatattttgaaggtacatcagtgggatttgctgactgattgagtaagagagttttcatagaggaaaaggagatagtagtcatcactggagctaagatttctgacccgtgtgcttcaacatatattttagatttgaaatatgtaatttttgcagtagtaaagataaaagggaaaaattcccagtgccgctcatatttggctcgtgggtctctcgtgctctttgctgtggcaccatcaggtgtctccggattctcaagctatcttcctgcctttgatgtatttcaggaaccttttattattagcatggggacgcttttcagggctctcctgagttgctgtgggtccacccaatttcttgtttatcccagcagcaccggcctttgacctcgccatccccctggcctggctttgggaggccctgtcagcccatacctctgactatgacggggttgcatggggctgccgctggctgtaaatctgaagagcaagggcctagattgaccctgttccccaagctttctgcaaatcttacattctagtctggttgctaaaattcctttatcatcagccaaggagtgctattcaggagggctgcctaattaatatattacccataaacataacagcaactctttttcgagtacttgctttgcatccttttaattgtatcatttttcatctttacgtcagcctagcaaactaggtattgctgtcccctacttttgcagatcaagaaactgagtctcaaagaggtaatgaaactgttaaaatcttgcatttgaaatgtgacaaagttgtgctcccagccagagctgcccgcctccgatacagcagtctttatacttttctctgctgctttgagccagcaggtgttaggttaactggttaataatccattaccactttcagtcatgaggtgcagtggaaagacctctggggtgagtcatagggtagactctattctctctgtctaaggcgtgtgacccctgcaagcctcagttacttcatctataaattgggaatttataccttaaaggaatataaagaaagtgtaatgaggaaatatacatggaaaacattttttaactcttaaagagtaatgtaaaagatctgctagtaacattcaaaggaatttcagagctgggaagtagctgggctgggactcaaacttggtcttcatactcaacattgggttcctctgactgcatcaggctgggccaagatgagcattgccatggggccatccatattcttggcagagtaggtgaaaattttgtttgcttgacaacaccaattaactagatatttgtctggggttgggaagaaataacagctgttggtcttattcacactttcctcaatctgttaaggaatgaatttgtcttatttaaccagtggtttcagcatggctgtttgtttttgtcttttataccattagccatggcatgtatttgagaattagttttttagtgtaattctaaagtccgatggaggacccctctctccatgaccctggaacctcccagatgtgcttcacctccgacttgtttctgttccagatctagtagggctgccaggaagcggagtctgtgaattgagccattggagaagactgtccaggaccttctttgatgtggtttctcattctcgcagaattatttgtcttatgatcacagtgatgtaggctatttattatttgttagttccaactctgcgtgaggtaataaatgttgttggcagaaggcttgcttaaatgggtgtgtatcagtaaagactcaggagtagctaaaagtttgctgatactatgaactgtgctgttcatggggttcctttgtgaaaccttgttgatttttattgactagtcaacccatatgagggtcttaaaggtttaccgtcctctgagcagtagagctcttgcccctgacacagactctctcacctccttttctagctcttccactcactagctaagtggccttcagcaagtttcttaccttttctcacttcaaataatggagattataaaagcacctaccacacaggactcttatgtggaccaagtgattgacacatgtaaagcacttataacagtctctgacatgcatgatacacacaatgaacacatcgtacctccaattatcatagccacaatatttcagtgtgttcctttcaagcctcctttggaattgatgttatttctcatcgtctagactatgttttaatagatgaacaactgcgttcatcttttataactctagaattacaaaaattggtttttaaaaactatcactatatttttaatccttgggttataccttttgaaataagagttgtgttcaatactatatctctctatatttgaaaaaaaaaaaaaaaaaaaagcagggtctaattaaataagtccagtgggaatttccactgtcttgtttatctccctgacacattgacatggttaatcccaactccgttggcccccatgaagccacatgcatcttcctgcttctctgtgtacctctctgacttttctatcttgttctctgtgtttgccatgttttttgccctttacagctttaaagagttcaggcattaaattttgtgggatgacttcaggctgagtctacccatttcctcgtgaccaggctcaggtcatgcattctaggctggactaccatagaaacaatgcagggctcttgatcacctggttctgtaggcatctgctaggtttcttctcattaaattaattttattttcttttaggatgtgtattttgtggggatatattctcagatcatgacaacatccttctccacatccaaacctccacctaccagccttagcatccattaatgactcctggtcacctgtatgatggctgccaaatggtgatatatctgtttccatcattccttccacatttattagttggtattccactgtgaggaagagctttcctttctctcctatttactgattgactcgtttactttcgtatggcactatggaattatggcttcctattttattcaaaggatcgtaatccattattatcattacttattttgatttggccagtgggaaccccttccagctggctcttatatgcttgacacgtccacaccagtcactgtacatttccttaccttttggcacagttatatgttccacgcccagtttgaattttccccactccagccctggcattggtcatttcccaaagcagcccttgttctttttattgaagaatagtattcagagaccaacaaaaagtgtgtcaattttgaaaactaagtaaataatatatcagttgttctgtataggtaaaggcaagttcgtcggtatgctgccttgagaaaatggaagtctagagtctatataaaatgtagcacgaaatggcacaggccagaacccttggtgcatccccaaacctgaacccaaggtcactgtcttggatctctgcactgccttccagttccactccctacccctcccagcttcccacatcacagtcaaggcctattatttatttacttgtttattttattttattttattttattttttagagacaggatctcactttgttacccaggctggagtgcagtagctcaacaatagctcactgcagcctcaacctcctggactcaaacaatcctcccacctcagcctccaaagtaactaggaccacaggagcacactaccacacccagctaattatttttaattgtttttatttaaaaatttttatttttatttttatttatttatctatttatttttgagatggagtcttgctctgtcaccgaggctggagtgcagtcgtgcagtctcagctcactgcaacctctgtcccctaggttcaagtgattctcctgcctcggatctcttgagcagctgggactacaggcgcatgccaccacacctggctaatttttttgtgtttttagtagagacggggttttaccatgtcggccaggctgctcttgctgctcttgaactcctgacttaaggtgatccacccgccttggcctcccaaagtgctgggattataggcgtgagccactgcacccagccaattgtttttatttttatttgttttattattattgttgttgtttcttttgtgttttggggttttgtttttgttctttttaagaaacgagatcttgctgtttgctaaggctggttctccaactcccttggcctcccacattgctgagattacaggtgtgagccactgtctcctcaagtcctgtttaactacccatggttcccttcatgtgtaccccacagaatttttgcctcttatgtatggctcaggcttcatcctagcccctgacatgtatacacacaagtacacatacacacacgcaacacacctggctgatttgattgtccttattgagatgtaactagttgtgacttcgtttagtaatcttctgatcagggatagctgccacccccaaatccctaaagccatacccacatctccactgtgttattaatagcctttgtatactcgacttccctgtaagacagtgagtgagctcttctctgacaggagccacatctcattctggccttcggcttaacacactggggcagagggggttgttagacagtgtgtgttgcatgaacaaaagtagacatcatttttgttttaagtgtttgtcctttttaaaccacaaacaaaaagttggaaaagtgatatttcaattacgttgattcagccagttacaagggaacaccagttcctgtggtacagagccaggagagagatttttagatcagaaatgggggatgggggtgcattggtgagtcgtccaacagtggtaacagcggatcctacttattttagggaatatctcaaaaaatcaaaataaaaaagaactgaaatatttttacatttgctgaataagttgaagtgaatagaaaatactattgacttttaagtgaggaataacctttctcagaaaaataattatggtccttggattataccattgtaaatggctttttttccccagaacattctttccatttcgttgatattttaccgtatgtttccatttctatagttagtacacagaccccccccacacacagacacacactctacaatacttcctatttgaattaatatttcctataaagtctgttatgactttgatttaaaattgcttggcttgttcccagctggctatacaagaactagggagtttgttagaaattcctattcctagactctgtccctggagactgggatccagcaggtcagaagacgggcccagacatgggcaattaaaaagtactctgacgattctgatagactgccagatttgggaaccactgggatattttcctaatttctagagtatttgtgtgtgtgtgtccattttataagtcaattaaattaggacgggctgcctggaagcgtaaacaaagcaaattgctgtacaataactgctgtgagatgcaaagtaaataatttgggatatattattttgtctaagaccttcactttcttttaacttgggttttagtgccggagaagaaacaatattttctcatcccaaacaggccagcataattatggttgcatatactgtaggtttcaagtcattctgtaacattccattattgtaccatattttgaccaactcaccagcctctgatcaataaaaattcttcttaagtgtctgtaaattgaaaccaagtaatgaaaattccgatcaatgtttagtgagaactaattattttaagtctgctggaaaagatcatagttgctgagaatgcagatatcctatttttggaactggtatacttattttgatatattaaaagagctactttccattattattacttgcttttgtttccaacaaaagagacaaaatatttcatgtctgaatacagtattaaccaaagacacagtgggaggattactgggattactgtccttttataattcttttttaaatttaataaattcccctttatatatattattttataattcttatagggtttgctcacgcttgctctctctctctttcccagcttgttctagtaaagtttaaatgtgacagtgtaaacttaaggaaaatatacatacttatggtgatatgtaggaagttgaataataataatgtaatgaaattgatcagtggtgattattgtgaggtgtgatccctccctcttctctggaaaagctgttttaaaaaatctgaaatacacaaattttaaaaaataaaaaacacacatatatatatattttttgacacagtttcattcttgttgcccaggatggagtgcagtggcacaatcttggctcaatgcaacctctgcctcccgggttcaagagattctcctgcctcagcctcctgagtagctgggattacaggcacctgccatcacgcccagctagtttttgtatttttagtagagacggggattcaccatgttggccaggctggtctcgaactcctgacctcaaatgatccgtccaccttggcctcccaaagtgctaggattacaggcacgagccattgtacccggcataaaaatctaaaaaaaatagaaaattatgagaaagcacatgaaaaggaaaaagagccaggtgtcgtggctcacacctgtaatcccagcactttgggaggccaaggcaggcggatcacctggggtcaggagttgggaccagtctggctaacatggtgaaaccccgtctctactaaaaattaaaaaattagctaggcatggtggtgcacacctgtaatcccagatacttgggaggctgaggcaggagaatcatttgaacctaggaggtagagattgcagtgagccaagattgtgccactgcactccagcctgggtgacaaagtgagactccatttcaaaaaaaccattcctataccagcctcctaacaagtaaggaatatttctttttccttgtcaatttgtttttgcccatacattattttcacatagttgtaaacttgttataaatatagtatcttctattcacattaccacttaacttaggctgcattatctttatgttgctacatactctttgtaagtacttcaaatgcctgtgcagtattatattgggtggttgtgccattgtaagcttggactttccaatattcttgaatgtttacattgtttacaacttctaaaatggagtttcattgttgccaaaccgtgtaattccaatgagagagtgtgtgtgttgaccctggatctagtaaatacatcatctgagtatgtcaaccatttgaaaagataatttccccatggagttgaatttgcccgacctagttgctgcctgtgagtaagcatgtcctctggaagagtgtgacacctcgtcccaggcttgctggttttctacttgctactgtagcttacgaaatttcagtttggttttcttattcatgtgaccaggaagccaggagcatagcactaggatggtgagtgacttgcataggtgggttcagacttttgcaggtcatgagctctgaacagaggatggttcccgcctccccataatttctttaaaaccgtattattagttcaaggaaattcagcaaagttctgagtttcgctatatggccagctcaattctctgttcatttgtttcttttgttttgttttgaaatgtaaaattatttcaaatttcagtttccttttgggaataggagtgtcaccttgcttggttgttccccaagcaaatgttttctctttccttgagtaactcagcaatcgataacaattaatttgggctggatattcatagaagaacatttgctctgcgccctaaaattttttatcgcgaagcgcgaacaaaaatattgtcctatgaacttgtagcagtctgcatttttcatactaactcccaccatcattttatatgatatggggttctttaattctatcctggtaacacaaagggtaccaatagaaagatgaaaaatctgactgacttaagcatgttttgaattgaggtcattatcaattcagggggattttgtaggaagaatggggattttgaagagcagactatatattattaacaaaaggctctccccatgcaggaaggctacccagcggaaggtggcctttgttactccggatgtgattaatattgcttcaaggtttaattttagaacttctaaaataaggaagcttgcatcaattcaaggcacatggtttgaaacctcagagtgcccactttttcttttctttttttaaattacaaaaatagcatatgcattataaaatgtttgaaaactaatgaattaaaacaagtttctctagtctctggcttgaccaaagcctttgttaatattttgtggtagttccagtcttttttttaagaaaaaaaaattgtaatcatgttttgtatataacttgaatgacttatttcacttaacatgatttcatttgcttgtttcctgtgtttacagtcttcatgtcagttgtaatttatgtagaattccacccttgtgatactccataattttcctaatcatatcccccattattgggcatgtaaaatgcttaatggtcagtggtgtgcacagtggtaattatccacaccatgttaatccggctcacacgggtcacatgggcgacctaatcctgctgtaacttgcctttctctactggtattgtacttaaaaaaaaaaattcttttctgcctgttttttttgtttttttgtttgtttgtttgttttgtgtgatgggggagacaaggaagggagctggtcgcaatccacttctcaggtggattctttgtctgtctttctttagtggtgaaagtggtgctggaaaaacagtggctgccaaatatatcatgagctacatctccagagtgtctggaggagggaccaaagtccaggtgagtgggcagtggcccattatgataccttatgttatgggaaatgtaagaggctccatttgctgttagaaaagaatttttcttccacagaaaagacactggttcttctataactgtgaaacttgaaatctggaatggaaaggaatagcatatgtatgtgtgtttgtgtgtgtgtgtgtgtgtgtgtgtgtgtgtgtgtgtgtgtgtgtgtatattttttttttttttttcttttttgagacagagtcttgctctgttgcccaggctggagtagtgcagtggcgcgatctcggctcaccacaacctctgcctcccgggttcaagagattctcctgcctcagcctcctgagtagctgggattacaggtgtgccccaccatgcccagctaatttttgtatttttagtagagacgggggtttcactatgttggccagtctggtctcgaactcctgacctcaggtgatctgccctcctcggcctcccaaagtgctgggattaaggaatagcatattttaaggtagatgtgcctaatatataatgaactcctacaaatcaataaaaagatcagcagcccaaaaggaaaataaacaaaggacatgaaagacaactcatagaaaaggaaatataaattactcacaaaacatgaaagtatgttcaccatcatgataagaagaaaaatgcaaattaaaactgcattagaaaactattttttgcctatcagattggccaaaatcttaccatgttttaaacgcttgattggtaggaagtagggacacagttgttctcatacattgctggtaggagatgaactagtacattttaatgaagaacatttcagcaaaatctgttaaacttacacatgtatgccattcgactcagcagttctgctgaaaagaatttattctttagatatgctgaaatgtatacaaaataatacatgtataaagttatttctgtcaattttggtaatgcaaaagactggaaacaacttaagtgttcatcactaggcaactggtgaaataatttgtggttctttatataatagaatattatacagcaataaaaatgaggcttcatgtaccgattgtactgatagagaatggtctccaagatgtatcattaattacaaaagacaaggttcagaacattgtttgtaatatatgctgccatttgagggatcaaaagagagtgcacatttgtatttgtttgggtatgttatcacatatccctcgaagtatacacaagaaactgtcaacaatggttgtcttgagggaggggagctgggaggttgggagaagggcctacccttcctgtataccctttagaaacttgcatggtttgagctatgtgaaccacttgccaattcaagaaacttataaaaattttaaaggacgtagacagagaaaggatttaagagaaggaaaaaagagagattaaagagtgtaaaggagtgttgggaaagagaaaagatccagagaatgaggatactcaagaggtgaaaattaaaatcagcattggcaggaatgagtaaagcctgctccccagagccatggatgagggtgatggcgagctaaggtccataaggggcagcccaagcttggcgctcatcaccagtatgcaccgctggtgacagaattccttccaaagattagttttttaaatcagaattatgtaatgttattgccatggtcagctgtagactttcaaaagacacataaaattctctttattgtggttcccttttttttttttttttttttgagatggggtctcactctgtcacccaagctgaagtgcagtggcatgatctcagctcactgtagcctcctgctcctgggcttatgcattcccttccacctcaacctcccaagtagctgggaccacaggtgtgtgccaccatgcctggctaatttttgtttgtttttggtagggacagggtttcaccacattgcccaggctggtctcaaactcctgagctgaagcgatccacccacctgggcctcccaaagagctgggattacaggcatgagccaccatgtctggcccctttctattaattaaatagtgttctatcatgtactggtagatcagaaagcttaaggtagagccaaacattcctcctttgagtttgtggatcaactctttctatcttttgtttgcgggccagacgtgcctataccatttaacgacagcttctgtcagggagagaacaaaggacagaatcttctctatctcttcccttctttaattacagactttaaaactgagaatatttatggatccatccatccatccatccgtgcatccatccatccatgcacccatccatccatccatccatccatccatccatccatccatccatcagtgatcagtgatgtccaacagaattttgtggcatgtggtgagcatatcagggaaaagagaaagagcaaactaaggttgcagagtgaagggtccttaaagtggcctctttctctgaatgaaaggaagatggagagcagctctgtgcagtagaaagatgaagcaagccatatgtgtaattctaaattttctagtagccatgttaaaagaagtaaaaagagaaaaaggaaattactttttaaaacagtattatttaacccaatatgtaaaaaaagattttattatataattaatataacaaaattaatgagatttttttttttttggtactaagtctttgaaatacagtgtgtattctacagttacacctcagttggggtagcttatggcttccctattggacagtaagggcagctatagaacctaggttcatgtggttcagtccacttgcttttctctattcctgtgattgtactggatcctgagagggttgacatggagacaagaatccaggatgctgttttgctgccttttttttttttttttttttttttagacggagtctcgctctgtcgccaggctggagtgcagtggtgcgatctcagctcactgcaacctctgtcttctgggttcaagcgattctcctgcctcagcctcccgagtagctgggactacaggcgtgcaccactatgcccagctaatttttgtatttttagtagagatggggtttcaccatgctggccaggatggtcttgatctgttgacctcatgatccgcccgccttggcttcccaaagtgctgggattacaggcgtgagccaccgcgcccggccgatgggctactcttttacctcagtttgctctttctcttttccctaatatgcccgccacatgccacaaaattctgttgaacatcaccgattgttgatgaatacatatggacggacggatggatggatgaatggatacataaagattctcattttaaacactgtaatttaaaaagggaaaagatagaagaagattctggcttttgttctcttcctgagagaagctgagttttgttaagtggtatgggcatgtctggccagcaaaaaaaaagatagagttaatgaagatccacaaactcaaaatagattttacaaagaaaagcagagtttatataaatccatgagtttttaaaagagagtaggcaggttgggagtatgtttctaagctttgaaactgacccatgaaaggaccacccagaattgcccttggtgccatggctaaggatgattccctcgtcacaatgaaagcccagttctcatttctcatggcagtttctcttctgaatgttcaggagggtgcctgttacaccctttgtaacactttggctgttacatagtcagttagtagttcattaatttactcctctttgctacacccctacgacctagtagccagactgcagacagttaatgttgatttttctcttcctgttttcctatgaggacaatgatacagagcccttggcttggaattagtcagtagctaaagagcacaagccagaagacttgttatttctggaacatgtttaaccatagcatgtgaataattagaagtacaaggaatgactcacttgttgaaagacttctccaacatcaaattctatctattgagctgtctcatgtctatggtgtgttttgcacacttctgcatagaactgggatgtttgaaaaacaaatccttccccccaggccaggactcgttccacacgatccactgttgacccttgctgcttaaagtgtgtatcagtgctggcaaaaccagcaacaccagggagctggctacaaatgcagattcttgggcctaccccaacctactaagtccacatctgcattttgacaagatccccaggtgattcatgaatattaaagtttgagaaacaccaggctatatttccataaccttgtttggggaggagaagtggattaattttccttaaggtaacttgcagtgaagcaggtggagatgggatgagatgggttggtagagtagttgggaaggggtagtgagaagaaagaccctggccagaacagcaaggacacgccccttcaggtaccacttcacttttggtgaagttgcagcaatcaatttggacactgagaacgtttgtatgaatagttcctgattgacagtggggccctggctcctggggactctgcatcaagccatgggaattggaagacccaaatacacaaacaggttgaggtctgtcatggtgaaagaataaatcctccagaaaccccaccagtgacacacgggtgtggggcccctcaccttaatgcattcagaaaccaggtccttagagaaggtttggcgtacactgtgtggtaggtgttcacaccttcctaacctccggtctatttgctgggacagcacgtgaaggacattatcctgcagtccaacccgctgctggaggccttcgggaacgccaagaccgtccggaacaacaactccagccgatttgtaagtcccttccctgtttcagagagtgtcgcttgattgatgatgttgatgcttctgactgaagtctagtatcccacaggaaatgggagcctttcacatatcatcaggaggccacctcttcgatctttccttcattttctatagcagcatgccgccaagctgcagtttgcctttttttgcgccccggggatacaaacaagataattttgaaaatcattttccacatcagttgccttactaaggaaaataaatgatgaaagtggcagctttggccttggaggagttgtctttatgccctagagaaaagaccttctttcccagaccaagaaataactagagtagaggggtatcccaggtatcatttcccactggcagtggttttgcttcttagaacttggtccatagactctgaagggtgcacagagttagactgatctggcaccttggagagaaacttcctcctctccatccctcagagcgagctgcctgcccaccgcagccctctggctttgtgcatctgtcttatgccctactcatgtaacctaacgacatcccaaagtgactggacctggcctcacaggttgcctcttaactggcttacctaactggtaatgaaaatgtcaaccaagtgcattgttatgaatgctcatttagtcatgtttctgtctgggtgtctccagagggggtaaataggaaagctggcaaggctgaatatgaatatgttccccttgacaaaagccacatttacaaagaaacaaatgtttatccagtaaccttgatttatatagattttgcatcttatttcaaccatagatcatgtctggcactaaagcattcacggagccatctgtgaggctgattctggaacgttttaaaataaataagtgggaattttggagaaaaacaattttcttttccactgtctattttggaaagaagcttctatttccaagagaatttttactatgtgctcatataataactgtcaagttccctggtgggttctatctgttagacttgcccttactttctttgctttccaatattattcaaactactcatttgtttgtctctcatatttgggcccaatgcctgagttgtgttatcctgaagaagttttccagataataaaataggaaagaagaattaaacaaattttccacttgaattaattttcaatctaaatcttataaaaatggacttgaccaaatttaactctttatttaccttttcccctgtcttggattccttggagaccagaaaaaaaaaacaattaaattgatattttcattgatttttgcaatataaattattcattatatttggaggatatatcagtttctgtaaataacaaaaacactcaacatttattatttttctaattgcaaaattttatacaaccctgatagaaagattggaagagacaattcagacacacattcacctgcacacacacacacacacacacacacacacacacacactgtctctctctctctcactattcaccatcatggatgagagaaatgtaaatgaaaaccacatataattttctgtctctcaaatgggcaaacattaagttgattgataataatcgagaaaacacgctattggttgagaactgacacattcttccaggaaagtgattgggcaattgttattaaaattttaatcgttcattatctttgcccaacaatacttttagaataaattacataagcttcctgcttaaataactacttattttaaaagatattcataatatattgttaaattaaaaaaacagattacagaacaatatttacaatatgttcttgtttttttttaatgtgcacattatatgaaaggtaactaagaggtatgtaaatcaaagtttgacatctatgacagtaattatttagcaagagaatgaagaagtggcatcagggtagaattatgagtaatttcactttaaaaaatgcacaggtattatgaagcataagaatgtatatatttaacacttacaaatcttttcaagttaaagaatgtattacgaaatacttcaaacacgatttaaaaacaatgcaatgaacatctatgtatctggcacccagcttaggaaataaatcattaccaagagtcgaggtgaaacttcttttcatttcattatcaaaatgcaaatgcaaccttttattccctttataaaatttcctgtcatcccccccaggctgctatacagcagtcctaaatatgttaaccttttgttagaaattttaacttttatatgacaattatgagccatgcatatgcattttattatgttagagcagtggttctcaaccttgaccacacataaaaatcagctgggtgctttttgaaaaccacacagctccgggccctggtcctagagtctgatgtgcgtggcctgggctgacagcatgttggaaaggctccccaggtgtttctaaggggcatccaaggttgagcactgctgctaggaggacttgggagcttgcctgtccaacacctgcccttcctgggtcagatgttctgtttggtttcattttccctcaactgttgaggaatgggggacaggcactgaagtattccctctatcacatgccaaaaggaaagggtggtgaaggtggccgccaaaggaagcacgggagctctctttcagtgagcttttctcaggtgccactgacattccgcagagcgatggctggtggttctctgtgcctggtgctgctgggtgtttttgttttttgcctggaggaaaagaatcatcagattaagacacatagacagttagaggctggccgccttcggtggtctttcttgacacctagaataattacgaacaggaacacggcatgtactcacacatttgcagtgtgcacagtacttttcttgcccttaatgagtttacagctccagtcacagacataaaacccagctgaattcatccctgagatgggtggatttagtcagcatacacatttttatgttattaaatgtgaatgcgatgaggctgggcatcttctccagtttgaccatagaccacaccactccctcttttcctttatccgtatttacccttctggcctctgagggtgcttaagtttctaagcacaggagacaaattaagttctagtgagaaaaaaaaaccaatttaaatatacatatgaaatatatataataattgttataataattatatatataattttgattcattttattttggtttttggacagagtctcgctctccggcccaggctggagttcagtggcatgatctcggctcactgcatcctccacctcccaggttcaagcgattctcctgcctcgctgggactgcaggcacccgccaccatgcccagctaattttttgtatttttagcagagatggggtttcaccatgttgaccaggctggttgcgaactcctgacctccagtgatccacctgcctcagccttcaaagtgctgggattacaggcgtgagccaccgcgcctggctatatataattaatataacaacctagataccttttcaactacagtctaggtttttattctcctttgttccctattagcagtcatttaaagaggaattttcataacaatgacagtgacaaaaatccctaggcccgtcagtagctagaaagaactttacttttaataaagtgtttccgttctagataaacattttagatgctccgtaggtaagagagattgagtgtttttgctcaaagccatgagatgaagcctgacagagcaagagtgctcttcctctgaaagggtgccatgccatttttctgcctcatgatttacaccttctggttgagcagacaggcacctactgggggaaaatgagcaaggaatagagcatatccttatttagtcatgctggaatgataggtgctctctctaacagaatcgtgtggctggacaaaagcacgggttattgtctgattgaaaactaaggaagtctagactcaaattaggagtaattcagaatgtgtattttattaatgaatttccttgaattatatactgtattcaaagcctgtttgggacatcatgttttgttcaccaaccattgaaggaaatccctaactttcttgcagggaaaatactttgaaatccagttcagtccaggtggggaaccagatggtggaaagatctccaacttccttctggaaaaatctagggtggtgatgaggaacccaggagagcggagttttcacatattttaccaggttttcctgtttacttttttcctacccacttcctgtcccttctctacattaaaatatttctcagacttcaggcatagactatagtctaggaagccagggaggactgatgatgataccatgtacaagtcaatgtgcagaattgtgagaatgtcctgccctcaaggagagtgagttctaattggagtgataagacagaaattcctccaaagctaaatcatcaagaaagtattgatgtaacttcaaaacaaaacgaggagtgttggagtctttgccaaaggaattcaggtgggcaggtttggccggatagtaggagaggtgtgaaggaggtagagcccggatggaaagtggaggggattgatgagggaagacaggtgacctgcaccaaagcagtggaggtgggagagggaaagccagtcagggagcccggcctcagcctgcctgcagggcaggcgtctccagaacgtgagctaccggaggaaagatttgagataggtttgggatctttaatgccaaattgaaaagtttccacctagaccctcagaagtcatggagagtttggggccagagcagcttgcagggtgctttttgattatgttacaggcttcagcagtcatctgagtcagctacttttattttatttatttttttatttgagacagtgtcttgctctcttgcccaggctggagtgcagtggcacaatcttggctcactgcaacctctgcatcctgggctcaaatgatccccctgcctcaccctcccaagtagctgggactataggcacatgccaccacacctggctaatttttgtatttttcgtagaggtggggtttcaccatgttacccaggttggtctctaactctcggactcaagtgacccacccacctcagcctcccaaagtgctaggattacaggcgtgagccattgcacctggccctgattcaggtacttttgtaaaaggtttttaagtacttaaaaaatataatgatgttaataaccaaattttttatgttctatttacttattagtattttatattgaagatccacattagactttcttcgaagaaagacctggtcactgttttttgttttgttttgtttcgtttcgtgtttagtttgtggatcactggattagaaggacattaaactgtggaagtagctcacattcaatcttttcaattacacacacatcttaggcaatgccaaataattcttttagtttgtacctgttggttgaaaaagtatataaatgattaaaacttctgtgaattcagtcatttttaaaattgtattaaagcaacatatatagataagtgaaaaataattatatatttcacataaataatacccagtgctagatggaagtgtataatggatgtcaggacttctttaaataaatgcaagccccaaccctcccccaggagttctctgcccttaagtcagaaaccaccagaatagaggctgggaactgatgggcgcaggggttcaagattctgacatgaaagtaattcttggctgggtgcggtggctcacgcctgtaatcccagcactttgggatgccaaggtgggtgaatcacgaggtcaggagatcgagaccatcctggctaacacagtgaaaccctgtctctactaaaaatacaaaaaattagctggccgtggtggtgggcgcctgtagtcccagctactcaggaggctgaggcaggagaatggcgtgaacctgggaggcggagcttgcagggagcggagatcgcaccagtgcactccagcctgggcgacagagtgagactccgtctcaaaaaaaaaaaaaagaaaagaaaagaaagaaaaagaaattcttgaagctacgaaatacttgggagtggatgtggggagaaaatcctgccacacaggaccaggggactttctagatatgtaggatcgggaggcattgaagagccagcagggaagtagttgaaggataaggaggaaagccaggatcctgcagtgtcaccaagccagggaagcctcagggcgacatcgacaggatcaaatggtcagagctcttgggcaaaagggacgagctggggtgtgggggccaaaaaaaaggctgttggatttaggcactgaaaaatagccatgcaagggttccgccagagtggtgaggggagaagctagaatgcaggtggttatgtcatggcaaggaagtagatcctgcagcttggaggagttcacagtcaaggaaaagcttctaaagaaggcaaagagtaccagagagcaggaagctgcatggcagttttttaacatgcaccctgcagtgagaaacatggaaaagccagcttaaaaagccatagcaagttgggcaggaactaagtaattaaaatctgttttgctttccactcttccgagggtggcagtccagttcctttcagtggacaatggaaaatcctcagctcttgcaggtctttccagagttaggaatcaaaatttgcagagatgacctggggctactacaagtacatatttgggggccaggactgcctgtaattttagaaagcagagatagaaagtccttagggatggtggctgcaggatgcaggagtgacttcgggtgccttgtggtccacatcatggctcaacctgtgttctcttgctccagctcatcgagggcgcctctgcagagcagaaacacagccttggcatcaccagcatggactattattactacctgagcctctcgggctcatacaaggttgatgacattgacgacaggcgggagtttcaggaaactctggtaagtgctggcgcagggccaggcaggatctgctctcccaactggccatttcctgtggccaaaagggcagtgaaggttaataaagcaaagagctgcatgaaatgtccgcctctttctctgtgagcactctgtatgctcatacatgtttcagtatccttaaacagccatgtgccagttgcctgaggaccacttaatgatttgagatgggtaaaaagaaatgaattcatcattatcaccctgcaggagctctgataaataggcaaaaatgattcatacgttgagcatacctgtttgctgatggcctactctattcgtgagctatttccttagaaaagctaagcaaaccgcacgtctatggactgaataggtttagacattttggaacgtctttagtcttttctcttatttcttttctggttttgaagactctcttcccctctgtattgtttagggcagaggaccctttttctgtgccatgcccttcacattgcatgtatgttatggtccaagctgtgaaactaggtagattatggaggggttccatcctgggggcaataatgtagaactttctggaggtaggctgaacacccacttggcctcaaaggccttcattgccacccactgccctttgagtctgtttcaagctggggactattcctcaacccagatccagaactgagcagtagactctgaatgagcagcgtgggttcagtacatttgtggttgaaagggacagaaagttcaaacagactgtgtcctgggtgccaggaaacaaaatggtatcaacaggtcacatggcctcaaagcagctgcggggaaaagtgccaataaggagtctgcacactggtcctagagtgtagttttcttaggagatgtttctcttaagatttagacattttagcggtatttattgcatttaagggacctcagaaactggacttttaaatgatgcttttattggatttcctggagatttttcattaagatccttttgcaagtacaatatattcttatccctcctgatgaagggaaagatctcgagtccactttgagtaggtggaaaggtcagcagcgaccttcgaggggaagctggcaacaagaacacatcaaaggatgaagacaggacttggagactttgtgtacaactaccactcttccgagtctctttcctcctggagtattctcttattcctggaggatggcatgctatgcttagagacagaagtgcccttccagcatgactttgagacgtgagaagaatgtgtgcattgggcagtgaccatgttgtacaagaacgtcctgctgtcatcacaagctaagccacatgtgactgcacaacccaatcttatgttttggcttttttttttttttttctttgtaactcgtctgtacttgtcacatccttatttagagcagctgctgtgccttggcttcttcctaaggtgcttttaaagctggtgaccagcttctctggatagtttctcttttctcttccagcacgccatgaatgtgattgggatctttgcagaagagcaaacgctggtgttgcagatagtggcgggtattctccacctgggaaacatcagcttcaaagaagttggcaactacgcggctgtggagagtgaagagtgtgcgtagccctggcatgtggccattgaatgaggggtggctagctctgattagaagtaacctagcactttcctttgcttagatctcaaatgggaatattgggaagaagtgataaatctacatgtcctctgtggcaaacagaatggcttcacgagagaccagacctcttctatgcacctgtccctgtccttacccccagcctttccaagtcccacaccatcgattattaatggaatcgtttcaatttatcattaacctggggaaagctgggaggatttcacaccttggtttaaagataaagtgatctctttaatggggattagagtaatggcttaatgcaaaagatttattgtctttatcaaaaccttttcagtaactggtctttaggatctaaattcacttacaggttttaaagagcaagcaatataatatatgtaaatatgggaagctcacagcttcacagtttgttccatggattggattacattggatttctgaacacagaaaaagatggacattgactgttgtgttgacatttctgatgatcacttttaatgatcacatctgtatacctggagcctcaacacctaaatggtcgtttttactctttgagaaaaaaaatcagggttcttcctacagagaggtgctgctggttacatgtgcccaaaatctaccataaatacagcggcacatgactttagcctcttaggcatcaacagcttgcaggctgctctcagaacccacacatcctttaaccacccaggaagacattcttcctttctcagcattctttaaggatgataaatttagatgcttagtaataaatagcatcccactcattgctgacaatgcagtggggatatttccattccaaataaggttctttttttatgtttttgttttcttttctgataaaagagggaagttctgctaacttctgatgtctatctgataaagaaaaagatgaattatgtttaccagggaagggagtagaaaacaataaatatacagggtgtccataaagtctaaaaacatgacctaataatcataataaggataactatgtttctaaactttgtgtacattatccttgacatttaacaaatgcacatatatttccagtaggatcattaacacttggccttttaattgtaacagtgttggtttggtggtagtttctgttgaagtagactggattttttttgccttcttggatagtaaaataatttactgcctctttatgcttgaaaacaaaatcatgacactgaaacagcaaacacttccctagatgtttgaaacaagaagtgttttattgcacattgatgtccagagttagtagtcttctcagccagatgggtaaggccgagcactggcaactgcccatgaaattccctgactagaggcgatggaggcatggagattggaaaaggctgagatggaagccagagaggtccaggaaatgggcctccccctaccaataatttcctttgatttggggttttgttcatttggtaatacattaacgtggcttgagggggtatgcagtgaaagttctcccttctataccttttctagtccacttgttcccctcgtcagaggtaaccaagattcccagtctcttgtgttccctttaaaggatgtgtgttccaaaacaactacacacaaccactcctttttctcacttttgtgcaataatgggggcttatactgcaatgttctacagttgctttttcacttaacatgtgtcttaggccaggcatggtggctcatgcctgtaatcccagcacttcaggaggctgaggcaggtgatcacctgaggtcaggagtttgaaaccagcctggccaacatggtgaaatcctgtctctactaaaaatacaaacattagccaggtttggtggtggtgcgcacctgtaattccagctactctggaggctgaggcaggagaatcgtttgaaccctgggcaacgagcgagtctccatctcaaaaagggaaaaaaaattatgtgtgtgtatatatatataatatatatatacacaccatatatatattatatatatagatatagatacactgtgagatgatgctatatcaattcctaacgagcttcatcttatttgggcgtacttgtgtgtaagagatggggtcctgcttagttgccagggctggtctcgaatttctggccttaagtcatcctcccgccttggctccggaagtgctgggaatcgaggattgagccactgcacctggctgtcctttttgtagctgcatagcattccattcattggctacactttatttatctgttgttggacattaatatggtttctgatcttctgctgttacaagactgaatgaacactactgaaaggaatagccttggtttctatcatctttctcatattttagtatatctatggaataaatttgtagagggaagtggtagtccatgcctttataatggaaaaaagcagactttctcttgctcttgcagtgtagaaaaaaaatggaaaaaaatggtaagattttcatcagaactggcctactaaagcaaaatagccattaataacagcaagcttttttgttttattttgttttttgtttttgttttgagacagagtctttctgtgtcacccaggctggagcgcagtggcgctatctcggctcactgcaacctccacctcctgggttcaagcagttctcctgtctcagcctcccaagtagctgggattacaggtgcgcaccaccacgcctggctaacttttgtatttttagtagagatggggttttgccacgttgaccaggctagtctcaaactcctgacctcagatgatatgcctgcctgggcctcccaaagtgcagtaattagaggcgtgagccaccacacctggccaaacaagctttgttttttttacctgaccttagactaatggaaatgtagcatttccctggtcaaacctttacgttgctgtgaagctaaacaaactaagaaatcccttcttagttggatatgttggtgaatgtctcttgattctcacaacaacccgacatgggtccagtctgatttatgaatgtcatctgtccttactctgtgcacaggagtgcaactctgtgagatgaatgcacacatcgcaaagaagtttctcagaatgcttctgtttagttcttctgtgaagatatttccttttccacaacaggcctcaaagtgctccaaatatccacttgcagattctacaaaaagagtgtttcagaactgctccatcaaaagaaatgttcaactctgtgagatgaatgcacgtttagttcactggaagacatatccagattcctagacatgtgttaacagtaaaactaaactaaggataatggccattttcagatcagtgcatttgattttgtttacatgtcctttctaaaaggaagcccttctattgctcaaagcatttttgtgaaacactcatatagaggataaatgtcttgttctggcattatactttttcaaaatgtattcactgacttaatctcattggaaggtgtatactgagaaatgtcagcccgttatattctaacaccatctgtgaaattcaaacagattatcctttattgggaggcttgtgattttttagcattatcataaggcctttaacaaaattcttttatcagataattttggtaaagcattatgcagaaaaagaaaactcagccaagttcaaaattttcattgcatctataaaaatctttcattcatattggaaaaatctgagcattctttcatgtcaaagaatggtgtcatttatttatatgagaacgttctgcccagaaatcaagaaaaccccatttatatcactagccctccttggtaagtttcatggtctgaaacaagatgttgagctatggaagtctccgtttttctatccaaagaccacagactgccataccatgtgacattagggcaggatatgaacaataccatccccttcatttcactccatatgctaccctcagaggaatcttcttataatgcccctctttattagccatcaggcccccttttgcctccagcccaaatatatcataccattcaaggacccccagcattggaatctgtcctaaccttttaaatctgacctgaactttcacctgtagccagtgctagtccacacactgtagaccgtctcgtcttgatcatgtctcccacacttctgcttcctccccttggtacactcccttctcctctctgcatctgcacaaatcgtattcatcctttacacccagctcaaatctcttgactaccccagcaagtagtaatatcttcctgttctaatttctccagatcttgtctgtctgtgttacatattcagcttttccaagggttctttatttggcaaactatttttgcctcatctagattgcattcaagatttcttacatattttctatcttttcctctctctttagtaaccctacacatgctaaatactcaataaacatgggattggttgtaattattagttcagtaatatcaggtgcttcaaaaatgatgctatgaaaacattgtactaaaaaggaagaaaacaatatttggagccaaagaaatgtttcttgattgagttccttcctggctgtcgtgctggaagcttggagagatgtccattttaggcatttgactgtgatctcagtaggagggataggtttgccatccttcttgaatccctgatttgtattattggaagtctcagtcatcataggaattgactcatgtcataaaacaattgggaaaaacaaaggagatggatgtgtatgggattactgataagcagccttcactagaacgtaagctcttggggcccgtgattgtgccttctatgcacacacacgtgcatgtgcacataagtgcctccatatgtttgtgagatgacttggaagtgtcacaattctgaaagattgtcatgttttgttttatgttctacagttttagcttttcctgcatatctgctagggataaaccaggaccggttgaaagaaaagctaacaagccggcagatggatagcaagtggggaggcaaatccgaatccatccacgtgaccctcaacgtagagcaggcctgttacacccgggatgcgctcgccaaggccctgcacgcccgggtctttgatttcttggtagatgtaagtaacagaagttgatgctggtgatgcttcatatcttagctataaagagtaaaactagtaggctgggtgcggtggctcacacctgtaatcccagtactttgagaggccaaggtgggaggatcactgcagcccaggagtttgagaccagcctctgcaacatggtgagaccctgtctctacaaaaaaacacaaaaattagccaggtgtggtggcatgtgcctgtggtcccagctactcaggaggctgaggtggttaagatcacttgagcctgggaggtcaaggctgcagtgagccgagattacgccactgcactccagcctgggggttagagtgagatcctatctcccaaaaaaaaaaaaaaaaaaaaaaaaaaggtaaaacgactgagggttttgtgttcctgttctggctccttcctttcacccattaccttacttcactttctctcactctgtgattactgaatcctgcttttccttctagaactgcccaccaagataccttagctaaatctaatgtggtaacaagtttcttctggacaaaatatttagtaaagctaggactagagaccagaaaaagaggagagccacgttcatgggcctttcttgacttttggacctaaagatttaggaatatgtttttcacatatttctatgttacaaattaacccaaaacctagcggcttgaaaccataagcacttattttctcagtttctgagggtgagatatttgggatcggctgagcttggtggttctgactcaaagacgaggttgcagtcaggaagctgattggaactgtggttgtctgaaggcttgcctagggttggaggatctggctgaaagatggattgcccatgtggctgttggcaggaggtctcagccccttgctgcatggacctctccttgaatatcctcataacataatggttggttttccccagagcgagtgatctgaaagagagaatgagcaagaagccagttttttatgtcctaatcttggactcaggtattgtcactttgccacattctgtttattagaagcaagtcactaagcaaagatcacacttaaggggaggggaatgaggctccaccttttagaggaaggaatatcaaaaactttttgcatgtattttgaaactattagatatttttggttatggcataattatgtgtgtgtgtgtgtgtgtgtgtgtgtgtgtgtatgtgtatatatatatatatatatacacatacacacacacacacacactgggggcccttcgatccaaaagatagatagatagatagatagatagatacacacacacacacacataaactcttatatatgaatatatatttatatatgtatatcacatatatattctgacaattagtctttcagcagtgtagagctgccagtaacaatctctgttaatcactgtagcctctaaatggtaaaataataatagcaggcacttatatagaactaactatgttagtgcccagatactgttctgagtattttaaagagaaaaaaccctcacttaattcttacaacaaccctgtgacttaggtattattatctctgctttacagataaactaagggaggcatagattgattaaggaatttgcccaaggtcactctgttattatgtgagtgatctaggaggccctagattcctagctagtttgtttctttgacgtttatatattcaagctagaaggaccctagtcaagggacaacagtgggggccattcaatccaaaagatctgtatttgattccaggcactaacatttatacggcttaaggtatggttagtgtggttagagtagggtcaggcaggacagggtaggagaactattctaggtactttagtggctatttaaaggataacattgcttgggaaggtcagggtcatactaaacagaagtcatgcagttaggttgtccagacccctcattttactgagaagggaacttcaggcctgagcaatggtggttttgcccaaggctggtcagcaagggggtggtgcagcctgggactagaatccatatctcttttctctttgttcagagcaccttccagcgctgggcttcctacctacctttctacctgtcacctgtcagttttttttgtgaatagtaccagtacatgaatactcatataagtgatcctaatttgaggtgggatttactgggcactgactgtgtgttgtgtatgattactcattcgctcacaaaagatgatatttcattttgtttgcctggaaaacacctctggtacttcagaattcgtccaggtattcatcacctcaaagaattgttcgcttacattcctcccccactgcatcccccaccaaccgctctatccaaacctcccttgctgtcattacatctgttcccatgaattgcttggcctcttctcacggtgattaagaacacagatttaggcatcatactgcttaaatttagtcccagaccctgcttcttacatagaacaaccttaagcaagccttggtgtatccatgtggaaaattgggaaaataatggtatcactgccattttgagaaatgaaatgggaattaagtgaaacaacacattgagagcacttagcaaaccctggcaaaggtgaatgtttaatagacgtaagctgcttctattatcaattcaaaaataatgactattgttactatctgcagatagctcaccctctctataagcgcctaggaacaagggttgtcttgtccttagcatccctggcatattgtgttgggtcatcattaaatgactggtgaatggaagacactggaaatgacaattacagatcctttagtgtgggttctttgtgtgaaataggttttacttcgatcatccaagatgacatttttttctaattgttaagacttcctgaaaaagcttacttggacagaaattaatggttatcatcattaaacaaacattttttgtttctactgtactcgcttttctgaatcctggtggttttccaaagtacttgactttggactgagagattgttaaagcagcaagtctcctgccttcacttgtcctctgtttcctgcaagcagtagtgtttgccgtgtagaatccagcttccctttccccagtgcatgcccgtttttagtatgaatggaaaggagttcactgccatgctgtttactttctctagtccatcaataaagccatggagaaagaccatgaagaatacaacattggcgtcctagacatctatggctttgaaatattccaggtaaggccagttttaataactaggggttgaggagggtgacgtatttcatctggcctgcaagaaataattctaggcaatgcaaaaacaaaaaaacagaaaacaaaccacaacaacaaaaaaaacaactcaggctcatttttgcctttgtgagttcttcatgtgcctttaccaaattagtttctcctaaatataaacttatttcttttgatgcatccaacatttctattaaagcttttcacatgaagacatttcaataaatcactccagaaatgacttttaaatgattttgtgaaagaattacatgtgaataactttttttttccagaaaaatggctttgaacagttttgtatcaattttgttaatgaaaaactgcagcagatttttattgaactgacattaaaggcagaacaggtaagcagtccctcttccttcatcctattctatttataatttattttgtttaagagggtatagatttctgtcttttgttaatagatttcggttccagtcttatattaggaaatgcatctaataaagtcaggcagaaaaaccatatgccattgtggcattttaatctatgaaatataaataccgtctgcagcatttgccttcttctttaagcaaatgatgctgtgatgttggaggtaagactggctgcttttactctactgactcattgagcacgtgggaaatgggagcctagttccagccccgactgtctgtggcaaatattgtgttccaaataaaagacttggtttcctcagatctacgccattttcaatcttccctaacaatacgtgcatttttaacaaagctggtatttgaatacttacctgaggtaacatgccttggtatagtttcttctaaagttcactgcaggctgggtgctgtggctcgtgcctgtaatcctagcactttgggaggccgagtcgggagaattgcttgagcccgggagttcaagaccagcctgcgggacaaaatgagaccccatccatacaaaaaaaataaaataattagctggacgtggtggcataagcctatagtcccagctactctggaggctgaggtgaaaggattgcttgagcccaggaggtcgaggcttatatcatcacaccactgcactccatcctaggcaacagagcaagactctatctcaaaaataaataatagccaggcgcagtggctcatgcctgtaatccctgcactttgggaggccgagacgggcagatcacttgaggtcaggaattcgagaccagcctggccaacatgatgaaaccccgtctctactaaaaatacaaaaattagctgggcgtgatggtgtgtgcctgtagacccagctactcagggggctgaggcaggagaatcgcttgaacccaggaggcagaggttgcagtgagctgagatcgtgccactgcactccagccttggcgacagagcgagacttcgtctcaaaataataataataataataataataataataataataataataataaataaatagttcagtgcagtttccattgtttcctgatagcatattgtttaggattcctggggccaccataacaaagcaccacaaactgagtgacttaaaacagtagcagtttcttccctcccagttgtggagcccagagtctgaagtcaagaagtcctcagggccacactcctcctcctcctcaggatagaggggagaatccttcctcttctagtttctggtggctcctggcatttcttggcttatggcagtttgactccagtctctgcctgtgtcttcacgtagcctttttcaatgtccctctgtgtctatatccaaatctccgtctctttcatgaagacaccattttagctttgcgcaatggcaatattttagccagggctgttcatctgaggcatgattattgctaattgaaaacttttcacaataccctgccatgatgactggaaatacagtcagcattgacaatttttgacagtctctatggagagtgaactgtaaaaaaaaagaaaaagaaaagaaagacaccattgttttggatttcaagttcactctaaacccaggatgacttattgtgagatccttagtgaattacatttacaaagaccttatttccaaacctcacattctgagaggttccaggtggatgtgaaatttggggggatactattcaagccattacacacatcaaaggctgtttggggtcatttagttatggaagtgtttatgcctctgcttaggaaacaccataccagggggtttcacgtgaccttctgccctggaacctgcccttggttgttttgctgtagctactctaaggggtggggtaggctagaggttcacatgaaacccattgctcccattgccatctaagtccctaccacgtctagcccagtctcctgcagtagtctcctaactggtttggtagtttccatatgggtttcctgtgaacctctagccttccccaacccttagagtagccagagcaaaacaaccaagtaagagtgcaatagccagtgagatgggagaggggaggcaggggctagattgtatgggaacttgcagggcatggctgagactttgggtgttacagtaagtggaatgaggacccactgaagaattttgagggaggagtgacatgatgtgatttgttgtgtttttgaaagggtcactctggctctatagacttatagagtgggatgagtcaggggaaagcaaactagaatggaagtttaaaaaccagtgagggggatactgcaggagactgcgctagacatggtagagacttagacggccatggtagcagtgtaggtggggagggggagtatctggagagtgagagaatgggacttgctcaaaataattagcaatagccaagaaagaaagagcaatcacgggtgattcttagctttataccctggataacagggccgatggtgacactgtttactggagggtaagattagaagaggggttgtttggaggtcacgggaaatatggaatcagagttcctctaaacaggttaagtgggagaggcctatcatacatccaagtgaagattccaatctgtagaatggatttgagtctggaaccccgtggcgaggtatagactagagaaataaattcaggggtcattagcctgtaggtggtatttaaagccatgggattgattgaaatcacctagagaaggagggctgagaaaatgagaaagctgaaagattgagccctgagactctaccacatataaaggtctggaaataagaaagacctggcaaaggaagctgacaaagtgaaaccagtgaggaaagaggaaaaaaccaggatggtgttgtggtgttcaagttaaatgagcaactcatagactgaagaaccttcccattaagtacctggatgctaatctgtactcctgtcctatattcaatttttttttttttttttgagttggagtttcgctctgtcatccaggctgaagtgcagtggcacaatctcagctcacttcaacctccaccttctgggttcaagcaattctcctgcctcagcctcccaagtagccgggattacaggcgcgccccaccacactcagcttctttttgtatttttagtagagacagggtttcaccatgttggtcacgatggtctcgaactcctgaccttgtgatccgcccacctcggcctcccaaagtgctgggattacagatgtgagccaccgcgcccagtcctatgttaaattttaagagttttgtgatttttttgtaactggatttatcagttcggtgctactaaattgtagttttctttggccagaaacagttgtgtggcaataatttcatagggttcaaactaaacataaaaatcaccaagtcataaaatgttcctttcctgttacctcttagaaaataaaaattaaagtccctggtctttgttgcaggacattcaggtttttctcttttatgggaatttttgtccattcagggtctgtccgtgcagagctcttgctatctgggaaataatgtgagttccttgtctctgtgttacaggaagaatatgttcaagagggaataagatggacacccattgagtactttaataataaaatcgtatgtgacctcatagagaacaaagtggtaagtgttcatttagtatgtcttttcactgctcacaggtttacattaagtgagtttttattctctgtgtcattgttttagaacaggcaaagtgacaactctgatttgcagagaatttgagcaattgtactagttttctgtatgtgtgaaaagagaacagtacggctttattctggcagtaaatatgaacatgtggatatgagtaaaatgtcaatgtacaaatggaagttgttattgaattctaagagaagacaggatcacatgatgacttagcatggaaagagccataaaattggccctgtgttctagtccaacttctaggactttagccttaatgactgattcaggctggtcatggtggctcgtgcctgtaatcccagtactttgggaggctgaggcaggtggatcgcttgagcacaggggttcaagaccagccccagcaacatggtgaaaccctatttctaaacacaaaatttagctaatacaaaaattgtattagctaaatacaaaaattagccaggcatggtggcacgcacctgtagtcccagctactctggaggctgaggtgggaggatcgcttgagcctgggaggttgaggatgtggtgagctgagattgtgccactgcactctagcctgggtgacagagcaaggcaagaccatgtctcaaaaaaaaaaaaaaaaaaaaaaaaaaaaaaaaggtgattcaaaataaagtgatacagaacagatatctctgtaggatttttttatatatataaaagcccaaaaactggggatcctgctagtagtcgaacctgcagcgcgatggcacggcgtgtgtcagctggttctacatagttnnnnnnnnnnnnnnnnnnnncttatttatttatttatttacatgtttatttatttattttgagagacgtctcgctcggttgcccaggctagagtgcagtggcgccatcttggctcactgtaacctccacctcccgggttcaagcgattctcctgtctcagcctcctgagtagctgggattacaggcgcccaccaccacacctggctaatttttgtatttttagtagagagggggtttcaccatgttggccaggctggtctcgaactcctgacctcgtgatccacccccctcggcctcctaaattgctgggattacaggcatgagccaccatgcccggccagacaacttagttattaaacaaactatagcatatcagaacagagaagtatagccattaaaatagtaagtgtgaagaatgtgtaaaacatgaggaatgcttataaaatagtgctatgtgaaaaaggaaatgcattatagaatgtgtacactaaataactaccgaaatgatgcctatatgggtaacacgctgaaagagaacattaagaaatagattaggtcaaaggaaaatgtttttacttttggattcttaagcaagtcaatttggcatgactatgagtgagcagataatgatctgtgcatgactcttggataaaacttcagggagttaaacagctttttggaaagtggagtttcctccctctttagatctaagtggtgactccctatttgggactattaattgcattcttgcctgaaggggaatactgactttcaagatggtatcttaagtctggggagctgtttccttgcctaagaaaggacctgataagcattgtctgttttggagaggtcagtgactagggccttgccttcttgctcccatcagaaccctcctggcatcatgagcatcctggatgacgtgtgcgccacgatgcatgcggtgggtgagggggcagatcagacgctgctccagaaacttcagatgcagattgggagtcatgagcacttcaacagttggaaccaaggcttcatcattcatcattatgctgggaaggtatggccaatatccattttaatgtctatctgttttaagcctttgggtttgtgatctggtttctcatgaagcaaatcatatggctcgccgtattttattgattcaacaaacggaatttattaactatcaaaggaagcaaaacaaaagattgtatatactactgcatttttttgtatgtacatttatttttacattgtagaagaagctactacttttttacagcatataaatgaacataggtataaaccagcaagaatgaaagaaatagcatatatctaatgaaaagagtcggaatttctagaacacaataaatacctacatcctactttttgggaaccaaatgccaactacatatatataacatggcaagtgctgctacatcagaggtaccaaaaatacttaggaattgtaaataagtatcgtccagcacgtggatgctcaataaaagagctggaggactaaataaataggaaaatcactctacctactttcctgtttccatcttttaggaattcaagtttattcaaaatttcgttatataatcctgtatctatgatctcttcaataatttcggaatggtagttttaggcaactttaaagcttaagcttattctgaatttcccagagtgtttttgcactttttttcagatgggcctcttcttcaggggtcagctttatctttataaggttggtaataccgttctctcccaggatacaaggaatactgaggaatacttcttcatctattccatagaggcccttaattatggtggaaactggatgtattctcctaagattcttcaaaatactttctgttaaatcggccacagataggccaatggcccaagaagtataacctttcattttaataatctcataggcagttgcagtcacttctttgtggacatttttccattgctcaggatctttatcagttcctatatcagagttcagatccttcaaagggacaccagctatgttcactccactccacacaggaacacttgagtctccatgctctccgaggatccatccatggcagctttcagaatggataccaagcttttgtccaatcaagaaacgaaaacgagcagtatccagattacagccgcttccaataatacggtttttgggaaatgcactcaacttccaagctacataagttaagatatccactggattggaaacaataatcagtttgcagtgggggctgtactggacaatactggaaatcattaacttgaagatggccacatttcgctggactaaattaaggcgcgtttctcccttttcttggcgtgcacctgctgtgataatcactaggttggagtttgctgtgacaaagtaatctttgctacaaacaatatttggcattttcgtgaaagggctgccatgttgaagatccatcgtctcacccttcagtttgtcttcatcaagatccacaagggcaagttcatcactcaagccttttaataagatgctgatagcgcaggccatgcccaccgatccagttcctatgatggagaccttactgtgatgaacgggcttctcggaagtgaaacgctcaataagctcactcttcacagtcgccatcttgctcacgggtgtgaagagccaggtgccgttgagcgggatgcgcgttgcttgacgcagacacagggccatccccaggcataggaaattcgctcccaccgagctcattctctggctggcccgcacaacaggcacagtccaactcatggctgctcactgaagaagtggagagagagaatggaaaaaagctgctgatccgaacgttgagacgccaagagagccgttggcaggaccttcagcactctacggcaggtgcgcgtgccccgccccctggccctctactgcggctgcgcgggccttgccagagtctccgacacgtgctttccgtgggtgctcagactaaggcagtgaagggctgcttctctagcaagtgatttctggagttagttttgctaagagtattatcaatagttgacatgcttaagaggctaaccgagatccctggaattactagttttttatttttaatatgaatgctgaggaaacatgcttctgttaactacagatgaaaataaggttacgttttctgaaccgtgaccctgccaggaaggatagggctctatgctttgcgtactggtggctgcctgcaccatctcccagtgtcccagaattgggcgcctgctttctggtctatggcgctggaggcctattttgaaaggattccactgccttggtgccagtcctggccaggacccaccctgggacagtcggctggggcttcagcagggtaggggccggctgggagtcactccagcactaaatctcagcatactactgcatatttttggaaaatgaatcaccctgctacatgtattagctgctgaataaatggattttcgtcttgcctcttgctggaatcacagactggcattccttgtctccccatgcctactggtagtataaatcaaggcccagagtgcacttttggtgttcttataaagcccatcagtattgggtgcctactggatgccaggctgtgtggggctgctgatgataaaaaagttaagttgaggtcgtggtcttggggacttcctagtgctatggaaatcccctggtctcatccatcatcccagctgatctcttgttaaacagagtatctgagcatgagtttctggccagattggtgcaactttgataccacttctgggagaaactgcaaagcctcagatgacatggctcattgcagtgaattactgagcatgaggggcttcacttttgctctggcttagctaaaatttaggaaaagtattgagtatgtcacttagacacccctatggatccactgaagaaggggtatggggacttgagagctggagttctgattacggatcagctgggccatccaggcagccagatactcatcagcatctgcaggccttccccactaagtcagctaacaagtaagacgtgcacagccttcctgtgacagtgcacaatgaaatcccaaatgcaacatctggaaatccacatgttgtggtgagggtagccatgacagctttggttttttgtttggtgaaattagattttttgttcaataaatgattttgttcaattaattacattttgttcaatgaaattcgatttctttccattcttggccaggtatcctatgacatggatggcttttgtgaaaggaaccgggatgtgctttttatggatctcatcgagcttatgcagagcagcgagctgtaagtatgttttgccatagctgacaggggatataggtttgatgaaattttcaatatgaaaacaaacttatgagctgggtgtggtggtgtgttcctatagtcccagctactcaggaggctaaggcaggaggatcacttgatcctaggagtttgaggctgcactgagctgtgatcactcctgtcaatagccactgccctccagccaggcaacataggaacactgtgtctctaataaagaaaaaaacaaaaacaaaacaaaacacctgtgatgtttagtggttagcattttgttccttcatgctattgggtctggattatcatttaatctatttggtttctcaaaatagctttcttttctctatatcagtctctcccttttatgtccctaacacttcatgcccccaaattccaagtgccatctacaggtccttcagggcctcaggctttctacctttcaatactattatcagggagaaataagcccactggctttggattgggatggccatttctgactatttaagagtggaacagtctggttctatgatactttgcccctgagctcttcttcatggtcgttgaatttttaaagatggttaatggcttagcaagacccacattaaccagagtccctgaagtactgaagaaatggcttgagaactctgggagggacaactaaagaaggagtgactaagagatccattttaactcccaagaccctgtttcagctgtaggggtagaagagggagggtatcccccttgcacgctgctagaactctcaagaccacctctgccttcctccccttttccctgaaaaggttctcaagatcctggataacacataagatgtaatttacatgagcaagtccatcatgcttgcgaggcaaggcccatgcatgccagatcttacaatttctagagcttctttcaagtaagagctgcccttttgctctctgttagttaagctgtcacaatagcaaggccagcttctctgatcaacagcagcgagcctgataatttcctattaaagggctgactgcaatgaaagcaaagcaagagtttccttttcaggccctggtcagctgttctgctccgtttacttctctccctgtagctccctacccctcctcaccctctgctctccatccctgcgcttccttgcagccacaccaccatttctgagattttgcatttctttttattcaaaacatacataatcaatttgttcttctctgagatgtttaggtaagccacaagtcctggcttgtgggttttatggcagtcaggtgcagacttgcttccagagattgtttttaaaaaattattaaaattcctgccaagtttaagagctattattgcttccacataaactgctgtcatacggacatggcctattattttgtaaacacacttgatgtcaaaatctgtagttgtatctggtcaagttaaaagtagactgctggggagacttcctggaaaattcaagatgcccaaaaagtcattgaggaggaagtgagtttgagtttgaatgtcagattgctaatttacatggatcccgtcattcacccagtcagcaaatacatattatggaccaactgtgcaccatgctatgcttcagacaccagggacactaagatgagtaaggcattgtccctgccctgttgctagtgaggcagacgtataaacacatgcagctcaaatagcaccactaatgaaagtatcttcaggctgggtgcagtggctcatgcctgtaatcacagcactttgggaggccaaggtgggtggatcacgaggtcaagagatcgagaccactgtggccaacatgttgaaaccccgtctctactaacgatacaaaaattagctgtggtggcacgcacttgtagtcccagctactcaggaggctgaggcaggagaatcacttgaacctgggaggcagaggttgcagcgagccaagatcgcgccactgcactccagcctggtgacagagcgagactccatctcaaaaaaaaaaaaaagaaagtatattcagccggcagagcctggtgatttgttactgctccgcttaaaattgctcatactcaaaagcagtttgtcagggttttctgtgtagagctgggaacagtgtgctactggcatctggtgagcagagaccatggatgctgctaaatatcccacaatatgtagaagaggcgccctcctcggcccccaacaaagaattattcagccgcagataccaatggtgcccagactcagaaactctgctctagagcaaagcagcatctgcactgaatccagacatttcatataattccctgagctctggtctatcttgcttgtcttaacaaacacatgctggccaggcgcagtgcctcatgcctgtagtcccaacacttcaggaggctgaggcaggagcacctcttgagtccagttgtttgagaccagcctgggaaacatggcgaaaccccatctctaaagaaaatacaagaattagctggacgtggtggcgtctgcctatatatagtgccagctactcaggaggcggaggtgggaagatggcttgagtctgggaggtcgaggctgcagtgagccatgattgaacccctgcgctccaacctgggcagtagagcgagaccctgtctcaaaaacaaaacaaaaacctaaaatcccctactgacctccctctgttatgttctgtcaagatatacctcaattcctgtgactagggacgttggaaaggcaatgttttaaaatttattttgcagtctttgattccaaattgcttatatcttagaattctttcccttcatgacttttgtccgttgttcatttccccaagtcacatcttgatggcccgcgctgtgagtcagatggcttttctgtagccaaggttatgtgcctggggacggcccttcaccccatcctctagaaaggcaggctttcagccccagaggtacttacagattgttaattcattctctttctccttttccaggcctttcataaagtctttatttccggaaaatctgcaggctgacaagaaagggcgcccaactactgccggaagcaaaataaaggttagttctattttaggaagtttatagattcttataagggctagcgctttctaggagtaaggaactgcacccctgggccaggatgaggtcagtgagacgtgaggaggtggttacagaagatgcccagaagtaacatcgctgcttgttacaaggttccaggatgcaagctgaatttgacttggctgtaccgaaaccttaaatggatattaagtacctcatagcttaatagtcagcagatgataatcagctactttctaagaggaaatggctttaaacagaacctggaagaatttatgttaaactgtcagagaaatatggttcggagccatgttttggatactgttgacagtttaccaggccaggcccaaaaacctgccagttatggaacgttacttgccagaaattctacttggtcttttaggggcaatttatgcatccctcctcactgggtcctacaggcctctccttgctgtgaattgaagacacatctagccacatggtgtctcaaagtctgaaggaaatcttacagtgtttctcaggaagtaggcagggttctgtggtacctgagccattacactgaattaagagtttacacttaattacactgaattaagagtttgtgggctgggtgcggtggctcacgcctgtaatcccagcactttgggaggctgaggcgggtggatcacctgaggtcaggagttcaagaccagcctgaccaacatggagaaaccctgtctctactaaaaatacaaaattagccaggcgtggtggcacgtgagtgtaatcccagctactcaggaggctgaggcaggagaatcacttgaaccctggaggcagaggttgcagtgagccaagattgcgcgattgcactccagcctcggcaacaagagtaaaactccatctcaaaaaaaaaaaaaaaaaaatctgtgtcagccagatgtagtggctctggcctgtaatcccaacacttatggaggccgaggagggaggattacttgaccccaggagttcgagaccaacctgtgcgatataatgagaaccccatctctactaaaaataaaaatgaggtgtagtggctcacatcttatgctctcagctacttgggaggctaaggaaggaggatcgctttagtcaaggaagtcaaagctgcagtgagccatgattgctccagcctgggggacagaacgagaccctgtctccaaaaaaaaaaaaaaatagtttttgtcattgtgtcacacacaatcatgtaactgtaagaaatactcactgagctattttttaaaatcatactggttaagaataattttttttaaaattataccagctgaatacttcctcagttttacaatcaaaggaatggttgagtgacagcagggctttgagtttgctcgcctgtgttcgaatctcagctctggcttttcctcgctgtgtgcttgccaaggtgttacttacgctctcagtgccctcaccgcttccctgtaaaatggagtctatcttaagagtctatcttaagatattagtgtctatcttaagagattactgtgatgattcagcttcataattcattggaagcatgtaacgcagtgcctgaggcatactgaacacaagatgtatatgtatgctctgactacattctttcccattagcccctttcctgtatcgccgttgttggtctctgcttaattgttgtttttttcttttttgtaaagttggggtgtcacaatgtcacctaggctggtcttgaactcctgggctcaagcgatccacctcagactcccaaaatgctaggattacaggcacaagccaccgagtccagcctgggctttcagctgtagggtagagccctctgagcgtcaagaacatcatgttgaaagaactagagacatttagtagcctcaggacagtccctgggttaggctcactggggcagattgctgaaggcagaaaacaaatgaaattctcatgaggcccagatattaatgtctgcgtgaagtgtctgactcatgcctttactgcaaagtcctggataaggattaactctgggctggaaaatcgagtcataagactgtcacattcagatccaaggggcccagatcatccaggttatgatgactcattttcaagtggtctggattattgtctataaaaaggagagcaagggtagggacactttttcctccttaaagacttgtcccctttctttccttcgtatgcttgtctggttgaaggctcaaagtgccaccattgtgggatgtttccaaaatgtttaggtttacaagtctcaggcccttgtctagggaggtcaagctgaagtcagcagtttacctaaagagagtacagcatgttttcccacctccaggcacaatctccttggtggatgttgtgacctctgtctgcctggctgtctgcctccacgtaggaataaaagtctctcccagtacctcttacagatacatagccatggcccaatcgctgatacgttccatatctacagtaatttgcagacatcattgtcatcttaacgatgtccctgaggcgtaagcgtttaaaaggattctgagttccttgaaagaaaaattaaacttgtgttcaaggtcatcgtagtgttatagatttcattatattctaattatttaaaaatttaaactgatttgtaggatttaactaatagaatattcatttgatgggaactcttattatattgattataaataaaagtataaatatagtaatatttaatagcatttgattttgaggttttacttaattcgatattgtcgtgtctggaagggacaagtacaggttgagcatctcaaatcctgaaatgctccaatgagcatttcctctgagcatcgtgttggtgctcaaaaagtttcaaattttggagcattttggatttcagcttttcagattaggggtactcaactataaagtataatgcaggccgggcacagtggctcatggctgttatcctagcactttgggagaccgaggtggctggatcatttgaggtcagtctggccaacatggtgaaaccccatctctactaaaaatacaaaaattagctgggcatggtggcaggagcctgtaatgccagctactcaggaggctgaggcaggagaattggttgagcccaggaggtggaggttgcaagtgagccgagatcatgccactgaactccagcctgggcgacagagcgagactccatctcaaaaaataaagtataatgccaatattccaaaatctgaaaaaacccacaatccgaaacacctcccttcccaagcatttcggataagggatactcatcccatatttaaattagagccaaagattgatgactacggagaaacagaaccaagcctcagaggctggcaaaggcagactggctatagctttatctgagtgcagctggagctataagggacatgacagaggaagtacaggcatcatgcaggtgattggattggttgggggtttttttggtttgtttttttttggttttttttcttgagatggagccttgctgtgtcacccaggctgaagggcagtgatgcgatcttggctcactgcaacctctgcctcccagattcaagcgatcctcctgcctcatcctcccacgtggctggactacaggtggcaccaccatgctcagctaattttttggtattttttttagtagagacgaagtttcaccatgttggccaggctggtctcgaactcctgacttcaattgatccgcctgcctcagcctcccgaagtgctgagattacaggagtgagccgttgcacccagcctgattgtttgttttttaatatgtatttcaatctctagattaaattagaggtcttctagttcaacctacttagtttacagatagagaactgaggaccagagaaatctagtgattagtcatgtaacttgcaaataaaagtgccaggacccacagtcaggcctgctgtcatctctgttgaaggtagaatgaggagctttcaccctgagccgtttctcactgtgctgtctgcgtattttaacacctgcttctgttgagcaagtgctgttggtacttttctgtcctaactcaggaacccttcttggctggaatcaggattaaattcagttactgcttcacaaccacctcagcagacatcttaagttgacccaaggttgggcacagtggctcacacctgtaatctcagcactctgggaggccaaggtgggaagattgcttgaggccaggattggagacgagcctgggaaatatagtgagaccccacctctacaaaaattttttttcaaaaattagctgggtgtggtggcatgtgcttccagtcccagctacacagagggctgaggtggaaggatcactcgagcttgggaggccaaggctccagtgagctgtgatcatgccactctactccagcctggacaacagagcaagaccctgtttcaaaaattaaaaataggtaaataaagttgacccatagctattgaaatacaggataattttgatggttaagatgtatttctgtttgctgaaattaattattcacagcctggtggcttctgtctaatcctacctcaaccagttaattccttttatatcacactaaatgatcccatctctttgtcagcaaggcaggataggattgttgccaaagaacaggcttggtagcccatgggcgtgggttcaagccttacttctctttcatgcaaattgtgtcatcttgagcaatactttgtttctttaaggcccagctttctcatctaaaaaacaggaataatattaaatagtagccacctcttcaggttgttgtgaggcgtaaatgagataatacatgtatctaatctgcactgcaaactcagtaaatgttatctgtcactattttagctggagaggactatggcaagtgacttataaacttaagttacacttgcctctctatgttttcttatgctgaggtgaaaaagaaggaatgctgttaaatacttaggacaaaagagtttgcaaagttattcttggaaattaaaagttgtaggctgggcacagtggctcacgcctgtaatcccagcactttgagaggctgaggcgggtggatcacctgaggtcaggagctcgagaccagcctgaccaacatggtgaaaccccatctctactaaaattacaaaaattagttgggcctggtggcatacgcctgtagtcccagctactcgggaggcggaggcaggcgaatcgcttgaactcgggaggcagaggttgcaatgagcagagatcacgccactgcactccagcctgggcctcagagtgagactccatctcaaaaaaaaaaaaaaaaaaaaaaaaaaagtcgtaattaaatacaaaactaaaatctaaaaatgaagtttaaaaaattaagaatttggggattttaagaacaaaaaaaagctgtgctatattcaaccctgcagtccctctccggctccacctgatgtgttgcaaaaatcatcaaatttgttctcaagtgcagtctgcatcatcaaagaacataagaggcaatttactttttcatcatagggctttgctttgatcatgcaacctctgcagccctgtctgtcctcaatttcaagcatcgcaaagaatgctatttcctgcacatctaaacagagaacttaattcaccaatgaatatcttgctttgaatatactcaatagtttttctcaagggtttcagatttcccaaacccatgaaaacagaaaagtcctaattgagacagggttgtgtcttgcaagcaaatctcttctgctgactgtaatggttttctggctttggaggtcccttttggctttttttcttttagaggttttctctctttaggctgctttgcttggaagtggagttcgcatgtgtgccacatccttggacccacagggtgtgctcagctgtggggtgggaatgctgatgtgagctctactcctgtttcttcaaacaaagtttgagattctcagggtttaaaatacttcataagcaatttcagctttatgtggctttttctgcttgaatccagttctactttgagtacccagtgcacaggcattaatagaaggttttatatagaatattctagatttgcaaagaagtaagttggcagccacagataaagtgttcagactctgcaggtttttaaatggccatattgaggaagaaactgaatgaaatggaatatcaaaagtttataaattctcagatttttatgaatctcccattctttaactatgaattttcatcactttagcaaagtgattcttcattagttggattgccagaaaagagagtgtaggggatttgatgatttatccttacaaataattttgggggaaaaaaagttaatgagaacaatatatcttcaaaggcgctctatcagcataaaatgaacttagtttgttaactgacatgcttcactgtaccacctgaaaatcattttgtatgtgaagatttattgggatttttgttttttgttgttgttctattttattaactgtactgaaaatgcctagttgcttttgaagattgaatttcaaacccatttaggagtgataaaatcatcataaaagtcggcaaagctttcggaaagtttagtagacctgagttatgcttaacgagcaaattgtcatgaagattaattcctagctatgtatttctacaagagagttttacaagtctcctttgaaatttggtcttctttagagaaagttccatgattctgatactgttcttcctttctagaaacaagccaatgaccttgtgagcaccctgatgaaatgtacgccccactacattcgctgcatcaagccaaacgaaaccaagaagcccagagactgggaggaaagcaggtatcgggggaaaccggcttaggtggggccgggacctttttccctctgctcaagatgagccgtcctccatcacaggcaggagcagtgtcagttgtccgcacatgtctttgtcatgcccttgcatcttaactttttcaggacaaaagctgtatactgtttcccctccgtgtcatttgctaaaatgttagcagtgccattcatttcagcattagcagtttataatgttgatcttggctagtctgggggcagatggaaaaaaaacaaaacataacctcataccgcagagtcatgatggttttaaaatcagtttgaggttctgtgtagacattcttagtccacccagcccctgatcgggacccacaggatgtggcctagaatgcttagcttggggtggaaagtggagggcgtaagagctgatggaaatacaatccagcatttgctgtgcctcgtgaagacactggggacaagctggaggctctggcattccccctaagcaccgtattgatgagaagaacgactctgggaggaaagatgtcaaagggaaatgcagagcacaagaattcagcaaaccctttctgccctgacttccagtgaagcctgcatcactgttcctcccacagctaggatttagggaagtggcctgggcaggaagaaatggcggcattgaggaggagcctgttaaggtggtggctagagggtatgaattttgtggcccgctgggagacccagacacacattgttcagaggcctgatcccactgtccatagaagcatgggaaggagggagagacttaaactacagagaggaccctagccatcgtcacctagtatcagtcccaggatgggagcctaccagaattgctacctcttgtcttctctcttggagaaaagaaggtaggctcttttaggtgtcgagtgaagagctccaggtttagcttccacaggaagacaaggactaaaattcctagctgccgattatctcctgcgagggacaggtgtgtccattttccttcctgccagcaagatcctaaaccatggcagatagatgatgcctgatcctttacaggaggaaacagatccatagtaagaaaaacacgtaggtcaaacatttactgtctgaaagttcgttctatttaatattgaatacttcggcatgcagtctaagtctgttctctcctctgaagaagccaggctgcttggatgtaagagctgccatcttttcaggccactatgttctgaataatctcatccatagatgcatattcttaaggatttttttttttttttggagacaagagtctcgctctgtcacccaggctggagtgcagcggcatgatcttggttcactgcaacctctgcctcccggtttccagtgattctcctgcctcagcctcctgagtagttgagattacaggtgcccaccatcatgcctggctacttctatatttttagtagagatggggtttcaccatcttgaccaggctggttttgaactcctgacttcgtgatccaactgcctcggcctcccaaagtgctgggattacaggtgtgagccaccacccctgaccgcttaaggcatcttttctattgaatctctgaaatttttcaatttaatgtagtcagattccttctacaatattgtccgttaatgatattcaggcccggatgaggagctcatacttgctaaggtgaccagctcttctttggtcaattcttactttaggaggctgtacagtccttctctaggtcacttttatcctaatcccaggttttcaatctgcgataagaatcattctcattactttgccactggacaccttttctgttagttcgaggtgaccgtcgtgtttctcttgaatcttctcttctacaggttaatccctctcagttccgtcaacagtttctctaggacatgaaatataagcattccccatcttagcccttctcttggaggtacttaatttggcctctgcttttctgaaatgtatagttccgcttctcctttcagactaagagggtagcagcattgtcatctcttctcctctaaagatgtaaaatgcttacacccaggagtttgaggctgcagagagccatgattgagccactgcactccagcccagctgttagagtgagaccccaagtcaatcaatcaatcaatcatacagaaaacatcttgttttgctctcttacattggttcccatacttgagcctgcctcaggatccccaggaggccttgttaaagctgagattgctgggctccatcccgagtttctgatgcagtgggtctcaggtggggcccatgaatgtgcatcttaaaaatcttgcaggtggtgctggtgatgatggcccaggcactgcactttgagaatcactgatctagagcaaagaactagactgtgtcccggtgctgacctatcactaagttgttagagcgagactcttcatctccttagccctcagttccttcctcttaagagggtccatctagaataggatctccttcagtctgacagaatgaaggcttccagacagtggctgtcagtctgcctctgtctctgtcacttttacactcacctctcacacatacccacacttgtacacccacccacacatacatccacatgtacacacacacaacagaacagtgatattaaatcaatatcccaatatgattactccaaccaaatctttagtcaaccttagaaataaaccatgagagtcttggaagcagaggtattgccaaagggggccttagcccaccttcccccatttcaaactctatccacctgctcttcccagcaaatactcttaaatgaaaacatctcacttgccctacaaatgcattttgacagtcttggaaaaagactccctctgcaagacggagttggcatagcctagggaacaactgggcattgtctgatcaatgccccctagcacaccctcctctaccccacgtagatagttctactgaaagcccctctaaaatagaaattttgcaatagctgcttggaagttcaccaaccctgatgctacttccttgtaaaaatccaacataattcattggaatatcagaaaatggagaaattaaatgagtggtacattttattcagtaaatcctcataggatgaggatggtattttctcttttcttttttttttttttaaatgattcccctttgaattgcagcaaagaattttatgacatgcattcaaataaactggttttaagaagttcaaggtattagttggtcgagcgttgatttataattccagtaagaccgctttctgggattccacccttaatcctggtttgggtttattgtgtaacaaatggtttcactccatccatgagtcaggagtgttagggtccgtgaaagggcagtgtgcttcactggctgggattacacacccagttgaagctcctggtaaagagggttactcattccacaagtttatgaggtgtagggtttttcttttcctgttgcaaatgcgtttttgtttggcttctggcaaggttgcttgccctgcattctgaattgctgccttgcagagttgtctagccctgatcaatttgagtaaacggccagggacagtcttggaaaaagactccctctgcaagatggagttggcatagcctagggaacaactgggcattgtctgatcaacgactactgaggaggtgacagtgctccaggaatatgcaaaaatcaacttgtgtcgctttgatgacccccaaattttaaacattacaggacttgctagactcatttctaccagaaaatttcctgatggtggaagttataatgaatgaaacaatgttttaacatgaggaatattccttcctatgtgattcatgggagaggaacgtttctgcttgaattaatgggtgatgcattccctgcctcgaaagcttggcgtgaagccagtgtttatgaaaagtactttaaaatgagcagaacctttaaatgcatttttcatgcatttttctcactagagaaaaggccagtggcgagttttagatttggagggtgagagaaaggaaaattaattatttttcaatttaattacctttttaattgacatgacatttctttctctctctctctctctctctctctctctctctctctctgtctctgtctgtctgacttatatgggcaaaggtggatatttagtacagacggggtttcactgtgttggccaggctggtctcgaactcctgacctcatgatttgcccgcctcggcctcccaaagtgctgggattacaagcgtgagccactatgcccggcttaactctttgcacacagaggctttctgaaagttaataatcttagaggaatcaacatttctggctcttggctctgtaagacccatcaaactggagactcttaaacaccactcccattgtgacatccttcccatcagccaaggttgcacccccacttcgagcttcatctgtccccctcctcctgtcccacagcaccctgccactggcctttcctattcttgtacctttgctttcacagccctctgccttgtcctgtatacctcatggattcaactcgcccctccaggcccaggcacatcacagtgctcctgagaatccctgtgctgtgaaaaatccacttccttctctattctcctatcctggtttacatattgtagctgggaatggatgacgataataacagctttacatgctcgtgctacgaactaagtgctttccatagaaagtactcgtctagaaataaagaatttatgccaccattcctgtttttacagaagaggaaactgagaggcacagagaagttgcatcgtggcagggccagtggcgcagcaggaatgcagcaccagaacctggctcctaaccactgtgctgcctgtgtgggctccagcaggaatcatagcattgtccttttttggtgaccctagcatgttgcaataggcactgtgtgtgactggcccacagtagacatccgcaagtatgagacttaattggaaatggtggtttttgtgagagccttactgggaagacagctgttgggaacctgcgtgacatcggaatgaggatgcttctgattgtcttttcagctcagcagctcctgaaaggcccattttgctgagcgcattagccccgttatcagcacagatatccccaaatgtaccaaacagggagtgtgaggagttacctccctactgcagcacaatcctgacattccatcttcgaaagagagagaccttactttttatgtctaatttgcctcaaataccatgtttccaagtgtctggttcagccagctcgcgcagcacgcagcccaggcccaatttatcttcccagagtggatgatctgaagcaagttttcaggatctgtcggcatccagagcactgtgttttccagcaagtggtgggttttcacaaggcacatgtccgtgctccaccttagacccagcaggtgtactaaaatagcctccccaaggtgcaggcctactaaatcagcatccccaaggtgtggggcatggggcatcttctggtatgaaaatcctcatgtgtgagaatattaacctaatagttctttacatccattttttcaaaagacattgctagatttttactgttaagaaaccaggatgggccaggcgtggtggatcacctgaggccaggagttcgagaccagcctggccaacatggcgaaaccccgtctctacgaaaaaagacaaaaaattacccaggcatggtggcacatgcctgtaattccagctattcgagatgctgaggcaggagaatctcttgaacccacaaggcggagtttgcagagagccgagattttgccactgcactccagcctagatgacaaagcaagactctgtctcaagaaagaaagaaaagaaagaaagtttgccactgcactccagcctggatgacaaagtgagactctgactcaagaaagaaagaaagaaaagaaaaagaaaggaaagaaagtttgccactccactccagcctggatgacaaagcgagactctgtctcgaaagaaagaaaggaaagggaaagggaaagaaagaaagaaaagggaagggaaagtgaagggaaaggaaaggaagaaacacgccgagtacagtggctcatgcctataatcccagaactttgggaggctaaagcaggcagataattgagttcaggagtttgagaccagcctgggcaaagtggcgaaaccctgtctctccaaaaaatacaaaaattagccaggtgtggtggtgcatgcttgtagtcccaactgcgcaggagcctgaaataggaggatcacctgagcctggggaggtcaaggctgcagtgaactatcacatcactacaatgtagcctggatgacaaagtgagaccctgtatcaaaaaaaaattcttgtaagaaagaagaaatcaactaaaactataatttagatatattttagaccatttttaatgtacacacttgaaattaatagttttaaatgcccttttgtaacttgtattagaaaagcctagaagtgtagttccattaagtcataatcaatattaaaatttaagttcaataacaaaaccagcattagcatcatttaattcaaaagttaaaagttctttcctttagccttctgattaaccaatatttttgttcatactctaggtgatagatgggtctttgtgttactgttattctttgaaatagatatgtaatgccctgttatttaattgctgtatttttatttatttatttatttatatttattttatttctgagacggagtctcactctgtcatgcaggctggagtgcagtggtgcaatctcagctcactgcagcctctgcctccctggttcaagcgattttcctgcctcagcctcccgagtagctgggactacaggtgcgtgccaccatgcctggctaatttttttatttttaatagagacagggtttcaccatgttggccaggctggtcttgaactcctgacctcaggtgatctacccgcctcaccctcccaaagtgctggaattacaggtgtgagccactgcgcccagcctaattgctgtatttcaatatttaaaaattagcattatgtcatctgagaggtcagctcagtgtttgaacactataaattgtagtcttctgaatatgtttccctacagcttggaactgggggcttgggggttggctggtaagaacacgagtgaaaggattatccagtaatgtccaggccccattttctcctttgcacagggtaaagcatcaagtcgaatatttgggtctgaaagagaacattcgagtgagaagagctggctatgcctatcggcgcatcttccaaaaattcctacagaggtaatgaactagtgactctggccttttttaaaacaggtttattgagctataattcaaatctatacaattcacccacttcaagcgtacgagtcaatggcttttaacgtattcacagagttgtgcaactatcaccaccgttaattttaggacattttcttaccctgaaaagaaatcatgcttccctttgttgtcaacctccaattctccccttgcctctgggcccagtcagtcacttatctaccttctgtctatagatttgcctatgcttttcatagcaatggaatcatatatgtgtcctctgtgactgacttctttcactgaacataagattcatccatgttgttgcatttccatgcttccttcctgttaattgcagaataatattccattgtgtggatataccacagtttacttatgcattcatcagttgataaacgtcagttgtttccacttcttggctattatgaataatgctgctatgaaaatctgtgtacaagtttttatgtggtcatatttcatttctttcgggtatatgcttcaaagtgcaattgcttggtcatatggtaactctgcatttaacctttgagaggaactgcctgattgttttctgaagtggctgcaccacttcacattttgtaccaccagcagtatttgaggcttccaatttatctaaatccttgccaacataagttattttctaaccatcctagtgagtgtggagtggtatttcatgatggttttgatttgcatttcccagatggcaaattatattgaggattttttcatgtgcctgttagccatttgtatttcctctttggagaaatgtctgtgaggccctttgccattttttaattgggtgttttgtctttttatcattgcattgtaataataattcttttactgttatttattgtagaataaatcagtagccataagtattcattaggctgtctgtttagtgtaacacataagtgcaagaattcttgataattgtgccacaggaagagcggaggtttaacttgactgaataaattaacagtatgaagacaatttcaggaaaatgtttaacccacttaagacaataagcttaaaatatttaacctcaaaaattttgtacaatccatgtataaatttaaacttatttttatatatcccttaacatgtatttggcaggacctatacttaaattgttcttattttgtgttgtttgtaaaaggataaaatgtggtacccttaaaatgttacatcactctaacttctctaatgattctgtggcgttccactgtatttctacatctatttaatttccttgaaggaatagggaaacaaaaaagaagtaagccaaatgtagtgttttatttatttatttagagacaaagtcttgctctattactcaggagtgcagtggtgcaatcataactcactgcatctttgaactcctgggctcaagccattctctcccacctcagtctgcaagtagctagtactacaggcatgcatcaccatgcccagatgactttttacttttcgtagagacagggtctcgctatgttgccccagctactctcaagtgatcctcccacctcaacctcccaaagtgttgggattatcagcacgagcgaccacaccgcgtcaaactgagcattttaatcagaaacaattacatcttcctgatatattatgcaggggctggatataatgtttttttttttaaattcagattgtatataactgaagaagaagttaattactgtctttggaatctagtatttctaataagacagttcttatttagggctgttgtttcttctgctatgagattaggacagccgactcaccatttagaggttttaaaaaagagctaatgattttgtataataaagcgtcagaaactcagtcccccacatttgagtttcctaataaccgtggaggtgagttagactaggaacaaggtttaccctctttgttctctgaattaaagacgtcagtacgcctatagtgtaagcaggactatgtgaaagaaatatttaggaagttgagaaaaggtatttgtagagcttttgcatcacatagcaccacccatttgctgacacacaactgagatgttagttatgagacttccttaaacagatcagtaacactagctcagaaaaggttttctcaacctcagaccactgacattttaggctggaagattctttgctgcgaagtctgtcctgtgtattgtgggatgtttagcagccttcttggcctccacccactagatgccagtagtgtaccttcctctgagttgtgacatccaaaagcgtatccaggcattgactaatgttccccctacagggcacagtcagttgaggaactttggcttagataatcatttttaaattttatttatttatttattttagagataaggtctcccttggttgcccaggctggtcttgaactcttgggcttaagcagtcctcctgccttagcctcccaaactgctgggattacaggcatcagctaccatgcccgaccccaaaatacccttttttaattaagaggggccgggcacggtggctcacacctataatcccagcactttgggaggccgaggtgggcatatcacctgaggtcaggagtttgagaccagcctggccaacatggtgaaacctgtctctactaaaaatacaaaaattagccaggtgcagtggcatgcatctgtaatcccagctgcctgggaggctgaggcaggagaattgcttgaaccagggagatggaagttgcagtgagttggcatggcgccattgcactccagcctgggcgacagagtgagactccatctcaaaaaaaaaattccacacagcaaaggaaacaatccacaaaatgaagagacaacccacaaaatgggagaaaatctttgcaaaccatccgacaagggattaataaccagaatatagaaggagctcaaacaactttgtggggaaaaaatctaataatccaatcaaaaaaatgagcaaaagatctcaagagacatttctcaaaaaaaagacatgctgatggcagacaggcatatgaaaacgtgttcaatatcattgatcatcagagaaagccaaaataaaactacagtgcgatatctcacctcagttaaaatggcttttacccaaaagacaggcaataacaaatgctggcgagaatgtggagaaagggaaccatcgtatgctgttggtgggaatgtaaattagtataactactatggggaatagtttggaagttcctccaaaaactaaaaatagagctaccatatgatccagcaagcccactcctaggtatggagccaaaagaaaggaaatcaggatatcaaagagatatgttcacgcctgtgtttatggcagcactattcacaatagccaagatttggaagtaagctgcatccatcaacagacaaatggataaagaaaatgtgatacaggctgggtgcagtggctcacacctgtaatcctagcactttgggaggtcaaggtaggcagatcacttgagatcacaagttcgagatcagcctggccaacgtggtgaaaccctgtctctactaaaaatacaaaacttagccaagtgtggtgtcccatgcctgtaatgccagctacttgggaggctgaggcgggaaaattgcttgaactcgggaggcagaggctgcaatgagtgaagattttgccactgtactacatacaacctaggcaatggagcaagactgtgtctcaaaaaaaagaaaatgtgttacacatacacagtggagtactattcaggcataaaaaataatgagatccaggccaggcgcagtggctcccacctgttatcccagcactttgggaggccaaggtgtgtggatcacttgaggtcgggagtttgagaccagcctggccaacatggtgaaacctcatctctactaaaaatacaaaaattagccaggtgtggtggcgcacacctgtaattccagatactcgggaggctgaggtggaaggattgctggaacccaaggcagaggttgcagtgagccgagattacgccactgccctcaagcctgggtgacagaacgagattccgtctcagaaaaagaatgagatcctgtcatttgcaacaacacgatggaattggagatcattatgttaagtgaaacaaaccaggcacagaaagacaaacatcacatgttctcacttatttgtgggagctaaaaattaaaataatggagctcatcaagatagagaataaaatgatggttaccagaggctgggaagggtagtgggggaaggggaagggaggtgcagatggttaatgcatacaaaaaaatagaaagaatgagtaagacctagtgtttcctagcacaactgggtgactatagtcaaatataatttaactgtacattttaaaacaactaaaagagtatagttggatttcatataacacaaagaataaatgtttgaggagatggacaccccattttccatgatgtggttattccacattgcatgcctgtatcaaaacatctcatgcaaaaagtaaaaaagaaaaaaaatctcatgcaacccataaatatgtatacctactatgtatccaccccccaaaaaaaacttatcagtccaggtgcagtggctcatgcctgtaatcccagaacactgggaggctgaggcaggaggattactcgagcccaggaggtcaaggccacagtgagttagcctgggtgacagagcaagactgtgtctcaagaaaacaagaaaaaaaaaaaaacctgatcaaaccttttttaatctattctgggtttttttgtttgttttttgagaaaccagttctgaaagacctccttccttctaccttgttttaaaaaccaaccaaccaaccaaactgacttccataaacaatgctgagagtgctgccatctcaggagagcaggaagtctatgcactctttttcccgtctaaggcaggggtccccaactcgcagcaggggaccagtactggtctgtggcctgttaggaactgggccttacagtaggaggtgagcagcgggccagcgagcattaccgcctgagccccacctcctgtcagatcagcggtggcattagattctcataggagcacaaaccctattgtgaactgcacgtgcgagggatctagcttgtgcgctccttttgagaatctaatgcctgatgacctgaggtggaacagtttcatcccaaaaccatccccacaaccccgtccatagaaaaattatcttccatgaatcctggtgccaaaaagattggctggtgtaagggaccctgtgatacgtgcatgaggtgtgaactgactctgttgattatccggatctgtctcgagtgccatgccagcttcatgattccatgctgtactttacgctgtgccgcactctgagtaggcattttgtgaaatttgttattccttttatgttgaggaacttccactgaaatgcttgtatccttggatgcctcccttagctctcctgctgtaagcttttcctttcagaacagacaaatagccttgtctctattgtcaaaaagtaggctcttttattgttgtcatacttttcttggtttgagaatactggggctgggcaagatggctcaatgcctataatcgcagcactttgggaggccgcagtgggcagatcacctcagatcaggagttcaggaccagcctgaccaaaatggtgaaaccccgcctctactaaaaatacaaaaattagccaggcatggtgccgggtgcctgtagtcccagctactcagaaggctgaggcaggagaatcgcttgaacccgggaggcgcaggttgcagtgaaccaagactgcgccactgcactccagcctgggcgacaagagtggaactccatctcaaaaataaaaataaaaaaaaagaatactgggaggagaatcaaagtttggaaagaaattatttttctataaaaaggacattttcaatcccccacactatatttcaaaactgttattgaagcagtccactcaaaagtggcttgaagtcccactatatcagtgggcgggggtatttctctggagagaacacaattttccataagacgcatgagtctgggatcttggtcatgcagaattcatccagagtccaccgccaactgtctcatcctatgatgctctacaagtaattgaaccatctcataactttattttctctaaaggtgagaggaaaggctttgttcataaaattgctctctaggtgtccacagaaaggctgccaaatgagaaacacaaagtaaaagcctgaagggaaaggatatattaatacccagcacaactatccacatctgcatgtattatacaccctccctatataggaagttcacaggcctaaacagagccatggctcacagactacccagagcatagtgtttgcttaggaaatattctgtgtgtttagtgtgtgttcgtttcctctctggaaaatcctttatatttatcaaaaccatccctcttgactgaatattggagagcaaaaatcaaaagatgccttaattcccccatgggtgggccccatgctcttgaagtaagtgctgtgctacttgaagcagtagtaggaagaacccatttacaccatctccccactacaacttttatgccttcagaaagtgttaaaaaactgttacaaatagccatgttgtgtcttggaaaataagttctccagaaaacacctctctgagctaggcaatgtgtgtttctttctgtggttggcagaaataagcccaaatacagattctgatgcttaggaggaagaatgtggtagaaacataacagatttgcaaagtctatcttgtagcatgatttacacttcctcacaagcatgcttcctctgaccttagcctctcagaatgtggggatgataaagggatgcctcatcagcaaaggcgttccacttcacgggcaagagagaaggaggaataggaagcccaggaaagcacggagtggtggagagcgtcctcctggctgccaggatgtttgtgtcctccgaggtcagaaacatccttaatctcaagtgccagcagctgggagtccctggggtcccagctgcatttcctctgagaaggaaacatgggatcagtgatccaagagataacaagagcagggaacagatttccaggcagaaagaggagctggcacaaaggccttgagaggaaatattagcatatttgagtcttaaactgaaaatatgtgatgaaaggaatgtaagctattattgccatctgtccaaaattatcacaggcaccagttaggcaggggcaccattgccctgtgcaacctgttcccatgagtatatcctagagaaagagagtggcctgggtacacttggtaggagaacatgtgttgttggtttatgccctggtctccagtgcgataccaaaggatggggtgaggatgtatcaggcttcatggaagcaaaggaagccccaggcaattcccatgtattgccaagaccctcaacactggaggccttgtcaggataagggagagaaagtctctgcaaggttcgttaccattaaaaaaaaaaaaagagaaacgcagcattaattttgtaggaaaaaatgtgaattgccataaagacccatttccagttgcacgataaatatactttagtttataattttaggttagatcaagccaagcaaaactgtactctcagaagcttgtcaccttgaaagtctatagtcttttccttctcacttctaccctccatgaactttctgcctcacccaattagattcctagcacctactcattttcactaactcccccaatcacatctagacaggttctgctattagtcatttatgtgtagcttaatttgttttaattaacatccttataacatatatgaatgttattcatgctaatgtgtgacttccactaggcattttcatttttaagctttttatctctaattagggaataggaggatttacctctctaggaagtttatgatattatcaggcaagatgcagacatttgagaggagcagagaaggctcctaaaatcacctgagtcgcaaccagctggcagggccactcaaggttcccttctcccttggctgtcataaatcagtctaatcgtgacagtagtttctgggaacaaaggagggccctggcttcgctcaaggcctgggggcctattgcctgggccctggatgtgctctcacgtgggccacgccctccaacttcacacccacacatacccatgatgattctatccatatttgacaaactgtaatgtgtttgtctctccttgattatatcagcctctgacataatagtaatgtttctaacataggcatgtatagtagactggataatctttaaaagaaatatttaaatgtgaaccagtccatggcttttttacagtgccatcatgaaagagacagagagggattcaaatcccatctctgacgcttaatggctaagtagccttgggcaagtcataatttgcctctgtctcctactctgcaaaatggaaaaccaacctgatcaggttgctgtaggagtaagaggagatcgtacatcaaaagcttcaatcacagcacctcatgcagagagagcacccatccgcattagccaggaatgttcattatgactgctgtgtgccaggcacggtttaaggctctggatgtacagcaggagccacacagatgtggcatccggtctcctggagctctcaccttcatctgggaggcataaattaaccaaataaacaccaccgtgaatataactaccaattagagtacatgctctgaaggaaaaatagtacttgctatgagagaaactaacaagagagcagtttttgatttttggtccaagaaggcctgtctgggagtgtcactgaaggtgagacacccaagcgggagccagccgagtgatgagtttggggagcagcacaccagtagaggggagagcaggggcagaggcgccgaggaaggaaagggcatggtgggcatgaagaagaggccattctcgaagaaatgcagcaagccaaagtgagaatgaagaggcgaggctggagaacagccaacgaccagatcccaagggcctcgtgacccagatgcacagaatttcaaaggtgaaagttgatacacagttgtcataatagctgtttagcaggagctttataaaactctttgcattaagtgttaaatgccctgaagaagtcaggggagatgattattgagacaagaccgtttgatttttgcctaaagaccacccctggtggccttccacaatgctattttcagacagtggtagaaagagtacgcaggttttcaccagggtgttgacgtgggaatgctgggaaagggaaagaagcaggaggcagctcgggaacgagcatcccagactcgggatttttgcagtcatcgcagtccacgcctgagccttcgaacgctggtaaacagatgatcagtaactttgcagcactgggcaccttcagagcagagctcttgctgccttgcccgggtagaaaaccagtgcggtcccgcccaagtgtgattctcttctccccaatgtccccacaggtatgccattctgaccaaagccacctggccttcttggcagggagaggagaagcaaggcgtcctgcacctgctgcagtcggtcaacatggacagcgaccagttccagctggggaggagtaaagtgttcatcaaagcccccgagtctgtgagtgcttggctggctctccactctcttccctcccgcggggcccccgccagccctgctccacccctcagctggcttctttttctcattcttcgcttcatgccatcaatgttgtctcctcaaagaagccttccctcccttcctggtctaagtgggtccttccctaaacacctgctctccatagcccatcactgcccggttcatttcctgcagagcactaagcagatagaaaaaggggcatcagagagtggctccttcctcactgactgtctcgctcctctctagctgctacactcctggagggcagggactctttgttccatatgtgtttatatacccaaagcctcacacagaaaatgctcaatagttacttaatctctaagagtgtctaagctaaagagggacttcagtgtcccacccatggttagttgacaccaagtcagttacgcatagtctcaggattcctcctggaaggtgcagcagagtgccgggtgggaattcccaggattgtacctagaaggctgtgggggagcctagaaaggactgtgagggggaaaataggtgggaggagaaatctctggtttatagaacacagtacttaccagtaaggcattcataatacacatttacaattcacaaacagtctgctacagcttcatttagagacacttctttctttcctgatgagagtgtggtcagtgagccccatgaatgtccacaggaagttctgttcagttcttctgcccagtttgctccagggctgcggaataaagacattcattcctttttaagctggagaaactgctggaaccgaggctcagcatcatcgtttctcaaggctcccttaaccatcacaagacctatttcaagagtcagtgatgaacttggcagaaatcagtcatcagaccaaggggaaatcatatgggaactcacagtaaaaagggaagcatttgacttcaggcagatcccagtcttgccattagttttcttctcctctaaggtgggccccatagccactgtttctgcctgcctcgtaggatcagcctgagactcaggaatgataatggctataactgaatggctttgtgagacatcaagattattaaataaataagcggcacacagagatggaacccatttatgacacgtttgtggtagcatttttctactttgagttatttgtagcttcacaagaattttcatttccaaatataaagtgaaaatgttgtgtcattcgccattaagcaacccacagaacagttcctgttctttctaaaatgggatggagtgatttatcggtacaatgcagaactccttgtttcatacccgctgttacttttcaacttgtgaggttttcatatataattaaaacagcctcaatatttgtaatacttttttttctgcttcagttgcgttggagggggttatattcaaaatcaagatttatttttggctgtccttttccttgccttacattcaattgtgttattaccattatttgactctcctttcccccatctttgacacatgcactcacacacgcacaccatcacctccgctctctcccctgccccaaacgcatacatccccatctagccctgacatgcaaatactttcacaaaagttgactcttaaaatctggctgggcacagtggctcatgcctctaatctcaatactttgggaggctgagttgggaagatgacttgaggccaggagttcaagactgggcaagtcagttagacctcttctctacaaaaaaatttaaaattagctgggtgtggtggtacacgcctgctgtcctagctactcaggaggctgaggttggaggatcacttgagcccaggagttcaaggttacagtgagctatgattgtaccactgcagtccagcctgggcaacagatcaagaaagaccctttctctaaaaaaaagaaaaaaaaaaaaaaaggaaaaagaaaacctaccatgtggtttcaccttaatagtaaatgttctgaatatacaaaattacctatttgctttaagaacccacatcataaccgcgcgcagtggctcacgcctgtaatcccagcactttggggggctgaggccggcagatcacgaggtcaggagatcaagaccatcctggctaacacggcgaaaccccatctctactaaaaatacaaaaaaaattagccgggcatggtggcgggcgcctgtagtcccagctactcaggtggctgaggcaggagaatggcgtgaacccaggaggcagagcttgcagtgggccgagatcgcgccactgcactccagcctgggtgacagagcaagactctgcctcggaaaacaacaacaacaacaacaaaacccacatcagacaccatagggtttgtttttgttttgttaaatgtatccatgtcttttggcttttctcatttaaggttgttttgtgtgttttcctgttgttgttgtttggtttggtttggtttttattctctccttatctgtgttatcaaggttttttcttgaacctccctaatttctaaccccctgggcttttaaaaagaaatctaaaatccagcgaatctttgagatagtctctaggaagttgggaatcgtttgcctgttcatcctttctctgagtcacaagtgtattttctgtgatacgcccaaaatagttctgggaaagaagaaggaaacaagacttactcagaaacccaatacacaagataagaaatatcaatggatattcttacaacaggcaactgcagggctcagattttaaacattctgtccagttgctaatctgtgcattccacttggggtttagaaatctgtccttatgcctattgtttacagcactgaagccaggggaattacgtggcccctcccctggtgtttggagtttgagttgttgtttctgcacagatggatctgtgaggagagaagttgagtggcaggagaggataggtctgtctcccaagcatgcacccggataaacagagacaacaaatcaagcccagctgccttcaaaccacattggcttgtttacttctggaacatttttgcaatgactgttcatcatctttactttggatttttattggttgattttatttttttcctagagagtcatgtaagccactctcaaggtaaatgagaaggtttcctactattttacaagtggatcaagtgcagatttacagagaaagctttgcgtgtctaaatgaggaggagcctggcagagcctgaaagacctaggttcactttctagccccacccagtcttagttccaatgttctcatctgtaaaatagagatgacagagtatgcggctcatgtagctgtggaggcgttgaatgaaactgtgtggaaatcatctagggtgacttctgccccatagtgggcactcggctcactacagctgtttgctgtcacctttatcattccaaggcctggttgaggcgcagctgtcagcattcattggtaaaatggccggactctcaagacctgctagaggctgatgtggtccctaaacagccccagcctttctgggcaaatgcaagtcctcattaacacacctcacgtccagctccagtcactgtggttattatcctctgctccgctgctccttggtgaatcctgagattggtgaatcctgagacaggaagtctatattttcttggaactgaaagtagggcagccctccttccacagcagcacaagcccagctcctgcagaaactggaaaattctgtttagaggctgcatgcagaagtgccgcgccaaacaacagcaacagcctccacccactcacttgatctgacttcctaataatatactctttggatcaaggtggggaataagtggagaagcattgaatcgctcattcgattctcacagagactgtagcaaggcaggacaaggtctaactgaatacactcagattctcctatttcccattgttttccattaaaagaaaaaaaggtataggtcattttatagtgagaataaacaacatgccacagtaagcgtttcacatattcgttcatgaatcagagaagctgcttcccgtgtgtgtcattgtctaaactgagggtccctggaataacaagaaaagtgttgttcagggattggggcttggggcttggctcacatttgtcttctctccattcacagctatttcttttagaagagatgagagagagaaagtatgatgggtatgctcgagtgatacagaaatcatggaggaaattcgtggcccggaagaaatacgttcaaatgagagaagaaggtattttagcaattttgtttcattgattttaataaatctgaagagtaaattggagcttaagtgaagttttaagttccattttattttgcatataatgtcacgctaaaaatattgcatcatttagagtttctttgtatatttccacagtattttcctcccttttctgactgacttatccttcttccatcttgaccctcttgggaattgtagcctcagacctcttattgaacaagaaggagagaaggagaaacagtattaacaggaactttataggggattatattgggatggaagagcacccagaactccagcagttcgtgggcaagagggagaagattgatttcgcagacacagtcaccaagtatgacaggaggttcaaggtacgtgctaactgcctgcctctgagatcaccaaacagattccttatttttttaataacttgttattttgcttttgttgttaccaaatcagaatgtgttcgttgtagaaaaatttagagaaaatacagtaaaccaaaagataaacaggcacctatgcccagaaacattcactgttaacattctgtgtatatccatatctttcagaatgtttttatgaaaacatacatttgcgtatttagttttacaaaaaatgagatatacattacatgctgttttatgtcctgaagtggttttttgtttgtttgtcttttaaataatgcgagaattttcgatagtaatacagttagcaatataagttattttacatggctgcatagtattccatttgacagatgctttattatttttaaccagtttctcatgaatcaatttttagtgagtttttcttttttactatcgtaacttcagtgagcatcttttcacacatctttgtgtatctatctgtctcctaatatttttagaagaaattgataggagtgaaatcgttgaatcaaaggattcagagtatcaagtaatattgcagagtatcctcatccattttcccagagtggctgataagtaaggcttttccagccacaggaggaacagttgatttttcacctcctcctttagataccttttgataaagtcttggtcctaatagaaaaatctgaagcttcagaagctcatggacccgttaagagcttttggctttttgccaggggcggggaggtcaagaaaaaaatttaacgaaataaacaacggaagcatgttttgctaaaaccaaaccattccttgcaacctgtgcatggcaccagctgctgtgacggcagccctggatgcacacaggggtgcttagctctcgcagcggtactcattataaagtggttacccacaaattcccaagtagatttctattagattattgagaattatcattcaaatgacaatatatcagtattttagaatgaaaattttatgaactcccaagaaaatatatgcagacactgccctctgtttagaaacatgctgtagtgcatccttgctaagttcaccacaggtgttggtgactttccctttacacctgctgtcctgatatgtgaagtgactccatatgagtttgccagtttttaagtcaaaaagagtcaaatgtcatcattttttacatgtcatcctaataatcatgaacaatgccctctttcactgtcatggggcccggtcatgtgatgaatggaatggcctctcaacagtagtgaagattgactgtccaaggcagcttccccctgtcctggtaacagcagtccactgtgtgaattgttgtcatcacattgaccatgtctgtccacctttttttgagacggagtcttgctctgtcacccaggctggagtgcaatggcgcaatctcggctcactgcaacctccacctcccaggttaaagcgattctcctgcctcagcctcccaagtagctgggattgcaggcgcccaccaccacacccagctaatttttgtattttcagtagagacggggtttcaccatgttggtcaggctggtctcgaactcctgacctcaggtgattcacccgcctcggcctccgaaagtactgggattacaggtgtgagccaccatgcctggcctgtccagcttcttaaagctcctctccttacagggtgtaaagcgagacctgctccttaccccaaagtgcttgtacttaatcggacgagaaaaagtcaaacagggcccagacaagggcctggtgaaagaagtcctgaagcggaaaatcgagatagaacggatcttgtctgtgtccctcaggtgagtagtggaggtgcagaggcaggactgccccttctcgcctcagcatcacggtccgctgttccaaacagccaggaggaaggccgggctgggcttcccagctgtcaaaatcatgatcaagagaatggaatttccctttgtcccaaagggaagactccctagtctcagcaagtcttgatatgtcaggaagaaggtaccaagaaaaggttgcctccggacagctcctctaatcaagggggacccagatctcttgtaaccgaaacatgttagaaatgaacccggtatatggaacacctcagagaataatttctcttgttgcagtagagccaaggattcagagccctgtcccccagtccacctcacccaggttggaggcctcacccatttccctgagcagagggtcctgaaagggaagtttctttgggacttccttagggagtgcaagttggtctccattctctgtagccctggagtcatcgtgagatgctctcttcgctccagttctcaggcagtggggagtggtgtttgcttccacaaggcctcaggaagggcccttgctcctcccggcagcaccttggcttcctctcggcagaagggctcctctgccggccgtcagcatctcctccgtcagtgggacctaggctaggggttcttagcataggaggtcttcccatgctaagaagtcctcccatgccaagaactcccagactaggagtcctcccatgctaagtcctcccgaagtcctcccatggtaagaactcctagactaagttccgctgacacaggaaatcctcgcaatccatgaagactaagaatggaagaaaggcctccttgagccccatagcttcctccaagaatcgtgtccctgggcctctgaggctaacactactttaatcaggaaaagctttgggcctttgcattaaagatgttctgctctcacatgaacatggaattgggacgcctgtcaaactcttactccacacagaaggcaaaactggtgcgctcaggaaaaagcaggggttttatgtgctcaggcgtctgatgtaccaagctggaaatcctagttccagtctgataatccaaaacagatttctagttgcatccattcttgcctgtgtctctgtggtttctgattctatctgttcctaatttccctggataaagggccaggcagtgcagtgcagtgaagtatttaaaacgtgccaactcaggatgtggtaaagttgctaagcagatgagtccgcagtgtccattttgcagccccacctcaggtaggtttcaaggctattgttttttttgttttttttttaaagctctaggcgctgactgattttctgaaggccttcctaaacattcagctcactggctgggtcccaacctgagcggggcagtgcctgctggccacactcttcctggctagctgggccctgaggctgccgtggaaacccaacaggaagctcctgctttgtttgtcattgcatggggccctgccatgcctggactaagccaggttggccacagcgtgcttggcaggcacagcaggtgaaagtcagggaaccacagctctagggtgtgtgtagtcgctgtgccgagagtgacttgttctttctgttattgcccaggtatgtcttcagtccctcagacccctggtggagtgctcatgactgggaccataaattatcctaattgagctacatttgtgtggttgttttgttttgttttgttttgttttgttttagacagagtctcgctctgtcacccaggctggagtgcagtggcgtgatctcagctcactgcaacttctgcctccctggtccaagtggttctcctgcctcaggctcccgagtagctgggattacaggcctgagccaccacccctggctaatgtttgtatttttagtgagagacaaggtttcaccacgttggccaggctcgtcttgaactcccgacttcaagtgatccactcatctcagcctcccaaagtgctgggattagaggcgtgagccaccgtgcctggccttgagctacacttgtatcaagcactttgacacttactatcttattgataagtccttgagggggttgtcaagcagggactgtagggactgttcacactcaaatttcttccttttattgttttttgtttgtttattgtcttcttttacagcctctggggatataatctgtcatgggagcaccagcttctttttcttcttcctgttcagtattcattatctggaaggttcctttcttgcggtctttcctttttaaaggctgtagtaaaatgaggtacttagcctaaaagtttttctgactctaaggaaaaaaaaagaaagtgtgagtcatttgaacttgtgatgtctgtgtattgcagtcactgaacctcacacttgccaagatgaataatagtgtcccctcatttctttatacttgagttaggccagtaatcagaaccaagttaggaaagcaaccagagggtgatgtgtgtgcagaatcgaacccagagtggaaattaattctggtaccagactactgaacatgcgtgtgtgttctcaaaatacttcagtactggcatagagaaagattttaacagttggcttgtacttcaggaaaaaagctgcaacatctgtatgtgtttttaagaatttctgagattgaccagttgactattggctggaatgatatcaacatatggcctcctagttacgatttatcaaagtatcccataagcttgatcttagcccatctctagctcttacaattaatgtcagtgcacagtgggcctacagctccctattcaaaccaaccaaccattcagtaacagttacaagacaacatgtgagcatgactaaatatttggtatgaagaatttattgtttatttctgtaggtatgataatgttttgtggttaattttaatataaagagactttatcttttaatgatatgtactgaaacatttgagcatgaaataaaggctgagcgcagtgacccacgcctgtaatcccagcactttgggagaccaaggcaggaggctcgcttgaccccaggaggtttgggacccacctgggcaacatagtaagaacccatctctacaaaaaatgtgaaaattagccaggagtggtggtacgtgcccgtggtcccagctactcaggaagctgaggtgggaggattgcttgagcccaataggtcaaggctgcaatgagtcatgatcataccactgcactccagcctggtagttattttaaagtggaagcagggagagtgaggttgtagataattgtgattatccgtgaattggtgcttgaaatctgacatgtggtggttcattctatactactttttatttttttgagacggggtctcactttgccacccaggctggagtgcagtggcgcaatctcggctcactgcagcctcgccctccaggttcaagcaatcctcccacctcagccccctaagtatctgagactacaggcatgtacccccacttctggctaatttttgtattttttgtagagacacggtttccccatgttacccaggctggtctccaattcctgggctcatgggatctacccacctcgcctcccaaagtgctaggattacaggcatgagccactgcacctggccctactatcctacttgtttacaatttagaattttccataataaaatgtttttctaatcctccagtagatgttaaatttttagaagtctttatcttttctaaacatacagatatatgtctagttgagttacggttaaaaatttttttgaagttttcatttacaagaaaaaataggatcccaacaggtagaaatagggccaatagctcagagagatattaagacaatagtttgtcaaagggactccaggataatttgatcaggaaaaatccttatttaaataaaaattaggctgggtgtggtggctcacacctgtaatcccagcactttgggaggccgaggcgagccgattgcttgaggtcaggcgttcaagaccagcctggccaacatgatgaaaccccctctctactaaaaatacaaaaaaattagttgagcatggtggtgtgtgcctgtaatcccagctacttaggaggctgcggcaggagaatcgcttgagcccaggaggcggagggtgcagtgagccaagatcacaccactgcactccagcctgggcaacagagcgagactccgtctcaaaataaataaataaataaaaattaaagtgaaacactgacgcttgcatttctggcttcattggagactcgggaagagtgtcaggaggtgacacaccaatacagagttgagacacgggatttctgagtgtatggtggctgctggcagaaggccatgcctgggtttttgaaggatcctcccagagttgcttcttgttcaagtactggcctggccccactcttatttgaaaaactcaattgcaggaagggtgaccacaggtgtaatgacccatgttcttggctttgctattgtaggtgttgagttcggtgccatggaagctcttatttgggggtctctgatgaggcttctcatttttcttctcattctggtggctgatcaccagaaggatgagaccaaaagttgtgtggctgtctgtctgggttaatagattttccagtacttatctccaattggaaaaacaacccgtaagacggtgcttttagacagaggctccagctccctggtcacaacattcttgcccagaatgtctccttgcctgaatcccctaaactttctggcaataaaaacagcccacttcactgcctgtcctgctgacctgaagcattactggcatcttgacttgctatggtctgtaagcattgggaacctggaagttgtcaacatcatgggattgagcacctacctggtgctgagccctggtattcgaaggtggatgaggcacagtcactgcctcaggaagctcctctcattctggaagggggaacagacagctgagtaaacatgtgccttactataagtgttcccagcgtgatttaaaggatattcctgggacacaagagaggagagtgggtctttgcatctgcgggtcaggtgaagcttctttgagctggacacgtcactgctgaggcctgcatctgcgtccgggctttctcagagaagttaagaaggttctgaaactggtgccactggtttctctgagtggtagaattctgggcaaggtttattttcttcttgattcgcctccgtatcttccagtttcctaaaagcagcatatatttcataatcaggaaagacttttataaaagcttaaataaaggcagggctatccttggaaattgccttttcagctttaaaaaaaaaaaacaaaactccttcaggactttccttggtgttttgtaactaacatttctgtgaaaagatatattggtgaagagagtaaaacagattttctagtgttttcagcaatacaacagtaagccgcaaagacagaggaataaaaaaacaagggcagatccaaaccagagactaggaagaggtctttcaacacagcttacagcgtcaaacatctgtaaggaattgcagcataggaataagtcaggggtgaagtccaaagataagtctgactttttagaataaataaacacgaaagctttgttttcaggttcaggagcatgggctaaggagagcagaatgagctgagaccctggcctgggtgaaggtggtctgcctagctccaatgcctggatcattgaagggaggggattttggagttgttggttaaagtcaaagtgtccaaacacatctcttctcatttctagattcatgctgataattgaccttgaagttttggcccgcttgcttttttcgttataatagtaatgaaactcctaataaatctaagcacattaaaccactcaaggtgacttgtgttgggctcatttagccctgttgaataatcaccatcctgccacagttcagccaggccaccaggcatgaccagacatgccaaagaaagctttgagcaaacaaccaaaacaggaaggcgtttcattcctcaccccaaaggccaaaaagtggagcttcttgttttactctggtcttttgcatgcactctacctaatgcagccgggttcttacacctgggctagggtgccaggaggcttagactttattaattcaaaatgacttggaagagctcttttgagcagcttttcataagtgctttttggggttttagattgctggctgtacctttaaaggtaagtaggaggtgtttgttcccaggcactatggaactggcacgttggccctgaattgcctttgcatgagctgttgagtgacggagatgaaaaccgtctattgtttaaaccactgcttgtcagggtttatccttgatcccaactatcacaggagtgggcaagaagcatggctatgatgtgtggatgtctgaaaacaaacatctgaggtaatgataatgaccaagtgttccacccaaatggctattatttgtccaaaaaacactgtaaaaggttctgactttacgtccaagggaaactctttggctgctcttcagtaagctggccatgaaaggaccaagctcctttcccctgacactggcctcttgcttccagtgaactccattcaccgccccgccccacccccatggtttgcgcgtactgccattctacgccttcctatccaattgtgctgtggttccttcgacctctttttctcctgtggattaccaagcccctttcctgtaggaggactgaaagtgggtaatatgtaaacagtaagaatttaatttttacagttctagagaccgggaagtccaaggtcaaggtgcaggcagatgtggtgtctggtgaaggcccagtcttttctttatagatggcgcctcttgttgtgtcctcacatgggagaatgacagaaagggcaaaccactctgtcatacctcttctgtaaggtcactaatccaattcatgaggacctcttccttgtaacttaatcacctccttaaggccacacttcttaatactagcacattggtgaatgagtttcaacatcagaccaaggtagaggctgtggctacagctactggctccatcagctctgggtcactagctccctgtctcagtctggagagaaggttcctgacaagcctgagatagtcccccaagattctctgcccaagggagccctgtcattccaagaagggcccaacccctaccttgacctgtgaatggggctgaacagggataccacaggagtttccttctaaatggatcagattttacatggaagaaggatccagggtctcaaagattctccacagctcagtcctcttgtgatccccttgcctcatcatctggctttgtcacagccacagtaatcccactggtgcagtgacaccaggtgctctgagagcagagcagagctcctgagtgatgctgcagggctctggatatacaaagaaccgtgtctgtggcacttggagagaataaaatgttaccatggtcaattcactgaagcaggtttgcctaatttgtttctaatgcctgggaaaatgcttacaatccctaacgaaatctcattcttcaaagggttgtctttgatatttggcagtggtacttggagatactcgtaaacttatatattatagtctttggggtggtggccccattcacctgagtgataaatctaacagggaatgcaaattctcaattacatacatgttgttgctttctaccaagcctagccaggcttgaagatggaactttgtctcatcaacctcccctgaccagcaagcgtttcctcggagctgggtctgcctcagcgtctctctgccatcaccctatagcttgtaacacctgctcccctccaggcataaatttctccacaatcccaccctgtccaaacatgcagttcccgcaaaggtgtgttctttccttgtctgacaaaattcattagcttgaaggtgatgatttttgcttgtttgctgtttgtccattctggccttcgcatctctgaacttggatgtgtctgtacgttctagtagctcctggcctacagtgtccacagagcactgtttgccagaaggttcctaataagtaccttgaagtccaggatattggtttccctcttgagaaccgagcttatgattcttcaagttcaaatttactacaatagctataaccatatcataaattatactaacttggaacttaaatgtagagtcatcccttttcaactgcattctattcataactttctggatttttatgatcttaaaaacacaagttggacttgaaaatggatttttttttaatatgggctaaattgtccttaagttcctgattgtaaaaatcatgtggaaaaagtactttgatcatgcttttgttggactataaaccttctttgaaagcagatttcagcaatttcattatgtaattcattgttgttggttttgtttgaaagattattacttatagaaagaaagactgtaaaatcttagcactatcttgcaggatttttaaaatggaagaaaaaaaaaacaatagagtaaacagaagcacagctttcaccaagtgtgtttgtccaatctctttacagtactatgcaggatgacatttttattctccatgagcaagagtatgacagtttgcttgaatctgtcttcaaaactgaattcctaagcctcttagcaaagcgttacgaggagaagacccagaagcaactacctctgaaattcagcaatacgtaagtccggatctgggacccagacttctgcgtgtagctaaaaaggggtcttgatcgcacccctgcgattcaggatggggctggaggaggcctgcgaggagaagagtggggtctggctggccccagtggaaccttagagcctgcagaagacagtctggatagtagtcacagactttgaaaaggttacttttgcatttctgtgaaataatgacttcatagactagtgtattttatcatttagacaaaaatcacctgaatgaggcagacaaaggcagatttttatgtatcacccaaaaaagggtttttttaatttaggagagcagacaggagtagaatcacactggaagcagataaaagtgacagaggtgggggtttaaattccccaaaccaatgcataataaaacctgtttattggtagagcctccgggggcttgaggactataggtggccaacgtattgtgtaggtggttcacctttctttctttttttttttttttcttttttttttcttgagatggcgtctcgttctgttgcccaggctggcgtacagtggtgcgaccttggctcactgcaacctctgcctcccaggttcaagcaattctcctgcctcagcctcctgagtagctaggattacaagtgctcaccaccacacccagctaatgttttcttatttttagtagatacggggtttcaccatgttggccaggctggtcttgaactcctaacctcaagtgatccacccgcctcggcgtcccaaagtgctgggatcacaggcttgagccaccatgcccagcctcaccttcatttcttttggcaacatgatctaatggaccaggtactggctggcatactgttgaccctctaatctcatatttgctgagtaagagttatttagctagtctgggcaatatagtaagaccacatctctacaaaaagtaaaaaataaaaaaaaaattagccgagtatggtggtgcatgcctgtagtcccagctactcgggaggctgaggtgggaggatacttgagcccaggaggcagaggttgcagtgagctgagaccgcaccactgcacgccagcctgggcaacagagcaagaccctgtctaaaacacagaaagaaagttatttagcttttctttttaaatttccccatctataaaatgggaatatcctccatcttttcctagctacaaaaataaggccaagacaaagcctttatatcatgatgagggaaacttataataggcagctacttaaaattatgatttttccttcttatgatatcagaaaatataacttaaaaacagaataaggattgcataatacaggcatatatgcaatatagaagcattaaaactggatggggagtttgggaattgcaggtaaatcctgccttctatttggattttggttgctagtgtgtgtctttttccatccctgggtgggctgtgatggtgcaagaatagtacaggactaaacaaagccaggttctatgctagagtcctcaagctggcctgtgtctggcatctctcagtcctccacaagcacagaatcagggacaacagctggaagcacaatgacagcacagcggtatgacctggaaattgtctctttcctctgtcccctcagcaggcgcctctgagaccacctgacagagtggcactggcacattagccaggtgtacctccctcaccacctggtgtctcacggtaccgggccccagatgctcctttttctggctcattgtcatgcagcgacagtgccaccccatggatgcggtgcgcatcctcagggccctgctcctggtgtagattgtccgttctcgcctcatgtttatgcttttccagcagcagaactccgtggcgggatctctgagcaccgttttctcactgcgtccttcgacctgttaaccccactgtgctttttgcaggcttgaactgaagttgaaaaaggaaaactggggcccctggagtgcagggggctcccggcaagtgcagttccaccaagggtttggggacctggctgtcctcaagcccagtaacaaagtgctgcaggtcagcatcggacctggactgcccaagaactcccgtaagtgctccacgggccctgcaggcagaactgccgccgctcccccgagtctcccgagcaaatgctgcaaacatgtgcacagatgtgggggctgagaatcagtacaccttctgcttgctggggctcacgctttcttcagaatggaacatttcaaactaaagcaacagcaaggaaaatgagcaggttaaaagtttctgagggacttagtacttatgtatcagtacacctggcattacaatattgtggttaaaacaaatcaaagtttgttagcttcaaatttcccctccctttccagtcagatcttgtccacaataccaacatcatcctctatgccacctttaaagaaattgactgggcccggcgtggtggctcacacctataatcccagcaccttgggaggccaaggccggacgatcgcttgaacccaagagttccagaccagcctgagtaacatggcaaaaccctgtctccacacacaaaaataaaaatgtaaaaattagccaggcatggtggtgcatgcctgtagtcccagccactccggaggctgaggtgggaggatggcttgagcctgggaggtcaaggctgcagtaaatcatgatctttactggggtgccactgcaccccagcctaggtgacagagcaagaccctgcctcattaaaaaaaagaagatgaaaaagaaataaaacaccatacacacacacacacacacacacacacacacacacacacacacacgcactacctcaaaccccagtctaactccttccctggcctttatttttgtatttataattgatatttataaacttatatctatagcacacagcatagaataatcatacatgctatgtatgcatatactgtgatattgttctaagatttagcctgtgtgtgatcacacacatgaagatgccttatataaaataactgtttctaggccaggcacggtggctcatgcctataatccctgcactttgggaggccgaggcaggcggactacctgaggtcaggagtttgagaccagcctgaccaacacccagtctctactaaatacaaaaaactagccaggtgttgtggcgtatgcctgtagtcccagctacttgggaggctgaggcaggagaattgcttgaacccaggaggtggaggttgcagtgagctgagatcgcgccattgcacaccagcctgggcaacaagagcgaaactccatctcaaaaattaattaattaattagccatttctcaaatctgtctgcaaaggtacaccttaacatgttctctaacatattaatacaataccagcaaatgccatcatatctttatatatgtagagccactcagaaaatgttgatgtatgtctgtgtatccgttagtacttgcagaaaacagacagcaacttttggagggatttctgaagcgatttttcagtgaaaagatgtggacggggtttagggaacaaagtagggacccagggaaagggagtggcaggaaatcattattatccgcaaacctgaagcagcagagggaggaacgaggtgaactgaaggctacagtcaggaaggaggcacatgaagtcccccacctccctcctgacactccagtctccttccagtgcctcctgttggcctggcctataggcctcaccccactggaaggcagaggcctggctgtccacaggactcagaccccagggcacagagccgggcaaagaaaggctgcaaataaccagcaggctatgtttgtgcggcgggcccccgaggggaaattgcccaataggtgttggattctatcttatttggggtggcgagagtggcctaggtactgggagggaagcgtccagcaggccacactgggtttgccccgatcccacgtggtcggttctcccaggccctagagctgcagctcctttgctgtgtttgcactgtgcaccttgtcacctcctacccttctctattcttcagctcttctctttataagaaattccctctgcacccctcttccagctggtttaatcctaccttccttcctgttccattcaagaccctattgtttttcttccccacatagatgtctctgcagagatctcctctggctcctctggccctgctgtccagccctgactgtgacccacagtgtgttcctttggccccagcttgttcctcattccttcatgtctgtgtcaagggtacaagtctgcttctcctccttgtggtctgtgtttagttcaaggaccgtagaacacacactcttgcgtgcaaggcgcttgacgtaggcaggtgtgcagtcagtgccagaacgggcttcatgccaaccccgttgatccgcagcattagtgaacctgctcagccacttagcatttagaacatgaatgcaaatgtttaaatgttccatctgtctcttttaaaagtctgtaaaaatagaaacacctttgtaagatgaccaatccttctttaagaaccactgtctctaacatttcaaaactgtacctctataaccctgtcctccagcccctcccacccaatagctaccattacatacttccctcaacggctccttctccactgcaactgttctcctgcagatccacctgagagctggaatccaagcttctcaaaaattttccatatgcaaagaaccatgaggatccataaaaccaaccagtagcactggttttaactttgtcttgtttatttcaggtcctaccagaaggaacactacccaaaatacaggttattccagtgggactcaaaatgccaactacccagtgagagctgcccctcctcccccaggtaagccagctacgtaccgtagtctgggaccactaaatctggacccataacttataaaatatgtttgggaagaaacccattagcaaatcaatgcacacatattaaccaggcatggaccatttcagtgccacatgtacaacacagcagccctacttgagacctcaaaattcagaaaaataggagtcagtgagactgaactgcggctgagtttgcaatctggatttcattacctcgaaatattactcccttaggaaaggcttctgacagagagaaaggagttccttgtccgtaacaaccagactgttgtcagcttttaagacacaggatgctgctttatggaaataggagtttacaggtctaaccccaccaccactacccagctccggccaaataccactacagcagcacccccttatcctcgggggatgcattccaagacgcccagtgggggcttgaaaatgcagatattaccaaaacctatctatacttttccagtttgagttttccacaaaaccagcagaaatttttttctgtcttcacagtgttacagatagaagatatattgttactgaatttacttaaaggaagcgctttcacttaaaggaagcgcttaatggcttctctttggcatacccaaattgccagcttcctggggccattatgaataacaagatggctgcttagtgactgatgatggggtagcacacacagcatggataggctgggcaaagggacgattcgtgtcctggcgggacagggtgagatggcacacaacctaagccttaggaattgttcattcctggaactttaatttaatatttccaggccacagttgaccatgggtaactgaaacagtggaaagcaaaatcatggataaggaggggagggggctactattttgtaagttatagcagcttaatgactgaatagaagaaatctgttttctatttattttctgagattaggattcaggaggcctgttcaaaaaaacaaagtaatatctgagagtattacaaaattgttataaaatttatgctcatatttcatatttatctcttctttttttgggatggggtctcagttgcccaactggagtgcagtggtgccatcatagctcactgcagcctcagcctccctggatcaagtgatcctcccacctcagccccttgagtagctgggactacaggcacgcaccaccacacctggctctttttttttttactctttgtagacacggagtctcactgtgttgcccaggctggtcttgaactcctaggttcaagcagtcatcccaccttggcctcccaaagtgttgggattgaaagtgtgagccactgcacctggcctctcatttttaatagtaaaaatataactgacatatccagacactctaaacctgaatctaagattttctgtctctaaaaatctgtgtagtgtttgcagaatgcttgcaaaaatacataaaatcttttaatgtttttccatcactcacaaaattcagttcataaaaaattactcccagagtgtttggtattaagcagtttagaattctaagtctgatagggtcattttgagactgtatttgattccagtcttcccagccaagagaattctatttgtaccaatgtccaagataaggagtaaaaagcatttcttgaggctggtcatggtggcttacgcctgtaatcccaacactttgggagaccaaggcaggagacttgcttgagaccggaagttagagcccagcctgggcaacacagcaaaaccccatctctacaaaaatgttcttaaaaattagctgcagccaggcgcagtggctcatgcctataatcccagcactttgggagaccaagacgagcagatcacttgaggccaggagtttgagaccagcctagccaacatgacaaaaccctgtctctactaaaaatacaaaaattagccaggcatggtggtgcacacctgtaatcccagctactggggaggatgaggcacgagaattgcttgaacccgggaggtggagattgcagtgagctgagatcacaccactgcactctagcctgggtgacagagcaacactctggctcaaaaataaataaataataaaataaattaaaaaataaaaattagctggacatggtggcacatgcctggaatcccagctactcaggaggctgaagtgggaggctgaggtggctatgatcatgccactgcactccagcctgagtaacagagtgagaccctgtctcaagattagctgggcgtggtggcatgcaccagtgattccagctactcacaaggctgagacatgaagattatttgagccggggaggcagaggttgctgtgatctgagattgcactactgtactccagcctgggtaactgagtgagagtctgtctcccctccccatccacccccaccttccccccagaaaagggcatttctttagtctctggaatctcaccattgcatgctaaagtatggacactggggcccagcagtgagaaactaattctcatctcttttggagtccccatcctgccttgacccggctctgtctcctcctttcttctttgaagaaaatccaagcacaaaggaacttaagagaagcactgtagtatcatattactgcgtgtgcgctggttccagtggagaattctggccaagtccacctggaaagctcactggcctcagctaggttggccaaagtagcctcagatcaaatcaggccacaaagtttccgaccttgagcagggctccccaactctctaaatgacagttccttcatcaaaaaaatgagacaatgggaccagatccatttgaccagcacttctcaaactgtctgtggtgaaagaccaggagttttcagggggttttaaaaaatttccagtccgtcacaaaccatgtatttgtatgttacaataaaaatgaattagtagaagaatggaattttcaaaacatataaaatataagccaaaatgtcttattataagatgcaacaggcatgaaatagatctgtcaaactgccatgaacgtttctaaatgcttactcttcatttctgaccttatcgtggacaaggggatctcgagcagcatgtggagcagcccctgtggggaccccacttttatcactggccatgtgacatcccgagggcatgtcacactcctaagatgcccctctccttttgttgggaccctaggcagcaagcagggtccttctaccctccccatccccagaccctgtgggagcccattcagctctcactcactgagggaatgaggtaagatgaagagcagctgtttgccccaaatgtctagttctgatctggtctgacggcctgtgggaggaaattgctagagacatggctggatgaggagccaccctcttgaaagctccaccctgataaaaccgtggttcaaagtaagaattccacctattattactgggcatgaaatatttctgcaataataaggatatagagaaaatgcttgtcggagctggaagccaccaagcagattctggacctatctcgtggttctttcatgaagaactgagactatgaaagatcaactctcttgctcatgatcagtatagctctcagaggcagagccagaactgaacccctaatcctttcctaagggtcatcccactggtaccaaagagttctcttaatttggttggaagaggtctttaggtagggttcaccaaagtgggccttgaagagtcttgttctctttctccactcagcccagatctgtcagtgggagaatgaataagggcctcttcatacgtagcatggaatgctaatgcccgagtctgccaagacgcatggtttggagcctgccactgtaacccattacttattggctaatgcgattttaactagacatcgctgtttggctgagagagcttgctccatccggactgatccaactgggtggccacttttcccttgcctgtgtagagcaccccctctgcctcacacagcaggctcctgccgtggatgcccaagattgacccctcgaaaatggatgtccagctgtttaagcagctgcctgtcagccctcttgagtcataatctcataatttttcttaggcccaagaaggtgtctcccagccggctgtaagcttaccttactgtgggctttgaaccccaggaaatctggggattctattgccaccaagcatgtgctgagtgtccgctgtgttccgggcacatcccgggaagttgaccatgcattgttgtacatgttaaatacatacaattttatttgtcagttatacctcagtaaagcccggtgatggggaaaacagggaatcagctctaattctcacaatgtgttagcagtgatgccttccatttttttcaaatgcggaaattgagactcagaagttaagtaagctgcccttgtagtacatggaagaaatgtggagagacttttggcaaaggatccaaaaatctgagccttatttccttctctgttcctctctctaggataccatcagaacggagtcatcagaaaccagtatgtgccatatccccatgctcctggaagccagaggtccaatcagaaaagcctgtacacctccatggcccgcccgcccttgcctcggcagcagtctaccagttcagaccgagtgtcacagacgccagagagcctggatttcctcaaggtcccggaccagggagctgcagggtaagattctcacatcctctggatgaagccggcaagctccatctccatcattcaaaacaagggttcagagattcctgtgggctgtcaatacacaggattctaaggtttagttttccacctcagtgctatatgccaggacccaaggctgtggggctgtggctggttatttgtaaaggtacagtcacattaatagcacacaattcatttcattctccagagagggcttatcttggaaacatcagaagacgggttccccttggccccagatatggttactctgtgacctctttgtgctttcttgcatggttgaggaataatggatcttttgatttgtgtctgtgcctgcagttgcataaatacaacagctttaagagtcttcagcaacattaagcataacatcccagcattctatatgatatttgttgaagaatatgggtctttgtggctttatagtgagagcctctctgcctttctagaatataaataaagagtggtgaagagaacccagcctttttagccggaggaagtgaagattcctgaaactctgtgtagatattaaaagagctatcagttttaaaagggggttaagacatgtcctgtggagtcgtagggatggaactagcgccaactgaaagccagttggtgaactctgccaggaggtagattttggctccagtaaaaggaagaacgtagcaacccaaatatgagttgccctcgtatgtaaacagcattttgttcctgggagcatccaggcaccaggtggatggggatcaccaggcaggagtgttcagagtagtgttgtcaaatggtagataaggggaaagagaggcctctctaacactggacctgctgtttgctctctctgagcttcagtttccttgtctaagcactaatgtaatgccatcaaacttgcagcaaacttgttgggaggactagaaattatatacataaaatctctagcatggtacttggcatgcaggcgtctgctcacttaactctagcttgagggtggtaatgacggtgacagggtgatgatcataaggacccccgtcacttcatggaggttgaactagagacttgtaaggaatcttccagctctgcacgactctccatggtggagtggctctgtctgctaaagctagtaatggcctgctcccacccactctctcttctcttcccctctctcaagcccacttccattttccactgtctcctgtctccagcaccatggagaagtttcaaatgaggatcaggaggtatgaatgcaaaatagacctgtgcaggaagagaaacaacagctccttcctctgagggggcagccatccatctacctttttgtttgttggttggttgctttgttttttgagacagggtctcgctctgttgcccaggctgcaatgcagtggtgcagtctcggctcactgcagcctcctcccaggttcaagtgattctcctgcctcagcctcctgagtagctgggattacaggcacgcaccaccacacccagctaattttttttttttttagacggagtctcactcggttgccaggctggagtgcagtgccacaatctcggctcactgcaatctctgcctcccgggttcaagcgattcccctgcctcagcctcccgagtagccaggactacaggcgcctgccaccatgcccggctaatttgtgtgtgtgtgtgtgtgtgtgtgtgtatttttgtagagacaagagtttcactgtgttggccaggatggtcttgatctcctgacctcgtgatccacccgccttggcctcccaaagtgctggaattaagatgtgagccaccgcacccagcctaatttttttacttttagtagagacagggtttcgccatgttggccaggctggtctcaaactcctgacctcaagtaatccacccgccttggcctcccaaagtgctgggattacaggcgtgagccactgtgcctggcctcattcatctttatgccctattatttgatgtttttcctgccttggcagcttccttctaaagaccacagagctcttaagagctttaccatgttctctcctagcagcattccttttgccctggcaagtcttatctcacttcatttgggctacaaatatgaaagcaccttagttggtttttttggggggggttttttgtttgtttgagatggagtcttgttctgttgccaggctggagtgcagtggtgcaatctcagctcactgcaacctccatgtcctgggttcaagtgactgtcctgcgtcaacctcctgagtagctgggactacaggtgcgtgccaccacacccagctaatttttttggtttttttttgtagagatggggtttcaccatgttggccaggatggtctcgatctcttgacctcgtcatctgcctgccttgtcctcccatagtagctgggattacaggcgtgagccaccgcgcccagctgaaagcaccttagttttatcacacagacagccatcagtagagtggatgccgcccttatgtagacctctctctaagtgcacgtgcgcgcgcgcgtgtgtgtgtgtgtgtgtgtgtgtgtgtgtgtgtgtccctctcctcttcccttccactaccccccagtcttgggtaagtagctatatcccaccagctctcatgaccgtggttcacgtgattggcttggtctaaaccagtagttctcaaactctagtgtgcagtagaatccgctggaaagcttgctggcccactttccgcgtttctgattctgtaggtctggggtagggcctaagaatttgcatttgtaccacgttcccaggtgatgctctgatccagggaccacattttgaaaaccactggtctgaaggcacctgtagtctgattgataaagccagggaagcctccatgtgaaggtgaattgcaagggtgctgttaggtttatgggatttttgctctctaacccagacctacacctttcaggtgggtgagcatcactaagtcacaatcccacctaggcccagtttgatgcctcaaagtaggcagggtattaaaagcagtcaacagaatgcaccaaatctcttagctctgtgtgctagctgcctacttactttggttttggcaagcaaaaccatctttccagcctactttgcaagttgcaaacttgcacatcagccagctgggagcatctgtcagccaaaagtaggcaatttaggaacactgtgtcttaaccaaggctgctcccttccagccctctgccatgtggttccctatttaagtcttatggcaccctttgccaccctccagcctaaagactgggtacacgtggtgctgtcttggaggcaggccatgaggccggaaggagaggacaccttcacacctgtctgctaggcattaagatttccttgtatgtaaaacacaattagtaggcacactgtgtcttagccagcctcctctttgtaaccttaaatctgctgtgcaaacattccttacaaaatagtaccttgggcaaaaggctcagccttttcttagtatttattttctaaaacatgtaaaggtgaaaattaaaagtatctaatgtggccagagactttggatgtggcattttatggatccccatggttacctaaatttaacagcttctcctatttgccaagaaaacatgaattgcatttattccacaggaggctgttgaagcatgcagggaattttaggatcccaagtttgtactttttccataaacatgaaaattcctatacatcaaagttctaaacagtcaccttgactttaccaatctataaaagtaggattactatggtctttctttcctggctttcacattctgagtttatctttccttcctctctctcatccctcagtgcactttttctgtaatttattttggatcatgtaatatggataaaatcaaatgatgtaattagcacctcaagttaattcaggcaagtctttatcagtttattttaggttcaatcagttgttctgaagagagcatgaagatttcactaaattaattaccatcccaactggattctttaccctttcattgcagtattggtgcacatggtagctatcattatcattctccaggaaacactgagagatctgcgtgggaatcaggatcttgccatcgattagcatagcttttgagaagtcttaattcaggtcaaagatctttcctgtttctcaaggaaagggaagaggttaggcaagaatcctattaacagttcatccaggccgggcgcggtggctcacgcctgtaatcccagcactttgggaggccgaggtgggtggatcacgaggtcaggagatcaagaccatcctgattaacacggtgaaaccccgtctccactaaaaacacaaacaattagctgggtatggtggtgggtgcctgtagtcccagctaatcaggaggctgaggcgggagaatggcgtgaacccaggaggcagagcttgcagtgagctgagattgggccactgcactccagcctgggcgacagagcaagactctgtctcaaaaaaaaaaaaaaaaaaaaaacaaaaaaaaaaaaacagttcatccacccacctttgctctgatctcactatccagtgtgctttgtaattttccctcctataactgaaatgtacctaatctacctgcagttcattcttggaagcattaaaacccagactggaaatgtctgttgacctttttaatcctgtggtccattttgtgggaggataacttcaggaaatttcaagatactccagagattaatccaactagaagttggaaaaacagaaaagtcttggaagtgctcagtggtagggcttctgggcatgccacaaaggaggggtcaatagaaatatttaaatgctgcctgtgtgtctcttgtcaagatcctcccaatggagtcatatttttatggggcttaaaatttccatcaagtgtccaatagcaatatttctcaacccataatctatgggagcagcagccatatcctggcccaggcagacatggtgctgaggaattcctggcatccatttccacatttccagtaatgtttatagattcaaccttttggaacacagcatatttttaagagccagtgaaataaaatgccattattttccttcttggaatttcaagacataaatttcccatctgcagaacaaagaggtgatattcgaaagcttaatcctagctcccccgacatagactaggcacacccacccaggaggtgtgggagctacagagaaattcacaaaaggtggcatttagagtgcagagagcacaggatttgcatctgtaagagtagggtgagtcctggttcattcattctttcctttttcttttattcatcaatatttactgagccatgtgccttctatgtgctaccccaggcttgtcacttaatctttctactcttggtgtcttcacctgtataatagggatactaatataataattttgaaaacccactcctcagggttttcttgaaggttaaataagggctttgtgtgctataaagcacaatgctatttgaaagttattttgtatttgattcattaccattattcattggctggtcttgcaaggaaattttaatgctctaccagggttgaaaggtgatgtttcctggcccagtggctttattctcaagaactcaaatctctggcctgcctagagctgtggactccatgaaggtctacgcttcaggcattgttggctgtaatgcggggaatgggcagcctagggaagccaagacaaggagaccagacagggagacgcccgcccccaacacacacacacccttggcagctgtgcctgttctccgtgggcacagagcatcagtggcacacagagttctgcagtaatggtaataatcactagacatgagagcctcatttggacaatttgaagatgaaaagtcacaaactccttctggctctgcaccgttccacagtctcttcctttcttttttttgtattgtttttttttttttttttttgagacagagtctcactctgtcacccaggctggagtgcaatggcgcgatcctggctcactgcagctcaacctctgcctcccacgttcaagcgattctcatgcctcaacctcgcaagcagctgagattacacgcatgagccaccacacctggctaatttttagtagggacggggtttcgccatgttggccaggctggtctcgaactcctggcctcaagtgatccgcccacctcagcctcccaaactgctgggattacaggcatgagtcactgcacctggcctccacggtctctttctaactaaacatctgagctgcagtcatcataacaatgaacagcccatggaaaggatggacattgctagggcagagggaattagccctcagtttagagagttttcatgtcatttggggttttgttttcttgtgggcttttggcaccttgtgagattcggcagccatccatgaggactcaaatgtcagctgacatccaaatgtctcggggcaagtatatcacttggtcttctctggtcactaatataggacttctcttgcagagcaagttttcacaaagcaaactggatgtagtgtacttaattcatcaggaaatgttatttgtttctgggttataatgtgattgccctactcagaaaaaagaacctggtgcaaaaagaagttgctgtgggtcagctttttcgtgcatttatgttaattggtaatagacacataaagtgatgtgtacaaattaccctaaaataagaaaactaaattggattgtacagaaattacatataatgaaacactggatttgctcagtgatgtatagttttataaccatatattaacatatgtatattacatatataaataatatatacaatataagtaatatatattatatatataatgagcctttattattgaaatgtcaaaagaaaaaataagttattgtgagtctgaaatcttgctgcaactccccatcatctagccaagcacagtggctcatgccgttaatcccagcagttctggaggccgaggcaggaggatcacttgagatcaggagttcgagaccaggctgaccaacatgtgaaaccctgtctctactaaaaatacaaaaattagtcgggcgtggtggcaggtgcctataatcccagctacttgggagactcaggcatgagaatcacttgaatctgggaggcggaggctgcagcgagccaagatcattccactgcactccggccaagtgacagagcaaggatctgtctcaaacaaaacaaaacaaaacaaaaaacaaccattatctcaatgaaataattatttttataacacgattttcaattctgtgatgtttattagaaatacaaatactgtatcacagagtaccagacctaccaaaattatctaagttgtacaattataaaacaaatggtggcacatggctgtagtcccagcactcagatagctaaagcaggaggatggcccaagtccaggggttcaagactgcagtgaggtatgatcatatcattgtaccccagcctgggcatcatagcaagaccttgtctctaaaaataataacaataaggaaataatgaaacaaaagttggcaaggcatttttagacatgagtgagcctgtgctgtcgtgagggcagcttgaggatggtaggatggtaggatggtagtgtgctggtaaacagtgggcactccagggaggaaaaggcctgaactgtaacatttaccagtttccatggtaaaattctctcttcatggccaatttcaagctaccagtgtgactactactgagtgcggagttgggaaaacatgggcagtctcaccattgtatagtatttctaccatacatcagcaatagactttaataacttcaaatgcatagatagaggaaaataagtaggctgggcacagtggctcacgactgtaatcccagcactttgggaggccaaggcgggtggatcacttgaggccaggagttcgagaccagcctgggcaacagggtgaaaccccatctctactaaaaatacaaaagaaaaattagccgggcttgttggcacatgcttgtaatcccagctactcgggaggctgaggcaggagaaacgcttgaacccgggaggcggaggttgcagtgagaagtaggaagagataaatgatgagcatttattgcttttgttttaatgtaatttctttgttgtcaatgatttggtttttaataatggccatgtttgacaactggctcacaaaattcctgaaagttctatcagctctcgcaagctggactaagcctgttctggcacagtgggcatgcgggtctcatgtgccctgtaagggggtgtgtaatcccttcctcctggactagccaattgcctcggctgggagtagggggctccacctgcctagaagacctcattaatcaaatttctggcagtttctttgaaagtcattcctggccggatgcggtggctcacgcctgtaatcccagcactttgggaagctgaggcaggtggatcagttgaggtcaggagttcaagaccagcctgaccaacatggagaaaccccatctctactaaaaatacaagattagccgggcatggtggtgcatgcctgtagtcccaactacttaggaggctgaggcaggagaatcgcttgaacccaggaggtggaggttgcggtgagccgagatcgtaccattgcactccagcctgggcaacaagagtgaaactccgtctcaaaacaaaacaaaaagtcattctttcttctcattaatgacacaggattgccacctagtgacgcagaggagattgcctgggttttcgaggctgttggagtctgggaaaatggctgttcccaccaactgtgttccaaggtggcttccaggtctccagtctggtgaatcgtagagattgtgacggcttcgttgacacagatttcctgtgttcctcagtgctgttgagagctctctgtaaaactttcctagaatcagaaaaaagacctggaacccggtgcggtggcttacacctgtaatcccagcactttgggaggccaaggtgggaggatcgcttaagcccaggagttcaagaccagcctgggcaacatggcaaaacttcatctctaaaaataaagaggccgggcgcattggctcacaactgtaatcccagcactttgggaggctgaggcgggcggatcacttgaggtcaggagttcaacaccagcctagccaacatagtgaaaccccgtgtctactaaaaatacaaaaattagctgggtgtggtggtgggcgcctgtaatcccagctacttgggaggctgaggcacgagaattgcttgaacctgggaggtggaggttgcagtgagccgagatcatgccactgcactccagcctgcgtcatagagtgagactcagtctcaaaaaaataaaaataaattaataaataaataaaaggaaaaagaaaaaggacctaggccattgcctgaatctgctcaggttttacagatgcagagcttggccccaaacccagcacacagactcaagcccacgtccccctcctgctacacactgtcaacatagagcttgaggccccatctcagggggagttagccaaatagccacacaagtcactgtcatgctacaattgacccatgttctggagaagccgtgggctaggagagggtatggccgggggtttgccagagtatgaggaagcagtgatggaaatgagatccgaaggccgagcaggagttagcagtgctgcctgggaagtgggcagaggccaggggagcatagccagaccaaggatccagaaagattccatgtggctgcagtgccaggagccttaggcgtgtgccaccatgttggccagggatgaaaccagcaggaaatcccaggagcctgcatcagtcatctcacaggagtgtcgtgagggtgaaatgaagcagcatctgtgaaaatgcctaggacaaggcctggctgagttgaggggagtttatccagacttcacacagctaccggcagtttcccagaagacatcctgtctgctagccctcacaagaagggtgtagacatgtgcaggctggccagggagaatggctctcactgtggctcgctttgggaatatgccgccccagcaaagcagctgtgcctctttgtggtcacaagacagagccaatggtggcagcatcagtgttgcccttcctaatgcaaagtgcaaactgcagaggtcctccctcctccacccacctgcccactcctcccggctgccatcagacagtccccactatccacacccatctcaaagctgccctggcctcccccacctctcacctgtggagttactaggaaccccattcagcctagtgataaagggccaaatggcttacactgccagcatggtagcagttgtccacaacctggacaattatggaccccaaattccccgggtaatttcggaggttttactttggccaggagtcacttatcctgaggaagtagcctctgatgccttgatatcaaagaccacgcagtggccacatacacacagctttttgcgtcctgcatccccttaggtcttatttataatttggtatcttatcaccagaaagaatccgttccatgagacttacgatctctagtttaaaacaatctagacgccttttttttttttttttttttttgcacctaattaccctggctagagtttccaggataatattggacagaagtggtgagtgctgacatccctgttttgttcctgatcttatggggaaatcattgtgagtttcaccagtaaatatgatgtaagcttgaagtatgtggacaagggtcctctccccaaccagggctcatgaagaaaggtaggaaggcaccaatgtggcctgcagcagggagtaaggctggggtgtgagcaggggccgcccctggcagagtctgtaggcgccatgaagggttttggtcctttttccaagagcagagagaagctgttagaaagattttcaggttgaggatggggcgaactaataacagctgagctagcatgagggccaagtgtcctagaaaggaaacaactggcaaggaagacacgaaggacagaaacaggtcttagtcaaagctggaggcaggtggggcagaacaagtgggtgatgcccagggcagggagggtcttacctctcaggagccatccgtcttgtcttcccactaagaggtcttaccccgaccctggcgaggggagtccttcagcaggaggaccctgtatctaagcccccatacttgggctccagagaccttgtcagtctacactaaggacactagggtttttccctgaacaagacaggacaaattagcatctgtgggttcaactggcccgctgtgcccatgggttccacatctgtggattcaaccaaacttggaatgaaaatattcagaaaaaatatggatagatgcctctgtagtgaacatgtacagacttaaaaaaaaaatttttttttttttgggatggagtctcactccgtttcccaggctggagtgcagtggcacgctctcggctcactgcaagctccgcctccctggttcacgccattctcctgcctcagcctcccgaatagctgggactacaagcgcccgccaccacgcccggctaattttttgtatttttagtagagacggggtttcaccgtgttagccaggatggtctctatctcctgacctcatgatccacccacctcggcctccccaagtgctgggattacagattacaggcgtgagccactgcacccagcctttttttttttttttttttttgagacaaagtcttactctgtggcccaggctggagtgcagtggctcaatctcgactcactgtaacctccatctcccgggttcaagcgattctcctgcctcagcctcccaagtagctgggactataggcatgcaccgtcacgcccagctaccgtctgtattttcagtagagacgggtttcgccatgttggccaggctggtctcgaactcctgacttcaggtgatccacccgccttggcctcccaaggtgctgggattataggcgtgagccaccatgcctagccagtcctatattttttaaaaagcctttttcttgtcattattccctaaacaatatagtataacaactatttacatagcatttacattatattaagtattataagtaatctagaggtgatttaacgtatacaggaggatgtgcataggttatatgcaattgttacactttcatatgagggacgtgtctgtggagtttagtatctgtgaggagtcctggaaccagtcccccagggagatagggatgagtttttggtgtgtgtgcgtgcacatgtgtgcatctgtgtccttccatgtgcacttgtagcccagttctgtggactgccaggctggaggcttcctccctcccagggtgttgtaatgcccgccgccatcccctttcattccttgttgctgagaagtcacatgacgtctggtatccaggctaatggctcttattaaccaaatgctgacacatcccaatatatagggtgcttaattaaaaacctgctcgcctggccaactttcagagaagcaagcacttcttgaacagggaatggggatttccagtaggcactaggtagaaaacgaatgatgtcacactaagaacctacaaaatgcctttcctctgcactaagagaaaagtgcaggggggtggtggtggtgggaggagtggagcctgagtagccttgaggattgctccctcccacgtggggtggtgtaaaagccgagtctcaggggcgcccagcccctcctggggacagtccaccaccctgctggcagtcagtgttccccccagccacccctttgtgatccaggttgttcatcagcaccccatgaacatctgtcatcacaggacctgggcaaggccagcaggctgtggctcctgagagcacagctcaaaactgggtgtggttgttctttccagaactcaggccccaggaaggccctcccttttcctccttgctcctgtaggtgtgaatgatgtgcacagacctaacagccagccccaccctgttgaggtccagcccaacttcttgagggagaaatcttaagtttgttttgtagggaaatgaatgtagcctttactttggtttgtccttaagcgaagtggaaaaaaagaaatgttctccatgtttccgttttcctttttgtttttgctaaatgctttttatgaacatatttaataaatgtttcaggtataagtgtaaagatctcactaaataggaacaagttgaacttacacacctttgaaagaatgtatgaatggtgacttaaggcagcatagtatataggaagaataactttaaagctagaagatctggattagggttagagcactggagttatttttaataattatgacagtggggtgaagggagtgtcactggtatccagtgggtagaggccagggatcctacagggcataggacagcctcccgcacccacccccatacacacacacacacacacacaacagagaattcccagccgcaaatgtcagtagtgcagatgttgagaaactgctctggataaactcttgtataagaatatttacagcaacatttttggaggggcaaaggggagctctgaggggtaataatgaaagaatgggaaggagacctgaggagtaatactgattgataaaatgagagggaagtctgtggattaataatgagggggtgggagggaagattgtggagtaatgatgagggtatgagggaagtctgcagagtaataatgagcaggtcggagggaagtgtgaggagtaataatgagggacgggagggaagtctgaggagtaataatgaggaggtaggagggaagtctgcagagtaataatgaggggtaggagggacatctgtggagtaataatgagagggcagaaaagcctgtagagtaataaggaaggggtaggagggccgtctgcagagtaataatgagggatgggagggaagtttgacaagaaataatgagaaggtgagacggaagtctgaggagtaataatgagggggtaggagggatgtctgcagagtaataagggggtgggaaagaagtctgcagagtaatgagcgggtgaaaggaaagtgaggagtaataatgaaggggtgggagggaagtgtgaggagtaataatgagggatgggagggaagtgtgatgagtaacaatgagcggtgggaggtaagtgtgaggagtaataatgaggggttgggagggaagtctgaggaggaatgaggggggtgggagggaagcctgaggagtaataatgagggggtgggagggaagtgtgaggagtaataatgagggatgggagggaagtctaaggagtaataatgaactggtgggagggaagtctctggagtaatgagggtgggtggatagatgggatgggagtagacaggagtgaggtctgaggcataataaggttgtgaatggggagcaaatctcatggcagcattttttataatagtgaaaactggaaccatcccaagtgaccatccacagtgccctggagaagtaaactgtgacacactcactcgcgcagtggtgtagtatcaggcagcaagggtgaaggaacgatagctgcaggcatcagcagggcacgtcatccagttgttgagcatgtgaccgtggaatatgattcctttcatacagttgacagtcggaccacaaatattggctaggggtatttacatgtgtggcaaactgtagagatgagccagagaatggttaatacaaactgtaaggtggtggtaatctggggggaatgcagtgaaggagaaatgcctacaggcttctgtggcacctgcaaaagttccatttcgaaacttgaggaaggagggacagatacctgaatgttcctgatttaaatgtatgggtatacttttgacacttttttatggatatgtgtctcccacatttccttctatgctggggacacagtgacaacagcagctaaggtttttaagagctatgtgcatttgcaacaaccttgtcagaaaagttacttttattcctcaagtttaaagactgcaccctgggccacatgtcttctaaggatggagctggatttgaacttgaacaggccagtgccggccgccatgctccaaaccaccgttcggtgctgctgccccctgttggggcccagtctcatctgctccactctctccacagggtcaggagacaaacaaccagtcggcctcccccagcagggggcagacccaagccccagcccaagcccaagcctcaggtgccacagtgcaaggctttgtatgcctatgacgctcaggacacagacgaactcagctttaatgccaatgacattattgatattatcaaagaaggtaagtgtgtggctggttggctgggacagcctcccaaagagcatgcagtcacattgctgtaagatctagtgtgaaaatgaaaagaatttatgggctcctcaaactgcaatttgtagaggcaggtcaggcctcaggctcagtctgatcaagacaccagcttttttaatgcttctttcagctctgcccccttatttatattccctcccttgtcaagctgtttttcttcatggtagcaaaacggcagcagcaattccaggccaacatatcaaaccatgtctgaaatgtgcatcatctctgaaacttctgttcttagtcattggacaaaagtcctgacttttattctgatcagaccaaattagccatgtgtccatccctgaaccaacttcagtagcaagacaaaggctgtaccctgagaggatgagacctggtaggggctgtccccagaaacggggaggtctgtcccacccacacttcctggcttcttcataatgaaagtggatggagtggaagccaggaagacaaccttgaatatccattattaaagcagtccatgggcttggctgagtgctttattaatttggtagatatcttacttttttcaacaaactttttgatttaaagaacaaagggaaaacaacatggatggagccaaatcacttgagcccatgggagcggagtgtgtgtggctggggcagaacagactttctcatcttcacttccaccacctctctctccctgcagatccttctggctggtggacgggtcgactacgaggcaagcagggcctgttccccaacaactatgtgaccaagatctgaggtgcccgtgactctgacacatggggcagaggagctccaggcacagaccaggggaggggatatttaggggctccccttacaatccacaatgagcaattgcttctccaaggcctggagctattctggtaccttccccatggaggacactgaaaaggctgggttggggacagggagtatcactccataagtgatcctaaaaggtagcctcttcataggaacccaggaggacaaaaccaccatgcattaagatttatttattgtatttaaacctggtgagaggacaagtgaggtctgctcagaccttgtaggcttctatcaaaacagcaccctgcttgctcaccaggcctagagaatggctgtaggtggccgctgacaagtgcctttagttgaagagcacatttctttcatctctcttgtccatacctgatagacacattcctctctgccaccttccttcagggaggacccgccctctgcagactgggcttagcgtgagcaggcacttcccatgtacgtgccaagggtaagctggcctgctgagcccagggcgacagaggggcactggtttacactttgccgggaccatcagggccgccaagcaggtcaggggctgggggctgggggctgggctgctggctttgctttctctgggtcttcaattagaatgtggctggcccatattggtttgtgtttaaatgctgtacttactacaagaaggatcttttttcaagctgtacatttataaaaacagatcatatactgtatatataaaaatcttgagatggtagaaacatgtatgaatgtactaagtagtattccactgtactcattcataaggtaggttttcttacaaaactcacaccaggtacttaaagatgtgctctgcttttttccaactacggagtgtcactgctttctaggtcagtccctgcagactcttctcaactctttccctataggaaacttactccgcgtcctgcccccacctcctaaataaataaaggaatcggcgaacaccttcttcttttatgacatttgttatgggttgaattgtgtgcctccaaagaagatgttggagtcccagccaccagtacctcacaatatgaccttatttggaaatagagtctttatggagcaaacaaacaaaactaattaaaatgaagtcattagagtgggtcttaatccaatataatggtgtcctgatgaaaaggggaaatttggacacagagaccaacatgccagaggaaagaccatgtgaaaaggcagggagaagacagccattcacaagccctggacagaggcctggaacagattctccctcacaccctcacaaggaaccagccctgcccaccttggtcttggacttccaacctccagaactgtgaggcaatacatttcgctgtttaagccactcggtttgtggtagtttgttacggcagccctaacaaactaaaacaatgttttcttgccataatagtgaaaagctggaatcagtgtaatgcccatcaataatggaatggttgtaagtagagactgccatttctctacctttcctcctctgggtgccatagccattcttaagctactggtaacttagagtttgagcagcatacacctttgaggctttcaggatcctcaagtccatgggaaaaaattatcagggcttacgtataagggaaaaaaattgatctagatttgaaacgaagatacatttaattctgctgtgttttacttcaagaacagggagcaaactccattctgtaacagtaacgaataatgttaaaaggctacttcagttccatgttgcgaccagagaggaaagtagagccatgatgcggtgagttgaggaaaggtaatcctgttgacactagtggtctctaaagtactttcacattcatggactccccgcagtgggaggaagataccaccagaactgggacagaggagcatgctggagtccccacagccaccagcactcaggctgcgttctcagggcaggaacaccaggaccatcttcccttgttatcataagcccctggctggctgggacaagcctttgtttttcctcctgattgattgattggcattttacacttgtgtgtaactgggaaccatcgggctctaggtcacaaaacagggactgagttaaacccccacgagtaacaccctcatccatggaaatcacagaccaagcccttagcacctgcatcgtgtgcccagccagtgccaggctcaaggagatgcccaacaaatggtgctgaaataggtaagtgacccacaggggaaggagacttagatctgcgtagagatgctgaaatgctgacactattaagaaaagtttggagaaatagtggtttatcttaaacttatttgtatatatttagaaattcaacatggggactaccagaaaaatctgggataaataacatttccctttttttcctaattaaaaagtcttcagaaaaatgtcttttttccctttaagacactaacctgggtttcctctagtctgtggatctagcctggcctgccattttgttcactgtgcagttaagcaaatatgaccactttaggagtcacttaccaggaaagaacatacagaagatcaaggggccacccccaccttctggaacttgccatcctgtttgaaataaggggtgttcatgtgcacacacagcaacgtgtatagcagtatcaaacacagtataaaaatgtgacatcccttcaaccaaaggttttaagtaaccaggaactaaatgagaaggcctgactgtgtaccctagggtagaggtgttcaagctttagttgtagaagagagagagacagaggtctgtataagggtggtatccactctactgatggccgtctgtgagacagagagaggctgatctgaaactcctgggatcaaacgatcctcctgcctcagcctctcaaagtgctgggattatgggcaagagccaccgtacctg

SEQ ID NO: 16265 - DNA, 49003 bp, Human
taactgcttcttttttgatgttgtttttaaaaatctttattgaaatgtaacttatattttatgatgttaaactatgtgaaatgtaaaattccatggtttttagtatatttacagatttgtgcaaacaataataacaataatctaattttagaatattcatcaccttataaaaagactttgcatccattagcaattactcccaatccctctgcccttactttcctgtaccacaggccaagcaatcactaatttactttttgagcatacagatttttctgttttgcacacttcatttaaatggtatcatacaatatgtaatgatttatgactattttttcatttaccgtagtgattttcaggtttatacatgttatggcatggattagtactgcgtttcttcttactgtaaaatagcctattgtgtcgcaatttgattacctattcattagttgatggacatttcactttttccacttttaagctattatgaataacattactataaacatttgtgtacaaatttttgtgtggccatgcattttaactcgtattgggtaggtgtgaagaatgagaactgtgaatttttggattataagataactccttttcacatttgacaaactgtcttcagaaatggttgctccattttatatttccatcagcatgcataagaattccaatttcttcacatcctcaccaacacttgttaatgtgtgtcttttgaattacagtgattctaatggatgtgaatttgtttctctttgtggttttgatttacatttccctaatacacaatgaagttgagaatatttgcatttgtgtactagttatttgcatatcttatttggagaaatgtctattcacattatttgcacatgttttaattaggttgcctttttgttgttagttgtaaatgttctttatatattctatatactagatctttatgggatatatattttgcaaatatttttaccatttctgaaggttgtctttttgttttcttgatggtgtcatttgaagcaggaagtttttaattttgaaaacttaatctttctccatttgattttcttggattcttcttcaaatattaattgactgtaaatgttagaatctatttctgggcactcaatttcactgatctgtaaatctaataaaaggccagtaacaaattgtcttggttactgtagtttatagttagttttgaaattgagatatgtgaatcctccaactttgttcttatttaaaattgttatggacattctgaataattttcatttttctgtgctttatttctggatcatgatccatgggcacttaaaaaacgcatatttgctgttttgtagtgaaatgtgctatagatatctattgccttataattttgttatagtcttcaatatctctgttgatatttttgcctaggtattctattattgaaagctgtttacttaagtctttaaatacgattgttaaattttctatttctcccttcaattctgttattttttgccttgtgtaattctctggctctgtttttggttgcatacatgtttataatttttatatcttcctgatagacatcctagctctcttattagtgatgtttgtatggtatatcttttaagttcctttacttttaggtgaattgtatcttcaaaaatgtactatgtctcctatacacacatctaaacattccggtttagagctaaacttttcttttaataattattataattattttgttgatagtagaattatacctttttataatgtttaaactttttaaatttctatggaaaaaatataaattccaattcatatttttcagtttttatactgaacatataacatataatttgtataagaaaataatgtctaaaaactaatatgtttgtaatttaaataatttattacttcaccaaattgaattttaaatgaaacaataacaatcattaaatgttaagcaatatatatttatatctaaaatgtaataatattttacagtataatcatatggggtctgatacaactgttgtcgctcaaaaagttttccagttgattggattgacgaatgctgtaagtctttgcttcttagtacttttgcacttcttgtgttactaaaacaatttctacacctcattatgacactacatgaatccacacgttgtgtggcataagggaaattaagttttattttaaattttacttatctgaagtgggaataataattgtatgcacataatttggctactgtaagacttaaattatataaagcatggggtatggggcttccttaaatgcaagcattataaaatctcaagtattacttttattattagtaacattttaaacttactaatctactttaaaagatgaaatgcagacttatagtttagttgtttaatatttatcataaatttgttttcaaacatatatatctaatttttaaaaactgtgacttttgagcacacttttgtatgttttctattttagatttttgtttcatttaatattacaattattctgtcttcattggagctttggatagatgaaaataaaattgcaaccactggagaagctaatgagttattacacacatttttaagatggaaaacatcttatcttgttttacgtcctcatgatgtggcatttttacttgtgtaaggatatcttgacattatataaagtttatctgaagaaaatttatgcaatttgaccgaatatcttactgttgataaatgtgtattaaaaaaatctatttttttctcacacacgccatgtaaatatttttcacaacatggtatttatattggaattactgatatcaatttatttattggtttgaagttaaaactcactccccaatcttgttcccatattacttctttccctagggtatataccacattattaaaaatctcacacaatacataaaattttcacaatatctatttggagaaacatctgaattctataaatatagtaattcagccttcttgttatgatttgttgttgtaaattaaaaagtaagcaaagtaattgaaacactatgttttaatatctctaatatatctgcattgtgcttaaggttttagtacattagccttcctttctatttaatagactctgtttttcttttatcaatattcagaatatatatatatattatgtgtgtatatatatgtgtatatatatatagagagagagagagtttttaagattaaacatggagttttaaacattttactttttatcttctgtcccataaatatgacatgctttttcatgtctctagaaggctaattttgtctgaataatgagagactttggtccatagagtgattctgctcattaacaagttgcattgccttagctttttacttttaaggaattttatttatttttattattttttgttttttcttcagtttttctgttttagtttttttaaatctacataaaatgaatctttgttatgttacagaaatccatataaaatacactttgtttttaaaatttattttattgtttttaaaagaagcagaaagatttagtcacatcttatgctatcttacattaatgttagatgtaaatattaatgattatcataaatgtaaaatttgtcttataaaaattcatattaatttttacaaaattatatgattatgatccctttttaaacttaagttacagagaaaagtcaaattatgttggtgcaacctttcaagggaagatgtgtgatgcaaactatgcaggaggtgttgttctggtatggtatggttatgtatagaaagtatgctacataaattagtatacagttacacattttcatatttaatttttatgtgtattaaaatttgcattgttctaagcatctttgtcactgttgctgacagaaatgtttaaactataagaagtactcattcaattcactatgtataaaaatttttcaatttcctatcatgagttcaagatatcctttctagaaagttaaggtagtgaactagtttagtcttactgtaaagtgctcttcaagttttcataatcttaatatttaataattaatttcggctaaaacttagattttatatgttttcctaattatgtagtgaacataattattaaccagattaaaataaaacatttgaaagtatcagtcgccttaaaatgcttcatagggtataagtaaagaataacggaaccaaatgtcctaattgacattaattatctagtagagaatgttagtgtattcaaaactgatatatttttgccgttatttcataatactatcactattctgacaaacagaacttgcctttttgttgtgtgagtgtttgtataatatctgcaggagtttcttagaggcaatgaacaaatgaagtgaagctaagtgaagcaataaagagatgaatcaattaaatggagataaaaataatttcaacttttattttagatttagggcatacatatacaagtttgtcacctgggtatattgtgagatgctaaggtttcagatatgattgattctgtcacccaggtactgagcatagtacccactagttagtttttcaacccttcctccacccccggtagttcctggtttctagtgttaccatcttaatgtctaagtggacccaatgtttagctcccacttataagtgagaacacgcagtatttggttttctgttcctgagttaattcacttagaataatagtctctagctgcatccatgttgctgcaaaggctatgattctttttatggctgcatagtattccatggtttatatgtatcacattttctttatccgatccaccatttacggacacttaggctgattccatgtctttgttattgtaaataatgctgtgataaacatataagtgccagtgtctttttggtagaatgatttattttctttctgtctttcttttttttttttttttatttgagacagagtctctgtcatccaggctggagtgcaatagcacaatctcgtttcactgcaacctccacctccctgggttcaggcaattctccagcctcagtctcccaagtagctgggattacaggtgctcaccaccaagcccagctaatttttgtatttttggtagagacaaagttttgccacattggccaggctggtcttgaactcctgacctcatgtgatccccccgccttggtctcccaaagtgctgggattgacttattttctttcgagtatatacccagtaatagggttgctggattgaatggtagttctgttttaagttatttgagaactctccaaactgctttccacagtttctgaactaattctagtccccctaacagtgtataagcagtctgttttcctcatagcctcatcagcatctgttgttttttattttgtaataagagccgttctgactggtgtgagatggtgtttcattgtggttttgatttgcatttctctaatgattagctggttagccatacacagaagaataaaactagatgccttcctttcaccatatgcaaaaattaactcaagatggattaaatatttaaatgtaactcctcagactataaggggttctagaaaaagacctaggaaacaccattctggactttggcattgccaaataatatatgactaagtcctcaaaaacaattgcaacaaaagcaaaaatttacaagtgagatttaattaaacaaaggagctgctgcacaacaagaaatatcaacagagtaaacagacaacctacagaaagggagaaaatatgcacaaactatacatctgacaaaggcctaatatccagaatctataaggtggtgaaacaattgaacaagcaaaaaacaaacaaccccattaaaaaatgggcaaaagacatgaacagacacttctcaaaagatgacatacaaatggccaacaacatatgaagaaaatgctcaacaaaaattaatcttcaatatttatgaacaagtttggagaatgtgacttatacttatggtcaagtgatttatctggtctcaaatgctggaatttggcttgtttatttcatcacatgccacactaagaaatcacaagactctcccatggagagtgcaaggccttcactgattaacaaagaggagagcagaactgattttctctacagggcgggcttccagcatgggcaacatagtaagaactcatttctacaataatttaaaaaaatataaatattcgccaggcatggtggaaggcccctgtagtcctaactgaggtaggaggatcacttgagcctaggagttcaaggctacagggagccaggactgcaccactgcactccagcctgggcaacagagcaagactccatctcaacaatcacaacaaaatttttaaattagaggcacgctagcttccaggaagaagaaaatgccataatttactggacaatttgtgcctcatgggcagagaaaaatggtctctttagtaacgacaattggaagaaagcttttctagtattctttcttattctccacagttattttgcctgccctttcactggaaaaatcagctataaacaatgttcacagaagtaagatgttgaagagaatagttgaagttctgccttttgatgtttaaattcccaccaccctttctacctaatcctgcagggctgtagattgcaatttagagtctgtatccttccaatgctgctccttcctaaaagtttatatgtgaaaccacagcacaagtagtttttggttgagtacaaacaagaaagaataatcagcatatgatttttcacttaattttttttttttcttttcgagacagagtctcgctctgtcacccaggctggaatggggtggcgcgatcttgactcaccccgcctcccaggttcaagcgattctcctgcctcagcctcctgagtagctgggactacaggtgcccggcaccatgcctggctaattgtttgtatttttagtagagatgggggtttcaccatgttagccaggatggtctcgatctcctgaccttgtgatctgcctgcctcagcctcccaaagtgccgggattacaggaatgagccactgtgcctggccttaaaatatttaattgacaaacatcatatatattcaagggttacaatgcgacaattatacgtctttagatatagtcatgttaggggtcacggtttcagcataagaatttggagtgggagggagacaatttggtccatagcagtagtctaaaggaaggatgttctagaagaaataatgaggaatatttaattatgatgaaggggaagatagcaatcataatgttgtatgcatataattacattgcttcaaaatatatagagcaaatgtgagagaataaaggaaaaagaggtccataatcatatttaagaatggaaaaaaacaacctacctcagcaatgaattttttcattttatcaaaatatatatttctaaaatcttataccaaagagaaacattgctaatgtagagtatttaccaaagcaaataatatggtgagaaataaagcagtatcaataaatattaaatgattgaaatcttacagagaaaagtgtctgagcattgtggatttaaatgagaaccaactaatagaaatatcacttaaaaatctcgaaagatttgcaaataaaataatgagataactcattttgagctaagtgacattaaaaatacagggtatctaaacttatgggatcccaaaaaggcagagctgagaggtagtgcatttatagctttaatgtataaataaaaataaggtcagtttgaatgtagatgatctaactccatctccaaaaagcattatagatggtgagttaagctaagagacgctataaagtaggaaataagttttaaggataatattggctatcaatgaaatacaaaatataatgaagaaaatcatcaaagctcaaactaattttttgaagatatatacaagttataacaacctaccaaaatgggtatcttatttcaaaaaaagctgaaaaaacaaattatccaaatattagttgaataaagggacatgatcaccacagatcatatagacattacacatataagacggcttatcctcaaccaattaatggcaataaatatggataaaattttatgaataataaattttctcaattaaatagaaaagtaaatctgcatcaccattgaaccattggcatagttgagtctccaattaaagcacttttctccaaaacaaacaaaacatctaggcccacatgatttccaaaaaatggctccaaaatatttaatgcttgtaataagttactttagataatacaaaaggaggggctaattctcaccttgttttatgatttgagatttatgttaactatatgttaacaaaaagaattctgcaatatatcaaaagagtatgacatggtgaacacatagaaattattctaggaatacaagatgaattttatatttgaaatcaatcattataatctactttattaaaaaatagatacagaagatacatttgttaaatttagaacctacttaggacaaaaaaaagcaagattgaatactctcagcaaacttaatgtaaaaagagacatcttcaagaaatgtttgcccattctaagatcatgaagctattctatcctctaacacaagcttgattgatttgcctttcaatgtagatgtataatccacattaaagaaatttgtttggtgtaaaataggggacagaatcagttagctcacattggataggtaattgcttcataacaacttatttaaaaggttagttttcctccaaataaatacagttgtgcctttgtaatagagatcaagtcgccatatcgctggcctctttccagaatcttctatgaccattggtgtttttgtatgtccttccaccaacaccacgttgtcataatgactctacctcgatagtgaaacatcaaaaatggtagtgtaaaccctactagtctgttattcttcaagactgttttaggtattccaagtcctctgcatttccattttaaaatcagcttgcaatttcaacaaaactgtttgatttttattgctttttatggaaactttagatcaagagagattagtatcaacaatattgaggcattttatccatcaaattcataaacatattgtggaatatccatatcctgtagtgcactacacagaaattaaaagaagtacagttacactcaaaattaatgaatttccaaaactatatttttagaaaaactagccagaaataaaataataaatacttaatggtgccatttttatgaagctaaagtgcaagtaaagataagccattgtactgagatcaaaataaagattctattttatgtggaggtagtgcctggaaacttgctgaaaagaacttcctgagtgatgaaaatattttgtgtctagtacaaagtagtagttatacaggttcatgtgacacacacacacatgcgcacacacacacaagtacacacgtatgcacttccccaatacatgtgtatatatgtgttttcacatgagtatacataaattatacctacatgaatgtgtacatatgggtacataactacacataaacatataaacacacacattgatatgtatatgaaactgtatcaaatccaaaacattattttaaaggtatgaaaggaacttacagtgagccaagatggcgccactgcactccagcctgggcgagagtgcgagattccatctcaaaaaaaaaaaaaagaaaaggtatgaaagcgccacacaaaacaagctttataataattccaaagggcaataattgaaagagataacaatgttttagtttcaactgtaaaaggcaaagattatttgatcgcattttctctacaagtttcaaacccatttgtaatatcacaggaattttaacccctaaagggtaagagaaagaccaaaaaataacaaccataggataatttatatatcaatactaatataaagcagcaaaatattatttaaataaaaatccatatgtattttgtttctattacttaagatgaaacaaaatcttagtagcattatataatgatcctgaacatatatgtaggtatattctaaaaatctactgaaatagaatgcaaacagtgaaacagctgtgaatataggcaaaataaattattaagtgttctttcaatgatattctggacttgactttctattgactgggctgtttgcaattattgggtggcagaggttaatgtgcagatttttgtctggtagaaatgcaaataatttctctctggtggatgagataacccacatattattattcattattctctaaaacactaatcagttttgtatctaaaacctacaattctatcctaacatgtttattaatatactcctagcttctcaaatgctctttgatatggtttggctctgtccccacccaaatgtcatcttgaattgtagctcccataattcccatgtgtcatgggagggacccggtgggaggtattgaatcatgggggtgagtctttcccatgctgttcttgtgatagtgaataagtcttatgagacctgatgctttcataaaggggagatcccctgcacgcgttctctggcctgccaccatgtaagatgtgcctttgctcttccttcctcttccactatgactgtgatgcttccccagccatgtgaaactgtgagtccattaaacctctttttctttataaattacccagtcttgggtatgtctttacccgcagcatgagagaagactaatacactctttgaattggcgtgaacatcttaccagtttcttgactaaataatgagttgaacaaaacataacatgtgttcattaaagaaaaaaaaggcatagatagaatgttgatacataaaattagagacgagtgtttttctaaaaaaacttatatggcaggcacatttatagagaatgctcacatgttatgcaaaaaacaagtctcaataaatccccacttgtttacaaatttctcagtctgatgattggcatataagaagcctaataaatgcttgttgctgttattatttgaaaactatggttctaaacaggtatattcaccaaaagaaaattgtctgctctgttgaaattttttgtccctaaatatatattttttaaattcagtgttaaatatagttgtgctttattgtcacttgcctttcaaatcagagataataataacaagaacctgtaggaaattctcttactgctttccatatctttaaaatttttttatactagtctggactgagctgtgtccccccgaattcatatgttgaagccttaacctccaatgtgactatattcagagataggacctgaaaggttaaataggtcatggtggggggctctaattcaataggactgctgtccatagaagaggaggaagagacagcagagataaggctctccatgcgcacatagaggaaaggccagcaagaaggcaacctatcacaagccaaaaaggtctcagcagatgccaaccaaccctgccagcaccctgatcttggacttctagaactgcgaaatttcacagaactgcaaggaaataaatttctcttgattaaaccatcaagtctttggtattttgatcctataatgatcaaagacatttgaaagtgtctttgaaaggaaatacaataaaaggaaagatcaaaaatatatgtactagtaagaatacagggaaggcaagagcaactgaacatgaaggaaaaaaaaaaccctgcttttatacaaatgcctaaagtgaaatcactggatcttgttgtttccatcttagtgaattataagagataacaggaaacaggagaaaaagagaaaagtataaagatgcatttatgggtcagtaagccttttctacaatatctcaaaaatagggggtttaaaataacagtaccagtattaatatactactacagtatttagcctcttgaaatttagctgaatccttcaatttattccctgtagaatcattctctctccttctccttccccttcttctccttcttttccttctccttttcattcctttcttctttctcctcctcctcgtcctcctccttcttcttcctaacactgtctctctgaaagcagatgatacatttaaaatgtggaaatttgataaatggagtatttatccatgtgcatgcaaaatgtagagcctttgcagtacctccacacaagtaataaagaactttaattggtaccaagtgttgatggagggaagagagtcattttatcagagtcacagacagaaggtagatgtcccatcaagggttcaaagagacgtaagcatccttgcaatgatgtagtaaatacctcactttcattcacatctcattctcttctctccattagaaaaaatcaaggtaaaactcaagggcaaagcatccctctgacataatccatttgtgtcatctttttggggtggagggcaaggtagaaaatgatggaaaactgacttagagaggcaacagaagaaatcaaaatgtatacctagaaacctatcatgaagtatattcatcaaaatgttagtagatatatttgaaggggtagcaggatatgtggatttttcccaaaattcatgttatagtgtgatcaaaatgtgctataataagcatcttactcttacaaaaagagaagttataaatttaaattatatgtttataatttaatatataattaatatataaattatatattaaaattatataaatataaattatatattttagttttcccaataaaattgaaacaactgaaaagtcagaattcttatatcagtcattattaccgtaatattaattaattcagtgagttaacttatgagtttataaaaacatttatgaaatggctatataaaatattatcattgaggaatcaatttttttaattttaatttttattatgggtacacaatagttatacatatttatggggagatgtgatgttttggtacaggcatacaatgtgtaatgattaaattaggataattggaatatccatcacctcaagcctttatcatttctttgcattaggaacatttcaattccactcacatatttcaacatatacagtaagtgttgttaactgaagtaacactattgtcctagaaatactagaccttattctatttaattgtgtttctctactcattaaaccatctcctctttatcccccactttgtactacccttcccagcctctggtaatgaccaaatttcataatttgacactatgtttttctatgcatttatctttagatattatcttttgtgaatataaatatgactgtaattgttgttagacatagctaacaaattcctggggcaattttttttctttgtctgaggccaccaaatgagtcatccatttacataccgataaaacttcagattttatttttcataattttcttacatttataatgagttagaccaacaaggatggcacttttgggataacagatgcccctattccattttatcatgtgatctttaataattgcattgttctcccagtaaacaaaataatctcccaaaacgtgtacatctatttttttttctcagcaccccagaaccataagtctggaatcacttgcagttattttagctcaattattgagccttagtatggggatcacttatgatgacattaacaaatgccagtgctcaggagctgtctgcattatgaatccagaagcaatgtaagatttctgacttttatactttacatatatagtttaatgtaattttaatgtatttagttgaagaaagtttaagttgttaaataataatggcgatcagctgtgactgaggactccaggaccaaaatgtgtattccaatgcccacgatgcatatttatctcaatatcacttgtaatcaaatgtcacactggctttctcacatgtgatctaacactacatttatcaatatgtttacttgtataattttacaatttgatgcataatttgataagccaaatgcaagcttgagatcactacacaaaaagtatttattagtatgaacttgtctgcatgagtctccttcaacttgccttggttcagcctgaagtctcagcatctgttgatttcagagatgctgccattcagctttttctttgtcatgagagaaagtcgtttgcagtattctaatcaggcctcaacgatctagtgaattttttttgctgatatcaacattattcttatagtacattatgaatgtttgtagaaatacgatcaaatagccaggggatttaaggaaaccaggcagtaactggagccagccttttatctttctgatggatattcttggaggcattctttgtttctcagatgtgttagagaatcaagcctcattgcctgcagcaggaaacatctcactgtctccattcccgcactgctgctccctaaaatatttgtgcttaagttcttgtctcaggctctgatttttggggtggcagggatgggggacctgtcctaaaatagttaccccagagtggctttagaaaacaaacctttatgaaaggattgtgggcctacatcaatacatgatctgatagcaacaagggcacctctggcaaaagataatgtgaaaagtgcactgcagcaggtccaggctgtggtgcaagacggcttgtctttggttcttgtgattatttaaatacaatgttactaaggatattcctggtagattacatacatgtggaatctctggcaagtatcagtaggagatttgcagcgcagacctgtagttctgctatagcttccaatgggctattgggctcttgcagccttgagcatgcatctaggaaatagtaagttgctatgttattgaagtttactgttttcatcataaaagaggtgttttagagccacaaaaatatatgtataagatcaagtgagcatatcaatctatctgatgaccaaaatggtaaatctgggagcaagctagagaaggtccagagagtacaagtaaataagggaatagggatcccagatcttcatgtcacctacatctattgcaccaatatttctcagtcaccatacactaatatccttgtagggattttctaaaactggttgatggagaaaaacaaacctcagtccaattttaatatgttagttgaagtattttttaaaagtcagtttcatatagagtcctattagatttagacctaaagactgtggggatggtaaatgtccccatgccccatgcacatatttgtaaacaatatatcgggttttccaccttgtatgagagaagtgccagagattggaatctacacagattcctatgctgtggcaaatagcttggatacttggtgaacgatctagatgctataaaactggacatttaaagacaagaaagtgtagggaagaagtatgtggatttatttagaatgggcacaacacattcagatgtttattttcaagttccaccagaacagcgtttacttcaaaagaagcactcaaggaccaggtctttgacatctatgaatgtcaaccagcctttttcctaggacactctaaaaaaaagtcttaaaatgaaatgtacgcactccttctctaggagcaaacttcagccactttagtgaaacaccagattcctgaccaactagggaaaattctgtaagatattctgtacattttcctgtgggccccgcagaaagaagtcattattgccatctcaataatacatgctgatatcgacctttcctccccctctctttcttcatccttacacccttattcctgcttcctagaatcaccacccacataaaattcctacaatcaagttcatgctttagagtattttctcctggccaatctaaacaaagacagatgacatttatatagtttgtattaataatgttgagcattattcattaaacttttatttatctcaaccacaatatagctgtttacaatgttgattataatgattacaatagttgtaatggtaaagaaaagataggaaggataagaaaatcacaaatataagaagttctttgggccctccacatcctcttggataatgtcaaagtattctctgttcaattttgaaacaggtaattttgttaggttgcctgataagttattcccatcatggttgggacctgttccttagttttgttttttatttttcctttggaaataggtttcttattgtttttctaattgcaccatgtttatgagactatgaaatttgcaattgtttgtgacaagtatatagaaacggtattgattaatttttattgagcttgtatcctgcagctttgctacactaacatattctattctggaacttctaatttagtctcatgagaattgtattcacatgtaattatatattataaatacatcttcctttttgatctttatatttttaaaacatctatatcttgccttatcgcagtgcttagggcctcgagtactatttaaaacaaaagtttgatgtgtggctgtctttgtttcactctgatttatgagcaagacttgtaacttttcaccaataaatacattaactgaaggttttacagagagacttttaatcagattgagaaagctttgtaaccctcatttatcagagttttcattatgaatatattttatcaaatattgagatgctcatgtgtttcttctactttattctgttgatacattgaaatacattttattcatttttaattgtttaaataatcttgcttttctgggataaactgcatcaaggaatgaggaattatccttttaatgtattaatcctttttgtagctggattttttcccctaatattggcaaagtatatttgcctgtatattaatgagtgatacagatctttagtagtaattctcttgcaattcctttgactggttttagtatcacagttacacgggcttcatataactttctaaaagagattttgtactattgatactatttctttctaaattgtttgatagcatttatcagtgaagctgtccggaactggataactctttttggaaaggtgtttaattggtcatttttgagatatttagattttggttatttttccttttctaataaatattttgtttcctcaaaattgattaatttttcataaaatcttttatagctttcatttattttcccctaaaagtcaatgggataatttgtgatatgccctcttttatctctggtactgatcatttgagtttctttttataatcactctaacttagattttatcaaattaattaatttttttaaagaatcatattttaattacattgactctttcccatggcctatctactttgttttcctttatttctacttagtttgtggtaagtttattcatcttttttctagatttttaatgtaaaaattcaaataacctcccttctttttgtgtaaaccctttaaagctgtgcatttctctctaatcacaagttcctagaacttgaccttcaattacacaccacacgtttttgatactttgtgtttcatttccagttagttgaaatattttcaattttttgtgatttcttctttgtctagctattttagatgtaggttagttgattttcaaatatttgtggatttcctaagtatctttttgttatctgatttaatatctgctgtggtccaaaaatatactttctagatgtctatcttttgaatttcatgagacttatttaataattgtgtttagttttgtctttctttgtttttcattttttcaaattgattccttccatcatgtacaacagaaagtgagagaatgtgttgaggtgttatttttctgtttttagttagtaattaagatgcctgtagtaattccttcaaaattatatttaaatataggttatattaatattcttcctagcgaatcgtactttttttaaaatacaaaatattagacacatgttttgatgttttgattatggattaaggaaaaagatgctccattcttttattttgtgttgtattgttactagaacatttcattcttttgcaaatactttgtaattttgtggtgagaaaatgaatggttgaaatgtggttgataaagaaatatcttgattgagatctatattgggattaagtctgtatttagattttgctgcaagttacagaaaacacaaaggaataatggctacaatcaaagaaaagtttattttgagaaattaccattcttttaattgtgtgatgtttcacagtataatttcacactgtatttctacacagtggcttccattcccaaaataatctcatatccctaatggaagttttaattacaacaattaaccaaatttaaagtgaccaattggataaaggagcttacaaaaacatgtctatctcattacctcctagaacttgaacttatggctcatcttaggtcaattatttgacttctatatatgttcactcatttattaaaaactgagaaatttagacattgtacaatgaagtcatgcattcaactaacaaccagaggctccattataaaaaaaaagtgagagaatagagaatgaaagcatccagcaaatctccatgaagattcaagctgcaaaaaagtactctaatcggatgcaattatgcttgatattttactttcttttctttttttttttttttaccgttctctctcccctctttctttttttttattatacttttaagttctagggtacatgtgcacaacgtgcggtttgttacatatgtatacatgcaccatttcggtgtgctgcacccattaactggtcatttacattaggtatatctcctaatgctatccctcccgtatttgactttctaatgacaatgttaatttcattaccagaaagtgtatactctataaaccagttcacacatggtaaatgtatcttgcattgcctggttctcagtaatattaaatttctatcagtttttttctatatggttccttgtatttagatagtaatcatttgaattcttggcaatttataataaattcattatttaaggttgatggaactgaaggggatgttcagccaggatgcaaccacacaaaaagtcataccaacactgttagttttttcaaaaattctaaatttattcgaggtcttcgagtgaataacattttcttgtgataatccaaatgactagagtttgataccatcaagtttattaccttaaaactcatcacattcctattaacaatgtcttccatcaaaatataggccatcgtgattataatctttttaaacattgttaatactacttagaataatcaaaattgtaacaaaattaaactttattatttatagtaagtggtttcaatagtgcactcctttaaaagaactagcagaagatagttaatgaatgattaaattagtaacattccagttgttggtaaatattctgaagtaaaacaaatgtcagtaaggggaataaagggtagtaaggaagcggtatttttaaagtgtgcttggaaatatccgtttgcataaattttgtatagacatgtgaaatgaatgaaagggaaccatgcatgcatactaaggaatagttttccaggcagaggaaatagtagaatatttgatggaggggacagtaagaggtccacctatttgagcagagtgagttgaggttgatgaggagaatgacctcggaggagttggtgaatacatcgcactgattttgctctgaatgattgagtaactataggtgaatttaaacatggaagtaatatgaaattgccacttttttaggaaacataattgattgagttttgaggaaaaaaatgcaaagggcaagaatcaaagcatatgatgagctagtaggctattgcattaatctgtagtgaaagaccataaagtctgtaagtggttgttgtggagaacacatattgaatatatagaaagtagacagatttgacaaaatttcatggcagataaggggtttgtgagaaatataagataacctcaaggtttctgtcctgagcaactaggcagttggaatttccctgtagtgaatttgaaaatattaggagtacaaactatggataggcacagtttttagtactttacatgtataatactctcacaactttatgagataaataaaacatttatcttcatattgcaaggaggaaactaaactgcatataattttaaaatcttttacaaggacaaacaacctgtaaatggcaaaaccaagactttaactcatttgttttgattggccacagagtccacattctgaaacactgtgttatactttgtgaggggtgtttttggggagaagaatcaagagtgttgggaatttatatttaaggtgccaataaaatacacttaagaagaaacactgaataaagcattagactctggacttcagttcaggtgataacgccagagaaacaaatatcggagctattgggcatagacgctatttgcaactatagacatggataaaataacctatgaataaatatagatttcttaaaaaaagaaaagcctgggctgggcgcgttggctcacgcctgtaatcccaacactttgggaggcctaggtgggcgaatcacgaggtcaggagttctagaccagcctggccaacatggtgaaaccccatctctactaaaaaaaatacaaaaattagtaggtcgtggtggcgtgtccctctaatcccagttacttgggaggctgaggcagaagaattgcttgaaccgggagatggacattgcagtgagcagagatcatgccattgcactccagcctgggtgacagagtgagactccgtctcaaaaaaaaaaaaaaagaaaaaagaaaaaaaagaaaagcctgttttctttattaatacaggggtgtcccagcacttagaagttataaaaagaaagagcacaaatgaaacagcatggggcactttggaaaataggagcttaaacaagagagagcagtgtcatgaataagtgtcataggagagccaataaaactttatggattagtaatttacttccactaaaatatttacattcttgcacagttgacttcccatgcacagagattgaaagcattgacactcacagacttgggaatttggtctgttgtggaatgctgttgtataggtttattctaagggtaggtagtttatggaaacccttacattaaaatttgacgtttgatgtgtctttagtcatttcagtggtgtgaagatctttagtaactgcagcttcgaagactttgcacattttatttcaaagcagaagtcccagtgtcttcacaatcagcctcgcttagatccttttttcaaacagcaagcagtgtgtggtaatgcaaagctggaagcaggagaggagtgtgactgtgggactgaacaggttggtactaattcggaagactacgcactgaaattgcagcaaaaattacttattaattcgagtgagaaactgccattttccttaattcatcaagctaaattttctgcaaatgattcaggagggcatgtaggtattataacaactaatgagtgcacttatatatattggtgtagtgcttcagtgctttgtggatctacgtggatttgtatgaatatacaggtaattttcctttatttattctagctttcttgaggtatagctgacaattttaaattgtatatatttaagttatacaacttgatgattgagtatatgagtacattttgaaatatttactaaaatctagataactaacatacctgtaatctcaccatagcattttattttttccttttcttttgcttttcaaaaattttcctttctgacaagaacactaagaatctaccttcttagcaaagttcaagtatatgatacaatattgttaactgtagtcatgtttgatctctagaacgtattcatcttgcagaactgaaattttataccccttgaccatcatctccctattttcccctccctgaagtccctggtaagcaccattctaatctctcatataagcaattttcaaggccactaatttcatagctgagttgatgtaggttcaatcttttcctcttgagtatatacttccctagtttttaagcctaaaatttaaaactagtatttaacctaaattcctttgttgttcagaaagagagatattttaaagctttcactatggagccagaaaacctagggagtacatttgtggtttttgaatattttaatccaggtggatatttaagtcaaaaagatttgtaacatacataattaagaagagctagttttctcaaaccacagaaatcttagataaagcacctgggttgaagggaggtgaggagagcagagataaagggaatgaaataagggaaaggagatattgaaactcatagtgaatggtacaggctcaaaaggatcacaaagactaagtagacttcattgtgccctacaatggtcactcatgtagccttccaaccttaaaagtatgtttatagatcctgagatatgtgatatgtttttaaaaaattgttcctcgtcacccacttgtttttgcttggttgggtttgaatggaaacatcttgaaaatttcttcttcaatttgacaatcatgtatctaagctctcgaaatgttatgtaattgaggcttaaaccactgagatataactttcccctctagaattacagtagatagcaatgacagtgacaattcttagaatagctgtgaaaaatactgacaactctgtgcttccaagtatcttgctataactcatatgaagactactaaactcatgatttatctttttgtgatttatcaaatttctttttccaatttaccctattttaaatttctgggtatttaaaaaatgtgagtgtgtgtgtgtgtgtgtgtgtgtgtgtgtgtgaatgcattgtcttttagccttcttatctattgcttttactaactttagtaatagaagttttaaaagcatattcactgggcatagatgaactaaagcataaaacaaggcataataagatatgagtgaatgatataaaggtgacaacttcagcattctcagaaataatatcattttccagaccttaattagggagttaaaaatgaaataaatcaacaatataccataaaatgcagaaacttgttaaaatattatattcagaagactctaataagaagtagtcactgcaatataatttttaaattataacttctgtttattttacgtcttgtatttaactatctctgtctacaagagccagagctcttctcagtgacttggctatggtggaccccagggcttcagagaatccttttatcagtgtaaccaaacctattatagcaatatgagcaacacatggtctggcaattagtaggtaattaataaatgtctgttaagtaaatgaataagtggttttatttttctgtttgccaacatgtaagttaagcacctatgtgtatgttatataatatgttgtctttatgaacatgcctgtccaatatgaatacaagttggaaaatacttcagagcatttgatttgccttacaggattgtgcccttattggagaaacatgctgtgatattgccacatgtagatttaaagccggttcaaactgtgctgaaggaccatgctgcgaaaactgtctagtaagagctttttgaaaaatttcaatattacctacataagtagttatcattattatgcttatgtattctcattctgcttaattcaatatcatttacctcatcccatcagtttatgtcaaaagaaagaatgtgtaggccttcctttgaagaatgcgacctccctgaatattgcaatggatcatctgcatcatgcccagaaaaccactatgttcagactgggcatccgtgtggactgaatcaatggatctgtatagatggagtttgtatgagtggggataaacaatgtacagacacatttggcaaaggtatttattatcatttgatttctcatatatgcgtttttttctggaaactgaacagaaatagatgctgatacatgattgtgatttttaaaatgtcacatttagtttaaatattctaaagaattatagaaagagaagaatacggccaggcgcggtggctcacgcatgtaatcccagcactttgggaggccgaggcgggcagatcacccaagatcaggtgtttgagaccagcctggccaacatgacaaaaacctgtctctactaaaaatacaaaaattagccgcaagtggtggcacatgcctgtaatcccagctactcaggaggctgaggttccagtgagctgagatcacgccactgcactccagcctgggagaaagagtgagactccacctcaaaagaaaaaaaaaaaaaagagaatactgtcagaaaaaatatcagtagctagaaattaaaaattaatttaattaaaagtgaaatcattacattattaattactttcatcaaaataatagagggaaagattcaaagtctatgggacttctgagttcaagaaggaagaaagtagagagaacacaaactatatttttacttcatatccatcccttgttttggtaaatatggaataagtaatatgactatagacattaaagtaattataagttgtcatataaatacagttcaaaccacatttaatgcaggcacacacattcaggtgcataaaatcacctgtggaaacaataaggaaatttcatgaaaatccagggactctgaagttattgagggatgatgtgcactgacgttaaaaacaaaaaagaaaaccatggtgcaaactatatacaaaattgtttgctaaataatatggaaacagcaacaatgccaacagtatttcatccccatatcgaaaaaatcaggaacaattgacagaggaaacatttaggatgttcatagaaacagataggtggtcacctttattctcaactggaacaagttgcaagtctaactctaatttctgtgtaaaaagggattgcaaagcacttatcactaaccaaaatgaacataaaattaggaatgactgttggtttgaagaaaaacaaaacaaagatgcaaagaaagaaacttacaaaatgaaaaagtgttgtcctgggaaaatgggtaatttggtaccacaatgtggatgattttcagattaaagaaggaaaatagagacagaaagagacagaaaggcagaaagaaagaagagggagcaaaagacaaactttttaattactgatttaatttcctcaatcgttggtgtattccgattttctacttttttcataatttaatattcgtaagttggatgtgtccaggaatttatctattttttctgttatcaaatttgttggcatatagttgttctatttatatatgtctcttatattcttcatatcataaggtatcattgtagtatcagtggtaatgttttctgtttcatttcagattttatttatttgagtcttctctttcaattatatggacccagagtgcttcctaaggagcactctacatcagtattatttagtggccaccaatagtctttccaatttcctttaatgccttggctatatgttttctaccctatgccaaaagtatctctgtgagaagacagattcaaacttcaagcagtttataagacagccttagctttcacttcctgcttgttcaggacctaaacatcatagagtaaggagtgactagaaaactctctgttctcagaactattctaggtatgtgtgcagctatttatttatttatttatttatttatttatttattttttggagccggagtcttgctctgtcgctcaggcttgagtgcagtggtgtgatcttggcttactgcaaccttcacctcccgtgttccagtgattctcctgcctcagcctcctagcctcctgagtagctgtgattagatgcacacaccaccacacccggctaatttttgtattttttaatagagatagggttttgccatgttggccaggctggtctcgaactcctgaccacaggtgatctgcctgcctgggcctcccgaagtgctgggattactcgcttgagccactgcgcctggcctgtgtgcagcattttagatccagttacattgttaccaagcaatgagttcacttccggatgtgcatagaggccaacactaatagcaccagcttccaagaaaagagaaagctttattgtgaggtccaccagcaaggagacaaaaggcaatgctcaaatctgtttccttaagctggcgtctgggggcaggttatataggcagatggtaactatgagagagatgagaaaggctctgatttggtcatgcaaagaggcggtgccaggtcctcagcttttaagtttttactgcaataaaacaggactcccctcccttcttttttgaggggaagagggcggtgagggtcttgcccaaactgtagtacagtgatgcaatcacagctcactgcagcctccaactcccaaggtcaagtgatctttttgcctcagcctcccaagtagcagggactacagatgcatgtcaccatgcccactattttttctttttctttttttgtagaggtgaggtcttgctgtgttgcccaagttggtctcaaacttctggtctcaagtaatcctcctgccttggcatcccaaagtgctggaattatagaagtgagccactgcatctgaccctttgcttcttaatttgttccatgctcctagatttgaatatttcaaactgagtacttcagttccagcctgctcaggttcagactatttgattggcaacctgggggtcgatggcaactgaaaaacagctaatcattttgtgactgataaatctgacccagagtgaacaataggtttgagctattctgtttcacatagtcatctaactctccaggaattcctttaaaatttccagtgagctcttgtttgcctcaactgaaatcacagccttaggcactggtgatgttggtagcagatttatattatttcagtaatgcctttgttgtcagtgaaccggttcagattctttacttcactgccgaaaagaatttgagagcaagtccaaagggaaagtaaataaagaagttcattgcaaagcaaagtacgctctgatagcaggctgcacaagaataagagcgtcggttggcattgaggaaactccctttattggagcctaacatgattattcataaaagggtgggagtgggcattgttgtttagcatgttgtaggtggtctcctgaatgcacatgtgctattgctgtacatgccagtacatgcatcacatttctcattagcattttaattctccacccaagggtgccttttttactattataatgaacatagatcactccaaggacacaaatcatgggtttctgcacttgaaccaatttgggtgttttcccttatgtttctttacctccttgctgcaggatgttctaaccagtatcccaggatgcagtttttgcactgttgggaggtttattctcgccatctattttgcaagtttgttctcatttaagggatgctatgaccaacctatctaatttacctcactctgaaagccaagattttttttattcattttttttttcacttaactgagctctaaatcaaatcaagtagccctagccacctggtaacagagatttttccagggaatggaaagtttagataaaatatttagataaattattggctgcctgtgggcatagcgctttcacagagctccaacggagatgtgacctcttcattagctgtaagcctgctggctttcatctgtcatgagacactgagaacaaatgagaatatgcccaagttaaaacatcaccgacccctttgtttatcaattctatcaaccagaactacaccagagaaacaaaatccattggatatgtaattctgcactctctcttcctctctgtagatagatagatataggtatatagatattttattgtatataaaattttgtgtatatatctatgcaaataattggctgatcagattgtggggctggctaggcaagcctgaaatctgtagggcaagacaattaaaagggcagaatagaaattttaagcataaattgaagtccacaggcagaatttttttctttttcagggaagcctgctgtaaaggtctttcaactattaataattgaatcaggcccatccacattatctaggataatatttcttaagtaaaataaacttattgtagacttcattacacctacaaaatacctacagagcaatgcctagattagtgtttaattgaataacttgagactatagcctaaccaagttgacacataaaatgtatcatcacaccgtctttcagtagtttctcttggatgcctaaaattcattttgatctgtagattgcggctttctttgttttggcctattttttgtctaccagcaatggcttgctaccatagccaaggttaaaattttgacttcttacccataaccagccttgcaaatgacctctgggacaaaatgaacttttacttttcagttcactacatcatctgtgggtcgcagctgagatctgagtctgtccactctgttattgagcattcatgctgcagcaacattatgtagtggttaagtctccctgtcaaagatttttgaccgagtccatcaagtagagcagttggaggttatgagaaataaactgctttttaagtaggttgaaacttttttttctttttcctttgagacgcagtctcgctctgtcgcccaggctggagtgcaatggcgcgatctcggctcactgcaggctctgcctccagggttcacgccattctcctgcctcagcctcccaagtagctgggactacgggcgcctgccaccatgcccggctaattttcttttgtagttttagtagagacggggtttcactgtgttagacaggctggtctcgatctccttaactcgtgatccgcccgcctcggcctcccaaagtcctggggttacaggcatgaaccaccgcgcccggccatgtaggttggatcttatgagaattaaaattatacagattatgcatgtggattggatgatgggagggtgaatgaatcaattgtgactccaatatatttcttgtctaaggaaattatgatgtaaaacaagataattggttagttgtttgacttgaaaaggcattcatgctaaaactgtttatttgacaaataagtcaattatgtgaaaaaagtttcctacgtactaatagatatgcatttatagacttactatgattagaggttaaacaatacagtggctaactctggagtatgtctaggatatgtctttgaatagtagaccagagtcctttcaatttttaaacatttcattgaagtagttttgtgtgatcttaaatctagtttttattttgaatgttatagtatgatcttattttgtacaatgaatatcttaaaccctttcagaattttaagtctatttgttatttatttttaattaatataagtttaatatgactaacctcacctttttattttcagaagtagagtttggcccttcagaatgttattctcaccttaattcaaagactgatgtatctggaaactgtggtataagtgattcaggatacacacagtgtgaagctgagtatgttttcagaaatctgtcttagaacttctatttatcaccttatatttgaaaataacatcaaacaattaagtttatgtaagcaaaatatcccctgaacataaagtaagaccatgtttattcaaattataaatatcatagacacatttctcctctcctataaccaaattatcccttgtacttttccacaaagtgtttagttttcatacaggtacattaattacccatcagtaatcatttttattgtgcatgctattactttaattttttttttttttttttttttttttttgagatggagtctcactctgttgcctaggctggaatgcagtggtgctattactttaatttttacaaagcatgacaatcctcatagtaaagaagttaaaatacacgaatttttactgcttaaggagcaaaatgtgtttttttttttatttttttattttatttttttgaaggagtctcactctctcccccaggctggagtgccgtggcactatctcggctcactgcaagttccgcctcccgggttcacgccattctcctgcctcagcctcccgagtagctgcgactgcaggcgcctgccaccatgcccgtctaattttttgtgttttcagtagagacggggtttcaccgtgttagccaggatggtcttgatctcctgacctcgtgatccacctgcctcggcctcccaaaatgctgggattataggcgtgagccaccgcgcctggccaaagcgtggtatttaagaacatgtgctctacagccagacattttgattttaaatcctaatcccactctttacctatttgtgtgacctcaggcacgtatttcagttttttttaatatgtaatatatgaatattaataacgcatcaccagtttggtgccagtgggaaacatagacgctgtatgaaaaacacttagaatggtgactgatacatagtatgtactatatgagtgctaactattatctgttactattattttgtaaattagaactagaagacccggcggggtagctcatacctgtaatcccagcactttgggaggctgaggcgggcagatcacctgaggttaggagttagagaccagcctggccaacctggtgaatccccttctctactaaaaattcaaaaattagccaggcatgatggcggttgcctgtaatcccagctactcgagaggctgaggcaggagaatcgcttgaacctgggaggcagaggttgcagtgagccgagatcgcgccactgcagtccagcctgggcgacagagcgagactccacctcaaaaataaaaaataaataaataaattagaactagaatgttactgatacccattcctttgctgtaaaattttatgttgatattatttcaaaagtaaagtaaaacttctgtaataaactttatagttttcgtgaatagtgcaaggaattcccatataccctttgcctaggtttacaggttgtttacatttttcctgttgctttacccttctgttgttccaactcttctctcctctcctctcttcataattatttttctgaaaggtttgagtgtaagttgaaaactgtgcttgtttattcctcaatatatccatgtgtttatcttgaaaataaagatattttcttacataacttattgtagctatcaaacatagttcatattgaaatttcattcattgttttgagtaattttaggctattttccttgttcaggaacaaacccagtgtcagatatttacatttactcctaatgtatttttagagttctttaatttggaacatttttgtttttatttgtgtttctttttattagttttttttaatactatcggttaactaatttgtagaattttcccacaatttaggtttctttgaaatttttcataattatgtgtaagtgatacattttggcatgtttatcactgaagtgatgttgttgtaccctggatttttttaaaggtacatgccattttctttcagtattggacattttaggttaaatgttttgataaagtcattattctctaaatctttcaactgtgaaattactattttccttttgggtttaatatgtaattttggaggagttatattgagaccctgggcatattctgtttctcctcaaactttaactaactagttttaaaatccattagtgattttctaactgtattattgactttgcctttattatctagaaatgtactgtaggaagaagtagtcacttctatatttttatttacttatctatatatatatcagtttagacacaataattgttattttatttaataggataaaatacattactatcattattttgatactttctcaaattctcttaattttgactattgggaatccctttgagctggttaatgtgtccttttcaaaagtctgtaggactttttaataacttccaaatttttctagcacaagaaaagatgttgtaggttgcattgagcttcttctacttctgctctggattcagctattcatccaaggagccttggttccttttcttagaagatggtatttgaaaataaatacctaagcaccagctgtgtgcatgtctactatttcttttttttttaaattttttttatttttactgactttttattttttaatgtttttatttggaaacaatttcagacatataaaagttagaataatagtgcaaataattcctgtatacccttcaaattttccaaattttagcattttaacacatttggcttatcattttctatctctttgtctctgtctctgtctctctctttcattacatataatatacacacaaatatacaaatacacacattataaacacatacagttttgtaactatatgtatatattgctttataattgcttttctgaaatatttgagagtaaatttcagatatggtggccctttatttctttttttttcttctcattacctctcaagcctgtcagtcaatggagctagaacatgcatttcatatatgcacatacatgtatcacatattcattcatgtaaatctctgaatttaagacatgaacttagtgataattctaattccaattaagtgccataaagtacattttagtatacaagttgcttcctcatatactcaagttccaaatgcacagaaatttgctttataattgctaaagcatatacttactgaaagaaaattctagctattatgactatattttccttttcatcattgatcctttttatataagctgcattaaagggcttctctgctgaatgaaatgtctgtgtagtattggtgttggtatctagtaatttatttgccctctatgttatattttactttttctatgtgtgtttagcatatttcttaactttgtatcatataatatgactaatacataatggaaattgcattcacttttgcttttctgaaggctagaattttgtaatggaaaggatttaacatagctggactcaaactataaagcaaacctgtctctgagcaggagctgaaaacattgttcatttcgttatgcctctgggagatgctttttatgtgctccctggattcttcaccacacaagcttaattagttcagtagtcatccaggtttcaggctgaatataaacctgaaatttatattcagatttcagttctcagtctaagtttccagtcaactaactgacattagacccgtattttaataatgtcctgggattattcaagctaagaatcttcaaccttggatgtgctttcataaattattaaacaaagccacatctacagaatatctggtgctgcagttcccattcttaaagctcagttatatagtcctttcctttctggttacattccggtgtcttcaaagtgtgagcatgtgtgtttcagattacagttctaccttactacaatgccttccagccaaagaccaccaagaaggcagccgtagttgagcaagttgggtttttttacatgttgagtggtgagaaatcgcatcatgagaaattgtggagtatgccagttctagagatttggacttgggttaggtgattttaggaaggtttcaggaaatagacctttgctgtaaattagatgttttaaagtagagatattaataattgtatgattgtatatcttaatcttatatatgaagagggaagactaaagtgaagctaaagttgtaattgctaaagaagcaatagtcacacatattagttgaatcctgggaatgtccagtaactgtggcttggacaatgtttgtttctcctctgtgttcagacatgatctatgaagtgagcttgcttattttcttaatctttcatgatcacagaatggctttgcctaaggttgatgttctatgaaattacttaatgtttaaccggtgtgtgcactatgagtgcagaacagcttttatcaactccaagtccttcctcgatgactcctggccacttcaggggctgggttgcccattttcgttgtcttcttttggccaaagggagaaaagttcaggccatagaaaattgcttgaagacatttagattttcatcactgctgagattttgctgattaggaggctatttagataacatatgttgtctatctcaacatatgcagttgatctagggttagtctctctgcctccatggtttcctgaatcttctgatgtagcaatggtcatgtggtagcatttaagattccaaacaggatgcaagggccaaataaaaatcttatggtttgtagcatgtactgtaggcaaatgctcacattaatctgtaggacatactacctatgtgatatatatagtgataaccctgtagtattaattaatggttatttttgttaattaatatgagtgaccttgaaatcttcatttttaaaatcactgaaaaggtgaacagatgttaaattcatttgagcttgggtttgattttgtttcagattcaaaggaaagtgaaggaatcacaaaaaaagttgtcaggctaactagggaatattaggttggtgcaaaagtgattgcggcttttgccattaaaaaagtggcaaaaaccactattagttttgcaccaaccttagttcataattaattactaaaatgttcagttattattggcaatttaggcaaggctctttttttggtgttttaaaacgaattgcatgtattagcttgcaaaccttgaatactttatttaaatctatctattttaaaaattatattcttgtacttctctaaattaaaattaataatttttatttgtggataaattatagcaatctgcagtgcggaaaattaatatgtaaatatgtaggtaaatttttattacaaattccaagagccactattatttatgccaacataagtggacatctctgcattgctgtggaatttgccagtgatcatgcagacagccaaaagatgtggataaaagatggaacttcttgtggttcaaataaggtaggtagtcttttattcccaaataatttcctaatattttagactttgcccttttttgagatgagtgtcactcttgccctggctagagtgcagtggtgtgatctctgctcactgcaacctctgccacccaggttcaagtgattctcctgcctcagcctcttgagtagctgggattacaggtggtaccaccacacccggctaatttttgtatttttagtagagacggagtttcacagtgttggccaggctgatctcaaactcctgacctcaggtgatccacccacctcagcctcctgaagtgctgggattacaggcgtgagccactgcacctggcctagactctgttcttaaatgatacataattagtattttttctcagaatttaagtgcatattcaatacagaaaatcaggaaaaaacaaactttaaaagaataaaatatttgcaatcatgcatatatgacattgctatgactatttcgctggttatttagtaactttttcattgaaattatgtgtattcactgaattgagaactgcgttgttcatttactgtattttattaaatatctcatatcacacagagaatacatctaatgtcataaattatcttttgatataatcattttaaaatagccattaaaataatatatgcccattttactgatgaaaataataaacaaactcacagaataaagaaaaaaatcaatccagtcgcatatctgagatgtaataacttaatttttatgaaccttccatcaatttttcatagacatgcacacacacatggagttgtagaatatttatctgtctacataactatctttcttactttgcattcaatatggtacctatgcatacatatcaacagtttttgccttcctagatttttttattatatgaaatatgaaatacacacaaacacatatatacacaaggaggtgcaagctcaaattagtctcatgtttaaattataaagcctctctggcttaataagtaacagaatacagtaagccccttattgaagaaaagagggaaaggaaaactatgctaactttactaatattcatttagaaaattagtaagtaagagtgtatacaaataaaaaaactgtcattcaaattctcacacaaaatgtaagtcatttaaaaaattgtgcaacacatttgcttttattaaatttactttgaaaatgtcttaccaaattaatgcccaagactatcttacattttaaattctccattgtttctaaatagtctaaaatacgttatgtgaggtaggaattgcacaggaaatgggaaccaccaagagtggcttaaatcgttggtagttatttttttcccataatacaaagtaattttggaggttgtccatccagagcagttattgggtgccattatgtcatcaatgatccagactcagtccagtttttagctatagatcttgtttgtgatcctcctttacatggccttcaaaagggttgattggaactctggttatatccacagttagtgaatgggatgaaggatatatgacaggcagtaccctgccacagtgttcatgacaaaagtgatgtcccatcaagtagccatctaagaacactaggacgaggatgggatgagttggaaaaataatacattttaaatcaaccatgtatttgagaaactaaaaaaccacacacaggcttaggaaagatgcatgctcagaaaggacctgggatgatcataagctttatattcaggttgaccccaacattaagataatactaaattaattagtaaagaactttcacagaatagagccattctacaaacactgggcaagttggcaggtttttaaattgccccattttcatgctatttcttgcctgaataccttgttttgtgtgtgtgtgtgtgagtgtgtgtgtgtgtgtgtgttttgttgttttataggtcctgtgaaatttatgctttaaggaggtaatggatttactattccggtggatttactattacttgcaccctctaaagctgtgggctgtgctgtaccttggacccttttagccatagctagagtggctgggatgcagggtgccaagtcctgaggcagtatagagcagggggaccctgggccctgcccaggaaaccatttttccctcctaggcctctgtgtctgtgatgggaagggctaccatgaaagtctctgatatgccttggagacattttccccactgtcttgatgactaacatttgactcctcattacttatgcaaatttctgcagcagacttaaatttttccccagaacatgggttttttttttttctattgcatcatcaggctgcaaatttttccaacttttatgctttgcttcctcttgaatgctttgctgcttagaaatttcttctgccaggtagcctaaatcatctctcaagttcagagttccacagatttctagggcaggggcaaaatgctgccactcttcttgctaaaacataacaagagtcaccttttctccagttcctaagaagttcctcatttccatctgagaccatctaagcctggacttcattgttcatatcactaagcgcattttgatcaaagccattcaacaagtctctaggaacttccaaactttcccacattttcccgtcttcttcttagccctccaaatgattccaatctctggctgttacccagttccaaaatcgcttccacattttttagtattttcacagcagcactccattcctggtaccgattttactgtattagtctgttctcatgctgttaatcaagacatgcctgaaactgggtaatttatatagaaaacaagatttaatggactcacagttccgcgtggctggggaggcctcacaatcatggcagaaggcaaaggaggaacaaaggcatgtcttacgtggaggcaggcaagagagtgtgtgcaggggaactgccctttataaaaccatgagatctcatgagacttactcactatcaggagaccagcatgggaaaaacctgccgccataattcaattacctcccaccaggtctctcccatgacactgtcgttattgtgggagctacaattacatctccaccgtaatcttttgccccaggtgtctgcaaatgttactctccctgcacctttccctagcagtctatactgcttctttccatctgagatttgagttaggcaaatcagaaaccagtccttaaggcagctaccagacaagttagagtattgccaataaaatctgtgctgcatccttcagtttgagggaagggattgagaatttagctgctgcctcattcagacaaaaatgccataaaattttctaccattttgactgtgacaatgtgttcttcagtattttactggttgctgtagacctttgactgttgccagagctcctataatgttatttcagccagattttgttttgttttctatatcaccgtttttctgatgtacctccccagactatttattgaaagtttgatataacctgcttctaattctgccactgttgtagggggtgcaaatgatcatttaaatccaaaatgcttggtcattggtggccactggaggagtgctgccttcagttttggttgcttttgtaaaatcacactgtttcacattttctgaacctaaaaatgatttttatctctggtacaactatgcctttaaaaaaagagtatgagcctggccaacatggtgaagccccgtctctactgaaaatacaaaaattaagtgggcgtggtggcacaagcctgtaatcccagttacttgagaggctgaggcacgagaattgcttgaacccaggaagcataggctgcagtgagctgagaccaagccactgcactccagcctgggcaacagagtgagaccctatctcaaaaaaaaaaagagtatgtacagattttatttcatttagcattttagttcctacataacaagaaggtttctgtaggaacctattccgcctagtgataataaaggaggctgcattatgattcttatctcaaaacaaaaataaatctgttttagagagtttggtgaagaataaaaaagaattgttttttttatgtaatattactattgctatatggttataaataatttttaatttttttagctagcttctttatttggatgctgcttttccctagcaaagcttcctgcatgatacaactgaagttaagcactctgccacaggcatgttaaagcaaaaacaaacaaacaaacaaaacccagacaaaaacaaaaacaaacaaaaaaacccacaaaaacacttcattgcagaaaaagggtaccagtaataccaacaacccttcctcaacttttgtttctctagacaattaatatatttaatggttctgaaaattaggtttacttttttctggacaatagctctgcaaattatatatctaactactgtatttaaattgtagttaggtgtgaaggaagcatgctaacagaatagatagatttataactacagcagcactaatctgtatccagtatccagagctagtactttttatactactaccacagccatccaaaataacctggccatctattcatcattagtccatttccccataaatcttaaatggaggtatgcattgccataattagccaacacaattaataatgtattttttcatactcaataatgttgggcaaaaactatgtgaacagattaactctctgactttaaaagttagtgtgttatgatcctatattataagaggaaaaatctcccaaaatattgccaatattctttagcaaacttttaaaataaaaaatatttctaattacatgttcttgggcttaccattagtcgctttgagtatttgtatgagtgcattaaacatttcttgttcttttgaaacatagcattatttgatataggttgaaagagatctctgaaaacaattactaaacctttgtctttatgcttaactttctttatctcagttgatttaactaccagcaagagaattaaacaagtcagaatccttggtgtcattcacccatctctttttactatgcatattactccaactcagctggtttcaactttctatctcaaatacatctactggtttctatcctcactaccactcaatttcattgtatgcttatcatttttgtggaccacagcaatgacattctaactttgtatctataggctattgccctttccattctcttttccaaaacctacttttatcagctttccttcttccaatatgtaaatatagcaaattgctatatttgaccaacttgctcatgaagaatataagattctacacaatcatgccaataatatcttctttcatataatatcgagttttttgtctgtttctctctcttttgttatggtatgaacaagatgagatttgtgttgttcactgatgccttcttggggccaggtacatttgtaggactcaaatatttatttaatgaatgactgaatggccacactgccctttagatttctcaaaggttcaatacggtcttccatggtagaatcattttaaatattacttctttttttataatactctgtcttttatttctatactaattaagtcctatctatcatcagggctcaatgagaaggttttaactgttctcaaatatttgacacatttcctgtattttacgcttcacaaatcaattttttcattacagcatttattacgtacttatttgtgttttactcatttcatatttgtccctgctatcccagtctaagcagggaagaagctgttattgttttgtttactcctagataatcagagtctcatctagtgctggaaacatagtagctcaatacattaactattcattgttagtatactaattcttgttgctaaatcaataccctttttattagtccatggtaatatggtatggtatggaatgcttttaattaaatggcaactctagatggcatgtcaattaacttatttttgctcatcctttttaggtttgcaggaatcaaagatgtgtgagttcttcatacttgggttatgattgtactactgacaaatgcaatgatagaggtgtaagtagcagtactatgaggtgaaaatagaaatcattgagcctaattttaggaaactgcattgctacacacacacacacgcacacacacacacacacacaccaaaacatataggaaaattggccttagctgacctacatattattttataattctacttgaacatatataaatctagttgcttatcttataaggtgatatttctccttcttttaggtatgcaataacaaaaagcactgtcactgtagtgcttcatatttacctccagattgctcagttcaatcagatctatggcctggtgggagtattgacagtggcaattttccacctgtagctataccagccagactccctggtaagtattaataataaatcagaaaataattaaaacataatttgaatttattaaattggataacaaataatattttgtctaccaatttatatctagactatgtttagacattaaactgcacatgaatgtgtatgtgttacttccacttccagagagtaatatattacaacatatgtagcatatgttataaatatgatatatcagtcagagcccaggcataaagacagaaatcactttagtctttcaaacagaaagaacaccgtgtaaggcatccggtaattgcatagatgagaagattaatcagagaaaggtgaggcaacccagaaaatgactaccactttttagggttgtagggacaataaaaagaggtggtattactagaatcagattctgggccatttagcatgatatataactatggtcagggatgtatagcaggattgaaaccacagggagagtaactgtccagcatgagctggaggtatagagaatatacagtcactgttggagattctggagaggaagggggaataatatcagagctatttttactcttcgaatcctccagatattacttagtgattcccagtgatcaaaactgactggaagacagcaggtcaaggaacttgggcagtgcggttccctgtgatattgatcaaagcagaggaaaagcctagatgaattttagagaaagccagaagttaactggcatatccaataatacttaggaccaggagattttctttgatataaaaatctaaatgtacatacaagtagagccatttttctgattttgagtcataggtagttattaattccagtatctggaaatattatatttaatgttatatagtaatagattagtaagtttaaaactttgtaattaatgtattttcaagctatttccattttactagcaacaattagcttatcttcccattggctgcaattaattgtttctattcatgcacacacatgccatttcccaatgagcagtggagaccactcctttccaggttggttttagtggtatgattgatcaataaaatgtgaagaactaacattctaggactctcgtggtcttcctacagactctagccaggtattttgcagcccttacttctctcattccctgaaatctcattctctcattcacttcttgaaaattatcagcaatatttgaaatttgattgcactcagaaacaaaaatacaaccatctaataagccctcctcaaattcataaccaacaaaattgtgagcaaaatctagtgttttaagttactaagccttgaggtaatttcttatacagcaataaataataaaaaacatttagctcccaatatgttgtgtaatagaaatataaaatgtgaccttagctttgaaattggatagtgcatggaagacagaaaggcaggaaactattgaagtcttagtacatgttgaagttggtgagcaattcaaggacagtttaaaaacacgttgcagaaagtgaaaccattattatgaagtggtaaattgtttggcatcactgctgcctttggtaatgtggaaaattgaactcatgcctactatgaaactactggaagaaaatgttaataaggcactctaggacattggtccaagcaaggattttattggtttgaaagtaaaactaattttcattctccacaagtttcttaaagtaagaaacaatgaaaggccaaatttgagattagagcaataaaattttatctcaaatcaaaattaagcaaggcctttgactgtaaacacctctgttaaaatctcagaaaaacttaagttgatatatcttagagactctttcttctatacaaaaggccttctaagtattttatgtaaatgcatcataaaaagtttcaaacagtaaggctactaagaattttaaactggtcatttcataacagcctcacaggatccaatacagagaaaggcttatgtcaaagagatttgcgagtgtggcctttgtttaatggattgtgtttttatttgatacatgagaaattcaaggaattatattagctcagactgaaagtgatcaaggtagcatgtacgttcattggtccccaatcaactataggcaagaaacaggctgataaaggtagtcagatgtgaaaaggactatttggattataaaccaaagggcataaacaaaaagtcagaaaccacacttcttaatctgtgggtttatgattttttaggtcaccaccaacaaaaataaacgacaacaaaaaactataggcatagatggtttcacaggtgaactgaaccaaattcttggaagaaagcaatattattttcagaaaacagtggtggggaagttcctgtcaactcattgtatgaggaaaacataatcctgatgccaaattcaaacaaggaactcaacaaagaagaaaatcacaaaaaaaattcttcatgaacagagatacaaaaatcctcagcaaagtatcagcccaccatatatagctatccattttaaaaagagttacaagagtcactttgggcatttatattttcaagttatctatttcatagaaaatatgttaatttttaaattattaaattgttcaaagattttattttggtagacgtagtaaaatacagaaatatctttactatatttctggtgcttgctttcaaatctttgatttttttttcttctagaaaggcgctacattgagaacatttaccattccaaaccaatgagatggccatttttcttattcattcctttctttattattttctgtgtactgattgctataatggtgaaagttaatttccaaaggaaaaaatggagaactgaggactattcaagcgatgagtatattgatttcatatttaagatttgttatttgtataatttatgaacatagtaaatagcaatgtggtcgatgtaatgagtaataattcaaattcaattattgtctttatatgggaatttaataactcatatattaataactaatggccaggggtggtggctcacgcctgtcatcccaccactttctgaggccaaggcgagtggatcacttaaagccaggagttcaagacaagcctgggcaacatgatgaaaccccatctctccaaaaatatacaaaaattagccaggcgtggtggcatgcacctatagtcccagctactcaggaggctgaggtgggaggatcacttgagcctgggaggcagaggctgcagtgagccgagattgtgccactgcactctagcctaggcaacagagtgagactgagactcaaaaaagaaaaaattatatatatatacacacacacacatgcacacacacacacacatacacatgcatatatacacatataataattgcaattttaatcttataagaatctggactttttaggggcaagattagctaaagtttagctgtccattcaagtttaaagtttatctttaaagtttatctatcttcttttattatttgatcttgttaaatatgtattttaacttaataatacttaaataactttgtaatatttctatatcttagtgaatttttatgctattttaatgaaaggtagtaggaaaacccaggaaagtaatttagcttttttttggtagtaatgtaaattgaagcacagcaattagaagtagaaaaagattaaaagttaataagtaataaaagacttaaaaatctagatgatagccacagctagtctacagaaaatataaaacaaataacttctattaaaaataaaaatatctgaatatgtgctataagaatacaagtaaacattaaaactggtttatttattttcaaggaaaatgctaccaaatgatttctccctgggagttatataactatgtccttcattttacttgaaatgaattgaatttcattaaaatacttaaaatgacaatgtaaatgaaaatggaatatattttaaaagttgatttgaaattgctgaaataatatacagcacctaaacgagtaataacttagtcattatttaaatatactaaagtggttttcttatattggataactattgtggaataactgatatcaaatatcttcagggaaaaaagcatagctagtaaaatgaatagaaattaatagggttgaaaatgaatggcaaaaagtttaaagatacttaaccaataatactatgaatataacaatgatctaagtttcttttcgggtaaacatatatcactgtgcttttttttcatattcactgatgcaaagatgttcattattagtcttgattaccagggcagagatgttctcagtgatagggtattctcaaataatgggtgaacccagttcttaggtaaaaattcagaactgtttcaagactgacagataatacagaggtttgtaaaatcatcttgaagaaagtataatattatttttatttttaatatgcaggcaacctgaaagtgagagtgaacctaaagggtagtctggacaacagagatgccatgatatcactgtgagtttctttcatttttttaaaatttattttactttaagtactgggacacaggtgcagaatgtgcaggtttgttacataggtatacatgtgccatggtggtttgctgcacctatcaacccgtcatctaggttttaagccccacatgcattaggtattggtctcaatgctcttcctccccttgcctcccaacccccgacaggttctggtgtgtgatgttcccctccctgtgtccatgtgttttcatgattcagctcccacttatgagtgagaacatgcggtgtttggttttatgttcctgtgtgtgtttgttgagaatgatggcttccagcttcatccatgtccctgcaaaggacatgagtgagttccaaatattttaaggatgggggggttggggggaggagagagaaagaacgtaatatattaaataaatatatattaagtagtgacagtcatatagctatatataataaaaataaattggagactatttttcggaattatatttttcagaatttataatagacatgatcaagttataaatgattttgaaattttccacttaaaaatttattacagtgttattttttaattattttctttagttaattttacttctttagcatttgtatatttaaaatgttggctaaaaataaattgcatgatataagtctactttgcaataaggttacttgcatgctatttgttgaactagctatcatttcaacttgttgataacggtgactttttttttcatttattcagtcttctagagtaattatctgtgatggatggacacaaaaaaatggaaagaaaagaatgtacattacctggtttcctgggattcaaacctgcatattgtgattttaatttgaccagaaaatatgatatatatgtataatttcacagataatttacttatttaaaaatgcatgataatgagttttacattacaaatttctgtttttttaaagttatcttacgctatttctgttggttagtagacactaattctgtcagtaggggcatggtataaggaaatatcataatgtaatgaggtggtactatgattaaaagccactgttacatttcaaattgcaatggtatgtgttatgttatagtgtgatggtctgaaatcaatcaaaggcaatgatcctaaaatttggaaaaatttttcaccatatgctgctgaaaaaagatacattttcaagtatataaacatttaaagtaaaggatgatattatttcagtcctacacatgctgattcctttcatgaggtcagcaaaaattagtaacaaaacatgacaaggattattcagcctgaaaaaagaaggaaatcttgttatatgcagtaacatgggtgaaatttaaggacgttatgctaagtgtaataagccaatcacaaaaaggcaaatattgcatgattccatttatatgaggtatctaaaatagtcaaactatttgactcaattatctgatttataagcatatactcacgcaagacacacagattttaagatactagaaatagatttgaagttttttaatctgatgaaagggatcaacaaaacatttatataatgaaaataattaatattgaattttctagtctttcctcctaatattgtgaagaagttaagaaaattcactattaacatttttatatatctttgtggaaatagtagtcagtaaatatggctacaaaaaagtaaaaaataaactttaaataggaatctttatacaaagaaaatcttattataatataaacacagaaaatccaagataatctatagataaaatattttaactaccaagtgaatctgaaaaatccattgggtgtaaatttaatacacaagtatcccatttacatataaaataaaaatgtaaacactagaatatttaaaagaatattatttacattagcactaaacatattaaatccttggaaataaccattctaggaaaactatgacacctatacatacaaaatgacaaattactattaaaagaaattaaagatagtgttaggccattcttgcattgctataaagaaaaacctgaggctggatttttttttttttgagacagaatttcacccttgttgcctaggctggagtgccaatggcatgatcttggctcactgcagcctctgcctcccaggttcaagtgattctcctgcgtcagcctcccgattagctgggattacaggcgcacaccactacgcccgaataatgtgtgtatgtttaatacagatggggtttcgccatgttggccaggctggtcttgaactcctgacctcaggtgatccgcccgccttggcctcccaaagtgctgggattacaggcgtgagccaccacgcccggctgaggctgggtaatttgtaagtaaatcacactacctaacttcaaaatgtgcaaacaccatggtactggcataaaagcagacatgtagaccaatggaacagaatagagagccaagaaataaatctgtgcatttacagccaactgattttcgacaaaggcaccaagaatacatatgaggaaaagtttcttcaacaaatgatgttgacaaaactggttacctatatgcagaagaatgaaattagatcctatatatcttagatatataggatctaatatatacataaattatctcaaaatgaatcaaagacttaaatataagacctgaaattgtaaaagtataggggaagaaaaacataggggaaaagctccacgacatttagtctgggtaaagactttttggaatatgacctcaaagtacagacaacaaatgcaaaaatagacaaatagaattgcaccatactaaaaagcttctgtacagcaaatgagactcaacagagtgaggtgacagcttaaagaaaaagagaaaagattggcaaactatacatctgataataagttaatattcaaaatattaacaaactcaaacaccaagaagacaaatagcctaattaaacaatggacacaataaaggaatagactttctcaaaagaatacatacaaatggccaacaggtaaattaaaaaatgctcaatatcactactcatcagaaaatgtatatcaaaaccacaa

SEQ ID NO: 16266 - DNA, 7026 bp, Human
acattcaaatgactggacacccatgcaagagccctgggccttggtattactagctcagaagtcaaagtcctggttgagagcaccagattgacccacgttaggtcatatgcttgagcccaggtgctgagggcagttgagagagtgaccctctgacccttctatttatttatttattgcctctcaccaaaacccacacaacaggggattgcaaacaggttcaaatgctggagaaccaaaagccaatacaggttggctacacaaggtcatcagcctagggcaggaagtgggcaacgggcgctggccatttggaagaaaatgtgaaatcagagagtgaacatatttaagccattaagtttgaatctcctaactgggctcctcatttcctgccctgtctctctacagtgcattctccacaacacagacagggggatctttaaaaaatataaatcagattttcagtgttctgttgaaaacttccttaacgagtcttctctttgtatctagaacaaaatccaggcttactatggtcacgggccctacataatctggtccccagctacctctccatactcctttactccttgctccacaagccctcctcacccccacccgcacctgccagtcttacagacacagggcaacttgtttcccctttgaaggttttgctctagccgttccctgtgtctgaaacactgtgtccctagatctttggatggctggtcctttcagctttcaactcaaagttctccttttcgacgagaactcccctgaccccaacccaggcagtccccttcccactctcattatacagccctgcttaggctgtctcacggaattcattatctgaagctgtactacttacttgtttgcttcattgtttatttcctccctgcccctttaacccaacttccaggaaaccaggaacttagcttttcttatcctgctgcatccccaacctctacaaccgtgcctggcacagactgagaggcactcagcgaaaacctcttgtgtggtggaatgcttgactttatagagggcccagggttcaagttggctagtggcagagagggcttacaacctagttctcctgactaatcagaggtagaactaaagactgggctccagcccctcattttttttttttttttttttttttttgagacggagtctcgctctgtcttccaggctggagtgcagtggcgcgatctcagctcactgcaagctctgcctcctgggttcacgccattctcctgcctcagcctcccgagtagctaggattacaggtgcccgccaccacgcccggctaacttttttgtatttttagtagagacagcgtttcaccgtgttagccaggatggtctcaatctcctgacctcgtgatccacccgcctcggcctcccaaagtgccgggattacaggcgtgagccaccacgcccggcccagcccttctggctagagctgcaggtcagcgtttagggagagtttaaaggatctctacaggaacttataatgacaataatgaaaagaacaatagctgatacctactgaacacgctctatgtgccaggcactgttctacgtatttaatctgagtttcatttacgcttcacgaccacactgcgcggtagatactatcattacccttactttatggataaggaaactgagtcactgagttgttaggttacctgcccagcatacagctgaatataaatcgtacgctgctatcaaaactttcttttgctctcactccgtcacactggctggggtgagacgatttctcgcatgtgacgacccaggacagccccagcgcctccgggtcacaggcccccggacgtcccagggcgcgggcgctaggcgggcggggaggggggagggcgcaggccgggattggtggaagagaagagattggtggaagacaatggaagtctagtagcggaagtcccgcccagcctaggccgaacttccggctctcactgctaggggcttaagcggagggagtcgagccagcgtcgccgcgatggtgttgttggagagcgagcaggtatggctaggcctggccggccgagggaagggggcggctcaggcgttactcgagacctgtgcctcctgcaggaggaccagggccttgacgcggcaggacgaggatttggggctggctaacggggctgggcctgttgttttccagttcctgacggagctgaccagacttttccagaagtgccggacgtcgggcagcgtctatatcaccttgaagaagtgtaagcagcgggaggggagccgggcgatgctccctgggttcccggtgtctgggagccaccggagtctgtctgccgcggaccgccgccttcctctacctttccccaccctgtactgagcacattcggggcttcgggcccggaaaatagtagggattgtagctggctcagtccccagcactgagccgcctaggttgcttctggtaacaatgggccccaagcagcccagggctctttgtcagggatcccagacgccgccactttgagtggaatttaacgtgcttcgatattacatgtttccgtcgtggaaataatagtttctccagggtttcgccagaccgtgatagcagatgaggtgtttaacaaaactagagcagcggggctggattaggtcatcacttaccccactcctctgttttaactgtttgtctgccgctcagccacgtacgcagccgtgttcaccaggatgcattttttccttcagatgacggtcgaaccaaacccattccaaagaaaggtactgtggagggctttgagcccgcagacaacaagtgtctgttaagagctaccgatgggaagaagaagatcagcactgtggtgagcttaatttctaaggctgtcttttgaaatgtaaagacttgaacttaacagaggatggggcgtttctgaaccaggcttttatttgtttttcccttttgccctgtgtggctatttttgagaccaggaccttcctatactttagtagtggaaacctcaagaataaaataagaaggtagaggtcagacagtcgttagttctgctaaagctcttgtggaaatgaaagtagcatattggtccttattcgtagtactgtaaggagcagctggcataaatatttgattccttagccccttactgtgctgggccttcaataagcagtttcttggtaccaggtgatgctattatttccttatctttgtggttcacatggcgaatgtgcagctagatgttaggtttgacacttgagaaaatatacatttagtcaagagccctagtctttcagtggaggttgaataaggcaaaggaagaggctccttgaattgagtgaatactactttattctgctgtggcagaaatcacattagtgtaggatactgactgcatgaaaatgtagactatacttagttggaagtctcccacgacaagttatcttgagaggacttctacagtaaaacaagcttatgtggttttacagattaagttagatatcatgaaataacaaaaacctaaggagtgttcttcagaggtagaatttattttgtggtagctcgcattgtgcttaaatatgcttgaattaatggaaggcaggtttaaaaataagatggggagggagtagtttaaatatatcttctattaatgtataaaaaattaatactgagaagtcctctgacttttctcagaacccagggagaaaacccaatgccacctttctaagggatttcaagaggtgagaaacaaagctttttttttttttttttttttttttttttttccccaaaaggagcctactgcctttcacctcttggtgcaattctcatgtggaaaaagatgcagagctccttttcttgttctctaggcagaggaaagtagagtagaaaaataaccattcgtgtattatgaaccctgaagttggggagaagtattttaaagataaggatattgtcttccggaggcttttgagatactatctggggtggagaagaggatgcttatatggataataggtatgacctcttttttccttctttttcaggtgagctccaaggaagtgaataagtttcagatggtgagttttgggtgttccttatgtttcccttctcagggcaagagtcagtatgatagtgaacactgggtaagattgatacttgggttcactgctctccggagataagttttaccagtatgtttcaagtaaaagctgccagggtgtgaatttcaacgctaataccgtcttcctttctagtttttttaagttagattttgtcttaggctgtagatatatgctacctatactatagttgaacaagaagttgcctgcaattttcccttggaaaaaaacgtaaaaaatgtgtgcaactgtctgtgggtgttgcagaagctgctataatgtgaaagagtgttttatgcttataccattttccggtacaagtgtccaatggtgctatattctttcctgatttttggctaccctaaatccattatgcagatagggctggtgttctgccagtttgcacatcttcccactaaggtatgctctgttgtatctttcaggcttattcaaacctccttagagctaacatggatgggctgaagaagagagacaaaaagaacaaaactaagaagaccaaagcagcagcagcagcagcagcagcagcacctgccgcagcagcaacagcagcaacaacagcagcaacaacagcagcaacagcagcacagtaaagggcatacatttcctgctttcaccaattaaccactgaattgctattttttccttttggccagatagctaggtttctggttcccccacagtaggtgttttcacataagattagggtccttttggaaagaatagttgcagtgtttataggatagttgtggtaagaatctagtttattttgcatttggctaattggtctgtgctgcatggttatatactcctggattatagattaaaagtctctgtagacatctctgtgaagagcaagctatcattaaacatgtctgtttatcagcactgtctctttattcctttcccaacccattttaatagttctggcaataactactaaatctagaatgatgtgattaatgaataggctttagctctataatatcttctaggttattagaattgaaacctgacagttttataaaaagtcatgttatctcatgagctgcttcccacctggctgtataattttatcatcatggttccccagtttcgatgagttctcacagtcaaatgagagtttgtttaaccaccttaggagaaacatactacaaagtcatcaagaataaaggttccaaagtaattatgatttttggtttctttatgccctttggtttggatattttcatgtgcttagtcattacagccaagggaagaaaaggctatttaccttatgttccagctccctaaaacctttagtgttaatagatttacaattaaaaagcagcaggtatatgaaagcatttattatatcccaaaagataaatttataatatattacacatgaaaaactaacaaagctcaactttgtaggacagcttcttagaaaaaaattttttttttctttttttttttaagacagggtcttgctctgttgtcccagactggagtgcagtggcgcagtcacagctcactgcagcctcaacctcctgaggctcagatgatccatctcagcctctggagtagctgggactacaggcatgtgccaccatgcccaactaatttttttagtttttatagagatggggtcttgctttgttgctcaggctggtctcaaactcctggtttcaagcagtcttcctgccttggcttcccaaagtgctgggattaaaggtgtgagccactgcacccagcctcttcttagaatttaattttaaattatgatgaatgtacaacattccattattccagtataagcctctgtctgtttgaatgaggttaacgacagttctttagggttaaaataagattctgtagtagtcatctctatagctgtacagaaatagcacagacaccctgcaaaagaaaagaaaagatataaggacagactcagtttaatgagtgaagaacagagctaataaatttttataacacctgtaggagctttatttaagcaaaaacaagatggaaggctagtcattaaaaaattatataggttttatacaaggtgtgactgacaggggtctgcagtataaggtcctagtaaggagataaccattcacctcataggcttccttgttgccttttaagtgtatgataacatgaatgattgattgattgattggcattatgacataaggacatacagcaaagtagtcatggttattttctttgatttaaacatacttagaaagtgaattacctgggtgaacaaaattgtaattgggacagctactcctaggacccctgtgttttgttattgatgagatcatgactgtgattcacagtccaagcaagatttattggttgtcagctgcaattctaagaacagcttaccaggcgtcaaacctcaacaagacaacaaaataatgtcactctgaaaccccccgccctgaattttaaccatgtgaaccctgctatgcccaagtgataacttactttttttctactttgatgttataaatttcatcacagactaatttgaggtatctttgctttggcaggcgtgacagcagctgcttcacagttgtgttaaatgcctgttcatcagcatcccactaggaaaaaaatagataagacttaacaacaggtctctagggtttactagctggttttttctgggtcactaatgaaattccagtgtcatttccctcttcaagtataccaggagaatcagtaatagggagatagcagaaccagttaggagactgctggggttcctctgaagcaccagttttccttaaaacaagactccctaattagagcctgattaacaatgctgcagccctagtgtgctgatgtgactttagagcagttatttctgcctaccgtttactttttt

SEQ ID NO: 16267 - DNA, 54531 bp, Human
tttgcatcataaatgaatttttattattgtgttttaaagcatcaaaaataaagggtctggtatgaaaggaagcaggaagtaataaattttaaatactctatttttattacttggtctactgaggtgactcaggtcataaaggcagtaacattgagaaccaggtttagaaagaaggagcttaccatgacagggtgagatataggtacacctacacactctaccctggcatagcaagcggtgctgcactcccatgtggacaaacttggaacaaatggctttcaagataaggcagtgacgtgaactatttaacctcactttatttgggaatttaacctaaggacgagcatactatatagaaataatacatgtattgggagtaattgtgtggttggattacatattatttgcttaatctagggtttttctaagtggagtctacaagtaatttgtttcagaattacatgagatcttgttgaatatgcacatttcctggctcgcctctgacctacagaatcaaaatcactgtggctggggtgggattctgcatacgacaatcttctcatatgccacaggtgcccactgcaatcaacattttttttttctggacaaaatttacaggaaactgtttgagaaagttagatgcacatcttttataaatttgaataatctaatgaaatattatagttaatagagagaaaattctgatatattgacaacatattttattgctttttctttcaactatttttttctgtaagaatttgaataattcgttatacatgcagaaggtcaggaaaaattatcacagattaaaaaaaatagacttctaattctctgatggaaccattacctgcaggccttcatttttggtttaaaaatataacaaatatgtggcatatcttatacttctgacctaaaatttcaattttttaacccagcaattttttaatatttttgttgatcttagatttcactatagataagctaaatgtgttatgagagagattttaaattgaaaactgctcacggtgacaatttatgcagttacatggcatgtataagagctcttaccacaacgcctgaaacaaaataggtaataattaatgcatgccctcttctgtgtaacataaacattctaagctcttgacatgaggtttggtgtctataattatctccattttaaggataagaacatgagtcacaagattatttataaagttatctaaggacaactaacttggtaaatagtaaagcctaatgttgaacccagaatatctctttctaagagatcatgtctaccatggtgccttctatcaaagatggtagaaatatcactacagtaataggtaggcattttgcatttccccatgctgatggggaagatgtatcttttgaaatgtgtcttgatattaactaagtttttgtcttcttacccaattttacagattaaatatttctcataatttctttaaaaagaagtacataatatacataatagtacctaaagtagagagactctgtgatatggtagatagacagttttaaagctgaaacaatttgagtttaaatgctgggtctatagtctatccattatctgtgtgcagatctcttaaactttgagtcttaattttctcatctgagaaatgaggatgatagtgtttacccatggaattaccagatatagtagaggttgtctatataatgtctcattgagctccttgcactggattaaatatagctgttacaatttaatacataaaatatcctcctgaaaggattatgggtctttctttattctgtatgaggtgtatactaggtaaaagacatgattttaatcaaaataccaaaatgtctgtttttctgtttaaatctttaagtatcttgaatacttcattttaaaatgtaatctcatgttttcgtttgaacagaagactggggtagtctaccccacagatgcctaactctcactatttcttctttcagcaaacttccttgataacatgcttttgcgaagtgcaggaaaattaaatgtgggcaccaagaaagaggatggtgagagtacagcccccaccccccgtccaaaggtcttgcgttgtaaatgccaccaccattgtccagaagactcagtcaacaatatttgcaggttggtgatataaatgatttaaagctagctttaacaaaaagtcacactttttcaactatgcaactgtaggctagtgtttcaaagaacacattttagagaacaatgcctaacactatcgtaaactcttagagctgtgcttgtattagagaaatattgaattgtgtttcaccctgaaacaatgttctaagcttctttttgatccctccagacagctcacatacacatgaacacagacctcagatcccaggctcctggtaaaggtgcaaatgccaattattttctttcaaaagacctggtccccacaattagttaaacatcagaggctgtcaaatgcgtgtgattttgtttgtttgtttgtttgtttgtttcaagcattcatcatgctgatgttagtattttggaaagaacacctaagctgctgggaatattcataaactgactctgggaagcagtgcagtggtagagctcatgcgattccccaagttgctaagaaagacattgtccaaatactagaaaatactctttaataggtaatcatgttcttatagatactttataacatttgaaactgaactattttgcctttttcttccttaaatgcctttatgcagctccatccattcctctgatcactatagctgcatttactccttacggtaaggtcaacagtggataaagagctatagcctaatgaggccagtgtgtgccaagagagaagtgggtcagctatctagaagagcacagccctcgagttaaaatgtcagagaagcagagtgtgccttaagcttcaagagagggcgtggacttaaatagaaaggtggactgctaggtttagagcccaggtagaatatctgagcaaccatttgaggcttcattagccagaaggtacgcaaagctgagttgaatgctttttttttttcctttctgagagctttttaaaaaaggtttttaagtttcccatgaagcaaaatctaatataagcttaccagggtattccaagaaccttgtatatttagcacaagaaacatgactgagtaacacagggagggaaacctgggtgtattcataaatatatatctcatttaatcagcaaaacaacttattctcacctttagacaaatgaaatttgggatccagagaggtctagtaacttgactcttgtactacaaagttgtgaccactgaatttttttgccaaggtaaaacgattccaaagctcagttttttccagggaaacactgcctctttatagtaaatagaaaaagtatcaggagagtttaaaaatgtttgaaagaaagcaaaattagcaggagcaaacaaagtagcgtggggtattttactattgtgtcttaagtctgtggtattcagaatacgcctgtgtgtgtcatttgagctattgtcctggtgatcaggattttccaaatattttgtcctgttttcctgataagccatttggatgtcctaagttggtttgatagaaagtgttcagtcagggtatctgcagtggaaattctgttgtgggaagaagcttggcgtgttcaaaagaaactgttttttctagagtacagggagtaggatcagggagtaggaacagtagagcatagtggtaggagctgagacaggaggtatagtgactgtgacctggtgggctatattaagaacgtgatcttattcctaagggtgttgggaagcaagtgaagggagttttgcagcaggagtggtggtagggttgacatgatctgatttgtttctttgctgcagaatattggatgtattagaaggagacagaagtgaattcaagaacagttaggtcagggaaattgaacagtggattcagtaaaatcagttcatgtgcaagaaaatgatcttgagctagggtggtgctggtgtaggagtgagtgagatctatttgagaaatatttagaagatagagctgtatgatgatggattagataccatctaggaggacaaccagagaggctttataagtttccagatgtagatttaaatgcataaggtagacttttaatgaaagaggacagatgaaaagaaccaagttccaatctggacatgatacatttgaggatttttatgtatctgagtagaggtatcagtatgcagttggatatggatctggggctcagagaagaggttgaggagagaggtcaaaatgtgcatagcattagtcactgtttgcggtgaaacagataacctcagaaccacagtggcttataattaaaaacacttatttttcattcaggggtttgtaaggaggctgtatccgtgctgcactctgctgggattaggtgggcttcacttcatgctgctgtttgagtttaggcctgctgcacatttcttcattttttttttttattttggatcagcagctacccaaggcatattgtttctcacaggagtgtaaaggagtaatcttttaaggcttctgctcatattgtgtcctctgacattgaattttccaaatcaagtgacaaaatcaaggtcacagtcaaggggaagcattgtccctggtaaagtatgaagaattgggattaataatagaacaatctaccagtgtatgacttggccatgagacatttaatgcttgggtaaaggggatgtctgcaagatactaaagaattcacaataaagcagtgagtatggtgtcactgaagccaggtttacttagagaggtagtaaggtcagctatgttggatctattagagagtagaataagaactgaaaaatggcaatcagatttatagacactgataactgcagtttagagatatttaatgtagtagagatggaagtcagattaaaatgggttgtgttatatggttgtcaaactttgatttatgacagcaaagaaaaagtaaacaaaaatacagaagaaagaaaaacagccacagtaaaaatggaatccctcaaaagaacatagatataccattgccgtcaacatcaatggattaacttgtagaagttaacagaaaactaatatttattgaatttttaataaatattagcatgtttacttttacctttctttattcattataacattcctataaagaatgtagcactatctatgtttgctaggtgagaattccgaggctctaaaaagttaagtaattttccatagttatgatgatatgatagaaaaattgtggccgggactccaaagtcctgaattcttggccagcggccagttctgacattggttctgaaaggagcaaacattcactcttgagtaaaaggcacatgtattttcctaatgaagtattgattccagttgaatcttcctgtgagctgagatcagtcatatgtgactcacaggggccacatttgtttctttgtcctaagacctatataaatccaggactttctacttccattcctgtaagcacactctactctctaccctccaaatcggtacttctcaggctatctctagtgaaagataattttctctccacaataaattgtatactgatactttgctaaattataataaaaaaattcttagaaaaattaatttttaaaatacttacaaaatacatgctccatttttattgcctaatatttaccttcaacagacataaatttgttcctttagattgctatacaagttttcatttttaaattcaccccttcccagatcagtagcaagcagtttgctgacctgcaggggaacacaccttgagtaatgctacactaagtattacccttctaggtaaaacagtttaaaggataaggttgtattttctaatgtgtaccttagaaaagggctggtctaaattgtctggcttgaggccttgtaccacccagatcttagtcaaactgagtgttgtggtaggtttcatgttcattatcacttccacctccctggagagaataatccaaaaggaggcaagagtgaatagtacttaaaagagaacctgaaatctcacatgctaatttagaggacatgtgcaaggttttagaggcttgtaaactccttttcagtaccattaattactctatcagccttcgccaaggccagagtcattcttggcttgatctctgtcaggtgcagatacggctgcttccaaaatccatgccatttccactgctcatgatattcacattaaaggatgtagtacaaacatagtgtgactgaatacagtaatagagccttttttatatttatatttcaaagtaaggggtaaagccattgtcctctctccctcgagataccatctgttttctaaatatctttccatgtgtcaatttgcgttgtaatccatcgagttccatttccagattctactcctaggatgacagaccatcactgcataccttgagtgctatagtttccttgagtaactctccttatgtggctttcaacatgccagtgttctgtttcagtttcctgtcctagcaagtgttatctcagccttgtttatatattttttctctatataatcagatctggctttgcatatcattccttgttttacttgatgtggtctgtaatcacatttttgtttctatcttaccacctttctcaagtccctccacttcctcacgcatgttatgcatttaaaaaattatttttgactattttcttcaaagacaatctttaatacttctttacttatcttattggtttcttaccaagaattctcctgcctgggcagttttcagggtttacagatgtaataaatcaaattgaatgtttgcacaaaggatgtgcaaatgacaccaggctgcttaaatgaggaattagataagcctccaactctgtatcctgaagagtcacaggtggaagaaggaaaagcttaggggctggagcctttttacaaagtttgtgttaactcaggctttttaaacctcttactgagtgtggtggtatgttttcaaacaggtgctcctgaccgtaggtctcagaggatttaagcgtgcattgttccagcttgtttgcacgttttaccttgcatactgaatgtcattataaaccatccagggttttattttttccacggttgcccaggccatttaaatattgatctatttaattatttttttccagtagaagatgttgatttcaaaccattgcacctaagagaatggtgggttcttcattagaacttctttttttattattattattattattatactttaagttttaggggacgtgtgcacaatgtgcagctttgttacatatgtatacaacatgtgccatgttggtgtgctgcacccattaactcgtcatttagcattaggtgtatctcctaatgctatccctcccccctccccccaccccacaacagtccccggtgtgtgatgttccccttcctgtgtccatgtgttctcattgttcaattcccacctatgagtgagaacattcagttataagaggctgtgattttaaattcacatatggaggcttttataaggaataactctcctcttgtacctctcattagtcatcaatgagaattttagacggtcccagtttgttgctggagttaatagaaagtgatagtgcagggcgctttaaaattatacagagagaactcttgaagatttttgagcagagacaatgtaggatttatcaggcttgctatatggaatggattagagttaggagaggagagaggaagtcctgcaggaaggctctcagagctgtcaaggtgagatgtggtgagggtccgcattgggtgaaattatactaatgctggttgaatgtaaaaactgagacaatttcaaaaaatcttgtacctcatagaaaaaataaacaaaatgctaaatcatttggcaagggtaccagggaaggatgtctgatagttacatgatcttgaggataaataaaaggggcatctctcacattggtacttcgtcgttaatgttgtaacttcaccttctcccaatactgtgacccctcagaaggaaagccagggaaggggaaagtagactcatatgtatttcacgctatattccgtccactgctatgggaatccatcatctaagatgataggggaaaagaagtaggattctattactttaataattaccacactcagcattcttctttggttacttcacaatcagtagaaaacacttaggcagcttatgatgtctgtccctattcctggaagttaaatgacttttctcttttccaggattggtggccttcgtagactatgagttcctcaaaatgcacccttgcatactcagcacccagctctgctggagtcatagtatgcttgataagtgtaaaacataccactgttaacaaagctatgagcagctttcagctattttagttaatggactaaaaagctgcaccctttaaatggtaattctaaaagttatgtgtatctttgcgtttacctgtgacaaaaactgaaaactgactttactcccttgagtgagaaatagatattttagaagaaaagatgttcttaagaacttgtttacagatgacctaaaatcagttaacctttaaaaatcaattctgactaaaatgtaaaagaaattcaaaagaaatttaagagttgttgtaggaaaactgttaatctttccagccaggtgcaactgagcagatagatacccatcatataaatataatgctttcaaatttcctatcacttgattgaacagagcagataaactctttttaactaatactttaaataattgttttacagttaaatgaatctttatgaagatctaaactgttagaggaaaagttctacaatagtctcttctcaactgtggtggctatatgaacaaccctggggtttacaataaagaaacataagatcttagtggaataatagaattaaagggaccaaagtttgggtaaaccttgtaaacactatattcatgtgaaataaagatgctatcagtgcagttttagacatcttctaaaattggtttctaaccattctacaacaactaatgaatgagttgggttccagaaggctatattataaatctgttttgaccataataaatgaaataaatttttgaccataataaatgcatctattctctgaatgcgtatctacctaaaaagagtatcgcttggtcccttgaagttttaaaacaggtagacaccttttttgcaagtgtatgttcacctgggcacactgaaaatctcttgaggtggttaaatgcctgatgatttttctagatgttccttctagacagtcctttgcttttggaatatttggggaacttaaggagcctagaacctgtataatcatccaagaattgtaacaaaattgttcctgttttgcttttctttctttttcatattctttttcttctctccctgaatcctcttcaagaaaaacaagacttgcattatcactgctttgacttcatgcagtctttaaattctcaagtgctttgctttttcatgagttaacattatgtcagaaggcagttagcactggtgactgaatatcttgtgcactcaactactgtttcattttgctatcacttttcttcgtctataacacagggacagcatttttgaaatgttacatcaattgtctttttatttcattcataatcattactacagttccctgattcatcctatgttcatgtatatatctcacttattttcaattttgtttaaaattatttccacttttatttccttcatgattcttcatctcatctttttatcacttccaacactctgggaacgagggtaacaatctctatacaaaactaagcttaaacatggcaaccaggcagcagaatgttcacataggccaatggtaagagttaattgtgacagcctgtagccgtctcttagaggtgggcaaaattgattagctttgactgcggaacatagctttgtttccatttgtacttgctttagggttgcaagttttcaagtaattcttgaacttctgtaattgtagtgctagtttccagttgatgttccttgctggagagcaatgtcagtgaggagcatataaattaatttgctttgtggcagctaatattccattgaaatggctgtctcgcctcctttcttgtcttccaactaaatatttgattcctttatgaatttatggcttataggggaagggactattttctcagggtctcccctctttatatttttagctcctctctctttgcagacaaggggtgtgtatttttaaagcttgaatttactgtctctgatgtttctttaaatttcctaggacatcatagcagtaacttgacaatagctttaccagctttttctgtgccatttcttttttattcttaacagttgcctagaagtgcatttctatttactcctattttgagtaagaagaacccatgataaggagaaattagtctttagatttaatttagggtacttctctagcccctataccttcctgatatcataaaattaggatgaccatattttccgataatttttgaattttgatttagatgagaaatgtaagttatacatgtagtctaaatatgaaggaaaagaataaaaaagtcacaggtgttacttgttcatattgtttaaagtaaatttctaaggaacagatattttaattattcccttcggtgtttacatgttttacatttttatagcaatttcagtaaattggttaaaaaggcctgaagagttcaaggcatgggctgttcagagacagtctttcttccacaacaatattcatgctttttgaccttggtgtaagagagggatttatcattggccctttttagccattcattagtatgtttgaattttgttgtgctggctcttataaagtgaagtattttggaccacttgaggcttataaaccaagtaaacaattctgagggtgttgataataactgaagggctaacatatagcagcatgctgctaccactaagacagaatagacaaacccacaaatcatggctagtatcgttctcagagctttattcccatgacctttcaagattacattgccatatctgtcttggacgctgagcatgcatatatatgagaaaaggatagagatatagtttagtactttatttcttaagacattcagtgctggtttatgacttatattgagagtctgctggcattcatcacccaaagttgtgaagatatcaatgtctgtttacaaacagttctgtatataacagatgtgttttttattttagtcccaaagggcatagcagaaaacacatggtgaagtgagaggcccttgattcaaggcccagttccataactgtttgttctttgatcttgtacaagtttgctacacttttataattttaatttcctcatctgtaagataggaataataatactttctttttcttattgttgagaggattaaatgatgtagaataagtgaaagttatttttaatctggaaaaccatacagaatttaaaattttatttcctctccactgtcttatcaagaacccttctttctgttgcccatctttaccccacccccaaatgaagcctatacttcttacaacaaagcttaatttctttatatgacaggacagcccagaagcagaggtactaaatgtcagaatctcagttatgccatgctgatcccaaatcctacctgtctttagtttttgtgctttaataagaaataagtgtatttcactatctcagagcaagaacagtataaacagtcacctgcctggattcacacccttgcactccttctcactaactgtaagacttttgaaagttactcaagccccctgagcctcagtttcctcatatagaaagcaacagtagtgctaccttcctcacagagtttgtctggatttgtctggaaaagtagtatctgtgaagggccaaaataagtgttcagtaattggtatctatggtttttcatggtaattaatgatgtatattatatggaaatgttagatccttctttttcacaagtttctggacaaaggagatattacaaaatgtttttatgtttattaaatccattttcataaaaggaagtttttggattctcttaacagatcattgacattctccttgttgcaataaaacaaatgatacacatcacttatttccttttcccctagacacacacacacacacacacacactgactcacacacacacattctgtttctcactttgcttgtttgatcttcagcacagacggatattgtttcacgatgatagaagaggatgactctgggttgcctgtggtcacttctggttgcctaggactagaaggctcagattttcagtgtcgggtaaggtagataacttgattctgtaacctttcattggctagatttccaacaagtttcaagcaagataaaaccattctttttcttggccagcccatttttagtatagtcatgagctgcacaaaaacatttaggtcagcaacagatggtatgtatgatgacagtggatggtggtcccataatattatagcaccatattttgactgtaccttttctatggttagatacacaaatggatactattgtgccttaattgcctacagtattaagttcagtgacatgctgtatggatttttaccctaggaacaataggctttatcttttggcctatgtgtgtagtaggctataccatctaggtttgtgcaagtgtactctgtgatcttctcacaatgacagaatcacctcataacacatttctcacaacatatccctgtctttaagtgacacatgattgtaatttagaaaactgaaattttccattggaccaattcttccttcattttgaaatcaaatattatttttatttttgctgttaacgtcttgtttagtgtcgcattagagcatcttcctcaaaatccaatttagcttgttgcattaatccaagccttcttcctcagtttatacaatgcacactagttattagaaatgtagtagtaattttgttgaaatgcaaaagttgcaataagataatacatggtagcttgaaataaattaccttatagaggagaacatatttaaggtgtttgagtgaaattgttagaattttaaattagttctctaaatagtgactatttttaaagttttagatgatttgactttgaaatttggaagaaactcactaatagctgtttgggttcgattataggacactcccattcctcatcaaagaagatcaattgaatgctgcacagaaaggaacgaatgtaataaagacctacaccctacactgcctccattgaaaaacagaggtaagtgaggaaggcttccagcctggaaaatcactaggtatcatgaaaataaaaactaaaaactagaatcgttctctctcaatctacctgtaccactttccactgctggagcagagcactgaggccagatgacatggaaccatcattcgaagacatgtgcaagtagtttgtgggaaaacagtcatatgtgacttcacttttatgatttttattttttcccacttctgttcagaaaattgctattcctagagtttgtagtgtatttcagggtggaggcaggagctagcactctgcttctccctgaaagttattcagaagttgtagttcacccaaaaactaccatttgtctatatttattttaaaagtaaagaccatataaagggctaaattaaacattatttgctatatggcatttcctttttttatgctagagtaacaccttttagtcaaatcgtatcaatatattgataaaatggggaaggtatctaaaagttttaatttcaaaacttacccatttaagtgttgttcctttaaaatgacaaatattgcctcccaagatattgcctcccaagagaccttttgtttgcaacaggtctcatgttccctttctcctcctccatgctttcagcgcgcgcacacacacacacacacacacacacacacacacacacacacacacacacggttttttgttgttgcagagttttaagtcctaaatcttatctaagtgatttaaagtgatttttcatgattgattttatttcttgagaagagaaaaatctttccaacaaaacataatggaatttcatgactttgttttgctttctctctctctctctcttttttttttttgagacagggtcttgctctgttgcccaggctggagtgcatggtgtcatcatagttcattgcaacctccacctcctgggctcaggcagtcctcccacctcagcctccccagtagctgggaaacaggtgcgcaccaccacacccagctagaattttgtgacaaatgttttaacatttgttcctgttctagcctagaaagctatacaagattgattaataatgattcacatcaaagcctcaccagcatttttttttaattgtggcaggcaacatgctaggtattaggaatacagaaattaatgaagaaaattattcctcccaagaagtatacattagaatgtaagagagcaccgtgtcaataactatatttgttcagaaatatctcattagtagagttagattataaagtgtattaaggacataatagagtgagtggctggctctacctgggggaggaggttgtcagaatagcttcctagaagtgatacttgaacaagactttaaggatgaagaggagtgtgctaagtggataaggcaggataggctaagtatatagaaagtttaaaatttaaatggctaactttagccacataatctgctaaaaagtacattaattaatccattttagcctcacagcagccctgtgaagtacatagaattgttcttccaactttaaagataaggaaaacacagcaccggaaagtttattaactttgagtttgcatagcctatgagtagcagtgactctaaacagatgcagtagttaagtgcagaggtctggtttgtaatattggagagccatttgctaactacaggagtatgaaacagcatgactggttggagaaaaatcccataattaagagagatgagggctgggcacagtggctcacacctgtaatctcagcagtttggaagaccaaagtgggaagatcgcctgggcccagaagttcaagaccagcctgggcaacatagcaaggctccatctctaaaaaaaaaaaaattttaatgatctgggcatggtggtatacatctgtagttgcagctactagggaggctaaggtgggaggatcacttgagcccggaagttcgacattacattgcgctacagtcctgccactgcactgcagcctgggtggcagaatgagacactctttctaaaaaaatctttttaaataaataagaaaagagagatggggccagatttcagtccagttaggagtgtgaaggtgagagagcattatctgaggaggatgtaggaatttagaaaaatagtagaataaaactccaaaggacagagtaaaaaggcttagaaaaggagggtaggaacaatgagaagacaagttcttggtccagggcagtgtggagatgaggatgcaggagtggctggtggactctactgagcattgcgtaaggtggctggctttggtggggtttagtagcattagaatgcactgctttgagctctgaggatctcaggtggtacttaggcaaggtctttccagattccactgctttgccagtgcctaggcaaggtctctgcagagtctactcaggtagtgtctagttccaaagtctctgcagattcttacctttttgggccagctgttttggggtcaagtaaatgtcactgcagattgtagtctgagagcactgatgtttttacatagctataccacagagctgctgctttttttttttgactctaccatatacacatgtacagtttttattgaaattgtactagatattttactttctagctatatgatttttttcttctatttcttattgcaattgtgaaccatcttctagtcttataaaaacagtcctggcattttaagcagttacaagctaattatcggagaggtgatagtagtgacagaatgcagttttgttgtgaaaccactggtgattcttaacttgcctctcagagtgaaccagacttcgcccgggagttctcagttctacttcccagagcagttggagtgacagcgcaggtagaaatctgctgtcctggagagagctgaaagctgtgggctctgctcttttcctgataggtatctggaactgttcactttctgagactctggctgtggcttgaatgtttacattgttagtgctccgagcacaggtaatggcagattaaaacatgaccagcgtgaccagcagaaacaaaaggtttattgataaggatcacctattcatgagagaagacaaggaggctgccggggatagggttatggggcaaataaaaggcaaatgggaaggtaaagctagccttaaataaagtgcttgatggaaaggaaagaatcccttgatccttctggtctcattgctctcataaatcagaaatataataagataagtaatacacagtgttcttgcagctcagggtgtatcctgtatcttgcatttacatggaaagtaaaaggcagtgaagcttggagtcttagtaaaattatatcattggaatggaaaagtattatgtgttcatatactgataatatattgacattataattatgtggatagttctagttttggttgagtatctagcattctcctaaaatctaaaatttttgcaaaatctttcgttatctttaaaattggaaatgcatttaagttaagtttccagtcgcagtcttaacgtatttgtgtgttacagtgtttggatgcttctatctgtataaaaatattgtgagttgtgctttcactggttgaggtattatgataccttgaatttatttttaactctttatataacctaagagagggaggaatggaggaaaaaatttactaagacaatttattgtgttaaattttagcctgcataacattaagagcttacagattattttcaagatttactaagcagcatgtttagacaatgaatgctcaaattatatataattcctgtttgtcttgaatggctccttgaatggctcctgttgagccctgaatgactttttacaagtgctataatatgtcaagttcctgagctcccttttcctggattattggtaacatttcttaatttattcatataataactgctttagtagcctctcatttagtgttttcagatgcagattactttcattaatattttgcaactattacaaatcataaatagctgttaaacatatatattttagactgatgagtaaatcataacactgaccatcatgaagtttggataagaaattcatagtggatttttgtttgtaatagataatccaaagattttctgaaatattttgaagatgtttttctttttttaaatttcagatttcatttgtacttacaaggggtacatgtggagactgttacaggagtttattggacccaggtagtaagcatagtacccagtaggcagtttctcaacccatctcccctcacccccgttaatccacagtgtctgttcttgccatgtttatgtccatgtgtgctcagtgtttagttcccacttataagtgagaacatacagtatttagttttctgttccttcattaattcacttaggactatggcctccagctccatccatgttgcttcaaaggatgttattttattgtcttttatggctgcgtagtattccatggtgtatatgtaccacattttgtttatccaacacaccattgatgagcaactacgttgattgtgtgtctttgctattgtgaatagtgtggcaatgaacatacaaatgcatgtgtctttttggcatattcctttggatatgtatacagcatcactcctattcagcatagcactggaagtcctagtcagagcaatcagaccagagaaagaaataaaaggcatccttatgaaaagaagaagttaaagtatcttcactgatggtatgatcgtatacttagaaaaacctaaagactccatcaaaagactactagaactgataaacgagttcagcaaggtttaaggatacagaatgaatatacaaaaaatcagtcaatagcctgcctttccttccttccttccttccttccttccttccttccttcctttccttccttccttcttctttcttttcttttctttctttctttctctctttctctctctctctctttctctctctctctttctgtctgtctctctctttctctctctctctccctcccttcctcccttcccttccctccccctgctcccctccctcccttccttacttccttttcaagatggagtctctctcagtcacccaggctggagtgcagtgacacgatttctgctcactgcaacctccacctcccgggttcaagcaattctcccgactcagcctcctcagtagctgggattacaggcgtgtgccatcatgcccagctaatttttgtatttttgtagagacggggttttgccatgttggccaggctggtcttgaactcctgaactcaggtgatccgcccaccttggcttcccaaactgctgggattacaggcgtgagccactgtgcccagccagtcagtagcatttctatacaccaataacatccaggctgagagtcaaatcaagaacacactcccatttacaatagccacaaagaatatgaaatacataggaatacagctaaccaaggaggtaaaagacctctacaaggagaactacaaaacactgctgaaagaaatcagagacaacacaaatggaaaaacatcctatgctcatggattggaagatttatgttcagtttatgtgttcatgataatttcctagatgttttgatctgggcatgcagtgtgaaataagcgcatcacggggctgtgcattaaccctttgagcacattattgtttagtaagatagtatccttgttcttaggaagtaccctctgaagtatttataagtggatagtggcattatgtctaaaactttaaatgatccaaaaataatacagacacacaaataagtaaacaaataaaaaatttgaatgcaaatgtatgtatgcatattatacataaatattgagagagagaggcattgagaaggcaagataattatttttaaaatgatgaaatgttaacaatgagaaatctaggtgaagggcacattggaattcttttttcttattttttttctgtaagggtgaaattatttcaaaataattaaaatctttgttcacattgatggtaaaatagaaattactgttaccttttaaaaagaatatttgacaatatgtatgaaaagacttaaaatatatatcttatgaactaacacacctacttctgggaatcttattaaggaaataatcattagcatgtgcaaagatgtatgtgtaagagtgtttattacagaattgtgtataacaaagaagccttatggcagaatctttagaatctcctgaatgtatgacagaagattcactttctaattaggatgattttatgtataatacagtttagtctttaaaagtcaggttgtagctgggcacagtggttcacgcctgtaatcccagcactttgggagaccgaggatcacttgaggccaggagtttgagaccagccgggccaacgtggcaaaaagccatctctgctaagcatacaaaaataagtggggcgtggtggctcgtacctgtgatctcaactactcagggtgctgaggcacagaatcgcttgaacccagaaggcagaggttgcagtaagctgagattgtgccactgcactccagcctcggccacagaggaagatcctgtatcaaaaaaaaaaaaaagtcatgttgcaataataaataatttcaaataggtgggaggacactgaatgttcccaacacaaagaaatgataagtgtttgagatgatggatatgctgtctgatcactgttcattatgtatgtattaaaatattataattatgtgtcaatataaaaatcctgttgcagaaaaaaatatttgttgttctggaaaatgttcacagtattataaatgagaacaacctagttataaatcagtatatattatattttgcttatgaacatttttattgaaatgatactgttagcagtaatttttcctgagtgttgaagaggtagtgattttattttattttggttagttgatccttttcagtttttcttcatgtaacatataatacttctgagtaaaaaaagttacattgagtggaagaacattcccagccaaaatatttaggtggccatatagttaaaggtatatagtacagttggaaaacgtcttgtccatagcatccaaagtcataaattacaatactaccttttaaaattaaatgacagtaatcactctctcaaaggtaaatggtgcctttaataagaatggtactaatggtattactatataagtgcacctggttttaagtcagtttcctcaaaatatgtcccagaaatcacccgtgtaaaatttacctgggatgattattaaaaataaagtactttgaatggaaatctttggggttaaagtcagtgaatatacattgtataaagttaagtcatttatataaaatttgaggaatctgatttgtcaagaactagagttaaaatgagtagtgtttaataatttgttgtataaaagtatcatacattctttggctggaacatatacattcttttaaaatatgattcagtttaagaaaaagtatggattttgaacacatttttgtttaaaacaacgcacaaccatatattctctatttggcaacatttgaggggtccacttcctttttatccactataagatgactttatatacaacgagttatgttttatgtcccatgaattatatagatgtttttttattcaaattcatggtatagagtactccagagaccacatgagaagagcctatgaacccatgagctgcgtctgtaataaagatgaactacctgtttctattgtgggtgcacagacccacttagctttgttgatgttctttctgtagttttatcctgtgtcgagcctgttccttccagacaggaagaaatgtgtgctcttgattaagtgcctaggtgaaggatgattcacgctagtcaaacttatttaattttgagtatatatgggtttttaaaaaattaattggtatgtgaaaaggatctttcacattttgtgcgtgatacttagcaagtacctttaggaaagagttactttcttatttttaagtaaaaatattctcttgattatggctctttttctttttaatttcagattttgttgatggacctatacaccacagggctttacttatatctgtgactgtctgtagtttgctcttggtccttatcatattattttgttacttccggtaagtttctaacatgtagatgcaaaatttttaatttatagtgtcttctttttactaatattctgcttttgcctgttagtgtttctcaccacagctttatttatcttaattagatcttatagttaactgaaaatgtctgttactgttgataaatatttgtcctaatgaagttacaaatagatacctatctcatttctgcttcagacttcaaaactacccatataaatattttatccctagggaaactagggtagttagagacttcagagactggttgttacttaggtttgattccaagcagagaaatggccatgttgaacttaagagttgctcaaattccttattttctaagctataacgtttctgattattaaaagattttaaacataatttatagattaatcattaaaataaggtcctttattatattaaattcggtaattcctatttttttaatggcctatgaacttatgttctagattgtgaaatattaaggaccttgatatttatgtcatttgccttttgattaatttattactcatttgagatactctgcaaatggtcagattaattgattcaaataaattcatttctaattgaaaacttaagtattgacaaaaagtttttaaagattaaatttatattatttctttagatatgaccttatataagagagttagctataatgatttttgtacacccaaaatttacatctttaattaattagggaccttagaaaagattttaaggaataatattggagctatttagaaacactagtagaatgtagtctgcttggatatgtgcaatttgaaataaataaaagaagaaaaattgtagatgcttgagactgagtaaaaatatgtagtttatttagtttattttaaaaaataggttagccaaacagtaatgagttttacttgggaaaccataactaagagtaaaaaatatgaagcatttaatgtattatatttaggtgctaaaataaaactgctgtgattaccattttagttgcaatattttactccatcattgcatttcattatctaaaattatcttcatctatccatctttaggtataaaagacaagaaaccagacctcgatacagcattgggttagaacaggatgaaacttacattcctcctggagaatccctgagagacttaattgagcagtctcagagctcaggaagtggatcaggcctccctctgctggtatgagaagaacacatcttgaatttaaaggaaatgttttctgaaagaactgtcaatgaatatggggtttcacttactgaaatagggcactggacaaggagaaagctctatgcagtctgttggacatccgatctcagctgcagggcttcctgataacattttgacatattgagagtaaggtgattgttttttaatgtaggtgtatggttacaatccagaccctcagacattctgatgaagagcagattagaaaacattaaacacgggaccatcttccctgtgttttccataaggatagcattaccgcactttggcctggcttttgaaggctaaagtattacaaccaactggcttctcagtatttctacaaagaaagagggttgcttttcagctgtggggtttatgtttcagggtaaagttctggcttttccattcaggagaagcttcattttctgatggtcagcactgccaaccttgaagagaatatatgagcaaatacaatttgaaaatcaatagtattacacttatttttttctaaaagagatgtacaaatagtaaaatcccttttggtattaatgaattagatgctcttggaatttaaactgagttcttccagtgtttcttgccttcaaactcatctttcccattactgtggagttctttctccaaaaccattgatcttgcactgttatgtcctgggtaaaatatcctaatacccaatactgcttgcaggtcttctttcccagcttggtatgtgtggcacataaactcaacctgccttcctgacgtctcctcccacctcttcccagtatgctgcctgggctctagcatcacctttgagtaattgtttctcaaatacaacatatatccacgtcattgcaaatgtaatctctttactggacatcactccaactcatggctcaaggcctacctcatgttttacctctgtgacaacttctcagttaccccagactaagccagtctatttatcttctgtgataacattttatttttagcactaataatggccatttaaaataatgttataattagtggtaatgttcttgtgtcttttggtggagtctgtcctctttggggtagaggttacattttgctcactttctatccccagtagagtggctgatttattataggcgctgttcaataatttgtttttaaaaagctttcagctcctacttttaatagctataaaaatactgtcttgtttctataatccagataccaaaaaataatatttggctcacatcatataatgattaaaagcatatattctcaagccaaattgtctgggttccaatcctggccagacattggcctttaaaactaaatcaaattctcatttagtcctcatagcaaccctataaggtagtaccagaaatatcagtataaccctgtattacacatcaggggatacaggcccagataggtcagctagctagtacgtggagaagccaggattcaaacccagatgatctgtgctcttaacattagtgagatgtgaactaaatgttggttaaataaaacaagaaagtgcatttgatggcggtaggatgggaaggagggttctataaaactcagttcaataaagaaaaagtctctattacagatttattttctggttttaagatttggttattaagataaacaatgcagaggtatacagttctctctccatatattgatatgtgagtgaatacctcatcttaacattgatttgttattaattttaataacataatgggcaaattagtgccttatatataaccacatacttggaccttgtgtttaacaaatgactttatacgtgccctttaattttgcatcttttctttttcataaaatgtcaattttttcctactttaaaaggaaataatatcgtagggctgttgtaagaattaagactgtgtgtgtgtgtgtgtgtgtgtgtgtgtgtgtgtgtgtgtgtgtgtgtgttctgtgtatgtcttctcacagtcctggaatagtgataattctttataactccttatacattcagttattctcagagtacatgaaatatagtgatctttttgaaagtacagttatagtcattgtatcttacaggcattttatttatacaatcaatctaaaaagttggtatctaagaatgtaatatagaattaaagtttaggtacagaaggaccagaaacatttgctaaatcaaataaaaactaaaataaatcagttaaaaaattttgaagttatatttttaggtccttacatgttataatagcttactttctgtctttgggataagttgttcctattctatcaagtatcgccaattctgtcaaaacttataattaaattataaaatgtattatcgttagaaaaaaaagcagatgcaaaactgcttatgttaggaaattctccatagacttacatgagcaatgctttgtaagatctgtaaattaaatatttttctttaataaatgtgggaagtttcctctcaaatgagtgatttccctgtgtatgaatttggctcccaactggtgcccatgttgctcctgtttccttgtttggaaatggagtacagtggactcaacatgatgtctcatggcgcacagggctcctaaagagaggacggctgcattacacataaacttgcttgcttatttccatcaagcttcagtggcttcatggtacatcagcagttcttttttaataaattacgaaatttataatcttcattataaataatatataatatataatgtccccccaaaatgttcatgccctaatccccaggatttttttttttttaagacaaggtcttactctgtcacttaggctggagtgttgtggtgcgatcttgtctcattacagccttgacctcccaggctcaagcgatcctcccacctcagcctcccaagtagcttgtcactacgggtgtgtgctaccacacctggctaattttcatattatttgtagagctgagtttttgccatgttgcccaggctggtcttgaactcctggactcaagggatcctccctccacagcctcccaaagtgctgggattacaggcatgagccaccgtgcccagacctaatccctagaattttatgttctatgacaaaggtgagcaaaggttgctgacgataagatgagatcattctggattatctggggtggcccaatgtaattgcatggctcttaaaagtacaaaaagaaaaactttaagtttttaattggtgtaaagtatatctctacaaagaatacgttccagtttgctgatcaggtgttataagagttatacgctagattccttatgtcctctaaattatataaattgtaatagatgcttagccctttcaatcttggaaccattgatatcagagttcttcaaatattttactgtaagtacagatgtgatgaagatcatatataaagagacatttaaatttaatgccacttaactcatattttcattctctttgtctgtactccactctttataatattgttcagagctctcttagagcttggtaaataatattatctccaacttgttactttctcttattaacttttctctctaatatgctggtttgtctacctgttttgcattttttattgtgacaattaactgtctcattacaaaaatgtaatttccattaatcttttcttgcttattttttattcaattttcatttcatttagagttacttggcattctgtatctcagaattccagtatgtaatctgaagaggttaaatctacttgggttgtttctgttgactctcatttatagtgactgtttctttgttctaaagaattcattctctataatcttctctcattctctttctttcttctctccctccatttttttttgttctcctttttcctccccattcttggatatttcctttatttccctgtgagcccaggagtgcattacagtttatttcttatgttatacccatgatcaagttgtatggtggcaagagttccttcaaagtactattatcccgccatagtcacggcatgaaaagtattctgcaaatggtttcctcaagagagagcatttgtaatgaggagccttggcatgctaccaacccatagcaaatttagtaccattcgatgctctctgcttaatgctgaagccctaggttcagttcctctggttttaaaggagtcagagtttaaactctggattccagttctggtattgttctttgcccagacggcagcttggtttatcgttccctggtctggtctcaactccttccttccctccctccttcctccctccctcccttttttcttcctccctgcatatagatttcctttatttctgtatgtgcctaacaatgcattacaattttgttttgttatatttatacatgattaggtgtatggtgacgagtctcttcagagtatgtagtagtccattataacggggaagtgcaagtattctactctgctgattactatgagcctactcaggttttttctctgagaaaataataatactaaaataaagtatttcataatttggaagcagtgttttgaacattcagaatccacactcaatctcaaatatgtttaaaagagtgtaacataaattaataaataaatacaaataagttgtctatatagagaaaaatactagctaaatatattttacatgcagtaatcgtttcttctctggagaaaaaaagattaaacaaatctgtagcgctgtgaatacactaacagtgtgttttgggatttcacaggtccaaaggactatagctaagcagattcagatggtgaaacagattggaaaaggtcgctatggggaagtttggatgggaaagtggcgtggcgaaaaggtagctgtgaaagtgttcttcaccacagaggaagccagctggttcagagagacagaaatatatcagacagtgttgatgaggcatgaaaacattttgggtgagtaaaagtctgcatagctatgttcagggtttcctagctttcctctgtctttctgttaacatctgcatgttaactcatctgtctagacccgttgcgaaatgtattgaagttttcttcttggcatgggcccaagaacatcataagtttctaatgggagacctcacaggaggaatgactaaggcacttctgtgagtaagtggtaggctggaaatggaatactctcaaatattttttcttcagaaacaggaaatgcgagtgtaaaaccagaatttcttagggtttcttaggaatttgaaggaacttatttttgtttaaatgttgagaaaagttgtaggaatcttatctgcagggtttatttatatcaatagtttatattgagaattgattttgtttcgcaagttagaaatgatctgtctggatcgttcaagtagaaggagagtaagctaatcagtggggtatattccttaattcaagaattcaagaccctgttttgcaatgtcttatgtgtaaccataataccataaagtagtttatataccatagtagtttgtaataccataaagtagtttaaacatcaactactgattaggaagggaccatattttcagatgtaaactcttaatctttctctactcctacaggtttttttctttttcttttcttttcctttttttttttttttttttttttgagataaagtctcgctctgtcacccaggctggagtgcaatggtgtgatctccgctcacggtaatctctgcttcccaggttaaagcaattctcctgcttagcttcccgagtagttgggatcacaggcacatgccaccatgcccagctaatttttgtatttttagtagagatggggtttcaccatgttgaccagagtggtcttgaactcctgacctcaagtgatccacccgccatggcctcccgatgtgcttggattacaggtgtgagccactgtgcctagccttacttgtacaattttgattgcttcttattggtattagtcatttaataccatcataggcatagtcaggaaattgaatgaaatgctaaacaaaaattatctatgacaaagaatgatgtttgagaatatgaattattcctgatactatttggaaaacactaaaccttttcatcttttttccttttaggtttcattgctgcagatatcaaagggacagggtcctggacccagttgtacctaatcacagactatcatgaaaatggttccctttatgattatctgaagtccaccaccctagacgctaaatcaatgctgaagttagcctactcttctgtcagtggcttatgtcatttacacacagaaatctttagtactcaaggcaaaccagcaattgcccatcgagatctgaaaagtaaaaacattctggtgaagaaaaatggaacttgctgtattgctgacctgggcctggctgttaaatttattaggttagtatcaaagtgaacaaatacatgttttatgactcttttctgttactttttattttgtagcgcagtgcttctaggatatttagtagaagaggaatatcattaattttgacatttgacggggagaaccaccaaacattttattagcaacacagcatatttgggtctgttctattgtttctatgctcatcagagacattgcttagagactgttcacattaggtttgcagctgtcattaagttatatagaaaagaagtagctaattcctgggaatacgtagtcagaattctgcataacatttgcaagtaggaaaaagttttggggaaaatttacagattatatatggataaagacaatttttatatggtataggaaagataacttgcatagatgttttgggagaaatgttagaaactaataaacaaaacccagctgttattcagtactgttatcctgtacctgaaacagtgaatttaacatctgtgcacataaaccagagcatgttgtaaaacagtggttttcagacccttagggctgcttgggttacatcagtagcttcttcacagtagggaggggagatgatagttgggactctattttgcttactcttactttaatcagagaggctccttccgtctcacagatgatttaattcgaataaatggtttctctgtttggaaaacaaaacaaaatgagcttgcaaaccactggtgtagagaaatcatcgtataactaccttttaaagaactcagtttaggcttagccattaataaatgttggatcatcttgtggatttttctaagtaagactctgtaatacatggagaggagcacaaagaaaaagtcatggagattattaaaagtttggaaagtaaaattcacaaaaaaagactgattgattggtattttcggccagaactgaaggctgaggtgtgatttaataacataccccaaatatatgaaggtcttcaccatgtaaaggatgggaaattgaagttcttgatctttaaaaacaaagcaagaggaaatgatttgggctatagatttaagttagaaatatgaacctcctgccaataaagattattaaatcctttctcccttctgatttttttttcctctgacctacaacccttttcaagtcttcctataaaaaaaaaaaatcccacaatgcttcttaaattaccagcctctctctccttctctcaccctgttaaatttctcccaagagttccaaaagatcatctgcttcgaaaacccagcaatttgttaatagtcttgtaatttggcttctgttccattctctttggacactgctgtattcagagacaccactgggcttggtcaccagaggccttctctattgccatcaccctatccacagtgtccaaacctttctttctcctgttttcttggtgtatctctgtactccaacttctcctttctctctctccactggctctgctctctttttacctcttacatattttccgactgctagatttcctgctgtatctgcatttccttcctagttcccagttttggctgatccattcttaatattaggtatctgacatcatctttcgttccctaacttttggtttgctcaagtgaatgaattttctttccacaatattcccatttgtactgggccagtgtgggccttctataccatttttctagattctggggtgaagcattttgagttactttctctttgtctctcctatttccagtcttctgtacatgctgccactgaatttattttcttgaagcctaattttgggcatcaaaataatttcatagtttcctgtggcttcgtattaaaatgtagttagagtcccttggtgcagtggactcttttcttttctgaccctgggctattcttctgccctatttccaccacacttcttacctttggcaagatttattctgaagacttcacacttctcataccatcaagtgtttataacatgcttttatcattacccgaacacccatatccccttctgtatctagatcacaactactgatcttcacagtttcttcctttgagacacctttttttatttttattttttagacaaagagtggctctgtcacccagactggagtgcagtggcaccatcacaactcactgcagccttgaccttcgaggcccaagcagtcctcccacctcagcctcctgagtaattggaacttcaggcatgtgccaccatgcctggctaattttttttttttttaatagatgggatctcactatgttgccaggctggcctcaaactcctggactcaagtgatcttcctgcatcagcctcccaaaacgctgggattataggcatgagccaccatgcctggcccacctgctgttttttttttcattatacttttaagttctagggtacacgtgcacaacgtgcaggtttgttacatatgtatacgtgtgccatgttggtgtgatgcacccattaacttgtcatttacattaggtgtatctactaatgctatccctcccccctccaccccacgacaggcctggtgtgtgatgttccccaccctgtgtccaagtgttctcattgttcaattcccacatatgagtgagaacatgcgatgtttggttttctgtccttgcgatagtttgctcagaatgatggtttccagtttcatccatgtccctacaaagaatatgaactcatcctttttcatggctgcatagtattccatggtgtatatgtgccacattttcttaatccagtctatcatcgatgtacatttgggttggttcccagtctttgctattgtgaatagtgccacagtaaatgtgtgcatgtgtctttatagcagcatgatttataatcctttgggtatatactcagtaatgggatggctgggtcaaatgtatttctagttctagatccttgaggaatcaccacactgtcttccacaatggttgaactagtttacagccccacaaacagtgtaaaagtgttcctatttctccacatcctctccagcacctgttgtttcctgactttttaatgatcaccattctgactggtgtgagatggcatctcattgtggttttgatttgcatttctctgatggccagtgatgatgagcattttttcatgtgtcttttggctgcataaatgtcttcttttgagaagtgtctgttcatatccttcgcccactttttgatggggttgtttttttcttgtaaatttgtttgagttctttgtagattctggattagccctttgtcagatgagtagattgcaaagattttctcccattctgtagattgcctgttcactctgatggtagtttctttgctgtgcagaagctctttagtttaattagatcccatttgtcaattttggcttttgttgccattgcttttggtgttttagacatgaagtccttgcccatgcctgtgtcctgaatggtaatgcctgggttttcttctgtggtttttatggttttaggtctcacatttaaatctttaatccatcttgaattaatttttgtataaggtgtaaggaagagatccagtttcagctttctccatatggctagccagttttcccagccccatttattaaatagggaatccttcccccatttcttgtttttctcaggtttgtcaagggtcagatagttgtagatgtgtggtattatttctgaggcctctgttctgttccattggtctatatctctgttttggtaccagtaccatgctgttttggttactgtagccttgtagtatagtttgaagtcaggtagtgtgatgcctccagctttgttcttttggcttaggattgacttagcaatgcgggctcttttttggttccatataaactttaaagtagttttttccaattctgtgaagaaagtcattggtagcttgatggggatggcattgaatctataaattaccttgggcagtatggccattttcacgatactgattcttcctatccatgagcatggaaagttcttctattagtttgtgtcctcttttatttcattgagcagtggtttgtagttctccttgaagaggtccttcacatcccttgtaaattggattcctaggtattttattctctttgaagcaattgtgaatgggagttcactcatgatttggctctctgtttgtctgttatttgtgtataagaatgcttgtgatttttgcacattgattttgtatcctgagactttgctgaagtttcttatcagcttaaggagattttgggctgagatgatggggttttctagatatacaatcatgtcatctgcaaacagggacaatttaacttcctcttttcctaattgaataccctttatttctttctcctgctggattgctttggccagaacttccaacactatgtcgaataggagtgctgagagagggcatccctgtctagtgccagttttcaaagggagtgcttccagtgtttgcccattcagtatgatattggccatgggtttgtcataaatagctcttattattttgagatacgtcccatcaataactagttttttgagagtttttagcatggagggctgttaaattttgttgaaggccttttctgcatgtaatgagatgatcatgtggtttttgtctttgctaggcaataattaatagcctaccaaccaaaaaaagtccaggaccagacggactacatttattgattatgttcactgatttgtgtatgttgaaccagccttgcatcccagggatgaagcccacttgatcatggtggataagctttttgatgtgcagctggattcgttttgccagtattttattgaggatttttgcatcgatgttcatcagggatattgggtctaaaattctctttttttgttgtgtctctgccaggctttggtatcaggatgatgctggcctcataaaatgggttagggaggattccctctctttctgttgattggaatagtttcagaaggcatggtaccagctcctctttgtacctctggtagaattcaaccatgaatccatgtggtcctagactttttttcgttggtaggctattaattattgcctcaatttcagagcctgttattagtctattcagggattcagcttcttcctggtttagtcttgggagggtgtatgtgtcgaggaatttatccatttcttctattttctagtttatttgcgtagaggtgtttatagtattctctgatgttagtttgtatttctgtgggatcggtggtgatatcccctttatcatttttttattgcatctatttgattcttctctcttttcttctttattagtctttctagcagtcttatcaattttgttgatcttttcaaaacaccaactcctggattcattgattttttgaagggttttttgtgtctctacctccttcagttctgctctgatcttagttatttcttgccttctgctagcttttgaatgtgtttgctcttgcttctcttgttcttttaattgtgatgttagggtatcagttttagatctttcctgctttcttttgtgggcatttagtgctatgaatttccttctacacactgctttaaatgtgtcccagagattctggtatgtttgtgtctttgttcttattggtttcaaagaacatctttatttctgccttcatttcgttatgtacccagtagtcattcaggagcaggttcagttgccatgtagttgagcggttttgagtaagtttcttaatcctgagttctagtttgattgcactgtggtctgagagatagtttgttataatttctgttcatttacatttgctgaagagtgctttacttccaactatgtggtcaattttggaataagtgcaatgtggtgctgagaagaatgtatattctgttgatttggggtggagagttctgtagatgtctattaggtctgcttggtgcagagctgagttcaattcctggatatccttcttaactttctgtctcgttgatctgtctaatgttgacagtggggtgttaaagtctcccattattattgtgtgggagtctaagtctctttgtaggtctctaaggactcgctttatgcatctgggtgctcctgtattgggtgcatatatatttaggatagttagctcttgttgaattgatccctttaccattatgtaatggccttctttgtctcttttgatctttgttagtttaaagtctgttttatcaaaaactagtattgcaacccctgcttttttctgttttccatttgcttggtacatcttcctccatccctttattttgagcctatgtgtgtctctgcacatgagatgggtctcctgaatacagcacactgatgggtcttgactctttatccaatttgccagtccgtatcttttaattggagcattcagcccatttacatttaaggttaatattgttatgtgtgagtttgatcctgtcattatgatgttagctgcatattttgctcgttagttgatgcagtttcttcctagcatcgatggtctttacaatttggcatgtttttgcagtggctgctaccggttgttcctttctatgtttagtgcttccttcaggagctcttgtaaggcaggcctgatggtgacaaaatctctcagcatttgcttgtctgtaaagtattttatttctctttcacttatgaagcttagtttggctggatgtgaaattctgggctgaacattcttttctttaagaatgttgaatattggcccccactctcttctggcttgtggagtttctgctgagagatcagctgttagtctgatgggcttccctttgtggctaacccgacctttctctctgactgcccttaacattttttccttcatttcaattttggtgaatttcacaattctgtgtcttggagttgctcttcttgaggagtatctttgtggtgttttctgtatttcctgaatttgaatgttggcttgccttgctaggttggggaagttctcctggataatgtcctgaagagtgtcttccaacttggttccattctccccatcactttcaggtacaccaatcagacgtagatttggtcttctcacatagtcccatatttcttggagggtttgttcattactttttactcttttttctctacacttctcttctcacttcatttcattcatttgatcttccatcactgataccctttctttcacttgatcgaatcgactactgaagcttgtgcatgcatcacgtagttcttgtgccatggttttcagctccatcaagtcatttaagatcttctccatgctgtttattctagttagccattcgtctaatcttttttcaaggtttttagcttctttgcaatgagtttggccatcctcctttagctcggagaagtttgttaatgccgattgtctgaagccttcttctctcaactcgtcaaagtcattctccgtgcagctttgttccattgctggtgaggagctcccttcctttggaggagaagaggtgctcgatttttagaattttcagctttcttgctctggtttctccccatctttgtggttttatctgcctttggtctttgatgatggtgatgtacagatggggttttggtgtggatgtcctttctgtttgttagttttccttctaacagtcaggaccctcagctgcaggtctgttggagtttgctggaggtccactccagaccctgtttgcctgggtatcaccagcggaggctgcagaacagcaaatattgcagaacggcaaatgttgctgcctgatccttcatctggaagcttcgtctcagaggggcacctggctgtatgaggtgtcagtcggcccctactgggaggtgcctcccagttaggctactcaggagtcagggacccactggaggaggcagtctgtccgttctcagatctcaaactccatgctgggagaaccactactcttttcaaagctgtcagacagggatgtttaagtctgcagaagtttctgctgccttttgttcagctgtactctgcccccagaggtggagtctacagaggcaggcaggcgtccttgagctgcagtgggctccacccagtttgagcttcctggctgctttgtttacctactcaagctcagcagtggcggacgcccctccctcagcctcgctgccgccttgcagttcaatctcagactgctgtgctagcaatgagcgaggctccatgggcgtgggaccctccgagccgggcgtgggaccctcggagccatgcgcgggatataatctcctggtgtgccgtttgctaagactgttggaaaagtgcagtattagggtgggagtgttccaattttccaggtaccgtgtgtcatggcttcccttggctaggaaagggaattccctgaccccttgcgcttgccgggtgaggcgatatgccccaccctgcttcggctcacactgtgtgggctgcacccactgtccgacaggccccagtgaggtgagcccagtacctaagttggaaatgcagaaatcactcatcttctgcgtcgctcatggtgggagctatagactggagctgttcctattcggccatcttgtaacttccccacctgctgtttttagtctccgttcttatgtcttctaatgtaactctgtgcttattaccatgaaatgtcttgcctgttatgtagtcatcattgactacttatttgtcattcccaatggaaagtaagccccttgaaagtagataacatgcatttttcagatttgcgtttctagtgcctttccctggtgctcattacttaacttttaatggataaatgattccatatggaacacaggatgaaggaaaaagaacttttttcctaacaccagagatcctacacattctggacgaaatccccctttctaatcttacattctacaaactctccaatttgtatgctttcttttgcgaaactgagctgcttgaattttctccttatatattccatgcttgctgttgccttgcttttgattgcacagtccctagcttggaaagtccctgattttccatgtatcttaatccagtctcagaatcacctctaagtcacttgattcatcccccagctgagaataatgacagcatcttctgtactactctttaatttcccggtctttgtctgcttggtattataattattttgggacatgcttcatttctcctaccagtgatggtgcatcctgagagcaggatacatgccagcttaattaatatatttcccatttaacatgacatagtgagttacccattatagatattctaacattgttgtgaatcaataaatgtaggcaatagcaaagtaactgagactcatctcctttatagaccttaaaacaaaaaaggaaagtgagtatctattatattatagaaacttagttctgcttaatggaaggagaatgaactgaatgacctctcaaatttcatacaaaccctgattctaggaagtggagggactattttaagggataattcagacatttacttggcatatattaactacttcatcaagagatgaagagatgaagatgatggctcagatgttggctgtgcagactcctatggccatagcctagctgtgtgaggccatctacctttctgggcctcagcatcatcttccattacatgcaggttacatttgatcatttcagaggtgctttttccagttttattttctatgtttcaaagtttgctcttctcagtttttgagcctaatttttaaaacttgctttatgtgtttctttagtttctactcttttttttccactgttttatattgtatttgtgcacatatgcatggatatttagactttaattacaagtggagtcacagcttaccctgtgctgaattctctgacttcatatgagaacttcctgtgagacagtctctgtgtaatggtaagtgttctcttaggcttttcagtcatttctgaaaggctcccagggaagtcgagagccacagagagggagcagactgtgcctgagagatttcctgctcatataaattttaaaacgctgtattggtttcttcatgcattctcttgacagtgacgtaagtgccgatgcatttcctgctcagcagaaatttaatccaggtgatgtgctggcggacatcaccattaccttcaatttctattgggaggagaaaacaatgacacatgaaatgccttgaagaaacttacaaagcttttcactcttcactctgaagaattcagcaaccactctgagacttcagagtcagaacaaaatattttcatatgggaaaaataaatcctggcttagggctctctggtattaaattaaaataaaaaacctgcaataaagactaggctgtcacactgatgtccagtggatgattgagaaattatccaagtacaaaagagatagggtagcttagttcggagggtactgaatttcttgagtcttgctgatatgattctttttagcactgcttttggtttgcattttaaaattgatttggctaaatgacccaccaaagtcataaaactaagctcattcgtggcatagtgaacactcccagtcaaggtttctgcaaccatacccaccttatgttgaagactttttagttctaaagttctgtttctaagataccctgagatttcttgggattttatcatagcagcattgaatgttgaaagtagctgcagaaaactccccttattggtgaacatctgccaggcagagttcaattctgcaagtcagttcctcagctatctccaggatgccacaggaaacccacagggatgtgcacagccccttcttccatagactcttgagaattttttatgcttttggggaatccaaatcatcttgctgagagaggatttaacatcctgtagtatatgtaatgggtagttaatttcagacatcacttacaagccacaggcaaacccatggcctccttcacatgtcttctcatgcctccttttttttccacacactctttaaagtacagttcttatttcataagaagctttttagattttttaaggggtacaatgtttgcttctcttttctttctcctgtctattacgtttttttaccttcctacttcctctctttccctttcctctctttcttttaggcatcaacagcatccagcaggaggaccatccgcatgtgcccaaaggctcaatgaggtagagccaccttgttggagctagcaactctttccctgcgctcgcctctcattgccacagcgggctgtgcttaggactttcatgagactcttacttcagtttatggtacagtggggaaagtgccctgtgctcagtcaagtagttggggctcttttttttttttttttaacataacacttttagccagaatttctgggtttaggtttataactaaaaggcttaattaacatgaaaaacatttaatatattatgaggctgaagagatactatatttttgaaaaactcccccttactccttgccaccgaaacaaaaatcttttgcctgccctcatttaatgcatgatagtcaagagcttaaggcatgcactgttccctgagtccactggggtgctcatgtttcattctccaacctgctcaggatcccagctgaaggctccactttcagcctttctgcacacacaagcagccccatgacttccctcccacagttacactaacacctgcagtgcacacacgccataccaggcagcagtgctgtgctaaggggcacgccaggggtggtacaccaggcacaggcaggaagggagtacactgtcgataataaaactgattaaaatcctacttttattgtcaccatgtgctgcaattctaaacaatgtcagtggctaaaatatgtctcctggcagagtgagtggctcccatcaccccctccttggtatgtccttccctggcaccttcagaggagaagaggaaaatcatagtttcgtgtgtcttttaattttcttgtctctctctctctcaaagtctttccctttgctccccttccctaccctcaaaaccataacctacagaactgtcactttgttagtgtcttccctggggtagaagagccacttggagtgtccatagacttatgaagccctttgattatcaatgtagacctcatactccaccatgctggcattttctatatcataccactgtcattcaagtgactttggtcagaaatatgaacttggttttctggcctctttaaataatcctagctgagagcagccctgcattttgagatccagatgaatgcagacattaacctcattcgtacctggtacagtagggaactcagcattattcactgcttgtctgggaattcaaaggagttgtgttcccctttgcattatcagccgatagctcccatatatgttgtgccttttccacattatatagttgctggttcctggcttccaaaatacgaacagctcaggtttgaagatgtttttactggagattgtgatggaagatagtacataaaatttagtccacctggacatttctcccaatttttttttttttttacccctacagggcttagtatcttatgaccctaggctagaagaacagaaccctttttctccctcactgagttcccctttacccccaggctctcattaatttcttactcagaaaattgtagacattttcattttatcctgttctatctccactgtccctaaatgtttattgattttttgagatgaggtctccctctgttgcccaggctagagtgcagtggtgtgatcttggctcactgcaacctctgcctcctgggctcaagtgatcctcctgcttcagcctcgcaagtagctggggctacaggcatgtgccaccacacccagcaaatttttgtatttttagtagagacggggttttaccatgttgcccaggctggtcttgaactcctggactcaagcaagcaatccacctgccttggcctcccaaaatgctgagattacaggcatgaaccaccacaccaggccttttttttttttaaaaaaaatactcattgaagcatgatttgaaaactaagaaagcttttttcctggagaggaatttatctgacatctctttattttattttcctcaaattgtatttccttctaattctacttaagtctgaatctctttagtactcacattaacagggacaaaagccatgttggatctagtggcagcattgattattgaagtataaaagggcaaaattgtctactcttataattctctgaaccctactcttaataatgacctctttgtgcacacatttccaaccattctccatgggaaagaagaagagagagaacatttcttctgtagtgaatgcaacacttttgtttttaatgggatattttcagttctccttcgtagcagctcattttctctgtaattttatccagtttatttatatcacttttgttcttcccgtccttatgcctataacctgtcctgtaatccttgaaatgtacattttctagttctggatcctgctgggttcttttaacttatactatacttagaaatatatatacttatatttgtgatataaacatacacaaaagtataaaaatgagacacccatgtaatatgaacagatgttagcagtttaccttgtttttctctggtttttctttttaaaagaaataaaatgttgaagatagccctgttgcagtcccattcctttttcatttcctgctatccttcccagaagtaacgagtatcctatttatgtctcctctgtatgattttataatctgacttcatatgtatgtagctactgcagtacataggattattgcgtggggttggaattattgtctctgagtctacagcccttgtgcagtatctatcttttcttgtcaaccttgtttctcccctccatagccctctgtggacaaggaggctagaggaagctagtgcagaaggcaccctgcccttttctgcctccttctttctcctggaactttccatctgttgtactgtctgttctcacgtgtaccacaccatctgactctacttccattctctttttcttcctttattcttggcaccccagtgttaaatcacatttatgtctatttttggctttaggattaacacaagcttgatttttctctgccattatttgggaacaggtaaaatgatgctactgaaaatctgagaaagaaatgtagtctaatgactttcaattatagaaacatgcctgagggaagaaggggcagagctaaatgttttggaggatctgacactttacagtatcagatatggattacctataattctcatgtttgttgtttaagtgtagtgctaaaggcacttgccaataggttgatagtgatctttcacaaaattagtttgctcaacaaaattctatttatccttctagaaattggtaagatctcattttatggcccatgcagtccagagatttttacatttccctttaaattatccatagcaaagtttagtgtaaacaaaccttttccttctttcatttaaagtacattattttcctgtcatgtgcaagacacactgcgaatggagaaggattggggctatgctctttggggatataccaaatgactatgacaagtatttgggggctcagaggagttgatagtcttcagttggaaaacagattacttactcaaatgttactagggagaagatttattcagctactactagggcaaacgtctagggtgggagaggaaggggaggagagagatggcttattgctgaacatgcatatgtatttaagggactatgtaaaggactgatttttggcatttggtggacattcagaatccttgagtgtatgtttttgcagtgtttgagaaaaagaatttagagatgaactatgtatagtccagctgtcacaaattttaattctattattaggtcacaattacctttcatttttctaatagatatctctacatcacacattccattatcttttcctgacctcccaaatccaaataaacattaaggagctaagagtaagaatggaatgaaattgcctaaaatctttatcaactgtggtcagattacacctttggcctttctaaatgcccttctgtgtggattgtcttaagattcttcttgttctggaatacagtggaggtctttaaccatcttcttttcatctgcaaaccctcatgtttgttttctctgcatgggacccaggacttcttacctggggtcaccactatcttcctcatgattaaaaattaaaattaggacatgctggcaccacattagtgaaatccctactctgctcccatgagaggtgtcagcaggtggagtaggaggagagcgtgctttataaatggaaatggagcttttgtagcatctattcaatctgacatgtttccagtttaccattaagtctcttctcagcatactttcctcccctgtcatttatcatttacacatacaaatgacaattttctattataccaataagtgctgagaattaacattttagcctctttttccagttttagaaaagatcccagaacactgggacctatgtttgcatatggtaaagaataccatctgttttgttttttaattacactttaactttttttttaacgtcttaacttttatttaagaaaacaggctagttattattgcacctagaaaaccacgaggggcctaatgagtacactgatgacatatctgttgatatgtcatcttatctaaaacataaaattttagattaagaattctagccggaagtgactttaaaatgttctaaaatgaagttttgcattttatgttttagtaaatgtaaaaattttgagatattcagaatgacacttaaaatgttctcaaatgacaaaaaatgacaccatgtatttcatgttgtagaagtggtcaaggcaatgagatcaaacccagaggtttttgatttttgtttttttcctgaagccactagtgttttggtattgactatctatgacagcaggataagtgtgatattcgataaatgaatctgttttccaggctgaggagaaataacatgtaaattcttgaaagtcaatagagtgtaatgaaaagcaaaagcaaaaaaaaaaattgttgggaatcaggaggtagaaaggtttattcaagattttccacagagttcagcttaataatgagtttctgtacctttttggttttatagtataccttatttggttatagtctgttcatctgtcatatctagggtttgttacttttctacctagttcctttactttctgatgagttacagtacttaagtatctaatatgtgcctagtaccatgttggcagggcttgtacatgtcatctcatttaatcatcagcctagtcattcagcacccttagaacaggggctggaactgtggctccagctcatcgcactgaagcaatggttcccaagtgccagtgtgcaggttgttgtccctccgtcattactcttttcccagtctatgggaaggaatagtaaatgggcctgttgtaaaattttcagaaagttaaagatgttatattccattattgttttcttcctttgaaaaaaaaagttaaatgctatttggttcataaaacaatagtgatagcagaaagcttttttatatgtcccaccttgtcagagtaaaacaattgcatgtctttgttggttctctccttctccccttttgaaacctgtttatagatctaagagctttacaacagctggcttaaaaaatactgtttcacatgaaattgtcatgtgtgcatgcccattttaagagtaaagtttttaaaataggaggggaaggaagagggtttttttagatatttaatatatatttagcagttgtttagggtataaatttgatctattggtaatgcaattttaaatgctgcagcttcattctgactgagttttatcttcattgttttttttttctaactttttttaagagatggcatctcactatgttgcccagtcaggccttgaacctctaggctcaagctatccttccacctcagcctccagaatagctgggcctacaggcatgcaccacagtatcagcttgcctttcattggcttttaacctgtaaatatttaatatagcttttggcaagaaatattctttaagaaattgtttttattccctggaaagtttttcttttccacttttcactaactaaagccattgtttcagaatcaccttgattcgtttttgttggtcctcttcaatgctgtaatgctttgctttactttttccttagtgatacaaatgaagttgacataccacctaacactcgagttggcaccaaacgctatatgcctccagaagtgttggacgagagcttgaacagaaatcacttccagtcttacatcatggctgacatgtatagttttggcctcatcctttgggaggttgctaggagatgtgtatcaggaggtaagaaacagtgctgtctttgaaaagctactattggagctactataaatcctttctttctgatcagaaatcaaagttatcatactgtctataagatctggttttattttcccctttatttctgttgatgcagtcatagtgcttccaggaaattatattcgacatcctagaataatctttgactgcttccttcctccagctgccactagacacactgtcagcctaccctgctttttcaagcatcactgttttctgctctgtgtattgtcttatttctgtcttgggttcttcctccagcagttgctcgatgaaatcaaacccccttttctgtccctgccagtttattctcacctagctgctgggccccatccccaactccattccctgggatttcctctgcagagatgacagtaggccataaatgtggggtcggacacccatttcttaccttctgtattttttataaaacttccccataaagcaatttgaaaacatcagttttttatcaaaaggaaattaaagtatcagagtattatttttttatattgttttttctacacatatgaggattccctagtaaaaacaattataatgaacaagaagacatatttaaatattcagaagtattattacttgtactattttgattgctctacagtctgtcttcgagtagattctgacaccttttaggcaaggagctgaatctttggcttttctgtatcaactcttctgtatgttattccatggttgtgctcattaaaaaaccttgatgctgctgctgttcctcataatggccaatttaagtctatcttcatgaaaacatgagcttgctgaagattctgaaagtgcagcatgcacttaactagtactgagatgtgttcttgttcctgctatttatctgtgatgccttggacaggttataaacttttctttgtttcagagtcctcttaaagatgaattgaattattgtatctgcttctgtggttgtatggtttcaatgtaaagataatgagaactgcctggcacataaatagcactcaatacatgttagctattattactattaatacttttcattttggttggtagagccataacatctttaggttcatatttaaatacaaagaagaaacagttaatcaacctgcattcacacttcaatagaaagatcattatcagtggcacagtgccttctaataatcactttgggaattctgaacctgttttaagaaatttgaaatagaacacatactctctgaagtgagggaactattttgtgcaaaaggaaagttaatgcaggaaattttctctaaccagatattgaataaatttctcattctaagtgtaaagaagaagtaaccaaaaaatttaacaaattgtctatgccttgatttcacgcattataaagagtagataagcctcacgtttgcattcccagcattttgggagtccaagcggggaggatcagttgaagccaggagttgaggactagtctgggcaatagattgggacccagtctgtatttaaaaagaaaaaaaaaaaaaaaacaagtagacgagccttttaaaaaataatatgcttatacttaattaagatagctttatggaagttgaaggtgtagagaacaaggttatttttctaattatgttttcttgaacatctaaaacaaacagggctacaggaagcctatatttgaaagcctgtgggccaaatacaggagaaattattctcagcttaaaaacaaagtagctttatataaacagcagggtattaattgctgtgctagggtattaatttgctttgctagggctgtctttggatgtggagatttgctataatgttgccttattgttagaggtgttggagtccctgctctgtcccataccaactgaatggacttgggcaagttacttaacccctgagagccaagtttcctcatctgagtagtgtggagaataatgtcatctcagaaacgcatttgtgagaatttaataagataatttatatagcatacctgtttccacaactgggatagaggaagctctcaataagcgattttatttttccagagaggcaaagcacacaaaattctattttctaacactttatgaagatattagaagttttttgggcttatctttctagtccaggcccttctgggtgaaagagacacatccagatgtaggcctttccatcttttaaaggagaagaaagacagaaaggtttgaggtttcaaacagagttaaatggcagctaacaggaaattttgaaaacttgattacatgacatggagaaaagaataaggcctattattcaacagttagatttgagtaattcataattttaagtggtgagctctgccttcgtctgttgtagtagatacacctaccccaccccatccatcagtccatccaccagcggaaaataggagatgggttaaagagatgtgggctttgccttcaggctgtttccagggccatggtcctgagaatgagaaagggagaaagaactgaaatgaagcagagcacatcctgcgtgttaggccctgtgcttttcttatctcatatggaggtaaaacacagtgaaaggaaatattaacatagataatacatataattagctctgtggtcacagcagggcacaggacaaatggtgagttggaatggtctgaaaaaacttctgaaccttctggtccttgatgattttataacagatttgagtttacaagaaagaacataacacagaccccagattttggcagagtaagcccccagtgaatttaacgatgtgatatataatctgccaacttgacggcatcatctttttcagatgaaaagcaatgatatttctataaaagatgatttaggatagggaggaggggtgctcccaaaagattgttcagagcagcagcctctaatgtaattattataaggagttaatcttaagaaggtgaaaaagaagatactagaagcctgcatttttaaaggagaagaggaagaaggtagaaattaaatactaggaacaataaaatgaaagtttagtgtgcatttttatgaagatgctatagatttatatttcttttcttttaacaatacatattttttctaatagtaatgtattccttactgaaaatttggataaatataggaaaaaaatcagataatccttgaacctaaaaaattcatggttaatatttttgggtgtctgtaattttctaaatttttaatgtgcaaaaccacattcctacaattaagcagaaaaaatgtaaatctgacattttgttcaagtaggatacacttctgaatttattatgatattcatagtttcatactatagtaatagaaacagtcacatgtagtatgagttcaggatatgtcttgcagatttgcattgagatttaatatagatttgtcttttaatttgttcttcataaaaatggaaataaatttaagatgcttgttttacttagcttttggaaattaggaaagaaaggcttgaagacctatgacaatatttttcattgggctttgtattcattttttctaaattagattaagtaccatttgggtaaatatttttcaagatttattttgctatttttctgcctgaacttgtctgtaatactgatagcacttttcctttgagaactgtgttagacttttatttctacttcacagaaaataataataataataataatagtaacaacatatttttaggtatagtggaagaataccagcttccttatcatgacctagtgcccagtgacccctcttatgaggacatgagggagattgtgtgcatcaagaagttacgcccctcattcccaaaccggtggagcagtgatgaggtaaggcttgaggtaaccatgtggctgtgactgacttctaaatagacttttcttttttagctaaaattccacatattgattgtaggaattcttctttttttgatggtgatggtgatggcgcctcattgcagtaatttatatgaagataagtgtagtatgttaaattacttgttctacttttccaattttattttgccacttccagaatatattgagtgagttggtcagtgtttagcctgcataacaaataacattattttctttatttataatgtcttgacatttgcataaaacctattatttctctgtgtgtgtttttaaagcatcataatttttctctgtgacaaacccatgtacagcattctcccattttgattagagaaaaaaagtaggcatgttaaagtgatacaggttgacctagttaagatgcctgactgtgctgggtgtctttgttaataaggatgacgagatgtgatttgaacaaatccaccttcagcttggctctaaggctgtagtggtgaaacctacataggtctggaaagcagcggctagtaaggaagaaatgagtcttgcctttcctgactcctcctcctgttccacattcctctccttccaccctcgcagccttcaaactcaccatgttctagagttctctggcagactggaatgttcaagatgagtttgaagcaccactggaaaaaaaaacaggctcttatcaaacgtaccaaagcactgcaaaggggggacagagcactatttctgaagtgtaaaagccatttaaatataatctctgggccgggcactgtggctcacatctgtaatcccggcactttggcaggccgaggcgggtggatcacttgagtccagaagttcgagaccagcctggccaatatagtgaaaacccatctctattaaaaaatacaaacaatagcctagtgtgttggtgcacacctgtattcccacctactcgggagattgatgcacgagaattgcttgaacccggaaggcggaggttgcaatgagccaggatcatgacactgcactcgacagaccgagaccctgtcttaaaacaaataaacaaacaacaacaaaaacaaaaacacctttggctcattggttttgtgtctagttactaaaatgctaaataatatatacgttttccagcaagctgtgcagaaagctttatgagatgctggagctctgttattgtgggcttttggtgttacttgatatctcttcactgaggatttcttatgaagtgaaattgtacttttcaataggaagaccaataattgatgtaccacaggagaaagttttagtgatgctgtgcacaggtcattaatcttgttaaatggtgcagtgtgatgctattactgcagcagacagctatgatttaggaataactgtgtttgtttgcatagtatggaattagataaaagattaaaacttatcaagtgttataaacaatctgggagtattgagtggaatacagactccctgggtatttttatgtttgcttaacactaatttcaaagacacctttctacaatcagcagaaccacctgcttgtttctatcacaaagaagacatgaacatctgttttagtcatatataattttgcatgaaaaaagcttacagaattttacttctacatggttttaagggtaccttttaaaaatatattcaaacttaatgaacctaaaactaaaaagctacattgtaacaggtgccagccttgcagatgatacatttttctaacatttctcttcctcagtgtctaaggcagatgggaaaactcatgacagaatgctgggctcacaatcctgcatcaaggctgacagccctgcgggttaagaaaacacttgccaaaatgtcagagtcccaggacattaaactctgataggagaggaaaagtaagcatctctgcagaaagccaacaggtactcttctgtttgtgggcagagcaaaagacatcaaataagcatccacagtacaagccttgaacatcgtcctgcttcccagtgggttcagacctcacctctcagggagcgacctgggcaaagacagagaagctcccagaaggagagattgatccatgtctgtttgtaggacggagaaaccgcttgggtaacttgttcaagatatgatgcatgttgctttctaagaaagccctgtattttgtgattgcctttttttttttttaagatgctttcattttgccaaaataaaacagataatgtggatggtttaagggttatagtattatagtttaaataataacaacaaaattcttcccaggaactctgctggaaggtaaattaaaatacttgtttttccattggtaaaatattgttgcactctgtgaaccaaaagacagtctaagttggaggacatagaacggaactcatcttaaacatactccccaccccgtcttggcctcctcagaccactttggccatccctgcatttggggccgctatggtaatgtgaatgcactgggtacaaacaccgcctgtctaggaccacatttggaattcctgcaggtggccttttgcagcttcaggcaatatggaacaaatgaaggtttatgtgactctaatagaagtaattgttgataggtgttcttcagatccacttctgtttctgattgagttaggcatctctttcatggtaaaacccttttcattaaacacaaagaaagctttttttttttttttttttttaatgtgcagaggattgacctgtgcatgcttttgatctctcattcaaaggatcaatattaaataaaattgtcatgagctgtgttgaagacagggtgctttcaaatagaggtaatttgctcttgtgttgtaagaggaacatgtcaacaaagatagggaatgagggtgatcgtgcagatggcttgtatcttatatatgcaaaggagccaatctcagaagcacaaagaaaaaagtgtgcataccttattttgtacagataaagatgatgtctttttgttattgtctgtctgttttgtatgtgtctgagataagggatagagaggaaacatccgtcaggctaatttaactacattttattttaaaaatagagaaacataacctctagatgggacagcagaggacagttagtagaggccacaaactgttatgggctgctgtgttttgttctaaaatcaatatggttggagcatgtatatcttaggtgatcatttcacatcttaggaatgcctactcattttattttattctagtgatgctcaattcactatttaatttattatattttctcttctgtggcacttatacaaaatatctcttcacctacttagttctacagggttttaactttggagcaacatgaataaaatcatcgagaaggccaatattgtttagcaacatgaatacaatacagtttaaagttgtacacatcctgctcaactttattcatatacatttcctttctgtggttttcttttgcttcttagaaattctgttagtggttagtaaagaatttgaaagtactttctccttgctgtttttttttttttttaagacattcctcccagaatactccagggggcagtgttttataacacattttccccactgggtgattgaaggatggaggatttttgaaaatttgacagctacatgaaacatgagaaaacattttcctcacttctgaagtcggtttgcagctggtaacttgttcatccagaaaacattctaaagcaatgagactttgtgagctgtgcttacagtttgggagaatcatgaagattctttctatattttgcatttacttcccagtgcttcatagctgcattttgtttgtaactaagacagaagaatttcgtaatccttgaaattgaaaaaaaaaaaattgtgtttttaaagagtgaaaacagttagaaaacaagtagaactgtaatcagaacgctgcttcaattgatattaaaaataacctcaataataatgtaaaggttcctttctcttgtgtcagttatattcttagggatagcctagaaggaatatatggttagaactaagtgtgactaatcatctgagccttgaagagaaacttcagtgcctctaaacagatcatctacaaaacaacaggtaaacatttatgccagttaagtgggtcatgtttt

SEQ ID NO: 16268 - DNA, 128175 bp, Human
gtatttatcatctattttattttccagtttgcattggcttttctgggtctttctacaactttaattgtaaattttttcttttatatttttatcatggcactcaaactcagaaaacctgttaaggcaactacataatgtgatctaaaaatccagttaacatattgctatggaaaccaggaaatagaaacagcactctaatcattcctttagacaactatggctctgtgtgtgtgtgtgtgtgtgtgtgtgtgtgtgtgtaaaactttttaaattcattaatttattcatcttttattgaaagctgttactgaacccaaaatctgtaattgatctgtccataaataggcccagtgccttattaccagtaaattagtgttttttaatgagctatagtcattgataaattatgccatgccgtatcaggaaatctccagtcaggccgcgttgtttatttagcctgctgaggcctcttggtatggtgtgaaggacacctgactgggctgaaagctaagttctaactttgcccctcttactaaccagctatgtgactctcctgggaacttttagggactcagtttctttacctgcaaaatggttcaatgcaagactttagtaacgtaatgggaactttccttttccataaaactggggaatcaagaggtaatctcttttgaggactgaaatcactcttatgtaacctctggttacattatcatttccaagtgcctggcacttgggaaatgataactattcttactacatttttctatgtttcattctgtagtaaataagaactgaacctgcatagtaactgttattttaacccatgactttcaataacgaagatatctatgtctcattatctattgccatgattgaacaagttggtatgagagccggaacgaactcaagttctaaccggcaatgcccgttccttagatcctattacctttgagtgttcatttactcttgtaggtgccaatttttatagcgaaatacaaagttatcccaacacaattactcctaatagagttcaccgaggccccaaaagctcttttttaaaaatcatcataagatttcaacattcaagaattaaacttttgttctgttgtgcttattcatcgctatttgcccagttatttaatcagcctgcttccggctatggaaaaaaaaaaaaagaaaaaaagaaatggaagtctcctcagggttaaactcctctgttgttcttccttgcagaaatttgagttattatagtagaggataatcgttgcataatgaaatcattgggacaattcgtccatccacttctacctccgcctctaacaatgaactccttgtttctgcggtgcccaaatctctctaaacccgggtgggcgcggggcggttagcggagacgtgggagaggccgagagcaaagctcgcgcccttcccggggtcagcgagcggggtgccaggagggtgcgcgccctgcctctgagcccggggtgacactcgcctcccaagcgccaggagggggagactcggtcccgcttatctccggctgtgctaacttcagactgcctgagctgggggaggagagcgcgcagccagggcgagaaaacttctccacctagaaagtttcaccttgtcgtgggcggggcagaggcgggaggaaacgcgacccccgcggggccaggcgcggcgcggacggcaggaagggcgggggccgatttccctctgggtggtgccagtccccacctcagcggtcctcggaacccgcggactaggggacggacagcacgcgaggcagacagacacgtgctggggcgggcaggcgagcgcctcagtctggtcgcctggcggtgcctccggccccaacgcgcccgggccgccgcgggccgcgcgcgccgatgcccggctgagtcactggcagggcagcgcgcgtgtgggaaggggcggagggagtgcggccggcgggcgggcggggcgctgggctcagcccggccgcaggtgacccggaggccctcgccgcccgcggcgccccgagcgctttgtgagcagatgcggagccgagtggagggcgcgagccagatgcggggcgacagctgacttgctgagaggaggcggggaggcgcggagcgcgcgtgtggtccttgcgccgctgacttctccactggttcctgggcaccgaaaggtaaaattgcagcccctttcagatccagtacccaatccctcgcctcaggggttctgctttctttgttcccctaagagacctgactgctgttccagggggcaaaaccacgtaggtgggctagagtttaggggcttcggaaactgaagagacgtggccacggcgaggacgaaactagaatggggcttgtctttttagggggttgcttctgatggccacctgtatgacttaggagggagaggggcgctgggacagtgggtgatgtgtgactgttacggcccagcaagttttaaagctgggatctgactcagcccttacaaaagggatccggtcatcctcgtcccaccgtgatgcagctggcaaggtttgagccgagctgtttccttgttcccagccttgctttatctgtgttatgttggggtccttccaaggggcaggtgtttctgtgaaagtctgaattcatttctggcaatcacgcggggcttgtgatccatcaattttccatcgtaccttatctctttctggggcttgtggtggacatctatcttattaggtgaaatagattataaccagaggctgagcgatgtggccagtcgtagtgctgacccgataattaaagcaccagtgaaagtactttccctgactattgtcaatgcagaatttactccgaagtacggtttcccattcatatctttcatgttttaaaagagccatttgctaatttggcagttggagagggctccaatggctcacgcatgaatagttgcccagtgtattttaccttatcacagttttatgttcaaaggagccctcgggcagaatgaaatattgtcaactctcttaggcaaaataatcaagatactttaattgctatgttaagatggtccatgaatgtgagaggattgtaagaactgacgttggaggcaatatagactatctggaccctctcttgaattttaagaagactgttcacattctgtagctttgggtgggggtttattctgtcgctttcatcagccagacacatgcacattgccatgcaaatggattcagaaaaacattatattcccttacagctaaactattatagctgactaatgaattttttctgcatgaagatgatctgaaaatgatgtacatcatgtttctctgtgctacagggacataaattgcatttttatgtaaacagtgtaagtggtgcttggattatttacaggtacatagctttccttccttgatctaagctaattgagctttgttttgaacgtgtaaacttccataatggaacataagtgaggtactttggttcctatcatttgcaagtctgtggtgtattcaatgttcattctttttgaactgctgaataacagagggaaaatttacatcattcataagaaattttggtagtacaaaaatgtgtctgatagcctataaaatgtactgctgttttaaaaattctattccgttttcaaacttaatggtgtataagctatagttattaacttaaatatattttgcttttaacatgatggaatttgtggcatatagaagacagtctgccgactactgctttttcaaaattgctttgttcttgatacatggcagtaggggtttacattagatgtatactacatgctttcaaaattagttgatggagtttatcttcatgataaaaaatgtaccagattaatcatagccagtcaatacgaaagctcataactaatattttcactacttttaaacctataatagagaaaaatgaccctttgctaagcaggagaaatacccatattttataaattccttttaagactatgtaagtatatgccttgcattaatcttgaaatctttaaaaaaaaattgtcttaatgagggctagactaagaaatacatttcaaaaatcaatttccttagctgtttttaaaatagtgtttgaagtagcattagtcatattatccttctgcagatctacataatagtctcaaattaactttttctcaaatgtggtcatctcaaaacaacgtgaataactcagaggagctaacatcctctaactggcttattttctccaagtggctgcaccaaagacatggcaacacccccatggtgagcacagttcctcacacattcagattacctcccatttctctgtcctcttcctcctcaaccctttcccttggtttggtcagagctgctttcaaggccttccgtgcccccatttctccagcccagtttgctcgtttcttctttaggcattaggcttagtgattctcgccagagccatctacgctttcttttccgtggtctaaatccctaagatttccttggtctgctgtgtttattcataggatactcaatttcctcattgtgccctcttaaggggagaaaatgtatgtagaaactcaagtgtccggaagtgagccttcttttcctggctggtgtatgctgaaactagtgtttttgacaccaagcccttagggcagagtttcttcatgggttttgctcagtgcaaaataaatagtcacttctcagtaataaatgatagatacactgactaatgttagttcagaatcactttgatgatgtgttctcaactgacactgagttgctgctagatccacatttgcctgaccaaaaatagctaggacctataggtagagtatcatatgtgctaggtactacagcattttctttaaaagaaagaaatggaatctgcccttgagaagtttatgatctagatacacagacaaatatcacatattaaatgaacacaaattcataattattaagaggacatcacatgagaaacgctttcaaaatcatcctatttgctatgaaataatagaatttttttttaaaaatcaaagtttggaacttaaaaaccttaacattttcaagctgtttctgcatacatcacctttctgataccaaaacgaccttacaagataggcaagtctgataacatcttaacattcttatgttatagacaaggaaactgagcttgagactagctccatgctatttcaatagcaccataccacctttcctcagccatcaactattggaaacattttccatggaggcatcattagggatgcttaagatagtggtaaatgatgaatataacatatctagtccctggagtttttgtcaccttctctttctccagttctctctctcttttttttttttaatttcttttcttttctttttttcttttctttgtagtgagacataccgagaaaaggtttcattcatatgtgtggggcattctgctcctgttatcagattaagagccgtgaataattttgtaatctatccttctatcagaaagcccattctcagatatcttttcagctgtgttaaacaggttagtatattccgcttgggatttgtttcaataaaaacatccagtaaaatctgactactttgcttttcatgggacaaaatgaaaaaagtgcttttataagctgtaaaacttaattgagagaaaaaatcacgtgtggcatttgtagcaggaggtatgagctcagtgaaataaaaaagttaactttgtaatcacatacccaggtacacatatttctctctgtgattgcataaatgtgtgcaagtatgtttatgtaggttactcccattgattttaatttctataataaattatgtagctatagggcccacaggcgattatataatgggcaatagaatttgaaaatgtatctctcctaatataattaaggatagcaattatgaaatgtgcttagagaatcacaagttatcgtgaaagccaggttcctgtactccaagaatgtgaatgaggatttagtcattcattcaggacaattttttgacaacctacgaggcatagttctaaaatctggcatttccacagagtataaaacagatgaaaacctctaacctcatgacactctgttctattgagttggcaaacaataaagaaatacataactgaaatgtgttgtatgtcaggtgatgataatagcttcaaggtagaataaaatggaaaagagaatagtgactgtcaaggataagagagagtgggatggtgattgaaaaactcaatagtgaggtcagggaaggcttgtcttcaaaggtgggctttgggctagaatctgaaggagataaggaagtgagccaggcgcatatgaggagcacttctcaggagtgctattctcatcttgtttttcctgaaattgtgcagttcacagcttgcacaactgtccatagactccctgattttggagggagatacctgaatagtgcccctgtttttgtagggaaatacctggacagtgcctgccatcattagctaccatgttaaagatgaagatacaggagtggcccacatctcttggtttatgagacatggaagaagaagacccagagtgttgttttgtttttttttttgtttttttgttttgttttgttttgttttgttttgcatccgcctggtcccatcccatactccatcctctatcagagatattgctccattcagacaattttccttcttattttccacactgtgagcctgtcacagtgggatttgttgagaaggatacccatggcttttttcactgatcccttccatagtataaatctaaagacagcaagaggcagttgctgatggtgtgcagcttctgtctgctatgcacttctttctttccccctcgctctccttccttttcctttccagtattaagtcactgcattggattttcttcctcttttcttccttttcccttattcccctatttatatcctgtatcaagatttgcaaacaggtaacttaaatgaggaaaactaaccatttcactagggattgacaaactgcttaggaaaagcagaggggcagtcactgcttggcgtgattagagctgttgtgaggctcagtgtatggcatgggcccatgtggtagtatctttcagattttcaagagaagctaggactctcccaattttaaaatgttgactcagtgtctttaaaacaccatacagcttacagtggcagaaagtctgcaagccagattgggctcctgatggtcccaattgcagcagcatgcatggcccgagagccccaggactgcttctacaaaatattttattttctaaaattctcagaaaattaactaaacaaattttttaaaaccaatattttatgtcagttcctattggcacgtggttatttttctaaactcatcagcccacatactttacatcaaactatgtacatttctaaactaaagggtaatctagttatttcattcttaaactgaagtagtagttttctgaaacctgaatccatcatggctttatgcatcaatttcatttccaagttctctgattcaggataaactccccctttggaatattgtctttctctctctctctctctctgtctctgtctctggaaatgactgaacttcacccgttgttattaccctgccattgaaattcaaaacatgcactgccctcctggtttccagtgccctttaaaagcaatcagatcagtgttaaaatctatttttccaaaggaataaaagctcacaggttgtgcactaatttgtttcctttaatcctaaaatctcagtgaaatgcccaagctagcagccctccagaaggccactgtgttagaaagggagattatgtactgtatttcttcctactattttaaatgcaaatataataatatatcatgaaacagtgcacatacagtatacatattaagatcagtggtctattcctgttttgaaatggtctcctactccttaatagttggaattctgaggcagcacctagactctcaggtccaatttgaaaatgtatgtttttttttaaaaaagaatgacttggggaataactgtttgataagaccgtggaagatttctaatttttaatattttattaaaaatgtaaagaaagacattcaaagctgagacctttgaaataatatggtctttgcaagtcagagaaaaagagaagtggtaaatttattagagataggttgcctcctttgaggcctaatcatgtgggaaaggaaaacccagccaaggtttgggtccataagacaattcaacctagctttaaaaataggttttggctttgcttgggaccagcattgggaccagagtgtatctagaccagcattttagctattaaattttaaacctaggggtcttttaagggaaatttaatccatgtgtctttgattcactaaatcttaaatcattactcacaaactgtatgtccctctaagctctttgatgtccaagagatctctaaaattgtgtaaggcctttttgttccagaaaaaaataggaagttggtttttgctaagcgtcaataaacagcatcctcaaaaatctgattaggtctaaaatcttgcaaccatgacagtatggatgtttgaatgatgcaatgtgaaaattttaagcactttttaaagtccttgtttaccagtaatactcagttgtaatccttactaaccccaaggaaattattttgacacatttcctctctgttttgtaatataaatacaaagcccaaatatttattattttattctggcacatagtaggtactcagtaagtattttgtagagtgttgaatgactctttcttctgcccagaaacttctagctaatgtcagttcttctattcaatattgatatccatctgtcataccttggaataagatctattctaagtcagtgaccttgttcgacaaatttttaaaataagccatctaactaaatatatgacatttattgaaattcattttgcaccatgaagcaactgccttgcaaagagtgctgaaaataggaaggaatttctagactaatttgattaaatattcagttgttgccatatgctttctgaaaattgattttcccccttttactattcctgtcatccttcctcccaccttgacatgcttactgattgaaagctatgcacagaaaaagggcaggtcgcttgtatgtataagcaagagcagcaagtccaaacaggcttagaaaacgtaatgctataatcacgagttgtcataatataggagaggggagagaggaatactcagcaataagagtggtgttgggtattgctccaaattacatggatgacacatctttgaactctattgtgtcgggggaaaacaccttcttgctgtagttagatttcctgtttgtgaatgtgtattttctggtaaccagacttcctatatgaatttgacatagctttaagtgcatttcaaatgacatgattaaaggatggctgctttggagacagcagctccttctctcttaaagaaataaactatcatgctaaaatataggcattgagatctttcttgataccatattgtgaatttctaatggctcatcacatttttatcctcagaaaacctttcctggtgaaaagcatgctgttttagtatcacatttggggtgatggaattggcaatttcttatatcttgagggggcgggggggtaaaaggaaaattgtgttaatagggtcttaaaatagagattctcttaggttaacctgaagatttactaaatacattatcattacagcttgttttgacatttaattgtagatggcactgtatcagcactgacttatttatacagctttgtttagacatgcctaatttttatttcattggtggaaccaaaccatcagtaataaatcatatatcagtgtttttgtacacattcgtatttacatgacttttaaaattccaaagtaaaggtctcacaacttgaaaaatgaatgaatgcctgagtatttgaacagttgggaaaatgtagttcaatttaagaaagattttttatgacaattcttatgccatatatagaaaatagataataaaggagaaggcctggaggtttagatgggatattggatcaatgagcaaaggaaggggaaaggtgggcgggatatgctgaagggtcatgggcttgagtgcaccctaagtcataaagagggtgtcccattaagaatcaggctgcctgaattctaagtaggaaagaggcaggtcaaaatggtgtataggccaggcacagtggctcacgcttgtaatcccagcactttaggaggccaaggtgggtggatggcttgagctcaggagtttgagaccagcctgggcaacatagcaaaacccccctcttaaaaaaattacaaaaagtagctggacatggtggcgcacacttgcagtcccagctactcaggaggctgaggtgggaggatcacctgagcctgggaggccaaggctgtagtgagccgagatcataccactgcactccagcatgggtgacaaagagagaccctgtctcagaaaaagtgggggagggagggtatggaataaagtaaagctcatgggaaaatggtacctttaccattttcccaccttgggaaatggtgggaaaatttagacattgctttacaaagtctaaatttctgccaacttgtgttacatgtggtttgattctggagaaagatagactatcatctatccagtcctaaattgggcctcttagtctgtcctcccctcagttaccaggaagaatagcaggaatatgtcacagaagcagagaaagcttttattctgagtgtcagaggcatgttctaagcactctgttatctactcccaggcactctaaatgaaattccattttctctgaggaaatcaaaatataaaaagaaaactcaggcaaatttataaaggttttacaccattttcatgactgaaatattctagcatatctagctcattataatctataaattcctgttgggaccaaaagttatggccctaaaacctgttatctgtaatccttttccactgggatattgtctctggggatatatattagctttccttgaggatactaccttgaaaccatttctttggtccttgactatacaaagttcatactagcatggatgtaggaattgtatttttctattctaaatacgaatttagacagtgatataaagattcaaggaaagcttctatcaaggcctgccttcactacttgtcttttggctcctctgagggtcttaggtgagccactttcatctgattctgccctcacttcaggcagaattcatatggctccagccaatggctacactgtccaaagtgagactgtggtctcacaaccatctggttaatacaaagacagcaagccaatatgatcacttaggacctaggcaaacctttgggcttaaaatattaccttagctattgttgtttttaatgagtatcaaatagtatgatatttgtaatttgtattatgtaaagaagtaaccaaagcagagattgttgacaaaaaaaaaaacttcctcctaacataaatgaatatgcattttggacttttcaaaaattccctttctgtcttgtcaaaattaagatatttctaaattttatttcggtctcactaacacatacttggattattgttcattgaaatctgtacgtcaaggcccagtgattttaaacattcttttggtcttcaaagaacttaccaaaaaaaaattgttctttaaatcaccagaaaagtgcagataaaatcccagacagtttcattaatgacaatgaaaggtgacagcccttgaatctatgtcataagttgattaattactttccaaacattattaaagatattagacgaataacttagactggtatccaggatcaaggttccttcataatccctaaatgggttttaattttcagagttagatgatcattatatgtgatttatttctttaacatctttagactgttggctttattgaaaagagaggagagtatctgtttcaatgtgttttcttttccctgaagttattccttgcagaattcaataaaaccggttttgaaataaaaataattaaatgctggcattttctgttaataagggcccatagacctgatgaattatataaacattacaaggaatttaccactgagttcataattatgtaaccatttaatgcccaaacctgcctactgacagtgaagacgttcaatgagaatggacattgtgcattaggataaggatgacctggagtgaactttcattcttgttttggttctttcccattttgcccaattcatagcacctgattctcttaaccagcaagtctgtttgcatgtctccagtccaatttttcgccatgcccactgcagtgattccaaactctcaccatttcttaagctcttgcatcttttgggctctccttattctcagtataagatctttccttatagtttagagagtaaacacaagcccagttgtttccatgtcacccattattacctctttctgtctcaaaggatgaaacagtcttttctacctaagtcttgaccctgttgttccccacacctgtgagcacctcctccctctatcctacccaccttacaactcttcccgtgtttaaaatctccctcaccatttttcttttttaaaaaaattatattttaggctcagtggtacatgcgcagatttgttacataggtaaactcgtgccacagggtttatttcatcacccaggtattaagcctagtacccaatagttatcttttctgctcctctccctcctctgccccctcaagtagaccccaatgtctgttgttcctttctttgtgttcataggttctcatcgtttagctcccacttataagtgagaacatgcagtatttggttttctgttcctttgttagtttgctaaggataacagcctccaattccatccatgtttctgcaaaagacagaatctcattcttttttatgtctgcatagtattccatggcttctctatttttcattcacctcttactcaacttactgattcttctagaaagaaataaaacacacacatcaggcatcctgataggatcttgaatacacaatttccttaagtagtcactcctgttttcattttagcctttaaataatgaattcttgaaaataaatgtctaactcagtttctctactttcttcattcccattcattcttaagtcattcaactcaagcagtctgtaccacatgcccaagaaagtgtcctcattctaatcaccagtgccctcctcatggccagatctgatggacactggtttttatcccttttgacccgtctgtagaatttgacaccatacattttatttctcccttctcgaaagttctccttagcttatctctccacattttctttgcctacaattgttctttttaccctttaaaacataaaggttagattctagtcttctgtaaggctccatctgaattcctcctttctacttacaaaacacattcacaagtgatctcacttcagtgacttccaatacaccgatggacgagtggttcacaaaccgctctctctcacttcctcttttctctagaccaccactttcatgttgtcagctaccttacagactccaccacttagatgaccagaagctacatcagggttattaactcaactaattacttttaccctcaaagtctcctctccctattttccttaccttggtttatgatacccagatagacaattttttagccattcttggcttttcagtctcctctacaatcaaaatccatattgaataattcccacataatttttctcactttaatatgtgtataatctagtccttcctttctttccataatgctagaaactttgttcaggaacattcttttgtatattgattgattctgttgtccattcattcaataaatgcttactaagtgccatgtaatgacactatgctaagggctaaaagtggagcttacactctgatgggagacacagataaataagttactatatagtgtggtaaaggctagataaggggaagacaggtttgatgtttgagcacataggagagttcctaattccttactagaaggtaagagatgcatcagagaaggcttcccagaactgttccctaagatgaggcttgaagagagaggacaacttatccatgtgaagttgagggcaagaatatccataaagagggatccacatgtgctgaaacccagagtggctgagcacatggcttgcttcaagaactggaagagggcagagtggccagagcctagatttctaatggtgtgatggcaagaggcaagactggagagtggggcagaaaaaaatggtatgtggtttgtaagctctgccaaggggttgacattttttttcagcaaagaagtgacatagtcaaattgtcagtttagaaagatatctctggtatgctagggggcagatgatcagggtgagaatggagagggaagaccagcgaggaagctgttgtagtaatccaggtatgaagtgacactgccctgaccatgggcatggaagccaataaggagatggacatgtttaaaatatttgtaggtgggtgtcaaagatgatgtcctagaaatatgggacatgttcagcactgaggtaggatacagagagggagaccaggttttgtgggagtagatggagataacagaaggatatccaactgctccttcttggtctcttgtcccatctgtctttgtctcctgacctattagctttggtggcgccatcactcagtcctcctctcttcattctctacagtccctctcctcggagatcccatccactctcatggcttttcatgacgtctacatgctgacaacttcttaatttaaatctctagcccagacctttctccttaaccccgggactcaaacatccaactgcatgcccggcatctccacttagatgcctaaaaaatgtatgtcaggctgagtgcagtggctcatgcctgtaatcccagcactttgggaggctgaggcgggtggatagtgaggcgggtggtggtcaggagttcaagaccagcctggccaacatggtgaaaccccgtctctactaaaaatacaaaatttagccaggtgtggtgatgtgtgcctgtaatcccaactactcaggaggctgaggcaggagaatcgcttgaacttgggaggcggaggttgcagttagccaacaccacatcactgcactccagcctgggcaacagagcaagactccatgtcaaaaaaataaaaataaaaaaacctccattgtgggcaaaactacattcctggtctcctcatatcctacaaacatgcttcaccaaccagagtctgcatgtcggtaactggcaaagccattctctctgttaaaaaagtcaaaatccttggcatattctcctttttttctcacatgcctcagatctgactccatcagtaaatccggatggagttcgatctgaggcatgtgacaaaatagctctgtcttcaaaatagaaccagaattcggccacatctccccactctccccttccttcctggcccaggccaccagggtccccctcctggaacaccactggagcctcccagctggcctcaccactccacctttgccctgaactgccccccagccactagcagtcttctctcccatatgatcgaggtgaatacattccaacataatccccccttgttcaacaccctgcaatgactccccatttcactccaataaaaacctgaatctcccaggggcctacaaggccttacatgctctgcttctttgtccttttgatctcagctcccggtcaacaaagtccaggcttactggcccccttgctgtgcttcagacacaccaggcacatttagttcttccttcttgcctctgcccagaaatctcttttcccatctcagacatctgggtccacaaaagccaccttcccaatttccgagctacaaacctatccccatacctctcctccaggcagttctgatgccccagccctactttttgtttttccctgtaacacacatcaacttctgaaacactacatcatcagcttgttatgggtattaattgttgtccccagctaaaaagtaagttccacaagagcaggggtgttgggttttgtttactgatgtatcccaagcatctgatgcatagtaggaccccagtaaatacttgtcaaatttggtcttaaatagctgttgcatagacaaaagtgatattggagagatggatttcgggattctctggagatccttcaacaaaacatatcagactttctttaatgtggccacagcctaatcttatacctttttccactgtcaacccagcccacctggcctctatgccaattgcagcttcctggacaaccctgcatcttctccccaggtgcccgtgtgtgagtccactccacccaaagtgtctgtcccctacctcagctgcacctgagcagctccaacttatcctgcaagacacagctcaagtagtatcccctctgaaatactccttggccccgctttctgtctgcatagttagctcttctcccccgtgctgctccactgacatgcgcacacctttacagcacagcctgggcgtgttgcaggtggaaggtggagattcccagtcaaggggcaacacctgtatggttggaaaagttgtttgttttaatttcttgccctctcttctctcttctatttctttcctctcccataaatacacataccgcctatatacacacaacctgccctgaattgttttccttgaattgatgagttacgtaaatgcaatcctaagcacagttgttttcaggttgtcctaaccttttgctttattgatttttcaaggatccagagtgtttactgagtttcagaaattggattctgtacttatttttctgtactatcctagttttatgagaatctatttgctcagcattctctattcttttaaaagtgtttaagatttttgtaaacagttttgtttggttctttattttctggtgacatattgatctcaacataatgctattcatatacttttaattcttcttccaacactgttaggattgcattatgttcacccaaggaatccacatctgtacaaaatgtggccaggtttggctattccttcacattcacagtattctcatgatttctaacaattcttgtctactttgcctaaataagaaaatgtcatatactgacaattttgatcgtgaaaaagagaccttagttcataccagtgtcagagtctacttgcaaacattgatttccaagaaaatttctcaggtgtgagcaaataagcaaaataaattcagacctaagagaaaatagcactacaaggaacgcccagctcattcaaacgctctgcattttgagactagagggggcttggcctttggcaccctcacacctctcccctttgtctctctgtccctgggtgctgatttctctttctttgtgtgacagccactgtgaaaagaatggggttcactcaccacctgcattcctccacagccatttgatatctgctttcgataacagcagaggaaactgatcagtcatataaatccaatcctgagcatagttcctcgtttggaattgtaccatgctttatgccgaggacattttcaaacacggagggaggggatgtctgattcattcgtgagtaatgtaccagcttcctctccaacttgtctcccttcagtggttcacattctgactattcagtcggtttatcctttccaaacccagtatttgaatgcaactggcaaaggttgattgcctctttttttttttaatatatagacttggaaagatgtttctcaaatgtgatttgcggatttatgttattcagtcttcctggattaattgaacaaaaactggtaacactgctacacagtctgaatcacaaaattatgtccatccatttggctgaaaaatacgaaaacaaatacttgtataagttttcatgcattttagcactttctttacattggggaagttcaaccttcacactttcaagggcaatgaaacatttttgtctgacctacaatttattaatgggacaaaagcccatctgtcaatcagggctctgagagttcaatgtattttctgaacaatattttttacattatgtacaatggtaaaaacaaatgtccatttattcttctttccaagaagttgagtactttcaaccattcttaaaaggacaaagatgtttgctgacagaatatgaatttataaaggataatcttgaggatataatggcattctattctttttatctttactcttgccatatcagagttggataatagtctcaatcatatgttacaactagaaaatgcacaattggctttttcttatgctaacaggcagccattttcaactttttaaatgattataggactaagaggggatgcaaaaacagataagaatctgaataaaagcactatctgtcaaagaaacaacatttgtgtaataatcaagaaaccgtttagagcaccccctggaaacattaattataacacatgcaaatcattcctgtacaaagcttaacttgtttatctcctatagccacctgtatttgaattttttaataagctcatttattataaataaagcatgtaaatcaatctgggaataccttttctgtttcagaaatttcatgtaaatgacaggctgccacatacagtacaactatagaggggaaaaagtttctttactccctttcatatagttataccttcatatgacacttaaaaccacctgccaggaacttttaaaacatgttttagatgcacagaagcaaacccaaatgaaaaaatgctatgcagttttgcaatacatatataccacagaaagctttaaaaacattctaccccaacagataaatagatttggcccaaatctttttaatgtgagttttgtgggtaaaaaagattattgttcccttatttttccccatttgctgacgactaggattgtcatataaaatacattcctgggacatgcttatactaaacaaattatccactgtttatctgaaattcaaatttaactcagcatcctatatctttacttgctaaatctcagttgggatatgggcttactcttttttttttttttttttttttttttgagacagagtctggctctgtcatccaggctggagtgcaatggtgtgatcacggttcactgcagcctcaacctccctagctcaagtgattctcccacctcagcttccacagtagctgggactataggcacatgccaccatgcctggctaatttttttattttttgtagagatggggtttgcccaggctggtctcaaactcctgaactcaagcaatcgtctggcctcagcctcctgaagtgctgggattgctggcgtgagtcacagtgcctggcctgagctaactcttttttaaagagttaaaatactggttcctatttgtttttacttctctagtatgggaggctgttactgtggcttctgtcttggggggcaattttcgaagggcttcaagaacttgaaccgaggttagaggaaaaccacaagatggctaaagggtgggaaaagaagaaataacactatttaaactttagatgagaggactaaagtgatgaaacagtcaccaggtatttggagtggtctcacccaagggactgtgccaacttcctcattttttatgagggcaggcaaaaactggccaaaacacaagttaggataataagcatagtagctattattaaatgctagggtgtgctgcataactgaaggacagtgtttctcacagtttatctccaactctcatggccaacccatgagatgtatatcattatccccacgttttgaatataagaaactgacactcaaatcagaaggcatgtcagtgaaaaaggccatattcacatcccatctaagtctgtctgacactaaagcccacactctctccactacactccaccttgtctccagaatgttttgggctgtttaaatgtgattataccaaagagcagttgaatgcactgaaaaattctgaagattcctcctgtcccttcgattcactgttggaaaccattgtcaaggtagtgtctggctacgatagaagggatttttgacatggcctattgttttatctttttaaagtaaatgtaggtgcttttgatgatcataacactaactgttaagtctttaggcataagaatcaagcattcaactaagcatgtttacaaatttgctttcagcccagtggatctatccacttttccatttaggttgcacatttagatttcggagtttatcctgttatcttcaaatccacggactgtacactctttgagggaagaaactcttagtatctagtcaagtacgtggcatgcaatgggtgctcccaaatacttgattaatatcatatgatataatgtaatatgattcttcataaacagtgagtgtttataaatacagtattttaaatgtcattaggaatcttctattggaatcttaactttattttaatagacctacttttaaagttaataaacataatataaatgtggacagggctaagatttttccctaagatttcactctggcaagtcttcctggagatttagccatggctatttttatgactgtaatttccttaatatggggcctcagccatattccatcatcataaatccctttcttgcacttaaaagcaatgttgaaatattttccagtttctatatcttaactctttacttagatccattatttccattttgagattatcttatgtaaatattgtagaagattttagaattatataataagaaaatactagtataccacctcagaaatcttaactaatagatatgttttcaaatgcaaagtgaaatatttaaagtaattattcaagtaaataaagagaccatctttgtcccaattacttgaatattttacgtaaagttggttttatgcacttgactttgtgtttaaactcaagtttgtagtattgtctactggacattgttagctcaggaccttttcaggagcaaggaatgaaagaatcatttttaaacttatttaaaaaaagaaataaggaagaaaagaagaaattttactggctcgccttagcttaagacatggctggatacagatgctcagacaatcacatcaggagcctgcctccctccgtgtctgggctctctggcctcttgggtcagtttcatgctcaggctggctttctccacatagtggcaaagatgggcatcagacatcccaagttaacatcatctttagtgctcatgctgtcagaatgaaagaggccctctcccagcatccatattaaatctccaaagagattctgtttggccttgctttggccacatactcaaccctgaccaagctccgtgtcaagagaacagagttcgttgaaaggccagcctggtttgcacactcattctgtgttgaaagatgtagaccatgtgattgacagtcccaggagataggagagggagaattttcaaaagagttgccggtataagagacagtggattctgggaaggtaaaaagaggtatttattaaaatactgtgcctttggaataaaaatcttttccaggaaatgcaaataatttaaaacaattcaaataaggatcatacattttaaaacaattagaaatacactcagaagaactgaattgctcatttagtagatttcagataatattttctcctctttgaacctcagttttgtcatctggaaacacaggataatgcttaccttataaggtaatcatgattagaagagatgatggagctgaccatatctatttactataaagtgctatctacatagttataaattatgacagctaagaaaattaatccctaaagaaagcaaaattacctatgtcacggtttagaaagtctctctcttaagaagaaacttattctattgcctctgttgggttttttcctgaggaatcggtgtttgaatgcaatatacatttttgtaggctctgcaatgtttttatgatgaggacagtcatagtgttgacaattactcaatgaatacttagagatttgaatgtatcgctagatttctgggaaatgaaaagaccaatgtaagctagttgaatgagaaaaccagaggtgggcagatggtggacagattaagtcgctggttttaaaggtaggctgaactggtatttgtaactattaataacagccatcttctttaaaggaagtactcctaaatatcaatagtttagtggccaaggtgccattgagatgatcactcccaggaaatgttttgccagtgatattaccttaactttcatctgaaaagaaataaagaaatgttttatggatgattcactttcacctgatatgtgcacaacattttaagagaatgaattagtcagtctgtttgaatcatctttacgtgttccttttagcagggaactcaaagttggttaaatggctagctctatttcagaaagcaaaaataacagaaacagtgaaaagacagtctatattgaaagcctgatccagacacatcatgggggaataaatatatcaggacaaaaatatatgaaaagtgaaagtatttctggagtatttcactaccaatataaatattaaaatgctcacacagccagatctggcaagttacatagatgaggaagtgaaagcaataatatgccaagtcaatggcattggtgtaaaatgtaatcatagaggaacaatctcagagttgaaaattattagaattggaaaacactttgaagttctttagttccacccaggagtatgccattaaatatttaataaccatccctctgcgggctttaataacaagccctgatttgtagtgtttgccaatttctatggtgtcaatacagccaccatggctgattttaggctaccaagatgaggtcactgaaacacaagttgggaagagatgcacatagtaggctgtcatgagccagcacacagctggttcagcattataattttcaaataagaaagcagttgacctcagaggagttgggtgacttgcctgggtcatacaaataattagctgcactgccacaactaaacctaggccctctccagtgtttgacctcagaattgtgaatgcattatgaggaaagcaccatgattgattgattggtaagcccacgtgactttctgtcctagttaagttcccctttaagggcctccatagacatttctacattgagtttaaactatagtctgcctatctccactactggcctgagatctcactgacatttggaaagcgttttatttatctttgtatcttcagcactctgtacagtatctgacacttagatgcttataagtgtttgttgggggccatgtacgaacaatagagaacatgcattgacctgctatgtgccaggcagtgttcttagtgatttacatgcattaacttattgaatccttagaataactctcacaagtgaggtaggtactataatcctgcccatattttagatgagaaaatacaggcttagacttacttgcctaaggtaacatagacagtgattggatttaaaccctaaaatctggccagtgcctgtgcacttggcctctcagttgtcactcatttaactagcagttatcatcatagtgcccagctcagcgccaaatacttctaaaaggtctccctcctttccttaggaaggacacaaaacgtttcccagaaaagatctgatctgaccaacacacacctttgttaatggggaagggcctttattaatgggaatgatcaaggaaatggggcgtttttggtgattacattttctcattatctgaggtttaaacagaaacctctagtttaattaaaatttctgttgctgacaataggccctagtcccatttttttctttaattaaaaaagttaacctttttttgatgtattcacttgaaaaatggcatcaccatatggtaacagataatgtaaagaaggtgtaggagattaaggtactaactccaactgtgttctgtgagggtttttctttaaatagaaaatatattcttcttccccactgattttccatttcatcaaatgaagtaacaaaaagcctatttctacatgtgtacattttcttggattcttgtccactgagatttagtacagtgtgtgacttatgtgcgaaccttaagatatgaatcttattttaaaaacataatttaatataatatctctaatttttttgtttttgtttttattttttttagatggagtctcgctctgtcatcaggctggagtgcagtggcgcaatctcaactcactgcaacctccaattccctggttcaagagattctcctgcctcagcctcccaagtagctgggattacaggcatgcgccaccacacccagctaatttttgtacttttagtagagacggggtttcaccatattggccaggatggttgtgatctcctgaccacgtgatccacccacctctgcctcccaaagtgctaggattacagattattttgaaggctccttcaaaaagcctagaagaaaaaatgtcattcacacttcacactgcattaatggacatcaactaacatgcaaattggttacaatatttttctcccttttggcaataataattcgtttcctttctttcattataatttctacagaaaatacagcaataaattatatattaagctcaattttgttagatacactgataccatattgataagtgcagttaacttttcacataatatttatttttcccattgtgctctagatggtttagatacatatttgcagtttggtttacagtttgtatttgccctctagtacaacaaattgtccctaatccttttcttctatcccttgttattccctctaccagcaccaaaaatttgctagtacattgcaaaacaatgagaattacagataaaatagcaagcatttatatatactctatattgatcaaagtgctttcagagatgagatctctttttgatccttaaaatggtcacgtgagaatatctgaccctgggactcagaggtgggtgattgcctggagtcacacagctagagagggaaagggctagaatcagagggctgattgtctgacttctgttctagtgcatgctcccacctcgctttggaagctgcttcggcatagtgaagcacttaagagcatggatgggttcttgttagccagacgtggaattgaatcttggttctaactgtgtgattttagcaagtttgcttatctagaagagaaggataataatacttccttcttcacagggtggtgatgaagagtaaatcaaagagtttagcagaatgcttcccatatggtaagcactcaatacatgttcttgttatttttattattacatggctttgccttactgaggcttcatcttgtcctctggtccaactacagttctctagcttggcttatcccttcataacctgtacccccagtggcacgatcttggctcactacaacctccgcttcccaagttcaagcaattctcctgcctcagcctcccaagtagctaggattacaggcacctgtcaccacacccagctaatttttttgtagtagagatgggggttcacagtgttggtcagcctgggttcaaactcctgacctcaagtgatctgcccacctcagcctcccaaagtgctaggattacaggcatgaaccaccgcgctcagccaggaattttcattctttatcctcctttgagactcggctctagcatcatttccagtcgagttggtctcccttcctctgcattctgataactgttaaccatcaagtgacttgagcttcccagggaagggcatcatgtctttgtagacatccaataaatgttagtagaagaaaggggggtcctgccaataatcatatgtctttcccacaatttaaactccttttcaccctgttactactttttgcttgtcttccctttgataaacattctacttcttcatcacccattccctcaatttaacatctgatactactatagaaactactgccttgaagatcaacaaacgggttccatgtggaccaacgtcctccttgagaccctcacttggcttttgtgacacagtgcaatatttgctctcttgatgcctcactgaccttaaccttccttgactcctgcatagatttctcaactgtgggtatcccctaagatttaggccatttgccttctcttctttcatctagtccattcatgaacacacccattcctggttttaaccatcacctctgtgcagataatgtgcaaagtttatttctagtcggagtggagtctctgttactctgccaatcaagttctaaatttttattccttctagtgcagcagtggcaaatacctgacactcatgtgtctcactcaagacagatactgtttcacccaagactgatcatgccgctttcccagtcaaggcaggcttctcagaatccttctcatttccgcctctgttctttggcactaatgctctgtctgcccagagttttcattcttcacttgttccaggcacctgcttcctggtgaataatgtaaaacctgctagtcatccttataggagaatatgcactcatttcccagcagcacacccgactcaacgtggttaaaaccaatctaccattcccatatattcagcctaacttcccagtgcagtctaccctagttttataacttgttctactttttccagataactgctaatcatctttgtttgtctttgctttcttttttgcactgtgtttgatatattagggtatcaaatcctacttattcaaatatgtcccttattcattccttctatccttggtgctaccatatttgttctggctcttgttacctcattatgggatataaaaatagcctgtcaactggtctttccattgccaggatctctctgttctaagccaccctgcctccagatcaatcttcctagagtaaaaccttcattgtatgacggtctagctcaaaattccttaatgattattaatcacctcttaaagtccccaattcttagactattagtagggtaaaattatttttgatttggagtcaaaaaattttggacgcaaattttggctactacacttaaccattatgtaacttcgaatttcggcttaatttttattcatcatttattcagtatctatttgtttaacaccttctgcatctcaggctctgtactaggtacttgggatacaatgatgagccaagcagaccttgtccttgctctcctggacctcacaacatggtgaacttgtctctattgctcatgatcataataatcctaagtacaggctgtgcttttttcccttgatacttgtagcttttggtttgtgctatgcagggtattgtaataccatttgcagtgccacaataatcagcatatatgtgttatcactcagccacattgcagcttcactgaagggcaggggctatgtcccatttctcatagcgcaagcacagtgccctgcacataccagctgctcagtgatttctgatgtggtttttgtagatccagggttagtctttggcagtcatgatgcctagtatgtttttagaggctccctttgtcctatcagaattatgctatttaaaaaaaagtcatacctatttagtttatattcattctaaggcctctcctttccaacctactaccctgcctataactattataaggagaactcacaatgtttataacttgtgcaccttaagttttaaatactgaataacaggcccattcatgtttcctcatagaaatactgtctatatgcatacaatgaaatgttaaaataatgttctttttactaaatagctttttgacttggtaatgaacaatatgttgtttttccctgagaagtagttctaggactttagttctgaagattatgttgtattttatacattttcagcctcctgtttttcagttcccagtgatcttacattaaacatttgtctgtctaaaacaataggttaactatagccaaattataaccataccattcctctccacacaaaatcctataaacagcatgtgatcatattgcttctagaatttatgattgttttcttccaaaaggaagctaaatttagcctagtaattctacatgcgctcaagaaaacaatgcctgctgtgatttctagaataaatgaatgtgaaccacagttcctttacttgactaacagagaaagtttaaatatcaacctagtcattaaccacagttattaaaccacgttaaacaaccagcaaggggttaagaaagaaagttgctatgttttttctttcattgctgaatgagtctaacttagttactgtatcaaccttaatacagaacattgtttgcatctcaatggttctctaaaattattcgttcatggcttgagttctaaaattaaactatgtggagtcatgtccaaccgcacaatgcatctttatgtgaaacttgctagagtttttgttttccttctatgtaaaagtccagttgggaagctttatttctgatagattaaatggtataggtctttcagttttctcttcatttctgacaactgaactgctctcgccttgaacctgttttggcagataaacctctcataatgaaggcccccgctgtgcttgcacctggcatcctcgtgctcctgtttaccttggtgcagaggagcaatggggagtgtaaagaggcactagcaaagtccgagatgaatgtgaatatgaagtatcagcttcccaacttcaccgcggaaacacccatccagaatgtcattctacatgagcatcacattttccttggtgccactaactacatttatgttttaaatgaggaagaccttcagaaggttgctgagtacaagactgggcctgtgctggaacacccagattgtttcccatgtcaggactgcagcagcaaagccaatttatcaggaggtgtttggaaagataacatcaacatggctctagttgtcgacacctactatgatgatcaactcattagctgtggcagcgtcaacagagggacctgccagcgacatgtctttccccacaatcatactgctgacatacagtcggaggttcactgcatattctccccacagatagaagagcccagccagtgtcctgactgtgtggtgagcgccctgggagccaaagtcctttcatctgtaaaggaccggttcatcaacttctttgtaggcaataccataaattcttcttatttcccagatcatccattgcattcgatatcagtgagaaggctaaaggaaacgaaagatggttttatgtttttgacggaccagtcctacattgatgttttacctgagttcagagattcttaccccattaagtatgtccatgcctttgaaagcaacaattttatttacttcttgacggtccaaagggaaactctagatgctcagacttttcacacaagaataatcaggttctgttccataaactctggattgcattcctacatggaaatgcctctggagtgtattctcacagaaaagagaaaaaagagatccacaaagaaggaagtgtttaatatacttcaggctgcgtatgtcagcaagcctggggcccagcttgctagacaaataggagccagcctgaatgatgacattcttttcggggtgttcgcacaaagcaagccagattctgccgaaccaatggatcgatctgccatgtgtgcattccctatcaaatatgtcaacgacttcttcaacaagatcgtcaacaaaaacaatgtgagatgtctccagcatttttacggacccaatcatgagcactgctttaatagggtaagtcacatcagttccccacttataaactgtgaggtataaattagaaataagtatcagtctcaaaaagaatatccagggcttcttttgtgctttgtaaatggtgtttatccaaaatagttgcagattttttccaagaaaattgaggaattgaatcttcatttacacctaaaattatatctttaaaatgtaaatggtaactaaaagaaaaatgtttttacaattcagatttgcatgttcgtgacatttcagattatattaaagttatttcccatataagcttttttatatttacacagattttatcagatttacacagattttatcagatttacacagatttttatcacagcagcaattcccataaaacataattattgacatttctatataatctctgcaacatttacaagatgttcaagctaatttgtatgccttaaagaattgttccttatgagattatattctctcactgatacacaactgattaatctatattcttgacattacttaaaggaacttaactttaaaaaacctcttctgaaatgctggtaaataaaacatttttaaatgagctcgtatacttctctaaataacctgtaagagtagagaggaaatgtttgttcccaagtccttcctttagagcttgactttaatcatggacttccttctggaaaagacttgtgtctaccaagttctagcttggcactttacctggttggtatttgttatttataagcataaatattttggttgatgattatttatacttatatgaaatggtattttcttaggagctgttagagatattcttggtgctgtgatttaaatatagtaacagctaccagctatacctggagatttatcctgctagtcagttgatcacctggtctgagtgtttattgtggctttgagtttcttgatctgggccagatttggaatacggacctgactatgaccatcattgaatgaacaaatagtatagcttttctaaagacagtttgactttggcatggtatgtttcacttactttaacaggtttcagtctaagatataaaggttataattgcaatcaggtagaacattaaacatgtcctcagtagcataaagtatataatttgctgaggggtaaaggcatatgaattcagaaacatttggttgacttttgctgaaatgtctgggacacttctctagatggaaactatagttaactttttatgatgctaggaaaatacttccaagaaagtcagttcatcttttggtgaactaaaaacaaaacttccttcctctctcttccaaagtctatgaatatacataacataaatgcacatacattccaactaagacttatttccccctacatacatttaatatatgttgcaaagaagcaatagaattccttatgaagctcccccgtttctttactagaaactacaaaagaatgaaaggaaacaaaatgattttcagaaacctgggattaggaaataaaaatataatattaatagcattacagagaagatatttttctgcatccagtaagttgattctgagacacaagttttaaaagagtctattaggaattcctccagggctcctagagcacatggatttgctatttaaatctttctttgttaaaaattaaaaagaagggtagggcaagaaaaaaattaaaaagagaattcataaaggtatattgatatctcattttttaaattttgtacatttcaatccttagatgtaaaaatacttatcaattctagaaattctcaaaacacatctgaattttatcctacccttttgacttttttagtgttccaagggagacaaacagacaggattagccaatgaaattcaggtcagttttatcgcccaggaaaaattcccaaaatgcactagccacacctgaaaccattatcactcccatcacaaaaattcttgcgggaaacaagatggaacttgccaacatagtcttcttacaaaggaagccaacttttacactggccaaattccatagacaaataccttcaaacctcctctatttatttgcctgtttatcttctctggttacaaagatcaaaattcttctgagactgagactacacatattctctctctccatataccccatccagacctcagattgttccaataatgagcatataatcatttcctagcttaatgccaaaatgaaggcacctagagccattcatcacacacaaaaaaaacaaaatgattacaagatcaaagctgtttagcaggactctcaagcaataagatgactccattttgtcttggcagatttacttggccagaaatcaagtgacccttttaataatttcttggaactgagtttttactttggcatcaagtttggtgaaaagacacacatattgtagttttgttattaacatctctaatacatttataaagggactcttgtggacaaggttaagaaagctgagctgcagcagtaactttctacttatgcttctgcccagtcctcagtgttgacacattgctgaaagagggatttcctggcactccaagagctctccaccatgtgcaaaaagtgtttctatcacaagatcagataatgggagtgccagggacgggccttttacattttaggggtccagcaggtgtaccaggcctgacttgcttgtttaggatcacatattttgttgcttttcccagtctcacatttcatgaaatatgtctatgcaaactcttcacatgcatcttctcatattgatgacatcacaaaagccctcttttgagtcatttgataattcccagtactcgtcatcttcacccataagctatttgtgcttcagaactctttgtctccacatatgatgctgtttctggaaacttatcccaagccacaaatgcccacttatagaataccagtgttgttgactatgtcagttgttctataagaatatattcttgatcctcacaatgtgtccattttttatgttgcttttgaaagtgattctaaagaatttgtttacagtgacttccaatattgagtactatgagattatacacccacaaataattactaaatctgtttaatatctttacctcctcctttacccattcatcaatcaacctctataagcatcctaaattagtattgattgaagttgttttaggctaatgcatattctctaaatagcatattattattcaaaataaaataattgagaaaattgtcccataatatggatggaacctttgtaaaggcccatatgtagggagaaaaaaccctcatctctatttgaggataagcagtagcaaaaatttcattaacttgtttaaaattaagtggaatttaattttaagactgtggaatctctaacagtcttttacatataagggattgattaatgtgacaatttcaggaaaaaaaggagaatcagtacacattggcccaatctcctacaaatgagaatcaatacagaataagagaattttttaaatccccaaatcagcaaagatcctgttccctaagttatagaatatttattaaaacaagtgaaatcgtacattttagaaaaaattttaatcaaagttgaaattagaaaagcattcttgaaatagctctcgcctctcagaaaatacaattagcacacaacactgtttttcttgaagttctattatcaaagttttgctctatagataagcatttgaaagacctgtagcaagtattttcgccaacatcttgatgaccttaatgaccaaagttggatcaagtgaaggggaaaagcatttggtgccagacacacctgggtggaagtcctggtttactgcataccaaccatgtgacttctgccacattacctgacttcttggaggctgagtctcattggtatcatgcagataacaatacctacttcacaggtttttgtgaaaatttgggataatatatatgaggtacctggcacaagatgactataaatttagcccgttgggagacagcatggactaatggaaagagactaaaatcagagatgttggttcaaatctgaaccccaccgtcttctacctggatggccatgaaagcattatttaaactctgaacccatcgtcctgcgtgcaggactatagtgtggacaagtatattaataacatctgtaaaaggtcccaacttggtccttggcacaaaataaatagcagctattattgtaaggaatacttgcgtaaagaaagacaaattcaaatgattggattattctctggaagaggcacattctggttctattgtttacaagtctttcacttccctctctaactgttatgagtgacctacctccataatggttaatttgtgttatgttgttcttaagattataatagttccaaaaaagagatggggtgaggagtggtggtagtttgagggggcagaggatggggagaaagacaattgaatcaaaactgtactatagtcaagttagaaggtataaattgttctccttcctctcactttcaatcctaactatccatgacctaagatattactcttatgtactttgtcatatcttgcattcaagaatttgcagataatgcagttttagaaaaagtcaacctcataggttgtttgtattgggcttccttgtttttaaatatcatttatactcaaattcaaagagtagccaactgcttcccaaaataaaggaaacttaaggtagtaattttccatctccgtttcacagaatgccaaagttaaagagtcactactcagagccatcaaaggaagaaagcaaagtgattagaacaattttaaaggaggacaaaaatcaaaacaagatgcaaacaaggaataataggaataggcagaaaaataaacatacagtgatgtttctttattatgattataaagatgatagatgagtaaaatcgagttacatttaagttgtaatggaagaaaataattgcagccttccatcaggaaaccacaaggaccgttattgatctgtcatcctcagggcatgtctcgtaatatttaataaaataaacaaagatttataacttttataggccatatatctataatctcccacaccacttgaactgtgaatgtggagtcaatgttacaaataacatccatgtgattatactggtttggcatgccttattccaacaatctagcactctcaagagaatgtattttgtattagggatgaaaaatgtgaagccagattatagagttttttacttattgtgctcaaaaatgagaaaatgttatccaatatgaaaaatgttgttaaggattcttcattcttaatattagacagcctttcaaacctaaatattaaatatcttggccatatgccaaatgtaatagctaccaaagcaaaatcttgcaagaaagaaaatccttgaggtataaagattcaatgtactttttaaaaaatgtaagtaaaaggttattaattttacatttcatttctttttctttcctagacactacttcatcctctcataggctcagggagtcactgcttcctaacttctttattttaattatccatgctactcattccacgaaaagtggcatattgcattattttattaaaagaaatttaaaattagtttctttccagaattttgtaacgccccctgagatcactgggcacacccttggggtgttagaaaacatgttacaaaatgaacctttaattccttttgctttttcccttcctcttgctgactgctctttaaaccattacatggctcattcacaagtctctctaccccaggaaagatgaaaaagcaaaggcatgatgtttttataacctaatagcaagagaacacagtgctgaagctgtcaccaaaactgtgggtaggttttacccgtgggttatattaattcatgatatgattgataatatctctcacttgtgtggggaatgaagcgttaactatgccgcatgcattttaaattaatttgacattattcttaatgtcctttcaagcaggtggcattataacctgtgtcttatttaggtagttgatttctacacggagattcatctgataaaactgatatcgcaaacgggaaggagtttgtacaaaatgaaataaatcttaaagttgatttttgtaaagcccaaatgttaattaaaatctttgaatccacaactctgatacatgatattttcattgacataaacatgattagcgatttctggaagcatgtgggatgctgcattgataaggatatgaacctccttgagtaataatgtatatttttactccaaatactgtttcacattttgggtgttacatccttacttcagacttctgccttatcagtggccatcccaccctatgttcttatctcctcagtctaaaaagaaaaatggggacccatcagaatttggatagaagaccctccaggaatttctgccactgcttattcatgggttggcacagacactgattcagtgggcacacagagttcagaatgattcagagcccagatatgtgccctaagtcacatctccagcgtccagggaggactgtaaagtgctcgttatcaggaaaatgaaaccaagggctcagctactcctgaagtcattaaaactccttcccttgatttttttttttttttttttaaatagtatatgtggtaaccgaatctaggatcctggatacattccagtctgctaattacatatttttttctaactaaaatgttccaggcaggttcatttgcatgtgaattacttgctgagccatgttgacttcctattctaaaagcctcactctgccttgggaagcagtttactgcacttcaccctagacctagtctaatgttggagcagacaaagtgtagctacccatatatacttcaaaaatattttccagtctccccacaagaggaaagaaaaatgtctagcaattgcatgctaatttagaccaaagctttgttttaaccattcttggtgatcacaaatggggaaaaatgatttatgaacagtataactataaaacaaacaaaaaaaaaccattgtgaattcagagtgaagtctgacttcatttgtcttatttgggtaaatcagcaaaatgttcatcagtcagaggacattaaaatggtagatgatacttcaaatcgtgccctagataaaaggagagaattaaggttagttttgatttgtaaaccattctcttcgaaggctgattttataaaaattaagtttgctgagtcatcatctcaaaatatatagttattcatgattagttaaaatttgtgtctgtgtatcaaagaagtaaatttgtatgatattaaattttctaacaatgttttaaattttaaaatgtccgattaacacttgcatctagcaaccagtctactaactaaactataggtgaagtcatgctcaggaaatggggaaaatgcacagattaaattggtctgttagctctgagtgaatcaatagtatttagtgctaatgcactaaggagattacaagcactaatgcagtagcagtcaatagcgaaaactaatatctctaaaaaatatcttgacaataaaatgtgcaatattttccatttatcttaagctaattacattacctgcttgttctttcatcttattagtttaagccaagtgctagaagcctaaccattttatttagtgcataaaagggccaaaaccttgtaatcattgttttcagcaggagacagaggaaaggattaattcatgtaaccaagattcaaccagaaattcaacagatatttatttagtctctaaacctgatagtattacaatggagaatgagctagactgtacctgtcttcaacaagcagatagactagtgaagatgacagtaaacattcagtcacaccagtgaacaaatacatcatgataatttatgaaatgtgctgtgagggaaataaacatctgtgaatgcaaatgagagggaatatctaaatttggtagttgagtcacaaaaggctgtcctgaggaggtgaaagctaacctttatataaagcttaaaactttaaaaaagcaatacgtctttagtacacaggcaaatatataaactaaatatataaactaatagtcattacttatttcacaagctttacatcttaactacaagctgctacattaaatcagctttcttaagtggtttgtggtcattagtgcatactatcttacacttagaaaaacattgcaagaagtagtacaatgctggagaatttaactttttaaaacatttcctgccttaaaataaacagcagtaaatgtgtttaaacattcttttgatttctaaatgaattaagttactttttattatgtggttcttcttcatatgaagaaaataatatgtagattactagaagctaagaacatactttagatcctgctcacactcactgcctttcctggcctgtcaccttaatcagcttctttgaaaatcactgtttcttacataggccaggttgtttcttccttgtttccctcttcttccttctatggccaacccttgggaccccgtttgtcagaagaacatgttcctctttggggaggaggggattgtccttttaccaataagttttatgaccaagagaaacataagaatctgagaacacacaaaataagctcttttgaaactatcaaaattataaacattaatagaattcaagggaatgtgatgctgaagtgatcccaagtcacattgtctttctgcctctgtgcactgtactctgcacaattgcatccatttttagaccatttccttctcatgagaatcatgtgcatggagggccaaaggagagacaagtgctcacaaggatatcatgagcacttatgaatgtacaaatgagtgctctccagtcagtgccatctttatattgttccggtttataggcaatgccttcatctttacctacagacacatgttgcctttctgtttcattttaatcctgttcatctatacatatttaatcacacaaatatctaaataagtttatgtcttgtagggaaggcactttgtcatgcttctttgtacctaagcatatgctttgcaaatcataaacaatagtgttgattttatttgatataaaaacttggattctcaaaagaaatctatgtgttcacacgataaacagagaccatctgaattgccaaagtatgactgaatcataagcagtattgttttagtcatctttacagaccaggaagatttgaaatacaggtgtaaaaagatgtgtgaggcatcaaaagaaatattcacctttctttgtgttcattttttttatttttgcttggccgagaaagaaggggtgttttccaagggaataggaggcttcagggcttattcctgtgcctacaagtcagagaggtcactggcttgccccttcctgaaggctgtaattacaggcagaggactatttattttcccgtaaggcgaccagaatcttgagtgtaaaaaactgtttacaagagtacactgtgtataggggttacacacaacctcaggaaaaataataggaaagtgagactatttttcttcatgtattcaataatatgagaaggtccaagactctggaaatgttctaaagtacaataatagagatgaatatgaggtcaaattaggtgatcctggggcttaaggaactgaattaaatgaataaagaagaggaatttctaatagggcataatctaactgataatttgttaaatgtaaacttatttgtggctccaacatcatggtaaacaagaatgaataaatgtattagtaagagtaattgagaagtatttctaatgtgaaaaacaccaattacattgggtttatctggcgccaatgtggaaataaatgagcaatatttcttactctcaactaaacttactctcactttcagaactgttataggaaaggtattgattcaagtagagttgggcatgcaaagcacaagatcaattctgttactggcctgatattaaggatattagtcagtgtttgaaaaaatgatttgtaatatataagtagtagtttaacaaagtaggtaaaacttgtaattaatttcaaaaggtcaaagcagagattattgacatgtacaaagaggacccgctttatatgtgcctgctttgaaaagtaataccgtagtatggtaaattgtgactaattctgagattttctgtctagattctttttaaaaccaaatgcttaagaaaaaaacatgagacatgagtagcaattacattttttaggctgagtaggtagcataattgcctcatgcctgcctcctgtctccatttgtttttagtagattttgcacagaaaaacatgttgacctcggtactgaaattttggagttcactatttgcggcacagttacagatcacagaaaaaaatgtacaacaggacttcaccacacctaacaaaagaaagttttcttattaaaaaaaaaaccctccaaattattgtgagatctagggtaaccatggtgttaactatatgctatttgatatcttataaccctggtgataagataacaatccaattgaatgcagatgaactcatgaaaaaagaaggattatgaaatatttggaaagtaaacacctaaattttcataagtaaatattaattatttgtgtgatctttagatatgaaagcttcccctgcatgcacttggctcttggaaccagctgttaaaactcccagcaccttagttaataccctgtatgctggtggttcaagaactagttaagaaacagtcacattttctattttcactgccaatgtataataaaatctctgttccagtgaatggctggccaattattttaataacgatgttggcatggcttcattttacctttcttgctattagcaaagctttccttttgtactctgaagtacgggtaaatcacaaattaaactgagctgttgtttgtttaatgctgtgtttcctgctaaccttattcttgtctatcaacctgaacgtagttccccagtggctcagaaaaccctcaattgggattaagtaatagtttacacaaccttgctcagtcattaacctgtgttgactttctcattcttgtgttccagcctcatttaagagtttcttaagcactctatccagttgctggtttggtgacaactaacaatacctatttaatcaagaaatttaatatttccaaggaatcatttatcgtatctcagacttcttcattaacataatctaattcagtcttgtattccttcttcaaaataaagcctggtttcattcatagtaaatatgaagcttaaaaatttttacttcttttcttctctatacacacaaagcagaaagagaaaattgtatattatcattccagacaggtttttttttttgtttagtgtattgacattgatgccaataagataaaactagacctcagtggctcctcctcaactccacccaatctatttgtctccaaagtgctgttggagtaagtaatctttgttaagagcaaacctatttgtatatctgatgataatctgagggataataatatgatatttaaggagtttctgtccttggccctgactatttcctggtcctccttcacgcccagtgatgtgctggtaaatgttaaactctggggggaggggcagcagaagcccctaatttgtagcatttgccaatttctatggtgtaaatatcccactgagccagtttcaaggtaccactgaaacagcgttagtcactgaacaacaatgaggaagagatgtacacacttggctctgtgaactgttatgagatggttcaagcacagcactgccaccctgtcctacacgcaacctgtcattcttgtagttcccagaatccatcagcctccctcacaaccctgccttaacacgtgtagcttggtccacttcagattccctttaacactcattttgtcaagtgaacactttttccctattctttaaaacttccatgctggcattttccttccccaggacatttttccctagccttcaactcatcccctgccccccatattctggatttgttgcgtttcctgagcacaccagtagcactctgcttatttctaccatgtctcttatcacactccgtggtaatgtgtccaacagttccatcgttagccccctgaggggatgaactatgccatttatctccacagtcccagcacctaatacaatagcttgaacaatatatacatttatcggatgagcaaagaagtatgacagagccctgtatgtaaaatatattactataaatagaatgctgattcataaaaataattatttagataaaacagtttttccgtctctcccctaaatccctaaaaactaatttatagaattggggagttttcaagagctaaattagcactggagaaaaactggggagttttactcactattacctatgcccctcccgtcccccccacacacaccctccttcattcaccagtctgcaatgaagattgatcaaagaacaaagaagaagaaaaatgaaagaaaaaggaaagattaagatagggagggtgaatagataggaattccagagttttgtaatcgaaatttggaactcagaattaaagtcattaaaaggagaaagagggaatactttctctgctcccgtaaggttttctcaagcctttcaacagcactcaccctttgagcgggtgataccatctgtaagagggactttacgcaatgctttagtgggcgtggcttgagcagtgacaccagtagagatacccccttgaaactttcatttgaagtccacagattttcactattggtcaccaatccatgatttcaagttgaaaatgatatatgggttaaggaaaagaggccgggcgcggtggctcacgcctgtaatcccagcactttgggaggccgaggtgggcggatcacgaggtcaggagatcgagaccatcccggctaaaacggtgaaaccccgtctctactaaaaatacaaaaaattagccgggggtaatggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaggaaaagaagttaagggcaaaggtctttatcaacaccatccttcctgtggccacaggatcgtaatcccagtggcaacattcaaaggcaccaagtacgtgcttggtacagagagaagctttcctgagcttggccttggtgtagatgcagtgagaactgagtaagggcctctggcagggaccttggctgctgagaaggggagcccacagatggaggtttctgatcaacaggtcctatcagaaacaaggggagcagataagtaaagagtctcactccacggtggcaagatggaaaggagggataagaggtcatgacagttggattaatggcaggctagaatatagtcatgggcttgaacgatatattgggacacaattgaaggactcttgtttcatccatcgttcatctctcctggccctctgtgaagacatttatcacctgtttctattgaatgtgacactgttaggcacataaacagaccatggctcttaccacctccaagaagaactacttctgttttatttgttagtgcagggtaattggtgttgtgtcttctgaaaatctcttatacttctatgagtaagtgcattgaaattgtttctgttaactaagtagaggaaagcagaaaacctctttgcactaagcattaaaaccttcctaacttggaacaattttctttatgaatcactctgtcactcctggctatgattgaagtgcagtatgaaggctgctaaccaaaaacacatggacacagtctgtttcagatctgattcaccttaggaaatgatgataaagaagcaaaagttttaacacttagaattccaaggtccatatcattgtagaattgattcttttgaattgtggtggtacctcaagagaaaggatttatttatttcatttatatttaaatgcgtttgtatacatatgtatataaacccatatacacatatacataaaatatattctgctccaagtatttatctctcttttctctttactaatccagcttccattaagaactggctcaacttcgacctctgccatgagccttctccagctgtttaagcccacacagatcttatttttttcctagtcttagaggatttactgccagtacagtgttttcagaatgtaactatcaactgagttcttatactttgcatcagttagctattgtacgtgtcaatcttttgtctccctatgtagaggctagacccaaggtagaagcatttgccaggattgacaaacgatagcctgtttttatattctcaacaagtgaaaacttattttgtttatatttttttccctttttatacagttaaacactcacatgcacgcacacacacacacacacacacacacacacacacaggccacagggaccctatggccctcaaagactagcatatattctatctagccctttcccaaaaaacatgtgccaacccctgcattagagaatagtgtaaaataatagtggacagataacaggtccacaaattttggagagccatggatgaccttacttatgaacttaagtaattctcttcaataggtgtgagtgtttccattttacagatgatgaaattgaggctcattgatctaaacaattggattttgtcttcataggcattatgagggcttactagaccaacaatagtgataataataactgtttagttgcacaaggcagggatttatgtcttttttatttgctgccatatccttcagcacctagaacagtctgtcacatggtatggtattatattcattttccagagctcccataacaaattaccacaaactgggtggctgaaaacaacagaaatttatcctcacatggttctggaggccagatgtctgaaatcaaggcatcagccagggccatgctccctctggaggctctagggaggactccttccttgcctcttgcaattctggtgtcccaggcatcttaggttgtggcagctttactcccctctctgcctccatctttatgtggcagtccaccatgtctctctgtgtcccctcttcttataaggacaacagtcattgaattcagggcactcactaaatccaggatgatttcatctcaagatccttaactaatcacatatcaaagagcctatttccaaataaggtcacgatctgactttccaggtggacatgaattttgggaagacattattcggcctactgtaggtcttctaaatgaagtgaccatttaatatgtttctggcactggattcatttcatttaagcctcaaaacaaatctgttatgtagatatgtgttttcccactttacaagtgaagaactgaggtttagagatctaggaatcctaaagctgcacagccaggaagggcagggccacccctgacccaagttctctgctaggttagcatggttgtcacaggacaagctgagaaggtatttagggagcattacactaaaaagttgtagaagtcggcttaaggaagaagattctaaaatcaaaggaatcagattgtaggaggccatgtaggcaatttcctttaattcaatagaagagagtataagaatcagccaggcatggtggctcatgcctgtaatcctaacactttgggaggtcgaggtcgaaggattgctagagcctgtgaattcaagaccagcctgggcaacatggcaaaatcccatctctacaaagaaatacaaaaattagccaggtattgtggcacatgcctgtagtcccagctactctggatgctgaggagggaggatctcttgagcccagaagggaagaggttgcagtgagccaagattgtgccactgcactgccgcctgggtgacagagccagagcctttcaagcaagcaagcaagagggaaggagggagagagggagagagagagagagagagagagagagagagagagagagagagagagagagagagagaaaagaaacggagagagagggagggagggaaggaaggagggaaaaagagagaaagaaagagaaatatgaaagaaagaaagagtaaggaaggaaagaaagaaggaaagaaagaaaaagaaaagaaagaaagagaaagaaagaaagaaagaaagaaagaaagaaagaaagaaagaaagaaagaaagaaagaaagaaagaaagaagatatgaacaataaaggaaagactcaaagatggttcagatctcaaacttacggagagggtagctattgatgcattgagaaataggaagctggaagaggaaatcagtttggagagaaaagtgatggctttgaacatcatcaatggcgtattcaaacatagcttgaaggcatttgcagagacagggctggtcctcggaagagatggcaacggggtgtgtagagttaggtcatcaccacgaggctgtgagggcagagccacagtagcttccatcaccttgtgaatcaccagtgctcagcccgtggctggctggccggatgcctgcttatgctgtgctcccggctgtctggctgcacacacaaccgcagagcatgccctctctggctagggcagaaagaaattgaagcctcttaaattttgccccccccagctttgctcccttgctaggacttccaggccatgactattgaagccatagggcaggattacttcctcaagaggcgttagtggaaacagatgtgttgaggaagcctctttcttttcaactgtgccctgagcacatcagatggagtcctcttcatagcacaaaacaacttggtcagattcttagggtttgaccacagcaccctaacagcctggccgtgcattaaggaccccaaagagaaggatctgctttgccagagagctgactcttctgtattttacagacaattctgaattcaatgtcaacatcttagacatctcagtacagacagtaaagagttaaaatatgtctataagaaacagcgccagaccctgaaattgaaagctctgtgcctccctgcgtgcagtcagttccacactgtcctctctcccagttctatttaataaaaaaaacacatgagtgaaatttagggaaataagaattcctgaaattaaagcaattaagttttcagtcaactgtatgaaaagctctagacaaagaggtactttctatttcaaaatatgtatttcccagaaaaccattaccatatctagctagaatttctacaaagaatgattatgaataaagtatatattcaaatgcttctggtaatttagtcatggtcaaagaggagagaaaggtgatacaagtgaactggcaaagattttacaagatagtacatttttaaaaattttatttgcaagactgatttaaattatctatagatgagctaaatctgtcctatagatcaattaaatgaatcactattttaaatatatcacattcttaattacactgaattaaatataattacatattcactgcatacatcataatgttaattaggggaaacattttgaatcaaatatattgagatatatagcacttcaattttctttttataaaaaaagctatatgactaagtcaggtaaaaagaatctggcaagtactcatagaaagctaaaggaagactagattaattgatgtatcacatcaaggcttacaaattgtagaggaattcctattctttaactctatgacagtatataagactttgggctaaggaagcaagtttgcaacaagtttttaaaaaataataaaacaggaggcagggcacggtggctcacacctgtaatcccagcactttgggaagccgagacaggtggatcacaaggtcaggggttcaagaccaacctggccaaaatggtgaaacccagtctctaataaaaatacaaaaaagttagccagatatggtggcgggcacctgtagtctcagctattcaggaggctgaagcagggaattgcttgaacccaggaggcggaggttgtagtgagccgagatcacgccactgcactccagcctcggcgacagagctagactccatctcaaaataaataaataaataaaaattttaaaaaataaataaaataaaaaataaaacacattgtttaccattgtttctcagagacatacgattattttagaagtggataagccttttttttttatactttaagttttaggatacatgtgcacattgtgcaggttagttacatatgtatacatgtgccatgctggtgtgctgcacccactaactcatcatctagcattaggtatatctcccaatgctatccctcccccctccccccaccccaccacagtccccagagtgtgatattccccttcctgtgttcatgtgatctcattgttcaattcccacctatgagtgagaatatgcggtgtttggttttttgttcttgcaatagtttactgagaatgatgatttccaatttcatccatgtccctacaaaggacgtgaactcatcattttttatggctgcatagtattccatggtgtatatgtgccacattttcttaatccagtctatcattgttggacatttgggttggttccaagtctttgctattgtgaataatgtcgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatatccttcgcccactttttgatggggttgtttttttcttgtaaatttgtttgagttcattgtagattctggatattagccctttgtcagatgagtaggttgcaaaaattttctcccattttgtaggttgcctattcactctgatgatagtttcttttgctgtgcagaagctctttagtttaattagatcccatttgtcaattttggcttttgttgccattgcttttggtgttttggacatgaagtccttgcccatgcctatgtcctgaatggtaatacctaggttttcttctagggtttttatggttttaggtctaacgtttaagtctttaatccatcttgaataaatttttgtataaggtgtaaggaagggatccagtttcagctttctccatatggctagccagttttcccagcaccatttattaaatagggaatcctttccccattgcttgtttttctcaggtttgtcaaagatcagatagttgtagatatgcagcgttatttctgagggctctgttctgttccattgatctatatctctgttttggtaccagtaccatgctgttttggttactgtagccttgtagtatagtttgaagtcaggtagcgtgatgcctccagctttgttcttttggctcaggattgacttggcgatgcgggctcttttttggttccatatgaactttaaagtagttttttccaattctgtgaagaaagtcattggtagctttatggggatggcattgaatctataaattaccttgggcagtatggccattttcacgatatggattcttcctacccatgagcatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttccacttttcctaattgaataccctttatttccttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttaacatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcgttttgccagtattttattgaggatttttgcatcaatgttcatcaaggatattggtctaaaattctcttttttggttgtgtctctgcccagctttggtatcagaatgatgctggcctcataaaatgagttagggaggattctctctttttctattgattggaatagtttcagaaggaatggtaccagttcctccttgcacctctgatagaattcggctgtgaatccatctggtcctggactctttttggttggtaaactattgattattgccacaatttcagctcctgttattggtctattcacagattctacttcttcctggtttagtcttgggagagtgtatgtgtcgaggaatttatccatttcttctagattttctagtttatttgcgtagaagtgtttgtagtattctctgatggtagtttgtatttctgtgggattggtggtgatatcccctttatcattttttattgtgtctatttgattcttctctcttttcttctttattagtcttgctagcggtctatcaattttgttgatcctttcaaaaaaccagctcctggattcattaattttttgaagggttttttgtgtctctatttcctcagttctgctctgatttagttatttcttgccttctgctagcttttgaatgtgtttgctcttgcttttctagttcttttaattgtgatgttagggtgtcaattttggaactttcctgctttctcttgtgggcatttagtgctataaatttccctctccacactgctttgaatgcgtcccagagattctggtatgttgtgtctttgttctcgttggtttcaaagaacatctttatttctgccttcatttcgttatgtatccagtagtcattcaggagcaggttgttcagtttccatgtagttgagcggttttgagtgagattcttaatcctgagttctagtttgattgtgctgtggtctgagagatagtttgttataatctctgttctcttacatttgctgaggagagctttacttccaagtatgtggtcaattttggaataggtgtggtgtggtgctgaaaaaaatgtatattctgttgatttggggtggagagttctgtagatgtctattaggtcctcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtactcctgtattgggtgcatatatatttaggatagttagctcttcttgttgaattgatccctttaccattatgtaatggccttgtctcttttgatctttgttggtttaaagtctgttttatcagagactaggattgcaacccctgcctttttttgttttccatttgcttggtagctcttcctccatccttttattttgagcctatgtgtgtctctgcacgtgagatgggtttcctgaatacagcacactgatgggtcttgactctttatccaatttgccagtctgtgtgttttaattggagcatttagtccatttacatttaaagttaatattgttatgtgtgaatttgatcctgtcattatgatgttagctggttattttgctcgttagttgatgcagtttcttcctagtctcaatggtctttacattttggcatgattttgcagcggctggtaccggttgttcctttccatgtttagcgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatatggaatattggcccccactctcttctggcttgtagggtttctgccaagagatccgctgttagtctgatgggcttccctttgagggtaacccgacctttctctctggctgcccttaacattttttccttcatttcaactttggtgaatctgacaattatgtgtcttggagttgctcttctcaaggagtatctttgtggtgttctctgtatttcctgaatctgaacgttggcctgccttgctagattggggaagttctcctggataatatcctgcagagtgttttccaacttggttccattctccccatcactttcaggtacaccaatcagacgtagatttggtcttttcacatagtcccatatttcttggaggctttgctcatttctttttattcttttttctctaaacttcccttctctcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttcttttcctttggtttgaatgtcctcccgtagctcagagtaatttgatcatctgaagccttcttctctcagctcgccaaagtcattctccatccagctttgttccgttgctggtgaggaactgcgttcctttggaggaggagaggcgctctgcgttttagagtttccagtttttctgttctgtttttttccccatctttgtggttttatctacttttggtctttgatgatggtgatgtacagatgggtttttggtgtggatgtcctttctgtttgttagttttccttctaacagacaggaccctcagctgcaagtctgttggagtaccctgccgtgtgaggtgtcagtgtgcccctgctggggggtgcctcccagttaggctgctcgggggtcaggggtcagggacccacttgaggaggcagtctgcccattctcagatctccagctgcatgctgggagaaccactgctctcttcaaagctgtcagacagggacatttaagtctgcagaggttactgctgtctttttgtttgtctgtgccctgccccgagaggtggagcctacagaggcaggcaggcctccttgagctctggtgggctccacccagttctagcttccaggctgctttgtttacctaagcaagcctgggcaatggcgggtgcccctcccccagcctcgctgccgccttgcggtttgatctcagactgctgtgctagcaatcagcgggactccgtgggcgtaggaccctccgagccaggtgagggatataatctcgtggtgcgccgttttttaagccggtccgaaaagcgcaatattcgggtgggagtgacccgattttccaggtgcgtctgtcacccctttctttgatcccctgaccccttgtgcttcccaagtgaggcaatgcctcgccctgcttcggctcgcgcacggtgcacgcacccactgacctgcgcccactgtctggcactccctagtgagatgaacccagtacctcagatggaaatgcagaaatcacccgtcttctgcgtcgctcacgctgggagctgtagaccggagctgttcctattcggccatcttggctccgtggataagccttaaaaggctcaatactttttaaaaatttcctataaaatccagaatctatctagatttttgagcagcctgtagtggttggaggaccatgattgtttactcatttggtcacctaaacatcccaagcaatgatttgttctgacagcagactgataacagttttttttactccttggaatcggaaaaaaaatcagcaagggaagcttttggaagccacccggtagagctggaagagaatttcgaaatcaattcgctcaacctctccctttacaggcagaaaatgtgctagattggaggtgaagaccctggagccagagagcctaggcttagtcctagccctgcactgaaggtaatgtgaacactcagtgcctcagtttccttctaggcttcttgttctgagattccatgaattaatatttgtaaaatgcttagaactgtgtctaacacattgtaaacactaggaacaaatgctaaggtcatgcaactcatcaatgcctccctggggtagaaccagccttggcccatgggcatgctcattcttcttttagacaaggctcttaggcatccctagagtgtgggttggccttcctatgcctgtacgtaagaagtatgatgtaatgtaaggaatataggattcaaaatcaacaattaggattcaaatgctaatatttattgactcaactctctgaatcttagtttcttcatctgtaaaattataatgatcataacaaacccaagtcacagacttgttcagaggagcaaatgagataatgtactttgaaaaccataatctactctgcaaatgttatgtaacattataattgtgagttcagcaaagccatgagaatgtttcaaaactgtttaggacatcaagaagttggggtggggaaaattcttaataggttttctccatatcctcattttccatttattcattgttttaaaatttatttttcttatgatatacatatatatatatatatatatacacacacacaaaagaattatgtacggtcctgcattgcttgcattctgagaaatgcatgaataggcaattttgtcattgtacaaacatcatagagtgtacttatactaacctaggtgatatagcctactacacacctaggctgtatggtatgaccttttgctcctaggcaacaaacctgtacagcatgttactctgctgaatactgtaggcaattgtaacacaatggtaagtatttgtgtatctaaatatatctaaagatataaatatgtctttataagtatacaaatatatctttaaatatactagtatatatttatagatacaaatgtataaatatatctatagatgtactagtatatatatttatagactagaaaaggcacagtacaaatatgatattattagcggggtgtggtaattcatgcctgtaatcccagcactttgggaggctaaggtgggagaattgcttgagccctggagtttgaggttacagtgagctacgaacacatcactgcactccagcatgggtgacagggggataccctgtctctcaaaaaagaaactaaaacaataagatagaatcttatgggaccaccataatatattcagtctatcactgattgaaatgtcattatgcagcacatgactatatatatgtatatatatatatatatatatatatatatatatatgggatataaaacaaatactcatatctctaccaccaggctcaaaaagggaatattacctttgaagtcccctgaatatcccatcctagcaatattcctccccctcctggaaaagtgggtaaacaacaattgtaagtcatgtgtttgtctttcctttgcctgtagttgcgctacacaggtgtgtgcccagaaaatattctttattggatgcatggggtttccttcttgactcagagatctcaagctatacggtatcttcctgcagccttatagtgtccaccttattctttgtcactatttccctttcccagccaataaagcacattacctctgtcattcaaatgaactcgtaaagagagattttagaaaagagctggttcacctcaggttcacctgagcaaggaatgggtgtcagtgactgtggaaagtggagcacagctgccagagcagtgcaaggacccaagaaatgggagggtcttgactcgggataaccactctgagattcattggatgtcctagattgtcaccttgccttacaccttaagggagaaaaggataaaaagataaggcagatgtgaaagctatactaaggagcttagacttttcctgcaggcctttgggaagcaactgaagctttgaagaagggaatgacagcttgagactgcttcaaggcagaagagataggagaccagaaggccagtgaggaagcacttaggctgggccaggggtacaggtgtggctggaagggctgcccagaagcaccactgtggaccaggctgagcaggactgagtgactggttagatataggaaatgccagagaaagagaaggtggtgatgactgaaatttcagagttacctaaatgcaagcatggtatgttcataaccaaaataggtagcaaggagagctaggtttgagagccaagctgattagtacagaatgcgagtggttatctctgctgtttccagaaaataaagattaatttcagccttaaagtcagggacttaaatgagatgatctcgaaagccctttccatttttgtaattgtgcaatcctcagaacgttgcccagaatagtaagcagaagcaaaagaaattcaggagtttgaacataagagagagctgttctctgatgcctgctccaatgggaactgggcactgtgactgagccctcggctcactgagtctcctcctgaggagtgtgataaaacctcacagggctgctgtgggtcttattatacatgaaaatacccacctcagtgcctggcacattctgggtgcaggaaaaagtttgatttcctccctcccttccttccttccttcctttttcctccctttgttaccataggagagagtcaggctggttccctgcgggtgctggtgtgaaacctgctctttagactcttctgcagttccccaaagcagctactgtcccagagaactgctttctgccagcaatgctcagttttaccctaagacacgataactcctggctttgagggaagcacaggtagcaaggggacccctgacagcaaatgtgtagttgttcttccagctaggccccagccccaccttaaatgccacatccaggcactgtgtctacagtgctgagataaagcaaccccgtcttttccacacaaatgagcagcaaacatatttgctgattatctttgagggacataatgaatcagactgagatttagtcatatttgcacaatgctttacatctgagatactgaaagcttaatccaaggtttccctgttagttgaagtcctactgttagggctcaaagacagggtgcagctctgtaagccagtccctgatgccttgatcccaatcattgagtttatcaggattctccataggaagacacaaggagcacctctgctgcagcaaatgctggagtgttagtttttcctagaggctagtgcctcaacacctcttctgcagatctcagctatggagaaaatgaaaaagaaaaaggttagagtctcctggcttatgaaatttgaatgccacttgaacctgacatatttattttttagctctaaatcacacaagatcaagaagttctgcagatcctattccaacattgtgcaatgtctctatatttacaaattttatttgatggggggggcaatagagacataatttaatcctattagttcttgaggagatactatttagagatctcactaattcctgtcctgaaggagaagacttgaagtgtgcaatataaatattgcattaactctaatacagagttctacatttacgccttacatgtgtgcaaacaggtgcacagaggctaaagttctggttgtattgctctccctccatttacaaaagatcagtgagttcctgcttgcagattctctgaggagacccttagtttcatctcctcttcattcttctgctggcctgattcagcaagaccaaccacaaagcaaactgagtaggcaaatgggctttatctctggtgactttgcagatgcactaatttttcagcaggctgtcattaaatgcctactgggtgctaggcataatacagggtcctggggataaaagatgataagacaattcctgtcctcttgttgatagaaggcaggtagtttgtggtcaaagactctcattcacacccaccagattgtttttatatcccagtgaatccattatgtctctggcagcaccacacaccaggtcaagtttgaggctttaaagttcccaggatgtcacctagacttagagatgaagaaacactaacaaaagaagaaacaagacaaccacaaaaacctgagcctgaagagctgccacctctataatggaatatttcaaatggccttagatttaaaattggtctttgctcctttaagcagattcccttagctctggctatctctgcaaaatggatgattgatcaccaatagaaacttaattatcaattaatcggttgctatcgaattgctggtacatctcagttatctgctactcctcagagtaatccatagtactttagtgaagaaatacttctaattaaacagggaaatagcacttgctaatatatcaaagtaaatgactagacctaaaacattagtattaattacaagagtcagtgggtttagcatctctaagtttctatttgctaatttattgccactgaaaatgaagaaatcgttgttgatatataaaatagagcattttaggtggtttttaatcataaaagtcagtagatgtaaaaactctggattgcatgtggcagacatttgaccttaaggaataaggtcgctatacagaaggataactaaacttttatttgtttgttcttaaacaataaaatgatttgaaatatactttgatcattttgtgattattatcatatgggatgataatagagaatttcttacttcctaatcattttcctacacttatagttacatacaaagatgtaatgaaatttgctctccttttcttccaaggtatacatcattttccttaatactttctcccgtccccatcgtctaccccagatttaccaattcccagctatctccttaggacagtcaagaaccaaatactcccatttgtcccttataaactcttttaacttccccaatttctggaaaaacaaaaagctttaataatatagttttatatctccatactcatcccccatctacttataattgattcacttgttcattcattcaattaatatttactaaacatctactatgcatgatagttaatcaactactggcaataccatggtgaacgagtagggtccctgatcgcagcgagctgcttgggagaagtttcacattatcttataaatcacgcaagcaaatgttatgttgcagcttgtaactatgttacagctatgctatgggtacacaggtaaatgatattatgagaatctacactagaagcatttgacttagatagtggggtcagggcaggcctcctgaagaaatggtgataagctaagatctgaaggagatgtaggagttaacaaggtgaatgaaggtggaaggagcatttcaagccgggaaatagcatctgcagaggcccttaatgggagaacacgtgacatatttggagcgctgaaagaaggcctgctcgctggagcactaagaacacagatctggagaagttgggcaggggccggatgatgggaagggagccatacagtccatgttaaaaaaatgttgttctttatcctaacagcaatggggaagcattgagtgttttaaatagagagggatatggtcagatttgtgtttgaaaaagaaaatcctgctgcagtgtgaagaacagatcacctggcaagggtaacagtggatgtggtgggtctagttaagaagccgccgcagtagtccaggaaggaatgaggtggctaggatgaaaattgggaggaagggcatgaaggagaagactggatgggtctaggaggcatttagaaatgaaattgttgggaattggtgatggactgtatatgggggcggagggagagggaggaattggagatgacacttagatttctgacttgtgcacctggaggaatggtagagccattcactgaggtgtgtagtgtcctaaggtcaggcaggaggaagattgtggtttctaggatgggcatgttgttgaatctgaggtctctgagacatgtgaatggagatacttgagtgatgttatctacaagtgctgggctctttgtttgtttgttttgtttttattgcgtgggaggtcttccagaaaacctgctagacaaattctaaaagaaatataacactcatgctgggttctattgtgagagatttatataaactagcttgtttaatagttacacaagctctataaggtaagtactatttttttagttctctctactttacagattagggggaataaaacacagaaattacatgattttctgaatacagaaagattattacataaagcaagtaagcattaggggccaggatttgatgccagcacttgggtcagtgctctgtggcctcccagtgagttatccgttaaccaccactccctaccatctctctgcacaagaatgcacaaaggcacacatttaaaaatataatgtcagaacatgcctctaacatttattattattccagttgaaattcatctcatcagacttgcctgctagaagcattacctttgtgtcaagggctgagacatttaaaagttttgtttttcttataatagcagcagctaagttccatttttaggcgtgcacatattgaaccatggtgtgaattgcgatagtaaggttttagagtctataaataatgcctagtgaaattggagccattcagtccctagaaatatttatgcctatctgtggctatttgtctatttgcatgattatccttgccattatcctccaggctctgaaaatacacactgaaaggtttcttaccagcttgttcatgtctggattcacattaactctatgaccatattttattccagacacttctgagaaattcatcaggctgtgaagcgcgccgtgatgaatatcgaacagagtttaccacagctttgcagcgcgttgacttattcatgggtcaattcagcgaagtcctcttaacatctatatccaccttcattaaaggagacctcaccatagctaatcttgggacatcagagggtcgcttcatgcaggtaagtgctttctgagagtagctgtgtctgttctatctggtattgtgcaattaatttgttttcgtttttgcagtaaggtatttgcaaatactgtaaagtccaaatcatagtagaaactggaacacagactgaaagccaaacaatgaagcctggtctactttctgttaaatgtgtggtctctttttattaagttcttgaagctttcagtttgaatctgtttgctttaattttctcgtccagaatggtgtggcattttttttccatttataatttctgtcacgtgattggaaaataaaatgaaacaaagcacttctaggcaatttttttttatttcaagggaagctacagatcaaaggagagctattgtgtgaaccatgcatcttcatgagaagaaacattcacatcattgagaaatattggcaggagttaggaagggacaacattatcatcaaaatcccattgtaactcaagctctcctgattctgtaaaatggtagggttggatgcaaataagttcagatacaaaaaaaatccagattttattaagaaatggttttaatggatagcaacagtatttctgtacaacaaaagtttccatttcaacttactgtgtttcctagatacaagaaccatagcactttgcagaaattaaaagactctcttgttgggttggtttttgctgttttgtagttattggtgcctttaacatgagttgttagtagattcttgatgaggaaagaatgacaatagcatctatggaaatcttgaacttctgtgaatactagaaatttcttttaaagggagatttcgtaattgtctgatgtagttagtaccctcatcagacaataacctctagtaaaccaactgagaatgataagcttttcctataacttgcctgtctatacatcctatatgtgtattcttctacaaaacatttttttaattaccactctctttatagcagcctggatattgatcattgccatattttaaaacctgtaagttatgtttttcttgtactaaagggcatggtggaattttttcaaggtcaaaaaccatgtaaataaaaccttcctagctcaaaactaatcatacaggtcctgttatctaattattcccctagtaatctcccttctattgcttcacattgaactacgccttttctccccctttcctctgtccattccactgtgcttgtttatccaactcatccatcttgaccatttaattctatccttaacttctcaaacctgaaggagggaagccccgcccctcccacagagacatgcactctaatggatttgaaatatgctcatatctattatgtgtaaaatgtgtagtattgttctgtgtttatacatgtttttaatttacatcaatggcattctatacaattgcaaaaatacaaagaaggactagaaaagctggcatctattgatttcctaatgtgttcattatgttgatttgcccccttttatctttatttctgcttttttttttttcaaaatcgtccattacctcaccaatccagttttgtatgaataagctttttatgattactttagctccgactttttttaacatcaaaagttccctggcctatttccacattctaaagttgtaatacaattccttatttaaatatgttgctttattaactgagtaaattctgctgtgtgacagagtcaatcgcctgagggatatgtcacgcatcagtctcattatagaaacgctgtagcaaatgttttattcttgtctcctagcctttgtgtaaaagaaactatattttgcctattaactatgcatccaaaacaaaaggtaaaaaaaatgcttattttatgaaaagtactggtatcactgattttttttaaaagtggcttttaatttatcaaataagtatcaagaactacctaactttgctttactatacaaacgaatgaagcaaaggaaacagtgacacagaacttacctttaagaaattaaattttagtaggaaagatacctgataataatagtacctacagacaaagggctattcgaaaccacagagaatctatttctctgacgcttgcctaagagaatttcattccattaaattttataaagaaacctaaagcatttgaaggatcaaacaatcaacatcactgaagtccatatatttacagtaaataatagtgggggaggagtcaggagtggagcacagatatggcaacctcccactttaatctgtcagagcagtgacttcctacaaagttctgtaaatgttttgactgcaccacagtgttaaatgtatggctaggcctgagtttctacaactcgtgttttagtaaatacgatgaagtttctgttacaaaatagaatggacattttttttccccccaaagacagctgccctacacaaaagggaacagaaagatgattttacttccttcctaccctgaagcctaatggcaaagttgctttgcaaatttttttctcccaagagtttgcagctgtttctgtctttcctattgtgcttatgttcagctctggctgggaacacaagctacagccccagctgttgggtgcaaagtgaatcaggtatttcacagtggtcatttgattagaaagaattatattgtttagctaacaacattttgtgtatggcagggaagacatttttgacatgttcctaacatttaatgatgtgtaacttatcttgtacaggtgcagctatatctgaaaatactgatgcatacatatatttaagtctcaatatctgcagagccatgtcaatgtagatgaagatttaaaaataatttttatttgcatgatcactctcttgggatacttcgaagtaaaatagtaggataagcaatgtttgagatagtgtaagtgaacaatgagaacgtgccttcttacagactggggaaggagatgtagaacagagtcagacttgggaacattaacacagtgtacacagctacgtgggagagggaagagggattctcatgaagatcacaggactaatcacagggattgtccacgtctcccttctgagcgcctcgtctaatctacatccagaacaatgcttccttgattttttttaacagcacttgtataaggcttttaatctctaaatgcaaagcattgctattaaaatatttgtgcatgactgtcaggccagggagagtgagtggatcagggatgcgagagggggtggggaggccctttcaagaattgtttcaagttcagctccacaaatactcactgggcaactactatgtgcactacactgtgcctgctcccaatggccacagcctgggcactgtcactgctgctactgggctccgtggttccatcctagctcttcccgcatgcccctttcgcctctccaagttcctaaatgttgttaccacccactcatcactcctgttctcttctgcctcttaactggactagttggatcttaagtaagaaacccaaggaggtagagatcacctaaaaagatgtcccatgttcaagatcattacttatgaccactacttaaaggactgtgttagtaatcagtgaacctaagaataattactcacttccaataagaaaaatttgtttatctgttgacctcctgtcttcaaattccttcagttcccgtgcccccatcgtggcatgtcagtgctttctgtgagaagcctgtagtatgcatcatgtttggaattactgccattttagagtatgtagatgcagatccccaattcgtcaatgttgtgaacatctggcagagacacagctgaaggaagcttcaacttgaacaatgattctctttagggatttctaacttacccatctcttttataaaataatcagataaaaatattatctgcctttttgtgtgtgtacatcattaacttagttttaaccctaaagaatgttagctttggcttttttttttttttttcacagtgtctcgctctgttgcccaggctggagtgcagtggtgcaatcttggctcactgtaacccccacctccagtattcaagcaattcttgtgccttagcctcctgagtagctgggattacaggcacgtaccaccatgcccagctaatttttgtacttttagtagagacgggtttttcgccatgttggccaggctggtctagaaatcctggcctcaagtgatctgcccgccttggcctcccaaagtgctgggattacaggtatgagtcaccgtgcccacaagatttggtatatttctttagaggaaaatacactcaagggttctgaaatttcttttgtgtaagaaagaactttttataaataataatttcagttatgtccataactaaaaatcaaggattccatttatatgaaatatctagaataggaaaacctatagagatagaaagtagattagtggtagtcaagggctaagaggatatggggagactgggaatgacagctaagggatgtggggcttctttttgagataatgaaagcattctacaaccctgtctcaaaaaaaaaaaaaattaaaaccgttcaattgtccactttaaaaacaatgggggaggtatacagaaactgcatacaaacatcttatcttaaattgtattcatcattcttaaaatttaattctattaataaaacggtttaattaaagataaaactgtatatgggaggtaaggagatatggcctttacatatttgtggatatctcacacaaagttactttgttcaggtttacagatttgggggcctagccacaacagttttatttgtacatgtatttcttccccatgtcctatctacaaggggctatgtgagatcaaaaccacaaccatttggtaaattcagattctgccctgccccaaatgtattagtcctgtattttcaaggccattaaagaaaaaatatcctgtgacctaattactaaagattagttgttgaatagtaggaactcaaagataattgttggtcttctattttatgcgaattcttctaagattcccaggttatttatcataagaattacatttacatggcaaatttagttctgttcctagaaatatctccatgacaaccaaaaggaactcctaatttctggcacacattacttcaggggtattttgagagttaaagtggttaatcgattatttagaatcctagcaataagagaaagaaaagaattaagggtagaaaaacatttatagcagtaggtatccctgcagagaacgggctaatgatcaactaaaaaggcatttgcatctgtggtacagcctctgcgcaaaattccaaatggcattctcacttccaagtcacctcacttctccatgtgccttcctgtcttctcatcttcatcccattttctatagcaagcaacactcatgctaactcgtgatcaaaagtagagcttggcggagtgtgctagtaacattttctctatgccctcaaaaactagttagatgcagagactttctccttaggcacacttaacttgtgcagcaaaaattactgaaacacggagtaactggcgaggcaaatatattgtgaaatttgttttagtacttttactcacgagtggctcttgggagctcagagttgaagctttttcaatggtatttactctggtgctccaagagcctagcagttgagtgtttaagaggtcaagcacatggattctggcctcagataaagctctgtggaaatctgactcatgtactttctagctgaaattctatgttgtattttttttaaggaaaataatagtacctaccttataggagtattgtgaggagtaaataaaatctccatttaaagcacttggcacaatatgtgactcagtttcctgttatgaaagtacaaacatttggtgcttttcagacaaagctttttaacagaggatacacatatcaatcaatccaagtccagaggtgcaaagagcttccgaaaagaaagagaaaggttaattctttctgggaaaggactatttggatgggcttcagatatttcataaagtcaaagatgatgacctagtaattaagaagggattgcttattatagatttgggaaatggtattaaaaagagcaagaaggtaggagaaaaaaagggctctaggaggtgattgttatgtagccggtctaagtagaacggaggaaaccagggagacagacacaaaatgcaggtgtccattgcaaggttcatagtgatgaataatcttcagtgaagtgcaaagcatagaatgagctggaaaacaaagtcagggtattaagacagactggtgttctgtgttgcttttgacctgtgtgtgagaaaaggagtttttttgcttttgtgtttttgtttttgttttgttttttgttttacctttgcagtttgaagtgattggcaacagccaaagaaatatggggggtattgggcaggagtataggaaaaatgagatgtgatgagcccagaagggagttaagattgcaaaattgggtaaccaaaatctggagaatttgtaatagaagctttagaagtctaacatctgatattctgcttgtaaccagtacccaaagggaggtgggactggtaattgaatttctgttcactttgcctgcaaaggtcaccaatacctattgggccctaactttaggaaataacaatagtttccaacctttcccatcctgaccaagtgacccttcatccatcacttaacttctgtgcaaatataaccaccctttttaatggagatgttttgaaagcgttgagtgtttagagtagaacaaacattagagcacaaatgtcatgatgtttaacttttacagctgtatgtgagcttggttagtttctctatcaacaatccactctctgagaacaaattaggtactttgagaatcttcccaaattgcttcaggatacttggctcctttgttatgctgaagaaaaaatttacaattgttccccagaacatttatatgttgtatgtgtttgttagagtacaaagcagttaattattgctgtaattttcattcccattatacgaatgagaaagctgaggtagagggagtgactatgtaatcgtaatctcacagatgtccatgtttgtcctgtgatttcatacccatcgcgagtaaatgcatgttcaatgcaatgtaaaaggctattagagatgttgggcaatttcacaaagtagatttcaagtctagggctgtgctgagcctcctccaccttcatgtatatgcaacccagtggcctacttaagagtgaaagtttctctgagaactccaacaccctcctaaaaatctaagtgttcatgtaagataatcatttggattttatcccaattgttgtcaattatgctctgaactttattattactgggttctaggaacaggacagatggaaattagatagctgggaaacatcccaaattttaaaaacctgaaagcaaaaatgacatcaatcatcaaacctcatttcccgggcattgttaaaaccatcaggccttattttaaagccagaccaagaagcagagttttataatccaagtaataatatattgtgggacagtggtttataaaaaaatacaacacatcatttcaaagtagctgggggcctgttttgacctgaaaagatctataaatgtggcttaagagtagcacagctggaactagctccagtattccagactccgcgtccactactcttaaccattacatcaagggaaactgcctggcagggaggattaagaggatatatttaaaaaataatccagattcattgtagcatgtgtggtgtcttctttctggagagagttttggttcctccattttccaatacaattgcagggatttgtctgtatgtgctgccaattgattgaaagatctctttcccttgaaaccattaaaagatcataggcaaagtctgtcttgggggttcagataatttggcttcaaggcaagagattagaagatgacatattgatttacaatgaggggaactgttgggtcttcagttcaaacacccacaagccctgctaatctgttattaccattatcatctacattttccacttatatttaaactgagcttgttggaataaggatgttataacttttttgctgtttaggttgtggtttctcgatcaggaccatcaacccctcatgtgaattttctcctggactcccatccagtgtctccagaagtgattgtggagcatacattaaaccaaaatggctacacactggttatcactgggaagaaggtaagctgttcccacagggaatttccatagacgtggtttttcccaaatgcatatttacaaccagtgtcacttggccctttataatgtctctcttcatcttaaatttacccctcctccattaagttctttagtgagtattccagagatcttctgaaatctagttaatttgttctccaagaaagactagacctaagggaggtctttttcaaaacttctccttttgtcctatatttctcaacaagaaaaataaacacacagaatgagaattacagtcctaatgacagagctctagtgcaggcagataaatcctggaaatgtacattggaatccgactccaaccaataatcccttttctcctagagaagaaagtgcatcttgatgccagaatgacatgcaactttacttagaattttccagagattcaagtgtgttttcccaccacttaaattatactctcttgttattttaaaatcatctcagacagggcacaatgtccctactatgtagaacctctaacattgtgtggcaatgctatgctcactggacaataatgttactttttcacatacctgctaacaataaaggaaaggaaggaatcagatttttaaaattttaatcaccgttatgacaggatttgcacacatagttgctaagtctagaaaattccatcaaatgatatttacatgtaccttttgtgtacttactttataattaattaacaaactagatacccctctggaagctctttccaccccttctcttcacagatcacgaagatcccattgaatggcttgggctgcagacatttccagtcctgcagtcaatgcctctctgccccaccctttgttcagtgtggctggtgccacgacaaatgtgtgcgatcggaggaatgcctgagcgggacatggactcaacagatctgtctgcctgcaatctacaaggtaggaatctctaacagctggcatacatgtttttgtttggtgttttttttttttttttggtttggtttggtttgttttttgtttttttagatacaaatcccactaatgaaaaaaatttaaaaatcaatttactcatttagctgtgagtcatcagctaaagcaccatctctctcttggctttatccctcgggcagggagggggtggtgtttgggcatccccccaagtcctgcacctgaagtgcttgcttcacattgtctaggttctatcgctgggcagctgctcacctttagtgccgtgtgaataaaagagtggtggtgaataagcaacagtgctccccattttctcacactggggcctgttccctcctgactcacccactctctgattcctcgccacttcctatataggccaagtgcccagacatgagcctccatcacagaaacagatctgttcatggcatatcctggaaccctgagctgaatcctgcaaactggtgatccctgccatgctggggcacacaggacagttttcttcctgtccgatgcatagatggtggccttgtctgttcacagatgagactgaagattatttcccggggtgaggtgggcaaggcaagtggagggtcaacacccatgggtggctgtgagtcttccttcagtgttcccagaaaaaaaagcaaaggctcaacggatgactatactaacatctatacttctgtaagccatgccactctttaattcattccaaaaatatttattgagtgcataccatttagcaggctgccctctagtccctgaggagatatagtccagaacaagatgagcacatctcttgctgatagagaactcagtttctggcaatggacattggctctaacatcgcagccatgctaactgtgttgccttatttgcttaagcatatattcggcactatgaaaatctccacgcaatttttaaaaatttcttagtccaaaacatcttgcttaaaaacacttccctggtgagaacccagtgtgtatttttctctgtgtgcatgtagaaaagttggactttagtaaatagttcttatgaaagattcaagttaaaggtctcggtcacctggttcatgcccaagtaaacaaaatgtgcgagtcagaacaagaaccacccccaagtgcatggctgttttcatttagttacggtttggagcaagatttgtagtgggtgactgggttttaaaccaagttattttctgttaggtgtgacacagttattaagacttagcttgattgaccagagaataaactaaagacagtgacaaaacaaatttaaatctatactgtagtatttgtgtacttttttgttgttcagtatacttttggaaccgtatgcaattttatacttttataaacaaacaacttcagcaatttgagacactaggaatctgaactctgctattccatgaaatagatatggaaaatatatgtgtgtgtgcccatgcaattaaatcacaacaatttcatttcaaaaataaccaagctggtattttaagtaaagaaaatggtttgataacctgtacaaatgaaacatttaatttttactaatgtgcttccttttactaagcataaaagctatactaaaatgcttaaaaataaagtaaatatttcagaattttctggaaccagagaatctcttgcaatatttaaatgtccctcctctctcacccttcttaactctagcattctatagttgatgattctcaaaggttgcgtgctaccatgcacaagtcagtgaggcttaagctgcagttaggaaggcagggcagctgagtccataaatccctctaggttcatagttgttaggaagatttcatgctgcaccagactgtgacagttagcattcttcctgcaaaacataagacagactcgaggtgggtgttaagatggccgagtaggaacagctccggtctgcagctcgcagcaagatcagtgcagaaggcaggtgatttctgcatgtccaacagaggtacacggctcatctcattgggactggttagacagtgggtgcagcccacagaggttgagctgaagcaaggtgggatgttgcctcacctgggaagggcaagggattggggaactccctcccctagcaaaaggaatccttgagggactgtgttgtgaggaacaatgcattccggcccagatactacacttccctatggttttggcaactaacagaccaggagattccctcatttgcctacaccaccaggaccctgggtttgaagcacaaaactgggcggccatttgggcagacaccgagcaggagttttttttcataccccagtggtgcctggaatgccagcaagacagaaccattcactcccctggaaagggggctgaagccagggagccaagtggtctagctcagtggatcccacccctacagaacccagcaagctaagatgcactggcttcaaattctcactgccagcacagcagtctgaagttgacctgggatgctggagcttggtgcagggaggggtgtccaccattactgaggcttgaataggctattttcccctcacactgtaaagggtacagcttcagcagacttaaacattcctgcctgctggctctgaagagagcagcaaatcccccagcacagtgctctagctctgctaagggacagattgcctcttcaagtgggcccctgacccctgtgcctcctgactgggagacacctcccagcaggggtcgacagacacctcacacaggagagctctggctggcatctggtgggtgcccctctaggatgaagcttccagaggaaggaataggcagcaatctttgctgttctacagcctctgctagtgataccctggcaaacagggtctggagtggacctccagcaaactccagaagacctgcagcagtgaggcctgactgttagaagaaaaactaacaaacagaaagcaatagcattaacataaacaaaaagaacgtccacacaaaaaccctattcaaaggtcaccaacatcaaagaccaaaggttgataaatccatgaagatgaggaaaaaccagcgcagaaaggctgaaaattccaaaaaccagaacacctcttctcctccaaaggatcacaactccttgccagcaaggaaacagaattggacagagaatgagtttaacaaattgacagcagcaggcctcagaatttgggtaataacaaactcctccaagctaaaggagcatgttctaacccaatgcaaggaagctaagaaccttgaaaaaaaagctagaggaattgctaactagaataaccgtttagagaaaaacataaatgacctgatggagctgaaaaacacagcatgagaacttcatgaagcatacacaagtatcaatagccaaatcaatcaagtggaagaaagaatgtcagagattgaatatcaacttaatgaaataaagtgtggagacaagattagagaaaaaagaatgaaaaggaatgaacaaaacctccaagaaatatgcgactatgtgaaaagaccaaacctacatttgattggtgtacctgaaagttacagggagaatggaaccaagttggaaaacactcttcagaatattatccaggagaacttccccaacctagcaagacagcccaacattcaaattcaggaaatacagagaacaccacaaagatactcctctagaagagcaacaccaagacacataatagtcagattcaccaaggttgcaatgaaggaaaaaatgttaagggcagccggagagaaaagtcgggttacccacaaagggaagcccatcagactaacagtggatctctctgcagaaaccctacaagacagacacaagacagggatgccctctctcaccactcctattcaacatagtgttggaatttctggccaggacaaacaggcaggagaaagaaataaagggtattcaattaggaaaagaggaagtcaaattgtccctgtttgcagatgacatgattgtatatttagaaaactccatcgtctcagcccaaagtctccttaagctgataagcaactttagcaaagtctcaggatacaaattcaatgtgcaaaaatcacaagcatttttatacaccaataacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaatattccatgctcatggataggaagaatcaatatcatgaaaatggccatactgcccaaggtaatttatagattcaatgccatccccatcaagctaccaatgactttcttcacagaattggaaaaaactactttaacgttcatatggacccaaaaaagagcctgcattgtcaagtcaatactaagccaaaagaacaaagctggaggcatcatgctacctgacttcaaactatactacaaggctacagtaaccaaaacagcatggtactggcaccaaaacagagatatagatcaatggaacagaacagagccctcagaaataataccacacatctacaactatctgatctttgacaaacctgacaaaaacaaggtatggggaaaggattctctatttaacaaatggtgctgggaaaactggctagccatatggagaaagctgaaactggatcccttccttacaccttatacaaaaatttattcaagatggattaaagatgtaaatgttagacctaaaactataaaaaccttagaagaaaacctaggcaataccattcaggacataggcgtgggcaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaatttttgcaatctactcatctgacaaagggctaatatccagaatctacaaagaactcaaaccaatttacaagaaaaatctaacaaccccatcaacaagtaggcaaaggatatgaacagacacttctcaaaagaagacatttatgcagtcaaaagacacatgaaaaaatgctcattatcactggccatcagagaaatgcaaatcaaaaccgcaatgagataccatctcacaccagttagaatggcaatcattaaaaagtcaggaaacaatatgtgctggagaggatgtggagaaataggaacacttttacactgttgatgggactgtaaactagttcaaccattgtggaagacagtgtggtgattccttagggatctagaactagaaataccatttgacccagctgtcccattactgggtatatacccaaaggattataaagcatgctgctgtaaagacacatgcacatgtatgtttattgcagcactattcagaatagcaaagacttggaaccaacccaaatgtccaacaatgatagactggattaagaaaatgtggcacatatatgccatggaatactatgcagccataaaaaaggatgagttcatgtcctttgtagggacatggatgaagctggaaaccatcattctgagcaaactatcgcaagaacaaaaaaccaaacaccgcatgttctcactcataggtgggaattgaacaatgagaacacgtggacacaggaaggggaatatcacacaccggggcctgttgtggggtcgggggaggggggagagttagcattaggagatatacctaagtaaatgacaagttaatgggtgcagcacaccaacatgcacatgtatacatatgtaacaaacccgcacattgtgcacatgtaccctagaacttaaagtataataaaaaatatatataaaaaaagaaaccctacaagccagaagacagtgggggccaatattcaacattcttaaagaaaataatttccttcccagaatttcatatccagccaaactaagcttcataagtgaaggagaaataaaatcctttacagtcaagcaaatgctgagagattttgtcaccatcaggcctgtcttacaagagctcctgaaggaagcacaaaatatagaaaggaaaaaccggtaccacctactgcagaaacataccaaattgtaaagaccattgacactgtgaagaaactacatcaaccaatgggcaaaataaccagctaggatcaaattcacacataacactattaaccttaaatgtaaataggctaaatgccccaattaaaagacacagactggcaaattggataaagagtcaagacccattggtgtgctgtattcaggagacccatctcacgtgcaaagacacacataggctcaaaataaaggggcggaggaagatttaccaagcaaatggaaagcaaaaaaagcaggggttgcaatcctagtctctgataaaacagacttcaaaccaacaaagatcaaaaaagacaaagaagggcattacataatggtaaagggatcaacacaaccagaagagctaactatcctaaatatatatgctcccaatacaggaacacccagattcgtaaagcaagtccttagagacctacaaggagacttagactcccacacaataataataggagactttaacaccccactatcaacatcagacagatcaaggagacagaaagttaacaagggtatccaggacttgaactcggctctggaccaagcagacctaatagacatctacagaactctccattccaaatcagtagaatatacattcttctcagcaccacatagcacttattctaaaattggccacataattggcagtaaaacactcctcagcaaatgcaaacaaacagtctctcagatgacactacaatcaaattagaactcgagtttaagaaactcacttaaggccgggtgcagtggcttacgcctgtaatcccagcactttgggaggctgaggcgggcggatcacaaggtcaggagatccagacatcctgactaacatggtgaaaccccatctccactaaaaatactaaaaattagctgggcatggtggcgggcgcctgtagtcccagctactcgggaggctgaggcaggagaatggtgtgaacccaggaggcggagcttgtagtgagccgcgaaggcgccactgcactccagcctgggcaacagagcaagactccatgtcaaaaacaaaaacaacaacaacaaaaaagaagctcactcaaaaccacacaactacctggaaactgaataacctgctcctgaatgactactgactactcggtaaacaactggtacatttgttatttttcaagttaaataatgaaattaaggcagaaataaataagttctttgaaaccaataagaacaaagacaaagacacaacatatcagaatctctgggacacagctaaagcagtgtttagagggaaatttgtagcactaaatgcccacaggagaaagtgggaaagacctaaaatcaacccctaacatcacaattgaaagaactagagaagcaagagcaaacaaattcaaaagctaacagaagacaagaaataactaagatcagagcagaactgaaggacatagagacacgaaaaaccccaggagctggttttttgaaaagatcaacaaaattgatagactgctagccagaatcatcaagaagaaaagagagaagaatcaaatagacacagtacaaaatgataaaggggatatcaccactgatcccacagaaatacaaactaccatcagagaatactataaatatctccatgcaaataactagaaaatctagaagaaatggataaattcctggacacatacagcctcccaagactaaactaggaagaagttgaatccctgaatagaccaataacaagttctgcaattgagacagtaattaacagcctaccaaccaaaaaaagcccaggaccagacggattcacagccgaattctaccagaggtacaaagaggagctggtaccattccttctgaaactattccaaacaatagaaaaacaagggactcctccctaactcattttatgaggccagcatcatcctgataccaaaaccagacagagacacaacacaaaaaaagaaaatttcaggccaatatccctgatgaacatcgatgtgaacatcctcaatacaatactggcaaaccaaatccagcaacacatcaaaaagcttatccaccacaatcaagttggcttcatccctggaatgtaaggctggttcaacacaggcaaatcaataaacataatccatcacataaacagaaccaatgacaaaaaccacacgattattgcaatagatgcagaaaaggccttcgataaaattcaacaccccttcgtgctaaaaactctcaacaaactaggtgttgatggaacatatctcaaaataataagagctatttatgataaacccacagccaatatcattttgaatgggcaaaagctggaagcattccctttgaaaaccagcacaagacaaggatgccctctctcaccgctcctattcaacataacattggaagttctggccagggcaatcaggcaggggaaacaaataaagggtattcagataggaagagaggaagtcaaattgtctctgtttgcagatgacatgattgcatatttagaaaaccccatcgtctcagcccaaaatctccttaagctgataagcaacttcggcaaattctcaggatacaaaatcaatgtgcaaaaatcacaggcattcccatacaccaataatagacaaacagagagccaaatcatgagtgaagtctcattcacaattgctacaaagagaataaaatacctaggaatacaacttacaagggatgaaaaggacctcttcaagaactacaaaccacaagcaaatggagaaacattccatgctcatggataggaagactcaatattgtgaaaatggccatattgcccaaagtaatttatacattcaatgctatccccataaagctaccattgactttcttcacagaattagaaaaagctactttaaatttcatatggaaccaaaaaagagcccgcatagccaagacaatcctaagcaaaaagaacacagctggtggcatcacgctacctgacttcaaactatactacaaggttgcagtaaccaaaacagcatggtactggtaccaaaacagagatatagaccaatggaacagaacagaggcctcagaaataacaccacgcatttacaaccatctgatcttttacaaacctgacaaaaacaagcaatggggaaaggattccctatttaataaatgatgttgggaaaactggctatccatatgcagaaaactgaaactggaccccttccttacaccttatacaaaaattaactcaagatagattaaagacttaaacgcaagacctaaaaaccataaaaaccctagaagaaaacctaggcaataccattcaggacatatgcatgggcaaagacttcatgactaaaacaccaaaagcaatggcaacaaaagtctaaattgacaaatgggatctaattaaagagcttctgcacagcaaaagaaactatcatcagagtgaacaggcaacctacagaacaggattaaattgttgcaatctattcatctgactaagggctaatatccagaatctacaaggaacttaaacaaatttacaaggaaaaaaaccatcaaaaagtgggccaaggatataaacagacacttctcaaaagaagacatttaggtggccaaaaaacatatgaaaaaaagctcatcatcactggttattagagaaatgcaaatcaaaaccacaatgagatcccatctcacaccagttagaatggtgatcattaaaaagtcaggaaacaatatgtgctggagaggatgtggagaaatagggaatgcttttacactgttggtgggagtgtaaattagttcaaccattgtggaagacagtatggcgattcctcaaggatctagaatcagaaataccatttgacccagcaatcccattactgggtatatacccaaaggattataagtcattctaatataaagatacatgcacacgtatgtttattgcagcactactcacaatagcaaagacttggaaccaacccaaatgcccatcaaagatagactggataaagaaaatgtggcacatatatgccatggaatactatgcagccataaaaaaggatgagttcatgtcctttgcagggacatggatgaagctggaaaccgtaattcccagcaagctaacacaggaacagaaaaccagacactgcatgttctcactcataagtgggagttgaaccatgagaacacatggacacaaggagggaaacatcacacataggggcctgtcgggtggcgggggtctaggggagggatagcattaggagaaatacctaatgtagatgacagataatcttatgtgtcttaaactttgcaggcacaaaatccagctaatgtatggagtttcactttctaatacatgcaagttaacctgcttttcaaggtacatgatgttcagtggctaaaattctttacagttctagatatgagagatttcaggactgtaagcccattattttgcttcaaacatggtatctgatctcatacttaaagagcaatgagaaatgcttcagaaaagggagagcactttttaatatattctgaatgtattaggatgcagttatcatatcttgtaaggttgaaaattcaggccgggcgtggtggctcatgtctgtaatcccagcactttgggaggccgaggtgggcagatcacgaggtcaggagatcgagaccatcctggctaacacggtgaaaccctgtctccactaaaaataggaaaaattagctaggcatggtggcaggtgcctgtagtaccagctactcgggaggctgaggcaggagaatggcgtgaacctgggtggcggagcttgcagtgagccaagattgctccactgcactccagcctggatgacagaacgagactctgtctcaataaaaaaaaagaaagaaagaaagaaaattcaaccccagtgagacaacagaactattcattgatcagaatactcagaaaagcagtattatatagggataggagggtaggcaggcagtatactgccaccagtaaatatatttgtgagttctactaaagaggaaaggagaccccttttggagtttttttgttctgttttgtttttgttttttagttttctcatgttttatcctaatgggttttgaaagcatgatcatttaaaatactgttggaatgggcccatcagtgatgtgatctttcacctgtgaaaagacaagggctacttttgtggctgtatctcccctatccagacaggtaggagacccagcctctgtggctttatgccggacgctcatttcctgcccacagagtttctctgcccttcaggataactcagagtttgccagccattgttgggtctatccaagggtgtgtagttcacaactgcttccttcctttttccctagaagggtaaaggttaccccataagctaaggggaaaatgcccagcccagagagaaaagctaagcagagcgagcctcttggatcctgagggtctagcagagggcttataatatctcttcctattgccagtgccccagttgcgcagctctctgcgtcttttctcaaatcatcacccaatccgtttgccttttatagaaagtgatggtaatgatgtgtgtagagtgacagacttcagtttttacatagaaagacgggatgtaggcagtgggatcaggccaacatcagccttgggcagcgttttcagtggggaagcctcctcattagaagagccggcagcagctgtgtgactgcctcaggctgaagagagtcctgggagggttggatgtcttgttctctcctactggatttctaccataataataataaacagatttatttttctagtagttctcatttgactagacatggatgaggtaaattttcaggaaaggcacaacagtgtaatggatttttatgggtaaaatggctatcataaaagctttaagctaaaactttaaaggggtttgataacgagggtacattaagactttggtttgcaattatttacttaggaaggatggaaatgtttgcaagtttgaatttggctaaaagcccttcttaattgtaaaagaatcacttttagatgttcacaagctgagctttagcaaatacctttactggttcttgagttgcctctatcttagttttcccaccattgtactttacagcacaatttacaatatgtccccacccccaaaagagcatttcctttctcaattgtcacaaagctgctgagaagaagcttatttttaacttggaaatgtgttttgttttaatagttttagcctgagagcaattatcttacacactttataggtgcctaatgcggtcttaaatcatgactgaccaaggtttatcaataaatccattgataacataccagaaatgagtctgcaataacaaaatgagtctgttatttgcttaacatcaaccatcagggggaaaaatttaatcctaaaaatgagatataaaacaataccaatgaagataattaggaaaaattgttacaatactgattttgggccctctctggttccgtttttatctatttctaaaagaaacaacataacacatgtattaaatattacataatttttaaaaggctgagtgtgtcaactaaccagcctggtatacatcaaatagtgaccatatttaaagaacaaggaaaaatcttcagtcattaataaatgtgaactaataggtaaaaagaagtagattcacttttcatttgttagtgcctggtgcataggaggtgctttattaagaaataattaatgaaacctgggcagcataacaagaccccgtctctacagaaatttaaaaattagctgggtgaggtggcgcacacctgtagtcctgtctactagagaggctgaggcgggaggattgcttgagcccaggagtttgaggctgcagtgagctaggactatgccactgcactgcagactgggcaagagtgagacccccatctctaaaagtaaataagtaaataatgaatgaatgaatgaatgaatgaattattggcagatatgtgttccaaaaccatctatatgtttcatattatgctagctgctgaatgcaactgggcaaacactggataccaaatgaggtatttttactgtgcaacttttgtctctgggtggggaataccatagcaaccagaatgtagtgcacgcagccagtgcacagagcaaggcgtataatggctggaccttggcttatagagcacatgaaggagtttgataagagctcagtccgaaggctgatgaagagttacaatcagagttatgagcaagtaaaagtctgggcccaacgtgtttctactcctaccctaaagagccctagaagatgaattcacttcagaatggcccaaaaagggccaggtccaatggctcatgcttgtaatcctagcactttgggaggccaaggcaggaggatcacttgagcccaggagtttgagaccagctgggcaacgtagtgagaccctgtctctagaaaaaaaaaaaatagccaagcatggtggcccacgcctgtgatcccagctactcaggaggctaatgtgggaggattgcttgagctcaagaggttgaggctgcagtgagccatgatcacgccactgcactccagcctgaacaacagagccagactctgtctgaaaaagaaaagaaaagaaagaaggaagaaaggaagggagggaaagaaaaagaaagaaagagagagagagagaaagagagaaagaaagaaagaaagaaagaaagaaagaaagaaagaaagaaagaaagaaagaaagagaaagaaagagaaggaaggaagcagagaaaggaaagaaagaaagaaagaaagaaagaaagaaagaaagaaagaaagaaagaaagaaagaaagaaagaaagaaaagaaagaaagaacggaaggactcgaaaagcccctttattcctaccaagctgcatctgctctttgtcccatctttggatctcctgaaaacaacttgtttcattaacatgtcatgtagttttaatgtttgttccagatgctctgaaatttgtgaccctttttcctttagtgaaaattaaatttttactaaattgtgggaaaatgaaagaatttcagactatttaaggatatacattttgtttgttcgttttccatatatgtgaaaaattataatatattgggtttttttaaaagttctatgttgtccttgtaggttttcccaaatagtgcaccccttgaaggagggacaaggctgaccatatgtggctgggactttggatttcggaggaataataaatttgatttaaagaaaactagagttctccttggaaatgagagctgcaccttgactttaagtgagagcacgatgaatacgtaaggatcttaaaatgctttgctggggtgtgcttggaaaataggttttgtttttgaatgaatatttcttttaaaattgctcaagaagctcatctcttgaattaaaaagggtcttggcctgtcacatgccttgtgggtctgttctgttttgttcttgtaatcccatttactcattggatttgaagagagagaaaggtgacatggcctaggtgaagagaagaggccagaaatgggagtttctcaaccatttatgcgacaagtcttcaggtgttgtctgagtagatttgcaagagtagcactagttgggatcacttcatccttggagtcttcaaatgtagagtctccaaaggctttttctacagaaatcagtaaacagctcagcatggatcctctcttttaaattcactttctaaacctcagaaatgtagtgaggcagctgaatcacgtgtttgagacttttttagatgagttaaaatttatattcagcttatatttactggcactgcaatatatgggctgtatctcactgaaccatccccacggtcctgggagggagcagtatcattcctataatataaaagaggtacctgaagttcagagagatgaagtgtggcttcacagaggtaatccagagagtaagagctgaacaagccttcagctcagctctgatcatcttctgatccaagacccgtgctagttctactgtattctacatgtacccttctacaagctttgaattccataatcatcagagaatccagaaattattcattatcacataataacaacactcaaatatttaaagttttatggttgaatctttatgattgaacccattctatcaggtggttattttatatctaatagaattcatttcagggttacacaaaggtccgaatctatccattttactgagaccaaaacactaatgaaggtaatatttgttagctgaatggcaaaacaaattttttctagaaatctcccttgtaaaatctccaaaactcttaatcattgcatataaatcaggacctgtaaaagtaaagcataattcattctctcctttaaaaagttatttaataaatcaaattgtatttaaattttctcagaactatatgattattcattcagaaataattctatggaaagccatcacaatttcattatcatttaagtaatttaaataagcatgtacaagtataaccacagaaatgtacctgttgacatactttaatgaagagattggcctatttgtagttagcccattgtttcatatgcatctgaagtggaccaaagattatccccaaatattaatattatccaaacttagattattatgcactattcaactggtgaggtctttatggataaggtctgatatttcctgtttgtctgtataagtgctatagtaccattaatgtaaagtttagtataagcagggtgcagtggcttacgcctgtgatcccagcactttggcagaccaaggcaggaggatcacctgagcccaggaattcaagaccagcctgggcaacgtagtgagactccatctctaccaaaaaaaaaaaaaaatttttttttaattaaccagatgccgtggcatgcacctctagttccaactcctgagtccagaggatcccttgagcccaggagttcaaggctgcagtgagctatgactatgccactgccctccagcctgggtgacagagcaagatcctgtctctttttacataaaaataaaagttaagtttatcatagtatagaaataggattatataatttttggccttaatgcttatcttgaaactctgcttgctattcaaagcagtcagctcaccatttagagttaatgtcacttcctataaaacaacctaaccagaaaattccttggatttgtcatgtattaaactttgggttttttttccagattgaaatgcacagttggtcctgccatgaataagcatttcaatatgtccataattatttcaaatggccacgggacaacacaatacagtacattctcctatgtggtaaggaagattctatcctatcatgtttgatttttacttaatctatttaaattataagatgaacaagttactttgttttgtttttatctcccctccaggatcctgtaataacaagtatttcgccgaaatacggtcctatggctggtggcactttacttactttaactggaaattacctaaacagtgggaattctagacacatttcaattggtggaaaaacatgtactttaaaaaggtgttgtaaatttattttttgttgcatctgtcaatttgaattaatatctgtaccttaaaaattaagcagattgttttgtgtgtgtgtgtggagaagaaaaatcaagatgtttatttgtttactctcctactgacaaaacttcctccttccaaaattcatctactccttttgctgatttttcttcctttctcttgttttttagcaatcctacttttcagttttgtcttcccatccaccctctttattgttatagcttaggatcttagctatactatgagctgtgagagtctggtcattgataataatttaaaataaacattttcatcaagatttgtaattagactaagtcactctggggaaggaagaaatggggaaaattgggtctggaagacagttatgtttctgcttcttagagttggaagagctcagtttaatcaagtaccaaaagtactttaaaggtttttttttcaaatctcaaatgttttccagtcaaggatagcttgtccacaacaaaggtaagtttgagatccagtcagattaaacagcctacactagaaaaggcttccactcaggaaattcccacttaggaaccattgagttatatccttttgatttgtggatataattctaaaatatgtgtatctctaatagctaaaattcacttccttaattttttttgttcagtgtgtcaaacagtattcttgaatgttataccccagcccaaaccatttcaactgagtttgctgttaaattgaaaattgacttagccaaccgagagacaagcatcttcagttaccgtgaagatcccattgtctatgaaattcatccaaccaaatcttttattaggtaagtagaagcttctgatgggtataagaaaacaatgaatacaaggatgattttgctgtagaatagtcaagaggaattgcagttttatctctggctttgatgctgttatgttgcttttgaaggcttctttccaattcaggagagaaaactatattcaggttctgagtgtagtttgacttatcaatgctagttcattccaagaagtatcttatcctgttctattacatttaaacagagtatagcaaaatagtttaatgtggcattgtagtatacatgcacttacattatgtacatatcaattctatactaaccttagtgcccagaagtggaattaccttttttcttccattctctagatatgtttttgtcctgcctgctttacacacagcttttctttatgccagactctctttgaattgatatctcattggacccagttcaatctgccttgtttccgttaattctatcagtctagcaacaatagttaagttcggttttctttgtatttttttcagaggtgaaatatttattttgtgtaattcggtgaataaaatacaaatgcatttcttaagcttatgaaatatgcattttaaaaatattttcaagttaaataagttgtttccaaagaacagttacccatgaacttccatttgatgttgactgtgcctctgacctgtaatcagtgcaggtgattaaattgaatccctctcttacagtacttggtggaaagaacctctcaacattgtcagttttctattttgctttgccagtggtgggagcacaataacaggtgttgggaaaaacctgaattcagttagtgtcccgagaatggtcataaatgtgcatgaagcaggaaggaactttacagtggtaagtcctttgagcaatggttctactcagagctctgcatctttgcctctaaccatgtggctttcatggtacctgagacatctcagtttcgcctttaaggtttgctagttaatttccttgcagtgtagccaagtagtattttttatttaataactgaaattatctagagtcttgggctaaccatgtggaaaaaatacatacacatacacacatgcacatataatgtttagacaagaatgaagattaccaatttgagacagtgtttttttatgtttgttggttggttggttttgagggtttttttgagacagtatctcaccctgtcatccaggctggagtgcaagggcacgatctcagctcactgcaatttccccctcccaggttcaagcgattctccacctcagcctcccaagtagctgagactacaggcacgagccatcatgcctggctaatttttgtattttttggtagagacgaggtttcaccatgttggccaggctggtcttgaactcttgacctcaaatgatctgcccacctcggcctcccaaagtgctgggattacaggcatgagctactgtgcctggcctgaggcagtgtttttacagacagtcagtacaaatggaaatcacagcatttccctagtccctttttaatgtgtcatagaacatggacccttttgctctaataaaatccttggaaaaggttgctgatcttgcagcagtattcttgcatttctaagcagctgacgtatgctttcttacagccccctgttcttcttatcattcttcttgtccctttgttagctctttcttgaaagagctaacaaagaaagagcattagaatatttatgttatgtcctaaagtgtgaatgttatttgctgtttctccacctatccttattttatataggtcacattaaagtggtagttttagtttagaccttagaaagcttggagttatttccaaagattccatacattttgttgatgtttttctctaatataaaataccataatctagtaggacttgagcactcaactcagaatgaaagttctaagtgctcttgctcaagcaaggtcttgattggtcaggtgatagattgaattacagcacttccttttagattctccatccaatatttcttgaagactaaagccacaatgttctttaattacaaaaaccaatttggggctaaaaatgtcaagccaaatcaccaaataataaggtcatttcaaataagatttttcttggccttctcaatcagccacattgcatcacctctagagagtattattagatttttatcatattcctgagagattgtactctagggagtcaccatatgaagcaaagcattttgaaaccaatccccacacatggccacaaacaaagttagagtaccactgctattaatttaaaggacatcagttctccacaactaagcataacaatgtttcattaaccaaataagaataatagtgaccctctttggtgttggtatgagaccttttaaagtagaaatctgagaaattattagtttatctaattaatgctgagcctccattattaagataatgactgaatttcctttcttctccctcattggcattaaagtgacactcagaatgccttagcttcagtcattcatttgtaatcaaatatttattaaaaactttttaggtgtcacacatgagagttacatatcccaaggatgattcaaacaatggtagacgataaaaatcttatttgtttatatatctggaaatataaacttctgttgttttagtgacaaacatgttagtacagtagaactgtacattagaatcggacaagagtgaaaaattcagtggatctattttactatttactatttattttactgtcgtttgtgaaaagtactttataaggagatatgtattcattccatgttccttgccacttatagaatttaaagctgaccatgatgaattgaacccatttattatttaacaaataaaaactcttggtcaggtctgatttagatatataggtccagccacaataactttaagtccaataaacttgaatcctttcaaaacaagaacaatcatcttcataacaaaatgtatattaaattgttaacatgtgcattatgccctaggagcctgcagtttattgtgtagttctcaaatttcttgttatgtaaacaattattgtgatgacagttaaattgttcatgtccatcaggaataaataacttttagcattataatattaattttatataaaactaaatagtataattttatccatattatatctctatcagttttatctgctgcctatatacatttttaatgtaagatcattttttaaatgattttttaaagaaaatagcaaataacaaattctgtttgtcctttttatgtatatcctgagtcctttttctattgtgggcataagtaattgttttatctccaactatacttgtcaaagaaaaggaaatctaagggatgttgttgcttgtttgtcttttccttgggggaaaaatgcaaccgttaaccttagatgtaccactatgtgttgctggtttagtctaagtacaatcaagaggaagctacattttccaaaattccataaatcagaattccaaagaggaagatttgaaatgagacatgaaagggcatgaaataataatagcagaggctttgtaaaatagagagcataggaaaaggtttcagtataaaatatgtcatagacaaaaagatagcatgggagtgaagacactgaattttggagttaatggcctaggatttatattcgctattctgccactccaagctgtgtgacctggcctaatgacataagtttgcaaagctcagtttcttcatttgtaaactgtgggtaatcataatacccacctataggattatcaggagaattaaatgagaccaactttgtaaagtattttgcacagaacctggcattcaataattaatagcttaaaagacactaataagattacctaacaacatagttaattatcatgttcaccatatggtgcttggtgctttacaaagcactttaccatgtggtatccaacatggtaaatagcattttcatcttaattcctaaatgaggaaactgagttattcagtgtgggccctaccttagttcccatagcttgggttaaagctaggagatgagccaaggccttctaaccccacaaagctgagctcccagtctgcctgactgcctcacacaacaaggggcagttcctccaggtgactgtcctgtcttcttaaggaaaataaaatgatgagatgaaggccagcttcagatagatcagcacagtttatgctgggcaggtggagctctgtgtttctttgaagggtgggttgtttggataattttgcatgtatcgtgtttccagaaatgtgtagtctaacattaggaagttaaatacagattttttcaaaaattatatattttcaattgattggggtggtaaattataaagttgctatggatgttgccaagctgtattctgtttacagtggataattgtgtctttctctaggcatgtcaacatcgctctaattcagagataatctgttgtaccactccttccctgcaacagctgaatctgcaactccccctgaaaaccaaagcctttttcatgttagatgggatcctttccaaatactttgatctcatttatgtacataatcctgtgtttaagccttttgaaaagccagtgatgatctcaatgggcaatgaaaatgtactggaaattaaggtaagaaatgctttaaacactgtcttaaatcatcagctcaaacttaattgacttcatagctatgtgaatacaattgttgtacttggccattgtatcttatacaacaccagcaaatatataaactctgaaaaacaaatctttttggcataaaactaaaagataagaataaccgtggactgcattttaatgaagcattaaaaaaccctttcttgtgtatgtattaaaacgtagcaaatgtgggacacaaattatccattaaagaggatccgcgtcatgcattatcttgctgatgttatacatttccccggacatgttacctaaatgtgctcattataagataaaacataagagctgtgaaagtaaatgcatcaattgtatctccgttcttccttgtaatacttggaattttgtatctgggtatggtcatctctaagctaatttgtaaatggaactagatatctgccaccttaggaacatattagcttctaaatgtaatttaatagagaataacagatcatcttttctaaagcaagcctgttgcaaacaaagaacactaagacccagaaaggttaagtgattgacaagtgacaaaatagtggcagaataataaagactagagtgcagcttttttatgtcccttcagtagtttctacttcaaataataacacaggcaaaatgctcaagacttgaattattcatagctccagtcactagaaacagcaaaatatttatccttcaacatgttgttaaaacatttagaattttttttcctgaaagatgatctgaatgcaaatatgaacaaacataaagcaataggatagtctttatttggttgtaatataggctttcatgggtcatctccatctaagtaataatatgtttccattgaaatttttctgactttttcaacaaaaatttaactgcagcccaacttatgcatatgttcacgttcatacaagtttactaacctcattattgtgttttgtacaataattaagcaagcccagcataaaattgaatggaagcccgcttcaatgaacagtgtgtttacaaaagcaaagttctttcatctgcttctttaattagttttagaaagggagaaataagcttttatcacttctttttttttaataaaactaatctagtgtgaccttttgctttcaacaattactgtgtttgccatttgaaagattccatttggtttttcttgatgataacaaaggtttatgtgcaaatagttttacactcacagaaactctatttttctgttcctgtatctatgatgaagggattagagataaacggttctttatctacccttccaagcacagtctttatggaagagaaaacttctctttccataaattaaatacccattattcaacatcctacaaaattgttggaccaagaaaaacataatttggcatcatcctcggcctgtcaatggtattcccaacatggcgaaagggtcttctagagactggcaaaaaacactttattttcttgcctatatatggaataactctttctctaacaagtgtatagcacctgccacgtgacagaatagtaatctagtgggagcagtggcaattcagggagattattttagtatcatggttcaatattttttcatacttcatttttcttatgtatgagaggaaagcaaaggcataagagaatatttgttgtgtcagcaatctaactctttatcaatacgttaagttgatcacattaaaacttctacctctcagccaggcacggtagctcatacctgtaatcccagcactttgggaggccaaggcgggtgaatcacttgagatcaggagttcaagaccagcctggccaaaatggtgaaaccccatctccactaaaaatacaaaaattagctgggcatggtggtgggtgcctgtaatcccagctactcaggaggctgagggacggaggtgacctgagtcctgaaggcggaggttgcagtgagccaagatggcaccactgcactccagcctgggagacagagcaaaaaaaaaaaaaaaaaaaaaaccacgtacttcatcaatgaaagtgctctggagagaatcatgtgtttagaatgagatatgctctttattgccaggaagatttcatgctcctcatgcagccatgcatgcaagagttcctagggtgaaaagagattgtgatcattccctgccctagttgtgagagtccctcaattcatagtaagcccagtgactacaccatgggcaaaagggcgagccaggtttggatgagggaacacaataggggtcaagcataagtcacccctcagaatgaatcctaagccccatggatggagaaggaagtttttggccaaggcttcaagtcccccaagagcagtcgtagacagtggtcatcaaaagtaggtacctctttgtgggtatacatgactccccaaatgcctctatcaacaacagctcatgtttgtatggaattttacagttgacactgtactttggcatattttatttcatttgagtctcatgtggacccatgaggttgggaggtcagtgatgattatccccatttatagataggtaaacaaaggtttaggaagattagctgatttgtcttgggtcacccaggaagcaaagagcagaactggggctcacactcaggcttcttgattccaaatttggtcttctgtcactgcatacactaaattacagtatttcttatattaactctcatttaatgtatactaaaataccattatagagacacttttctatcatatgctatttatatatctatgcagttctttagagggaatagctcttaactttttataaatatctaaaaatttattctgtttaaagaaactctgtatttctccctgagtgtcttatttctgactttttatgcatgagcatatcttatgaaaagtagaaaagtattctgtttcatgctggaacaaggactgcctgacattgccttgggggtttatcttattctgcagcatataggaacatatgagaataaagatgcttcaaatgttcaatctggagaagtcaggtcaaacaggaaaaagaagcacaggaagatgagccagggcagggagcggggacttggtctatgacactgtcatcacaggaacaaatgctgagagctcaggaggaggtgaagcatcagtgtgtgggcattggaaggatcaaaaaggaagcatggttttgaaccatcctaatccacctgctgcccagagccagccagatgttgtccttctccctttgaataatttatgtgcaactctacccctcaatctcagtcaaaaccaccatgaactcagttctgagtccagacaggataaaagtgaagggttcttttttcagaggttatttggcccagtgtcgaaacctgttcttattaatggtgctcaacgcttactctcaaactagtatttctttgtgctgcccaggttaatgggcattctgcaaaatatatatatattctttttccagggcagtttcatagtatctaataataaagatagtaaaaaatatattcctgtggtttcatggtacctagtagtaaaggtccccaactagccagcaaagccaccagtttaattttggtttgcccagcttttcccaaatggccagggaagttttccccaaaatgcctattaacatctggtggaactcagttctgaagctgtctgtgaggttcgttgcttggttcctaagttgagggacttgtgtcctctatgtgaagtgtaaatctcaccccctcaccaccacctcactaatttcctactgctgatctccctggactttggaccctcagcctggctgagtcctgctgccaaactgtactgacttgcccagacccagcctgtggccacctgggtgtatgaaaacttgaaggaccctcctctcatagtgttatttttcagatcctacccacttccactcccatctgctcggttctgtaaccatctcagacatgagtccccgggtgtgaatactcaatagaaacatgtcacacctggccagggttggagaggaaagagacatggtacatcctgatatagcacattgggagtaattagttttcatttttgaaatggatccattttgacattgcagtgagaggaagaaatccttactcatctttatattctcagtgactagaactgtgtctaacacacagtagacggtaagtagattttgtgtcaaatggaatttgatttgcttcatgatctagcccctttctggataatagttctccatatgtaaagcagaaatgacaataatacctacttcagggggagtatctttgcaggataatatgagatgattataactaaattgctctatgtctgttggagattaaagatcagaaagctctctctcttttgttgctttatttttaaacccacatattaccattttagtgactgaaatcaccctgaagcagttgaatgacttttatttaataatagttaatattcaataataaatattaatataattaatagtaaaatttctaaatataagttttttagcatctcaataaagctatgtttactttcttttattttaaatgacaaaaattagcctataccttttaaaatttttccttttttgggccccattgttatatagaagtgagctaccagtatcacttttgtaatatctgggactttacgcttctaatatgcatatatatatatatgtgtgtgtgtgtgtgtgtgtgtgtgtgtgtgtatacatatgtgtgtgtgtgtatatatatatatatataactgatagtagttgcttatataagtcactacttaccatgtgtcctttggtatctacatataaaatgagacacagtggatgtgtgatctgtttttgttttagagaagcctttatgcaacaaccagggagatcctaagcctgaaaccataagtattggaaacacaaatgttgtacattcatcccttcccccaaccttagttattatctaagcaagcaagacacattttagaccttttctcataaatcaaatcctacagctctttaatctcttttctttgtcattccctgaattccctccaatatgtggataagggttttatcccccttcagacctagccaacaagttgtcgtttgaagccctaaagtcatctcttagattgctgagcttctgtgttgtgttggcctgtgtggctgacctggttcaatggactacacatactgcttctagaagtatcataaggatagggtttgtctatatccattttatctgaaactccaacatcaggttataaagaagtattttcttcccacttcttttcctagaataataactgcctgaccaatcaatctattgagatccgtatgagaccatgtatgtgaatggagtttgccgagtattaaagattatataaaacaaaggagcagcattttagctattatgggctgctctttgttagtaagaagaatagtaatatgctttgatatatgtcacctcaaaataatagcttgctcaataaataactgtactcattaagtcttgatatgagaaattatacctaggtttgcacttctttcgcaaggctaattattggtttctcaaacaaaacgttgatatttttaaaatgcctgatggtaacttcagttaactaaatatgccacattaactaatttttaaaaaatttttgtgtaactatgtaattgttcaaaataatggaattgtgctctcaaattataatagtcatacagcatctcacataaatttcttttaaaatgaattcacttatgtataggactcaagtgtgcaagaaggatgaaagtaaactacccaactcaaacaaaaaaagaatgtattaatattaacataacataatacagtgttaatacattaacaactatttaacatcagatctctggagatgagacccggacatcagtattttttaaagttttcacggtgattccaaaagcaaagtcaaggctgagaatctctgcattgggcagtgttagatagtgcaacaactgaatctctacattgcgtcttttttgccaaacattgataccccctgaggacaatggtgaggtgatgataggtaagacatcattccacatttaaggatgtgaagcaagaacctctttccttttctttaaggtccaatttgatgcaaaagctatatgctataattcctaactaacacatgccctgaaatggtcatgctcccctttagccatcccaattcccatgaaaattagtatcatagaatcgtgtgccttggcaaacaacatggcctgtgtttgcagtatatttatattcctttgccattgttagcattcctgcagaactgtgaagtgttaacaacctttttttttttttttcctttcagggaaatgatattgaccctgaagcagttaaaggtgaagtgttaaaagttggaaataagagctgtgagaatatacacttacattctgaagccgttttatgcacggtccccaatgacctgctgaaattgaacagcgagctaaatatagaggtgggattcctgcattcctctcatgatgtaaataaggaagccagtgtaattatgttattctcaggcttaaaataaatcattaaagctcatttatgtgtgggttttggctcatcaactcagcctgcattcctagttgttattttagaaatagtgagctttttgccacattgtctccttccccaagcctgggaggtagatctcaaaagttctttctacccacactgcttctccatcacgccacactcttcccaaaatttgctgtaattctcagaagaaataaggatgcatccaagagtgtccttctactgcctcccaccaccccaggaggccagagccagtgttccactgccaaccactgtgatcactaatgcatagagtcccataaataaaggaagatgcatgcatcaaacaaagtaaaataaagattaaactactttacagtaacttttttcgtgtagacaactgaatcaaacaagctagaaccaaagcgagtgatctttttcattctttttttagcagctttattgtgatgtaattcacataccatgcaattcacccattgaaagtgcacagttcaatgggtttcagtatattatattgtcaatttctttgaattgaggtaaaatatacataatgtaatgtttgccattttgaccatttttaaatgtacaattaagttgcattaatttcattcacagtgttgtataaccatcagcattacctaattccagaactttttcgtcaccccaaacagatactctataaccaataagcagcagctccacatacccttctctcccccggctcctgataacttccaatctactctttctctctagaatttgcctattctagatatttcatgtgagtggaatcatacaatatttgtctttttatgtgtggcctattttacttaacataatgtttatccacgtggatgaacataagattcatccacgttgtagcctgtgtcggtacttcattcctttttgtggatgaataatattccattgtatatatcccacatttatccaagagtaagtgatttttaaagggttcctgaagtcttctgaagttataaaatggaaaaacacacaaaaattagaaaatcaaaggctgaatcatgagatcagagttggaatttcagaaggaccataaatcctaaaaatcataaaatgttagagccagaagggacttcaaagatttctgctgtgtatcaaaactgaagtaaaaatattctgagactttattgttccatcataacagtacaattatttacctcttatgggaagtcttctctgccctccaccccaccgtccaggacagaattaatgtcccattgtctctgttgattactgtttagtcatacttctatggtacataccacactgtactggaatcatttatttatatgtctgtctccccttctatacttcagttcctgttttttgtacatctttttatccctaatacctagttacaaatacaaacagctaagtaccacataagtacttaagggatcagtgtcccctaattatttgaacactggagcataattgaggaatctcttattatcctgaaggcagttatgccatttgtagaatggtaataaccagttggtatttgggacccaaagtgctacaacctgtgtagtacaaatatctatcatggctaaatgctgacttttctttatttgtcatttttagtggaagcaagcaatttcttcaaccgtccttggaaaagtaatagttcaaccagatcagaatttcacaggattgattgctggtgttgtctcaatatcaacagcactgttattactacttgggtttttcctgtggctgaaaaagagaaagcaaattaaaggtgcatttttgttactgttcatttttagaagttaccttaagaacacagtcattacagtttaagattgtcgtcgattcttgtgtgctgtcttatatgtagtccataaaacccatgagttctgggcactgggtcaaagtctcctggggcccatgatagccgtctttaacaagctctttctttctctctgttttaagatctgggcagtgaattagttcgctacgatgcaagagtacacactcctcatttggataggcttgtaagtgcccgaagtgtaagcccaactacagaaatggtttcaaatgaatctgtagactaccgagctacttttccagaaggtatatttcagtttattgttctgagaaatacctatacatatacctcagtgggttgtgacattgttgtttatttttggttttgcatttatatttttataaaaacctaaaggaagtatttacctctgccaagtaagtatttgacacaaaattacatggctcttaattttaaaagaacccatgtatatattacattatgattttagagtccataagctctcatttcacaaaaaggttaatttgagcaaaagtaatttgtttatcatctaagtgcaatagtaagaaattgcgaagctctcttttacaatccaggaagagttaagttacaaaatatacttatttaaatgtaagttggaactgctacattttttacctgttgaagcccaaacattgaaattatactgttagtaattcttcgaagtgttttcaatgaactgttagtacacagcctttttcccaccatattctaggacttgaatgtattttgagacttagccaaggaaaaccttcaattatgccatgaaaaaaaggaggggtcaatatcatcagctttgtaaaacactatgcctagtaatgttcaggttaatcagagttttcatgttgttttatttaaatctcctggtaaaagcaaaaggtctgtattgtatcagctccattatctttagaagttacaggatgtgagtcaagtacaagcatttccttggttgaatatttaccattggacaaataaaatgagtcacagatcattgaggatactggaaaagttagaagttgctcatccaaacaagttcaagagcaatgaagcacttaacattttaacattttcaacacttactacctcttatgttttgaagtttatgttatttctatggagatacacatagtaaacattgtctttgccctgattccattcacctttaaaaatccattcgtttaaccgtgtggaaaaatcaaacctagtttattgttttgaaatttagatctatttagtattttatgtgcacatttagtgcatctatttagtattttatatgcacatttcatagttctaatctgagatcattaaaatttacaaattttctttgaaaaaaaaacttacctaatcttctttgaacctccttactcaccaaagctctgtcatcattgctaagaaggttgagtttcacactcttttctccattgagcctgctccttggagacatgaaaagaaaacaggtaaaagagggtcatttagagagaatgagaaaataggtgcacagccaaaacctaatgaagaggcaactgcagagctttcctctctacatctggtggggacagcattctcatcagactttttcacggagacctagagtgctatgtggtgtgacatcagggtggcacactgatggtttcaattggtttctgcacatgttggaatttagctgaagagtcacgttttcatgccaaagggcttttatccatgtctcaccaaggatttccctcaatctgtgcacccttaagcatttagagccctgatctccagatgcaaaggctttaggaagtgagaatgaaagacctgagtttagagaggctgattggcattcccaatcccctggggaaggtttagagaccctgactccttggaattaagggagcaagtacccagctaggctccttccttcctcactcacccaacatttcaggtacttcactgatgttccacatccttctttaaaggttgctcttgtcttttttctggctagtgtctactataactgtaattgatgcccaacgcttttctggaaccacttttggccaagttcatttattattaatcaaactgtccactgtagaaaatactaaaaatgctcaagtgggattaggaatagtcaaggtactaacagcattctttttatgcccttctctcagattctgattctcctgcttatttgcaaacaaatgatacattttggtgctaatgaggaacccccacataaccttctccctgtgttacatactaatacatttcaatactatgcctagtttatcttcatgtcagttgctgtggctatgatgccccctccttgatatgtgtgaattcccagtggaaagagaaagggaaagtggaaatgccctatttggcattaagaaattgactatcagcaccatttcttcccctgaaataaaaaaaaaaattctccttgcaaaagggaactttgcctgaggttcttacagagctttggttataaagatcaacttataaagaatgcttacccctttcatagtgtccttaactaaacaacaaggatggtccactaaccgagatctaacctgccttctctaaacaacagtaacactaaatccagtgccatcactgcacagtggagaatttaccactaatgtgaaaagctttcagttttgggaatatagccattatttatttctaatcatatgtgtatttttcccttggccaggaatccataggttttgcacaatagtaattaattccattaacaaatagtagtgtctcaaaaggcatctttttcattttcttatatttgagctggatttttgtgagacgaggcaattgctcaactacctttgctgctaccactgcttccattcttaaggacatagtatattcaaaaataaaccataagcatggctttttgctattgataaagagagaaatgtctaaggaaatgagggtaaaaagctttcaaaattaatacttagtctacttaaatgaaaatctgtaaacatctaatgaaatgcttgtatatataacttagtatcttttcccaatttattatcatttttatcaaactaattccattataaaagctcttcctgtttcagtccccattaaatgaggttttactgttgttctttaataattttccttcatcttacagatcagtttcctaattcatctcagaacggttcatgccgacaagtgcagtatcctctgacagacatgtcccccatcctaactagtggggactctgatatatccagtccattactgcaaaatactgtccacattgacctcagtgctctaaatccagagctggtccaggcagtgcagcatgtagtgattgggcccagtagcctgattgtgcatttcaatgaagtcataggaagaggtaagtatttccactcagctttttgttaaatacgattttccagtaagcattttatctttggcctttgcagattaggaacttagacaatggtgaaagcaactgacagagcagtgataacaagtgtacttgatttctgttctatagaaatgtagccctgtaaatcatatccgtggggatttgcccttgtgcatggaagcaattggataatcccccaaatatattagaactaaatcacaattcgtcctcgtcctgtgtgtactagcaattatagtttcttcaaaggtgccatttactttcttctaaaactcagggccaggcgcagtggctcacacgtgtaatcccagcactttgggaggccgaggcaggtggatcacctgaggtcaggagttcaaaaccatcctggccaacatggcaaaaccccgtctctactaaaaaaatacaaaaattagccaggcgtggtggcgggtgcctttaatcccaactactggggaggctgaagcaaggagaattgcttgaacccaggaggtggaagttgcagtgagccaaggttgtgccacagcactccagcctgggcagcagagcgagactccatgtcaaaaaaataaatacttataaataaataaatatcactcctttaattttgagtatttttattcaatctctctccagtctttctttaccctgagaacagtgacaaactctatgaagcctggtttatagcagtttgtacactgctggacagcatcagaagacagagaatttatagcattctcctgatctaaagcaacatatatcatctctacaatgcactccaatttctttatacaaagataaatgaatatttttaataagctagccaaagcagcaataacagctagcataaacagtatttgtggaaatatttagcaggaaaagaaaccaatcaaaaaccgggaaatgaacttcattcttcttgttgtttttttttttctaaaaagcttttacccttaatactaaatggcctctgatcccttttattctatatgtgctgcaagaggttgtacaggcatctgccagtgtgatacaagagaagctgatggcgtgatttcccttatatgaacacaaggccttctcactttcctgtggtagcatccacacattcttctgtcaaacaccccagagcgtaatcctttgtgtgctccttcttccccaagagtggcttcactgttaacaaacatctttccatttctcttcagagtaatatatagttctgtcataggcctataaatcccagtaattgcatcaattttagagtgtgtggactcactaattgtgttctaattctacacatttggaaaactagaattttttatcatgaaaggtactaaaatggcaattatttctcttttgaagttataatcattaacagctctataaatattagctactatgtatttatatgtttttctgcaggagaataggagcactcaaaagcataagttttattttattcttctttgcattagtagagggcagcctaatgcctgacactcacatactaggcactcatggtgtcttggccagctggatgaattaattagtgaatgacttacacagctatcagacatttggcacctctgggggaaattactgccactggataaaaggctaccattgggaaaatgatgtggttaaagccagagagaactggatgaagtgagtcagggtgaatttgcttcatctgggcaactgcctttcagtttctgccaacctggattacgtattaaccagtgactaatggggaaatccttattctataatactaatcctatttttaatggtaacatttttatttcatttcagcttattagaatatagagaacttattttattatagttcttcatgtgggttaactttattttcatattttaaaatactatgtcatcctttaaaaaaatttatttgatgaggccgatgttactcaccttttcagtggttccactgtggttgaatattttattaggttaggctttaatatgagtcatatcatctacaacttattcatgaattaaataatcacattgcttatatccttgggtgaaatgtgttgcatctacatatatatttacaaacacacctacgtacctatagtggtattgttaaaagtattttttaaatgtactcttttgctgtatagaaagaagaaagaataaaatgaagctcataaagggtttgataaataattatttcataattaaatgttacgcagtgctaaccaagttctttcttttgcacagggcattttggttgtgtatatcatgggactttgttggacaatgatggcaagaaaattcactgtgctgtgaaatccttgaacagtaagtggcattttatttaaccatggagtatacttttgtggtttgcaacctaataaatagcttataataaaacgttgatttacactttccccttgtggaaaaatcagctaccactgaaattatgggcctaatcctgaaaatttgttttgttctagacttttattgaactacttcccctgaaatgatccctcagagccctcattagtaagggggtaggagaaatgaggttcttggatgaactgagtatcatttaactataactatgtttggtttataatatttgttttgcaagtgacatttctggaaactattggaagcatgttggcacctacagtagtaatgactcattttacccagaggcattactataattattttttaaccacaacttccattaaaaagataaaaaatgaaataagacaaacaggagaaaactacgctggccaaaaattgaaaaatcataagtatggtaatacctcatttatccacatttttggagagtgaggcattccacatacatgaacttcctaaataaatgaaacctacccctttttaatgctggaacattacttaaaattttagctgttattgagaaaatctttttaagatgaaatgcatactctgtttaagggaatgcttccaaatacaaactaagtctttattggtgaccccaagccataattacagccataaattactatattacacaaacagtgtactccacatacatagtgttcctggctccgcctgtgttgacaggtctcacatgcttgcgttttctactcccatttctcattttctgcttgcaaattgcagcagcctgaaaaatgttaaccagctctactacaaactttatatgggacttaataagctttaagtgcacaaatgaaagattttcctgcaagatactttactgtcacaattatttcagtctttttaaaatataaatcaacatgctaagtagtgttctacatggttaattttgttggaagtctgaccatgagggaaataaatggacagtctttatgaaacctaagtataacctttgcactaagtttataggagacaaactggtggctggttggactctatcttgcaaaagtgggcataggtggtgactggaaggcacagtgcacggtggcatcattcactcagatgtgatgtaaaaagaacactctgcagtcaaaccctcaggacaagatgctaactgtgtggtttaccatttcattgctcttcctatctaaatttgacaaaagtattcactgttccataatgaagttaatgtctccaccactggatttctcaggaatcactgacataggagaagtttcccaatttctgaccgagggaatcatcatgaaagattttagtcatcccaatgtcctctcgctcctgggaatctgcctgcgaagtgaagggtctccgctggtggtcctaccatacatgaaacatggagatcttcgaaatttcattcgaaatgagactcatgtaagttgactgccaagcttactaactggcaaactagctgtaagccagccatcccttcaaaataggcctgctctgagtctttaaaaagctagtagccaaagatgcacatttaaaatgttagcatcattcaaatgcacctcaaagtcttctatcctggtgggaaatagtgacacctggaagggtttcctggagcaatgattcttacttgctctgcaagcaaccttgctctaccttccctctgatagggacatttagtcatctttgcatgtctactatgtgccagaaactgtgcacagcacaggagaagtggaagcagagcaagcctcagcccatatggaatgttaactctacaaggcattgaaaaattaactccagatgcgttccttgctgttccttgtccttgccatccactctcacacctcaggaactttgcacttgtgctccctcagcctggaacactctccccgcaaatagccacgtatctcacttcctcatcttcttcagcttttggccgtaatgccatcttcaacataagccttccctaatctgtttaaaattgcaactgaccacccaccctcatggcttcagactcctcttccctgctctattttcccccatcacacttaactgtcatctgatacatgcatgaagctgcctgaagctgcccaatactatggccatgagccacatgtaaaaggaggctagttcgaactgaaatgtgctgtacggtgtagaatacatcccagattctgaatacttagtattaaaaaaaaaagaaggtgaaatatctcactagtagttgtttatattgattacatgctgaaatattttggattttgggggttgaaaaatacattgtgaaaattaatttcacctgtttctttttacttttgagtatggctactagaaaattttatattacatgtgtgtcttgctttatatttctattgaatagcactgtagtagataataaacaaataaacaatagctatatagatgtatatgtatgcatatatatgtacacacaccctcatcccattagaatggaagctcatgagggtaggatttttgtgtattttgttcactgctgtggctccaacacctaaaacagtgtttagcacatagactcgcagtaaataattgttgaatgaatcagctaagggttacaaaaaaaggttcttagcctcttgcaagtggtagatttttttcttgacatttatgccaggacctaaaagtcaccaggccaggaccagggagggtgggaataagaatctcaagaactgaattcatagaaggcctcaagctccgtctcggttcctgctctccaagtctctgtgggaggtaatgaagttgatcaaaagcaactttataaatatggggtcaaattatcagagaaaataagctctaggagagtaatgagatattactcagccaaaagaataaaacattccctggcagtgaacttttgcagataaggcgaattgaccttacaaagcacacagctgccctgacagaccccactttcccacttcaacttttgttattaccctgatggattaatgtggctggaggtgctaccttctctagggtactgttaccccaggattaaagcatgatagagatttcctgttatccagaacggaatagtgccatggccttttttaatccaaggagctgatactgagagcaaccacaaacccagatgtgtcttaaagagaaacctaaaaccaggaactggcctttctctatgctgtgtgcattgagtggggctacagcccttttgcagggtccccactgactacatcttgcactgacaaactcctcagtgactgttgaaggggaataccccattcctgattgccagccagtgacatcaccagacttgacagctgagtggtttggggtgatttctttctgagcctcctctattcactgtgcttctgatgttctaacatcttgggccttactaaccctggaggaactgtccctcccaaggctagctaattcctgcaaatagtaaacagcttgccttcaaagcatacctgtcatgtgcaaaccaaccaatccagagcccttatctaacctcctcctttatcaggctcttacactttgggctactatccacctgccctaatcaccccagggcccagttccagacaactagaactatcctcggagcctgctgaaatactccagattggccagctccaaacctgcttaccctgccttaccagtttcttcccagggaaactgcaatgaaggctcttgctcatgtttttcccctctctctctctgcctctagagcccagggcttcccccatgtgaccctgcatgacagggtgtgcctcctcctcttgcaaactgtgaatagcaaactatcttttcaatggcagttgtctcctgttctgttggcctcatcatacctggaaaataataaaactacattttaaaacacctccattttcccatctggaaaatggagcctgtaacacctgcctgacagaagtgtagaagtagctgtaatttatgaaaacaattagcctggtgtgttgcatacaataaatacttaacaaatggttgatctgtcaatggggcacactttttgttgttgttgttttgttttttgtttttggagacaaggtctctgtcacccaggctggagtgcagtggcacagtcatagtgcactgcagtatccaactcctgggctcaagcaatcctccttcctcagactcctaagcagctgggactataggtgcacaccaccacaccaggctaatttttttgtgggcggtggatgggagtaaagacaggatctcactgtgttgcccaggctgatctcaaactcctggcctcaagccatcctctcgccttggcctctcaaagttctgggattacaggcttgagccattaagaccaaactaatttttgagacaagataattttttataaataaacatttcagaattctaaggtcaaaattagaacagtagatgcttagtttatgcttttctaactctctttgactgcagaatccaactgtaaaagatcttattggctttggtcttcaagtagccaaaggcatgaaatatcttgcaagcaaaaagtttgtccacagagacttggctgcaagaaactgtatgtaagtatcagaatctctgtgccacaatccaaattaagtgacaaggaggaatctgtttcccactgttcaatgctagttaagctgttttctcttcttatgcaaaagtcctttatttctgttacaatcttaaatcgatgtgtaagccctggggatgtgggtgggactttcagactttatccaacagagaatttaaaaggattctccatagggggtcttaaacagctgttgtgtacttttgcttttctcagtccttccctccagtagctctcaatgttgtggtttcacactgcattagtgttggggagggagaatttgatcttcagcatttgacagtgaaaaggagagggctgggaacacaaataccaacatattgcaacttcccaagagtggatttgaagccagcctgcagaagccctaccaaaaatggtatttggcaatgaatatacaaagaactttatttgtgtctggctgcctggctatgtaatacaacagtcaacagtttgtaattgagttcatgttttcccttgcatagcactgattcatgacttatggtatgtgtgaatgaaaaagggtgtgctattaatttcctaccttggttttggtcactgtaacaacataaaagccagcttaaacagaggatgcatagccccagatagcggaaattgatttttgttgaacttcgctgtttttcttagatgctttactgtgtatcctagttctctattacctcagtggtgggatatatgagttttgtgtgctaacctagctcatttaagaatgaaaaagtaaagtatcagtcccctgtcatgctctcccataaaactgagtatcgctaatcagttgacaagcgaagattggtgattgcttgggtagttaattagcatacttcatttagcaaccaaagtaaacccacaggggagacagccttactactgcagatctacattaaagcaaaaaggactttcttatgccatacaattcatgatctctttcctcagcctgttgaattggcaatgtcaatgtcaagcatttttattcaagaattctgttgtaatttagtgttagtcaatagaggccagatgaaatacttccttcagaagttatggatttcaaatactgaagccacttgtttaatctgtagatattcagcatcattgtaaattattctatttcagccacgggtaataatttttgtcctttctgtaggctggatgaaaaattcacagtcaaggttgctgattttggtcttgccagagacatgtatgataaagaatactatagtgtacacaacaaaacaggtgcaaagctgccagtgaagtggatggctttggaaagtctgcaaactcaaaagtttaccaccaagtcagatgtggtaatgtattggttatctctgagtttctcctcttttactttcatatccaactttttttgaagttttatcactacttaattttttaaaaaaattcaacaccaccaattccagttttcttcatatgtaaaaatggacttgtctgatacgtacacattgtatattttcataaattcactcatttgttcaaaaatatttgttgagtggggcaacataccagctccttaggaagcccagagctgaaccaggcatgaaccctgtcggccaagaactttggctcagaagggaagagatgagatggtcaacaatgactgtgacacaggtggcctggaatgggccctgattctcatagccccaggcgagcaagaattccacatcaagaaatctggaagctgtaactgaggcagtctagcagtgagggcatgatccctgggcctagctagtaaagtgccttcccttatctgcaaaggccatccttcttgcgcagaacaagctctcaaaaggcatgcacctgagtgctgaggctgggagaaatactcacctgggcagccagattcaccacattccccttccaccatatggagaagtggcatttgaattgggttaaaggacagcaggtttggagttgggcagctgggcaatggaaataccgatccaggtgtggcagaagagcaggaaagtataagcacctgtaaagttataaggaaacagtacttagttatttggcaagaacagaacacagagagggaagttatgagaataaatggagaaaaatatacttatactaggtcatagagttccttgaaaactgaactagagagtatggaatttattctctggtaatgtggaaacaaaaaagtaatcagattagactgcaatctttcatcattgtattagtccgttctcacactgctataaagaaatactgagcctgggtaacttataaaaagagatttaattggctcacagttctgcagactctacaggaagcatggctggagaggcctcagggagcttttacccatagcagaaggcaaaataggagcaggcattttacatggcaggagcaggaccaacggggctgtgggaagtgccatgcacttttaaacaaccagatctcctgagaactctatcacaagaacagcaccaaaggaagaaatctgcccccatgatccaatcacctccaaccacgcccctccctcagcattggggattacaattttacatgagagttgggtgggaacacagagtcaaaccatatcattccgccctagttcctcccaaatctcacgtccttctcacatttcaaaacacaatcatgccttcccaacagtcccccaaaatcttaactcattccaacatcagctaaaaagtccaagtccaaagtctcatctgagataaggcaagtcccttctgcctatgagcctgtaaaataaaaaaacaagttagttgcttacaagatacaacgggggtacaggcattgggtgaatgctcccattccaaacgggagaaattggccaaagcaaaggggctccaggccctacacaagtccgaggccctatgcaagtccaaaacccagcaaggcagttattaaatcttaaagctccaaaataatttttttgactccatgtctcatatccagggcacgctgatgcaagggatgggctcccaaggccttgggcagctctgctcctgtggctctacagggctcagccccatggctgctttcatcggctggcattgagtgcctgcagcttttccaggcacacggtgcaaactgtcagtggatctacctttctggggtctagaggatggtggccctcttctcacagccccacctggcaaagccccagcactaaggggaggtctcagggagctttttacccatggcagaaggcaaagcaggagcaggcatcttgcatggcaggagcaggaccaagtggggggagggggagcatcttatatggcaggagcaggaccaaggtggtgacaagctttcaccaaggggagaggtgccacacacttttaaacaaccagatctccgtagaattctatcacgagaacagcaccaaagggagaaatctacctccatgatgcagtcacctcccaccaggcctcagctcccacactggggattataattcaacatgagatttgaatggggacacaaatccaaaccatatcaatcattctccaagacaacttgaaaggagtagaagcaggaagatgaagtgagaagtggaacttgaaataagacacaatgagaatggaaaggaagagatgaaaggaggagcatctcagaggtagaatcagaagtatttaccaaggaattgataaaaagtcaaagattagcaaagatatatgctcatgcaataacacatatatgaagcacagaagcaaaagctggactcagaacaaaaatagcaagttgagccttaaacacactgagtttgccttgggagtagaatgtccaggcagagaagtccatcaggcaattgaaaatgtgaatctgcaacttgtaaaaaatgtattattcagcctgggctgtcatacaatagaccacagactggttggcttaaacaacaaaaatgtatttctaaccattctgaaggctagaagtccaagatcaggatgtcagcatggttgggctctattgagggctctcttcctggcctatagatggccaccttcttgctgtgtcctcacatggctaaaagaataagagtcagttctccagtatctcttcttagaagggcactaatcccagcatgaatgcccaccctcatgaccttgtctaaactgaattacctctaaatggccccatcattaaacattgtcacagtggggcttagagcttcaacatatgaatttccggggaacacaattcagtccatagcaggggtcaaggctgggaatatgcttttgagagtccaaaagcaattattcagtagtccaaaagcaattattcaactacatatataaagtgaaagagaaaagcagtgaggtaagggacccagaagcaaagaccaccatgaaagtcagagtaagagaaagtttcaaggagaaattggatgctcaacagagtccactgctactcagtacaccagaagggtcttggaagctgagtaacttgagtgatttggaggtctagagtgtgcttaggagcacaggtgttgaatggaatggagagtacacttattctattcacatgttgtaagtcagaggactgtgatgtctgaagatagagaaacatttgatgtttcagtccttaaggatgacaactaaaaaaggaaaatgtgcaaacaaagtagtcagaaaataatgttcatgggggacatgcacttgaagagaaagggttggtagcttttgagagatgatgggtcagagatctgagtgtggcatgggaagcaagaagtcatctcatccacctctctgtgaatcagcaagagggagaggtgtgacccctattggcaagagttgcaaagaaattgtgacttcaactgaaagctgagtttcagttcctgtgaggaggtaggggaactattagagaataagacgaggtgactgggagtttgttttcaatgagtaagtaggtcataggtcatggtggaggaccaggacttcagcatgcatgagattggtaagagaaagtgatagtgccatgtagagcttaatgcctgggattttgatcctgaaagattctgaaagaggtgaaagaagtgggtgctagagagggagactggggacatgttagtgacagtggcaggtgaaggcaaaagatagggagaattaacccatcctccaagaacatactgttcattcagacttgagggttagtctgccattaagaagccagagccaacccttacaactcaataataagactgtcttagtcgttttgtgctgctataacacaataccacaaattgggggatttataatgaacagaaatgtatttggcccacagttctggaggccaggaagtccaagatcaaggggccacatgtgctgaaggtcttcttgctgtgtcataacatggtggaaggcatcacatgggtgtgagagagtgcaagagagagcaagaggtgaacagattctctaacaaacccccttccacaataatgaactgactcccaagataatgacattaattcacccatgagagtagagcctcatgacctaattacctcttaaagatccctcctctgaacactgttgcattgggaggggattaagtgtccaacacatgaactttgggggacacattcaaaccatagcaaaggcaatattactcaatttttttaagtaagcagaagatttgaatagacattttaccaaagagacgtaagaatagctagctaatgagcacatgaaatgaaacatatgcccacatgaagatttgtacatgaatgatcacagtagttttcttcataatagccaaaaaccagaagcaatcttaatgtccatcaacgggtgaatggataaaaaaaaaatgtggtgtgtccatacaatggactaaaccattcatcaacataaaggaattactgatgcctactacagcatgataaacctcagaaacattatgttaagtgaaaaaaaggcagataaaaaaattacatgttgaatggttccatttatatgaaatttctagaaagaggcagaactacagagtcagaaaacaaatcagtggttgcctggggccaagagaaggagtgaagataaaccacaaatggacatgagggaattttctggaatgttgagatgatctaaaactggactgtgatgatatgatagctgcacgtctatataaatttactaaacatcatttaatcactttaatttactaaacatcaccaatcacttaaaattggtgagttttatgatctataaattatacctcaacaaagctgatttataaaaaaagagcctgatgaaattttggatgtttagggcaagtgttgggattctaagcttcttgacagccacatacatgcaacaatacccccacctccccaacaaacacacacagacagcacagaggccaaggcttcccccatagccacagtcactcagatacttgactggaaatgtacatagatttctgcagataggatggtgctatttctttctcactctcatcgaaagacactattttgtgctacataaaggctgaacctgaataatctgtacataatgctgctttgggaaatggttactgattgcatggataaatttgcacagtgttttacttccaggacagcgcaatcttgaatgttgacatggaacatttccaaaagcatgcaatgagctatgtgtatgttgaaacctgcgaccaaaaacttgcctgcttgtagattgggttttctttctagaaaatgcccaaatggagtttggctaaaatctgaatactctttaagtccattcaaacaaaatcggagtgtcactacactggaaatcactcacaccctcctctgaacccttttgcaatgggtgttgtaattgtattatacgttgtttcacacttaatacaagttcttccattaaactgtgtattgacttccttgttctcagcccttatctgcctcatctttctgaagtgtttaacattattgtaaccctcatttttcttgaaatttcctcttcctttggtttctgggacactgaaacttccagttttcctcctgcttctaggttgttttctttatcctcaatggcttctcttccttctgtcttccttctctcagatgtagctgtctcccaggatttttgtctttaggggtcatcctccaccaacagttggaaccattcccatcaataaccacctttgattctctctacctggatgtcatcatcagtgtcacaaatttaccatgttcagaatcaaactctttcctgccaaaccctcaatttctcacctcctggctttgattaatggcatcaccattgtgtaatttacccactcctcattcttttcagtgttcggtttttcaggttttgacaaatgcatgcagttgtgtaaccaccaccccaacaatcaggacatagaacagttctatcatctcagaaaatttccttatgctcctttgtagtcaacctctaccctatccccaggacctggaaatcagaaaaccagatttattttctgtctctagagttttactttttctaaaatgtcatataaatggaatcatgcagtcagtagtcttatgagtctgtctccttttacttcgcatattacatttgagagccatccatgttgtcgtatcagtagtagtaacgtatcagtaattcattcctttcttattgtggcaaaaaaatacataaaatttaccatctgaacgatttttattttattttaagttccagggtacatgtgcaagatgtgcagatttgttacgtaggtaaacgtgtgccatggtggtttgctgcacctatcaacccatcacctgggtattaagctcggcatgcattagctgcttttcctgatgctcctcccctccctcgataggccccagtgtgtgttgttcccttccctgtgttcatgtgctctcattgttcagctcccacttagtgagaacttgcggtatttggttttctgttcctgcgttagtttgctaaggataacagcttccagcttcatccatgtccctgcaaaagacatgatcttgttcctttttatggctgcatacaaccatttttaaatacacagtacagtattgttaactatgtgaacattgttgtgcaatagattcctagaactttttcatcttagcaaaactgaaactctatatccattaaacaattctctctctcccccaggccctggcaaccacaattctactttgtctaagagtttgactacttcagatacctcatataagtggaatcatgcagtatttgtctttttaggaccgacttatttcatttagcaaaatattctcaagcttcatccatgttctagtatatgacaagatttccttctttttaaaggcagaataatattccattgtacatatatgccacattttctttatccattcatctgtcaatggacatttaggtttcttatacctcttggctattatgaatagtgccgcagtggccatggatgtaaaaattctctttgagatcctttttttcaattcttttgtatatacacacagagacaggattgctggatcatatggtaattttattttcaaatttttggggacctctctactgttttccacagcagagtagttcatctctttttatttttgagtagtattccatcgtacagatgtaccacattttatttatccattcaccagttaaagaacatttggggccaggagaggtggctcacgcctgtaatcccagcactttgggaggccgaggagggcagatcacttgatgttaggagttcgagaccagcctagccaacatggtaaaaccccatctccactaaaaatacaaaaaattagccgggagtggtggcacatgcctgtaatcccaactattcaggaggctgcggcgggacagttgcttgaaccctggatgcagaggttgcagtgagctgagatcatgccactgtactccagcctggatgacagagtgagacccgtctcaaaaataataataataaagaacatttgagttctttccattttcaggcaattacttatacataattgtaatggctatgacatttgcttgaaggtttttctgtgaacgtaatttttatttctcttgggtgaatatctaggtgtaagagtaactaactgggttgtaagataagtgtacattcaactttatgagaaactgccaactatttttcaaagtggctgtatcattttatgtccccaccagcgatccataagagttccagttgttcagcatcctctcccgcacttgacattgtcagttttctgattgttagtcattctaattggttgtagtgctgtctcattttctttttaatctttatttcccaatggctagtgatgtcgagcctcttttcatgagcttatttgccatccttatatcacctttagtaaagtgtctactcaaatcttttgcctatttttaagtatttattaataatattaatttagttagggtttattttattggcttgtttttgtttcttattgaattgttcgagttctctgtatattgtggatacaagcatatcttatgcgatacacttttgccaatgcatttttttttcttttgggacgaagtctcactctgtcacccagcctgaagtgcagtggtgcaatcttggctcactgctacctctgcttcttgggttcaagtgattcttttacctcagcctcgccagtagctgggattgcaggcatgagccaccatgcccagctaatttttgtatttttagtagagacagggtttcaccatgttggccaggctcctgacttcaagtgatccgcctgccttggcctcccaaagtgctgggatcacaggcatgagccaccggtgacacctggcccacaaatgcatttttctagtctgtggattaccttttcatttatttaatggtatccttcaaaaagcaaaagtttttgattttgttgaaaattttatcagtttaccaattgataaaactttatcaatttattttttttcttttatcaatcctggtgttgatgttgtatctccatgcatctactcttgaatgctcagatttgcctatcatccttccttgctcacttacctcagtagcaaccctgtctatcacttttcatagcttacaaccatctttcacatttaatcatttctttgatcatcaccttcagtaaagttaggccagatattctccagatgagcttattgctggtgctcaaatgctcaaaatggcttgaccaatgccatacagtaagcacggatgatagcgctctcatggcttgaaactaaaactgacttgtttcctaatgcacatgaattgtacacctccctcccctcacccccgaccccccctcaaccgacagacacacacacacacacacacacacacacacacacacacacacacaccagcttctctcttcttggtcatcatcctaatcagcatcacctcctctttcactgtccctcccctcaccctgctgtcagccccacaatgctttcaggggagtgtggagtgcagacaatacaatgctcttcctggaaaccttcttcctcttacctccctgtcccgtgagtcctccagctattttctgatacccagttattgcccacgtcctttaattccttggaaaattacccaactccatcccccttttatgtgactttgtctccagacaaatctacatgtagcgtagactgtcagatagggagacctgatcacagaactttggcttcctcatcctaaaataaaaccaattacatcacaggattgtaaccaagtacaatccattataaggattaaataagatgttttgtaaaggatataatgcctatgcatgaatcattatatgacaaatacactctttcactaccttaattccagagaaaagcctcataggcttccgtattgtaggtatgcaggagtgtccctcacctattcttattcagaaacctcctaactggcctccatattgtgaatcagcttctcctttctgttctaagcttggcgcttacagatgccatctccctgagcacaactcagaactcagccatgtcccattgatttcagtctaacgcactttctttttttttttttttgagacggagtctcactctatcgcccaagctggagtgcaggggcgcgatctcagctcactgcaacttccacctcccaggttcaagcgattgtcctgcttcagcctcccaagtagctgggattacaggtgcacaccaccatgcctggctaatttttgtatttttagtagagacagggtttcaccatgttggccaggctggtcccgaactcttgacctcaagtgatctgcccacccccgcctcccaaagtgctgggattacagatgtgaaccaccttgtcccgtcctgtctaacccactttcaacatttaaaaacctccacagcacagtcccatttcaatcttatgggtccctaatcccttcccctactccaacatgtcaagcaacgtgaactattatactttatggtttaataagaacacatatgcagccaggcgccgtggctcatgcctgtaatcccagcactttgggaggccaaggagggtggatcacctgaggtcaggagttagagaccagcctggccaacatggagaaaccccgtctctactaaaaatacaaaaattagcctggcatggtggcaggcgcctataatcccagctactcaggaggctgaggcaggagaatcgcttgaacccgggaggaagaggttgcagtacaccaagattgcaccacttcactccagcctgggcaaaagagcgaaactccatctcaaaaaataaaaaaggaaagaaagaacacatgtgtactgttactcctggccccaccccctccacccaaaactctccctctgccctcatattacctgcacctataaaacaaagtctccctgttcctcaagacccaccttactgtcactctcttcctgcagcctttctcagtaccctactattatctctttgacttttggcaacctttgtacctctttgatattactgctctatattacagctattatcttattgtcctgtgtggcagttatctgctcaattctcttaaccctgttcattcagccctgggacctatctagtaacttgaacagtaacctactcgtatgtgatcaagggtcaattgatacttgttaaattgattttaaatgttaatgcatattctgggacttgaaagttaacacgatgatgttgtcagaagtgattgttgattgttaagattttcagactttgaaaacttctactttgcaaagctgaattagacagcaaagttctgtagctccctcctggcaaggggtttgagttttctgttgggatcaaggcagtcagcagccatcaagggttcttgcacttgggcaaagaagtcattaatggtaatttgtatcagcaattacagcatctacctcatttctttctttcagtcgcagcgttcaaaggcaggctttattctccttcttgctgggtactgcaagctacacttgcctctcagttttatgtcttcctactccagctgtctggtgtggattttccttctgctccaagcttccttcatttcttcctccttatgcttcctactcttagagtggcctggaagtgttgctgggccagaactgcccccctgggtcctgtccacaggggcggcctctgcccatgctgactctcctcgtgtcattcttgcatgggcacatgtccagggggagataatatgtatgacctggtctatcctgagcacagtgttttaaatcaagaaattgcatgtttattgaagttcagtagaccaaacaagacctaagggtcaggaactcttaaatgtttatcccagtgtggactcagatgtattggggaattttagcaagtcacttaacctctccgtgtccctgtgatcttcctatatagtactgatacggctattttatatgaatctagtactttcacatcttcatgtgacagttttattgaaattaattttcaatagagaaacttgttgccttgcagttttttttatttctgatttttaatatgtatttttacttatgttgatttagaccttcccatttaatagtaacctttcaatgtggttacatttcttaaagagtatttatgttcagtttgaaaccacacaaatttaaattttgggaggctttcttcttcttttacaagtaatgtaaaattgtagtgaagctattggaaaagaaaaggatagaaacatgttagtgctttgacacagcgggagagaattttggaagagatattctaccaactacagatggaatcttcatcatcatgtagacttcagatattcttttagaaaactttacatttacttataatctaaaccttacttgtttaaacaagtcatgaaatgtatagcttaataattgcctttaagaaaattgttgcccaaaacagaaaccgtattgagtatgtaaagccaagtttagttaccaagacctactgatttcctttcatatatgtatggtcacatctctcacctcatctgtcctgtttcttgttttactagtggtcctttggcgtgctcctctgggagctgatgacaagaggagccccaccttatcctgacgtaaacacctttgatataactgtttacttgttgcaagggagaagactcctacaacccgaatactgcccagaccccttgtaagtagtctttctgtacctcttacgttctttacttttacagaaatgcctgccttcaaagggtctcttacagcatgtctttctttttggaacagatatgaagtaatgctaaaatgctggcaccctaaagccgaaatgcgcccatccttttctgaactggtgtcccggatatcagcaatcttctctactttcattggggagcactatgtccatgtgaacgctacttatgtgaacgtaaaatgtgtcgctccatatccttctctgttgtcatcagaagataacgctgatgatgaggtggacacacgaccagcctccttctgggagacatcatagtgctagtactatgtcaaagcaacagtccacactttgtccaatggttttttcactgcctgacctttaaaaggccatcgatattctttgctcttgccaaaattgcactattataggacttgtattgttatttaaattactggattctaaggaatttcttatctgacagagcatcagaaccagaggcttggtcccacaggccacggaccaatggcctgcagccgtgacaacactcctgtcatattggagtccaaaacttgaattctgggttgaattttttaaaaatcaggtaccacttgatttcatatgggaaattgaagcaggaaatattgagggcttcttgatcacagaaaactcagaagagatagtaatgctcaggacaggagcggcagccccagaacaggccactcatttagaattctagtgtttcaaaacacttttgtgtgttgtatggtcaataacatttttcattactgatggtgtcattcacccattaggtaaacattcccttttaaatgtttgtttgttttttgagacaggatctcactctgttgccagggctgtagtgcagtggtgtgatcatagctcactgcaacctccacctcccaggctcaagcctcccgaatagctgggactacaggcgcacaccaccatccccggctaatttttgtattttttgtagagacggggttttgccatgttgccaaggctggtttcaaactcctggactcaagaaatccacccacctcagcctcccaaagtgctaggattacaggcatgagccactgcgcccagcccttataaatttttgtatagacattcctttggttggaagaatatttataggcaatacagtcaaagtttcaaaatagcatcacacaaaacatgtttataaatgaacaggatgtaatgtacatagatgacattaagaaaatttgtatgaaataatttagtcatcatgaaatatttagttgtcatataaaaacccactgtttgagaatgatgctactctgatctaatgaatgtgaacatgtagatgttttgtgtgtatttttttaaatgaaaactcaaaataagacaagtaatttgttgataaatatttttaaagataactcagcatgtttgtaaagcaggatacattttactaaaaggttcattggttccaatcacagctcataggtagagcaaagaaagggtggatggattgaaaagattagcctctgtctcggtggcaggttcccacctcgcaagcaattggaaacaaaacttttggggagttttattttgcattagggtgtgttttatgttaagcaaaacatactttagaaacaaatgaaaaaggcaattgaaaatcccagctatttcacctagatggaatagccaccctgagcagaactttgtgatgcttcattctgtggaattttgtgcttactactgtatagtgcatgtggtgtaggttactctaactggttttgtcgacgtaaacatttaaagtgttatattttttataaaaatgtttatttttaatgatatgagaaaaattttgttaggccacaaaaacactgcactgtgaacattttagaaaaggtatgtcagactgggattaatgacagcatgattttcaatgactgtaaattgcgataaggaaatgtactgattgccaatacaccccaccctcattacatcatcaggacttgaagccaagggttaacccagcaagctacaaagagggtgtgtcacactgaaactcaatagttgagtttggctgttgttgcaggaaaatgattataactaaaagctctctgatagtgcagagacttaccagaagacacaaggaattgtactgaagagctattacaatccaaatattgccgtttcataaatgtaataagtaatactaattcacagagtattgtaaatggtggatgacaaaagaaaatctgctctgtggaaagaaagaactgtctctaccagggtcaagagcatgaacgcatcaatagaaagaactcggggaaacatcccatcaacaggactacacacttgtatatacattcttgagaacactgcaatgtgaaaatcacgtttgctatttataaacttgtccttagattaatgtgtctggacagattgtgggagtaagtgattcttctaagaattagatacttgtcactgcctatacctgcagctgaactgaatggtacttcgtatgttaatagttgttctgataaatcatgcaattaaagtaaagtgatgcaacatcttgtatactgatagtggttattgccagtcatgcttgattacctgcatttgcataatgatagaggaagcctaagattgatttcacctggctgcatagagctcatccatgtaggagagccttagtcaagtgaatgctgaggaagtagtaaaacagcatgcatccccgaatctcaggaagtctctgtctttccaaggg

SEQ ID NO: 16269 - DNA, 63714 bp, Human
tttggcagttttgtaaatcttcaagacagtccattcatctatttttactaaagctaggaaaattggtgtaaaattgaatataaataggaacatttttcctaaattttatgaaattactgctcttccataagccaaagctagtttcttctgtgttttccagataaagacactgtaaagcctttttctttctactgaaaaccatgtttgtattgtgacagttgtgcagtttcattgctcttttgctctttttagtaactaatcgtttcctggattgtctctgctggacctttttgctcctttactaaggcaaggtttgtggattgttctgtggtatatctgagaaacggatgctttttactccatatcagagtcgattggggttgctgatgattgtcttagtttaaataaatactctctagtaggtcaacaatacacttacggaaataaatggcaaagattgagggaagaaaaaaatattaatcccaagtagttagtagctcaaggaagaattaggccttatttcaaatcctggtgcactgtgtccaggaataaggactagagaaaatatctacaataaaacataaccaagcaggcattagatttccaattctctaattttgaaagacggaacttaataatctaataacaaaaaataaaatctaataatagtttaacaatcaatgactgaatatttagcaagagcataatgcctggcacagaagttgacagaaaaatgggttacacatggatttagcttccaaataacataacagacatttagcaaattgacagcaaagaatatttttgttttccttataatcctagcacataagagagtgctttgcacagaatgaggggttatgtaactactgaattcatgaatacataaataaatgaatgagtgaatgaatgaatgaactattataacttagtttgtatatctatttaaacagactgatatgaaattttatagataagaggttaattgaaatctgaggatcagagatttgctggagaaattaaatgataaatctcatgaaacatctctaccagaaaaaaacccatagaaaactcagataaatctggttctctgctacctacaactggcataattttgtcctacagtaaatgtataaaagcattctatatgatcccattttaatttatttttatgtgactccattttttcttcatctatcccttactagtaaaatattggttacccccaaccatcagacaatcgtgattggaaaataaaggaagtaaaattctgattatttattccattagtgggtatctctggtagaagttccaggagcaaaatttaaagtgacttcctggtatacctgtctaattcaattacttatgctttccttttctgttattacttataatcattgagattaagtaatgatacagctgaagtgtatttataaaaatagaaagatatacatgtatgtagatagatgttttataattcagagtatatgtactatatgaaaggatagagacactgtaaacaagcttttgattatgtgtatgcatgtggatatacacttgaacaaaatgcagctttctggatagagcacagcagataagtatcataaaaacttttctcagtgtctttatgtagtagaacaaaatgttaaaactgtattcagcctatatcaacaaaattttgcactctctatcgtgaacctgaaatttctctttgaaatcagtgaaacgtgaaaccagggtgtgctcaggaaaagaaagttacttcatattttttcatgggttttcctgataataattgcctgtgctttcccatttacccttagctttgtcagagacccttcagcacttccatagagccatcccactagaggtcacagatcacaaaaaccctacagaaacaggaaaccgaacttcctgagtacgctacaaaacacagaaacctgtttcctctacacatctcaaactggcaaaactcagtcttagcagattcagtgtggaagcagctatcaaaaaggccataaggattttgtccccaaatttcacatgagctaccttgcttcaaactactgagatgaagggggcaagattatttgtccttctttctagtttatggagtgggggcattgggcttaacaacagtaagcattcttggactatacctgaggatgggaactctcagaagactatgccttctgcttcagttcctccaaataaaatacaaagtttgcaaatactgccaaccactcgggtcatgtcggcggagatagctacaactccagaggcaagaacttctgaagacagtcttcttaaatcaacactgcctccctcagaaacaagtgcacctgctgagggtgtgagaaatcaaactctcacatccacagagaaagcagaaggagtggtcaagttacagaatcttaccctcccaaccaacgctagcatcaagttcaatcctggagcagaatcagtggtcctttccaattctacactgaaatttcttcagagctttgccagaaagtcaaatgaacaagcaacttctctaaacacagttggaggcactggaggcattggaggcgttggaggcactggaggcgtgggaaatcgagccccacgggaaacatacctcagccggggtgacagcagttccagccaaagaactgactaccaaaaatcaaatttcgaaacaactagaggaaagtaagaaatcttcttttctttttgttctttctctgtctatcaggtctagaagattgcaagtgaaatttacctcactcccagaaaattatttcaaattcaagatgaaattggatcatatttataatttcaccatttcagttagataaagttattgttaatttatctaatagggaaaaatgaagaaataaaatgcagcaattttgttttaactgaaataatcattcacttttctactcacttatagaggtagttttacttagaatagtcattgccaagcaaactagcaccacggtggctgttagtttaattcaaggatatgttgattgtgttcccaaccatattcacaatatgaaagacaaaaataaacaaataaataaaattggggcttgaacagatgtgaaaattggaatagcagtattataaaaagtaacagttgtcaaagatcgaaacaagcacaccaggggtgcaatcctggcttcagtatggtctagttccatgattttgagcaactcagttgatgtctgtgaacctcagtttcttcatatggaaactacagatttaatacaaggaatgtcaataaaaataaaactttgcagggttctcgttcagataaaaatgaatgaaaagtgcttagatgcatgctcctcacagaataggtgctcaacaactcaaattttgctagtaccatgattattttgagttgtgttgccatcatgaatatgatgaatcagaaaacttatttttcaaattaattttaatttaaagttagagcaatttgagtggttgaaataaaataaaacaaatttaaaggagtgttgttaaagagggttttcaaaagaagtgatagtcaaatcaaaataaacaaagaaaaaatatctgggtgggtcaatattttattcatttaatgctcagagtcatctgtatgtttggaatactagaagtttagtattgcaaaactaaacttacaaatagtttttacatgtaataatacaaagtcaagacaccagacatgtcttgggagcaaaatggggttaaatatcttactaataataaaataaaatccaagttaaaaatagaagttgacacacctgctatgtgaaagacatttagttaaagctgttgctgatataaaggtgagaagaagagagacactggtaagaattctagccaatgaatttacttatttctgtattatttattattcaagtctatttttcactatatttcaaaagttatagaatttttcgaaatatataagtaaatctgattgtaactaaaaaagtattcacttggtggactttggaacaatcccagcttactgtaaaacaaatagtacagattacaatatgttcactttgggacaagtagatttgccattaaaaaaacatttaacagacatgcattaatctttctcactttgggggacaacaggattttatctattaaataatcagaaatgtcatttattgacagctttttctaaatcacttgaatgcatcatttctgttaatcatattttattagaggctgtaattaaatttttaaaaactaattacagtaaaacccttggacattcatgggaaacgattgtgagcttttcagagatgctatagctaagaatttttttttttttgagacggagtctcgctctcttgccaggctggagtgcagtggcacaatctcggctcactgcaatcttcgactcccaggttcaagcgattctcttgcctcagccttctgagtagctgggactacaggtggtgtgccatcacacccagctaatttttgtatttttagtagagatggggtttcaccatgttggccagggtggtcttgatctcttgacctcatgatccacccacctcagcctcccaaagtgctgggattacaggcgtgagccaccgcacccagccagaattttttaatagaaagggaaatataataaacagaaaaaagagacaattcaagttaaaatagcatttaaattttacataccatatagaaagtggcatacagttgtgtcataattagaactagtaactaatagtttgataaatactagtttttaaataaatgctagttgtgttatccaaggtccttgctttcaaatgttgggaacaatttgatgaatatttataatttgcccatcatgtgctagcactgtgctaggctttgggttacacagaatttaaaaaaataataataattcctctgtctaaggaatattccctataaaaagtaaacactaacatacctatcagacttcaaaaaatgttaatatgtgctatgagaaaacaagatactaaaggtataacttgctgaacagaactttatcctctggattttctaacaaaaataatcttaaactccttctatagaaaagtactaactgcatgtagggattctcttatttgaggtcctggagagcctgaggttttcttttagtaatcctttccattaccaagattccttactcattaggccatgcaaatgacaatggcattagagaaaagcctaggtccttcacttttggacacagtgctgctgcaaacccttgatatggtcaaaagaagtccttcgtactttcatttgattggcaaataataataataatagtagcaaacacttatatggcatctgttactagtactctactattgtcagtgaatatattcactcatttaatcattactataactccataaagaagaggaagatttttatcattatttctttacagagggattaagtagcttacctaaggtcacttggctaacaaagctcagggcaaagactcaaatccaagctggctggctttagagttgtagctctcagctcctacattacactcccttggcaggtacagtctcttatcacaagtgggaagataagcgtgaccagttcacttcccagctcgtgaggcttcacaggctattggttgcctccagaatacaatctagatttgttacccagttagtcacacgatgccatcctagatctgcctcctgcctacctccccaacctcatcttccgccacttccggctattcaaataagtggttctctggtacaatatgtgctgtttgttaaacccacctttcttccctgtctgcccctgtgactaacaatgggccctcttttgccatcgttctctcttttcacacctaataataactccaggaagccttctcaggtgaagttaggtggcctttctaatcgctcctacaggtctctttgaattcccctgttcactgcacttacgacactacataataatcataatgaatttgtagtatctttgcatatagggacttattttcagagctagcaaagtctctggtttatagcaggtacacaatcaatatttaatcatactgaatgtgaaatatgaggattaatatgtgaatataaagaagaaagcttcccaaatatttgcatttgtttatgaaaaaaacctggttgatttagaataaactcatatttgttcttttttctaccattcttggaattttataataattcttagtaaaaggcgtatttatgtttattacaggttcttttctagattattcaggattattctggcatatttttgtttcatcttgtagtttttcttctttttttttttagccttgcaggaactcctggccaaaatagacctatggtttcctgtctggcagagtgggtgttagtcaatgaccaagcactttgaaataggaaggatggaaataagaaattaggattagtgtatttatatgttgaacaaatatttgctgaacaccttatctgtcccaagcactgtgcttgtgctgggagtaaaacaatgaacaagaactcctacatgtcctgccttatggaaccaacagcccagtggcagaggtgagaggaggaataacagtgaatcacaaatgctgattctgaatgaagcttaagaaattgtagtgtataatggggggaatggcctaccaattgtgaatggggtcagtaaaccttgcctgagaggataataggtgaaatgaggtaatgatacaatctaactgcctacttagcttttcccacaattcccaacccctgtacacatgtatcttaatttttaccaaatcagtgaatggctagttccataactagaaaccttggatagatctttggcatttttctctcccttctggtttttatctaatctatcaaaaagtcttgttacacctctaatacatcccaaatacctcaacttctctccatcttctacttgccgttattcaccactagtgttctaattggtccacttctttccactcttgtctaccataatccatgatccacaaaagggagggatcttttgaacatttaagtcagattaatgcatttcactggattaagtcttcattattgtaagtgacacattattttaggtactaatcagaaggaaaagtatgacatcatacttgcttaatttgaatttttagatttgtctttcagactttgagattttggtcacatatcacttttgcaaacttaagaaggaaatgtaaatgaaactggtaaagtatttcgaaggcaatggcaacaactgctatctgaccactagtgactgaaaaatgcctttgatttcaagacacattcttgatttcagagatgtatgtcttaaaatgtgtgaaatttggtctttcattcattgtcacactccaagatcactgcacttcatttcctccagccacactggcttcctttctgtttattgaacatgtcaagttaatatctcaaaggaaactttttttgctcttgctggaatgctctttctgcaccttttataatgaaggactcctcttccacttgcacctccagctttaatgtcacctcttcaaagggaccttctcttaccacccaatgtaaagttaactatgctctcacttgccattccttattttgtcacctttatttttttctttgtaggaattatttgaaattattctacttatatagacaatggtgtattttatgtctttccgcaatacatcccatgaaaacagggaccttgcctgtcttattactactctatttgctgcctagaacagtgccaggtgcatagaaagagctcaataaaactctgtaaaatcatggattattagatgggtttggcatccagaggggagatcaaggctagagatataaatttggcaaagcattggtatatagaaatgtattaagtcatgaatgtggatgatactgaaagaaagaaggaccttgaattatgaacggagaatctctaatatttgatgaactgatagtggtggatgccaacaatacagtcttaaatggggtgaccagagaagttaggaaggaatctataaaagtgtggtgtcatagagcaaaggaagaaaatattttaagaaggaggtaagtgatcaacagtgtgaaatgctgctgaaaaagacaaaatgaggactgaaaaatagccactatttcagtttagtgagcaccatgctctggcctgagagaattgaggtatgaaggaaggcaaaagagagccattaaagccaactcaattaaggagggcttttatgaaaaaaaaaaaaaaaaaaggagaaagtggtcagaagccaaggctagtccagttatttatgttttgtgtttgtttcttataatatttcattttaaatacagagggctcatacatatgttaacatgttaatgagaagggtcagaggaaggtaaaatttgaatatgcagaaaaagagggattttttttctgagtttaatgacaaattagaaaattagaaattattatttctgagtttaatgacaaattagaaaattattctgagtttaatgacaaattagaaaattacaaaaattaaccattaaattctgctgtcatactttttttctgctcattttgtgtgaattatgaataggttttagaagtgaattatctgatcagctaaattcttgtgttgttttcaaagttattattaggcctaataacatccaaaatgggttattcttacatgctgttaaattctaaagagaaaccattatactaaagggtattttcttatatctttgtgaaatagatgtctctattacattactgccagtgaaataaacactacataaagtatattctctatcaacttttacccattaatcacattctttatttcattactttgctgtttctactctgttactataaatatatattgcatttcatatgctagaatttaatgagtgcttatatattcctaataattaagtgggaactttttgtattcgcacaacttctgcttttctgaatataaaactataattttaaatttattatttgggggtaaatgctaagagagtcagtttacaggaactggattaagcatagaattctgcatcacggcatccgttagcctgcctttgtggtctgcacgctgggaaagcctgacacctactggaatagaaacagtttacaacgcccggaatatgctcaagtcacagttttgcaaggaagggggaaacaaaaaataaaattaggtaaaaaagagtatgttcaattcccacaggaaggggaatatcacactctggggactgtggtggggtagggggaggggggagggatagcattgggagatatatctaatgctagatgacaagttagtgggtgcagcgcaccagcatggcacatgtatacatatgtaactaacctgcacaatgtgcacatgtaccctaaaacttaaagtataataaaaaaaataaataaataagttatagaagagaaaaaaaacaaatttatggaaaaggttatattaaaggttgactttaagaatcattacttataaaatatatatgttatacatatttaattcgatgtaccactttaaaaatatactacttttcactttaaaattggaaaataggttggatccaaacagcaaactctatgtacatcctgtgatggccatacattcggctcgttctcataaaactttacactgacaatattgtgtatagacagtaatttgtggctgtgaggcactctacagtcatctatcattgaaaactcaattacattcaccacactgttcccactacagaaagcaaataaaattatgcctgacaaaaatattttaattgcaaaagttggtacataaaaaagggtttcttcttaaagtctaaattaaccataaatcaaagtatctaaaattccccataatctgagctttgcataattgcttttcaaaaaattattttaaatatcaatttatttatatgattcttttacaaaactgatatttttatctcagtttgaatactatataaaattttgtaaaaggattaagcatagaaagatacactacaataaaagaaccacaaacataaattattttgttgttaggaaataaaacaatgattttcttaaggaaataaatattgagatgaacttgtcttttggacttttagccaaagctaaatatcaaatgtctaatgctttatttaaatataatttacatatcaagaatcttttcactaagtgtaaattattgcttcccatttttattatcttttttcatgtatatatttcccttgaattattttctcatttatgactagtgaactacatgcaaattatagtctttcaaattaataatttgattaaaaacttctctttttagcttgattggaaaaaataaagatttcaataaatagattctataacactttggaagtatttatgttcatgacttcttaagactgtagagacattctgaaagtttttttttttttcctgagaggcaagcttcatctgaattgaacataaatgatgatgatggtcttctgtattggctttatggaaattattgacttgaaacatacaagcaattatggttaagatgaatttatcaggtcattaaagaagcaaaacaggagctgtgtttctttgtatctgaggcaaaaaaatattgaggccatattatatatatcctcttcaaaaaaaatcccgcttaactctgaatcatttaattattataagcagtgatagcagcaaatattttacttttcttaaaacatttagtctcacgacaatcgtgtgaggtagataatattattgtagatgcttcgtagatgaggtagtcacttttgccagacaaagtcatggctataaattgtggagtcaagatctaaaagcaggtagcctggctccagcgacgaactatgttatgggaaatttttcagggaaatttttctttattttcttttgcttatgcagatgtgcccactgcccccacccctcacccttgcctaattcaggattagaaaaaaaaaaaaaaaactctaggcacagaaatacactctcttctttattcacacctatgtgtgcagttaaaaggagaataaaaatcttgtccagcaggcagaacttcatcatcagaaatgaccttctaattctgatctacgaggtgaaaaaagcatgtattgatgacaactctgatgttgccagaaatgcctcattcccctcctcctctcttcttttcccctttcctgttattttgtcctattttttcatcctttgctctatttcttactttttcttcttcaactctctctgattttgacaagagatatgcaaaattattatttttcactttgtgtggcatttttttcagtatgtatgtatttatttatttttattgtggtaaaatatacattaaaaaatttaccattctatccgtctttaaatgtacagttctgtggctttaagtaggttcacattgttttgcagtcatcactgccatctatttctggaacgttttcatcttcccaaactgaagctctgtacccattaaataataacttcccattgcaccctccctaccatccctagcaatcaccattctattttctgtctctatgaatttaaccacttaagtacatcatataagtgaaactgtacaatatttgtccttttgtgtcttgtttatttcacttagcatagtattttcaaggttcttccttttcaaaggttgaataataccccattttgagtgtgcgtgtgtgtctgtgtgtgtttgtgtgtgtgattttctttttccattcatctgtcaatggacacttgagttgcctctacctttctgttattgtgatacatgatattttaatgacgttctcaaattagggtagtgtgctagggagaacatgtactctgactagtgttgctatctaaaatctgttctatttttattgacttaggacacatagttttcctcagggacttaataattgaaccgttaaaacaaatgagggtttagctgaattttttccctgattattgacaccaataaaaataggtttgttaagatatagttacctttaaaattctattttcctctttaaacaaattattttttactaagtgatattttttaaaaagagagggggggaattatccacatatgtcagacttatagagttgagaatgagatgagcaggttggatttgcaaaaagtagtaaacacttataaaaaaatataagactaacttttatatatttaggatatgttttcccacttatcactgaattgggtggggattttatcactatggacttcaggagtttagtgtaaaatgatgtacaacactattatttcataattttgccattagtaatggtcaaacagttaagttttgtttggttgtattttcatgcaataataatcttataattaagatgatagtatttttcatgaggtaaattaggaataatatgaataaattattctcttatgagggatcaatatttttctctctaaattaagtcccaccagagacttagttcttcccctgaagcatttatgaattcattaatgtattcatatgttgtcatttgcaaactgtagtcatttttaagtacaaggtaaagaaatggacatttgagatcttatactttctcaagtcagagacgcatgggtgggtattaggtgaggtgtgaggggttattactagagtcacctgataatcttatttcttcaagagaatgttaattttcagaagcagctatgtctgtcttgtcctattttgttttcctcttgttcccttttaaatctctacgttaaagggcatgatgggaaacaaaggtcattcaatccataaagtctcccccagaaacaaaatcttctcccacttctcaaagaaaattatataccattggcttggtttatggtggcgattttattgtcttaccttgacttctaatgaacatcctcaggacttggtattttcatactattgtgtcaattaaagccacagtttattaatatgaaagtttaagtatttagcttcttttgaattagatgacaagcaatctattcatctgggttctaagaactagtataactgaataatgttagttcttagattatccctttatttcttgggaaaatattctgtgtggtcattatttaaagccatcttttttgcttcagtcctctctcactcagttcaggataagaattggtatgactgggccattatttagtcaattaatggaagttttttacattagtcttttcactagtttcctgaaagactgagtttctaaaatgtcaaaataaaaaatatagtaaactgtttatttatgatgccttctcttagttcattatccacaagtctttgagttttatgaatcataatagaatcctttcccctctctattttatatgttcaacaagctaggcatttgctcataaccaaagatgtctgcttttccctagaacaaaccttttacctattaacttggaaaatccaaagaatcaatacaagctttttttcagtacatgttgctgcacaaaagcaacagagttattaccctgaaagagaatcccaaatgtggtctgctggatggaaggttatgaccccatggaaaactaaacacttcaaagtaactgctctccatccaccataatcagtctagaaaggtacaaaggattactaggtttaagcaaaatgcttgtctgggatcattgcatttgcctttaaactgcccatcaccattttgccatgcttcattttctatttttaaacctacattttcagataatttggctttaaaattatatttacatttttaatatcccttaatgagcttatttcattggtagcataaacctaattatgagtcacaccaggggctcttttgctgtggatagttcttctaatttaccctggatcaaagattgctgggccatgagcagtctgctgatctgcttctttgtctcctcaactattttagtcatgagattgttttaatatttaggatttcaaaaggtctctgccaggtgacactatcattttgcctcacagagaatgaatatactttttttcttttcaaagccctgagcatgtagtgacggtgatacttgtgttgtttctgccccacactccctcctccacagtcattcagagaatgttcatgtgacaatttaattgtgcttctgttgaagtgagtcagtctcagtaattaggatcatcattgcatttgcatgaggaatctagttaattttttaaagatccctttattgtggtcctctcaattttaaatctttttatttttatttcttgctttttccagttctttgttttacattatttttgcctcaattgtcaccagtgatttaacaacatgtgccagcatgtcttcttacttctttaaggggcctgaaattttaaacatcacattcaaaagaacacaataagttctgtagagctcaatttctctgccttagatgaatgacaatgtggaatgattaaatcaagcaattaacatatctttttttctttttatgtgttgttttctggaatttgtgtatgatgtacttaagtgaggttttactttgtgtttatcctcttggaattcattaagcttcttagatatgagggttgatttttttaaaaaacaattttaggaaattttccctttttttcttctcatgtttattctgcccaatcttaggaccacttcagttttgctcatttatgtttttgaatttttttctctgtacttcagtttggctggtttctattccttatcttcgagtttattggtcttcctttctaaagtgtccaaatttctgttaagaacattcagtccatttttaattcacatattgtatacttctcgttctatttaatggttaattgttttaaagtcatgggttgctaattccaacttctatgtcatgcctgtttttttgttttttttttttctatttactggatttttactccatatactggtcctgttttgctgctttttctcatagttagttttgtctgcttttcatgctgggcattgtggatactatgttattagtgtctggattttgttgtttgcaagcacaaaatagtattcagtccaagattcaagggcacccctatattgacttttaaaatgatatttctgtctggccccctcattttattaatctttaacacattttttaaccatcctagtatccccaaactcagatctctattttctttacttggtgtcttttctggaatccatccttctgtgatgcagtttgaaaattgttcccaggcacaaaactagattgaatgtggagctaacatcacatattttccctcaagaatcatatcactgcattgtctactgcccaacatctgaaaactgttgctttatacatcttgtccagatttataatttttgccataaaaggtaaatctgatagtttatatagccagggacaaaattctctgaaatttatgtttttagtttattatatgaaaaattatagaataagctcatttaactccttatatcaagctaagatttgttgtgaaaattcatagaatttgaagattaatttgaggaaaattgacatatttgcattgggtttcccattaattaacatgattcattggctttttctttaaaacttttcaataaagtttaaaatttttacttattaaatctaacacttcttttgctgaatttattcttaggtacattattcttgttgttattttttgctactgttaatagtgtcttttttaatttgttgttggtacagagaaatgtaactgatcttaattttgtgattgaattaatataaattagtattgtattaactcataaacatttatatttgattacattgctgaattgtctttttaattataataatcggcatctagaccattttgcattttgtttggttacaatcatatccactgcagctaataacagttctttctcttcttttttgattttgaaaccatttatttacttatttacttatgctttactgcacataatttaaagtaatggacccggatctgagttttttatctcagtactaatattaatatttgctacaagagcattcttgcattttgatttatcttatagctaaactctgcaggtttctcattttagctttgatttattcttttctttattttgatcttgttagtgtttccttatagtccctgagtacagcaatacagtaataagttattttctcttatatttaaatattttaaagctaaatagcaatcttacaaggtttctgatctatagtatggcaaaaataaatgtttgtctgtgaaaataattttgatgaaaagaattcttttttgacaacagttttttccctaacaattatgatcttctttaggaattggtgtgcttatgtacataccaggttatctcccacagtgatattggacaaccaggtcacttatgtcccaggtgggaaaggaccttgtggctggaccggtggatcctgtcctcagaggtatgtaatatttcttgaaaatagccactgtttttgcaccataataaattatagccgggaatatataatgttattcatgcaaggtacataatacatagtagggtcaggggatggtagtcacattatgctttagtaagtgaaaatgcagacactaataatatttgcctcatatggtcatttttagaatcatttgagataatgcaatactatatttagcctagtgccttgtgccttataagcattcaataaatgttaattatcatgcttatttctatttttactatcactattacttttactctatatctggtcaacaatcctgtccttaattgcttatgaatttcatgcacagttttgaagatttattattttctcttcatgctaggtcagaaagaagtttataacttggttcatattctaaaattaggagagcttctagttacaattatgcatggaaaagcagctaggtgaagcttttcttcttgtgtctattgtaattagccatgtcatttgattatcattttttaaaaaagtctatgctgttgtcctaaaagatggggctgagtaattgataaattatctgaattcatgtagtcaccgtagctcagctgggggtgtttccaaagagcctgcaataaaaactccaattgttattcaggccatgatggctaatgttatgcaaatagtcatacaaataactcaggcaatgaatctgacacatggcaatctggaacagtgcacaataaggatacataaaatcaaggtgtttcttagtcccttgaggaatagctaaggttcatggtccagagacctaagcacatcttagggatttgggagagctgaactctagttctgttttcagccctcactctctttgtgacaatttccttgccaatacgagacacaaagaatgcattgctaattctttagtaataaaaaatttaccacagtagcccctagcatactgcccttctggattcaaggtgagctctttttatttttttcttttctttaaacaaaccataagtatttatctttattctcgaatcttatcttttttatgccttctgagtgggtgcattcattcgctatttttaatactcgtgtcataattgccactttttcttttattatgtctgagctacatgcaacagatattcagtttgccaaagcaggaacattgaccccaacaatagttcaactaactgcctgagctcatccttacaaactctatatacagtccctttccaaattgctttgcttcctacttagctttaactatgagagtgcagatagtatttcactagacagaatgatttagtgaaataaatgagggtaaatgattagcatgcttttcagatggaagggatcttgtagctcattttgcaactgacaaatagcctcagacatactcggttacctgtcatgttatagcagaaactgaaacgtaagtctctaaaggccggtctgttataatgctattgctccacatgttcacggtttacccatgtaggtgactgttgtctccatatagttgtacgtggcaaactccaggataataacaagggaggctagcccacatgacatgggctaaaatcacagctctaccccttttagatatgggactttgagagagttatttcatctctctgttctttggattcctcgtcaggaaatgaggataataataatgccttcatcataaactaaaatgaaaattaagcaagatagtatgtacccattttacagacccatttgataaatagcaactaaatattaaagtcacatgggtaagactaatatggccaaattgtacttatgacttacatttacaaacacacagagctcacaatttagtagcagtcactatattgattgttgtgttgaactgctatagtttccatatttcttttctgctgttctatggtttcatcttaaaaataaaatttcctcatattacatcccttctctctctctgtccttctctctctctctcagagaaatactatatgacaaaaatagtaggtagcataatttcaaaactttgaagatgaaaaattccatgggaaaatgatagtggttgtcataatttcaattagatcacgaatatccaatttgtttcaagttgtttgatactgatctggaggaaatacagatctttttaaatataacaatataggaaatcatatgaattgaagtagaataaattatctccatataactttaaaattggaatgaaaataaattttaacattgatttagcaagaagtattatcaagagaaaagctataatatctttagaaagtcaatggcaggtatcaatttaaaataccaaataccataactagtaatgctttttgtaatgtattgaaagaaacctaagttaggcaataatattgatgatgaatattatgattataacagccgatactaaataaatgcttgttatattgtaggcattgccccaaaaactttacatttattattccggctgataatttaatgtgaaacaaataatcgatttccctccaattgctcaactctctagatctcagaagatatccaatcctgtctataggatgcaacataaaattgtcacctcattggattggaggtgctgtcctggatacagtgggccgaaatgtcaactaagaggtacactctaatattaataatcacaattctgaacaataagaaactgattctattgaagaaaagaatagcatttccccttttgaaccaaggtaaattaacatgtagccaaactcctaggactgttatactttctaagctttctaacttggtagcttttataacactctgaaatctcataagctattctttaacttctccccccatttttatgttggatttatatgatgagcaaatggaaatctgatgaaagatcttacttattcttaacaacaagctatagaggcatgccttattaaaatatcaggaatgctaattttcaatttttaaataaagtgttattagaagtgactcaatataaaaataagactaccatctagttttgttccagttcagttatttgaaataatgtgcatatgaatgaaatttagtattaaaggacatacaaggtatgtcatgaataattctctctttttcaaaattctaatggagctattttttttttttcagctgaggttttaaggactttctggtggcaaggctgatcaaacacatggtaacccgctgtggcctaatatccatgtgactattattttgcttttggctttaaacaggtttcctttgaaaaataagatacagcatcagcatacatattttaaatgaatgaatattacaagaaaggccattagcagtggtggggaattcaatcaacagtataagagactgtgattaaaaattaataaaactgtggagaaaccgttatggctcacattaagaaaaagaaaattataatacaaaagctctaggaatcctgcattttagttagggatattatttatggttttactagcctatacaatgagaatctacaggcaaatttcaccataatgctatttgttctgggtctggcctgaatttcaaagatgttataaaaattcaatttatattcagactacagaatgaatatgtacttcatttataaccaggtaaaataaacttttaaataaaatataatctatgctgaaaatatttggaaataaggaatttagcatattttaaaaagacccaaatatggccctgatttctgatttccatgaagtacacaaatatatactcacaatggtaaaacatatttgtgtctagaattggtgaattgttaaaagttctggataatatttagaattctgtttctgaaatctgtatttctcttcttctacaaagaaggatatcatgagattattaattccatcattatttcttgatgattcaagtttgtttgcagagcacatttctagaaatttaggttgttattacacatcttattagtagacatgtggcagggaaaaagtctactaatgaaatgtcatggactctagttgatcagagcgttgttgctccgtgcttcaaccttttatacttaggaatcaattctttatcactatggtggactacatacatgtaggaagaaaataccagaacatcactgtaaatatagacacaagaaacaaagactagctgacagtttcaaatatagactgtgtcctgccactctcatttttcaaagtatgatatgaaatatttatgaattcaagtagtttagggattgtctaatgacaccttatatcctaattagaagcaacctgtggataggttttatactagatttacaaatcattgtattaatttccagtggcaaaaatgtcccagaacagttctgattatgaccttctgtcataatagtgtaattggaaccactcataattcaggtatctgctgattaagctgttattgaaaggcctcttttctacggaaatctacaatgggaataatgttccaatggcagatatgcatattgtgtcatattgtcatacaaccaattctaatatagctttgattccaaaatagcctcctgttgctctctgctatactttgaccattctacttttcactttttagtgcagttgtattttcaatggctgaattttctattagtgcaattgatgcactggttgtattaggaactactgtgtcctttgtcccttgaaccttcattatatctctcctgggaggatatttgcacattttccccttctaatagctaaccaaattgcagtaggaagatcttctaaatatgcagggaatatcaccagctcaggaataaattggagctgtttgcaattgtacttttttacttcttctcccccacttttgtacccttctttccatttctttcttttatacccttctttctatttctttggggatgtggatccatctcgaaactgttagaaagagatgtggtgactcagaatacatggcgattctctctttattccacaatatgctaatctgctacgcacgtactttagctgcaactcagataatcaaaatactggtagccacagttctagattaccttataaaaatattcatcatattatcaaaaggaaaccaatttttaaaaatctaaatgaatagaactttattgggggaaaaaaggagtactaagtccaacatcaaagtaatagttctgatatgttttacatttgttatgtcattttctcttttcaaacatatatatttgtacataatgaggagtgagtcatcaaagacagtttgcacaagggttttgcctttagaaaggacctaattttgtgatatggtattcaagatacttttcaaaaagtcagcagtaacatacacttaaatctgttttataaaatttgcaataatgctcttttccagtagatgtctctaaaatattctgaagtggaacaaggaaagtgtgacttgctttaatgacacaaagggcaatgatttaaatacaaatagtgttagattacagaggatgaagaaaacttgtttgcaaatctgtttttaaaaatccagtggctttaatcatcagatcctttataggaaaaaggtatcttataacattctgttttgtactgcagatattatgaatgctgacaaaatgtgagcatgtacaagtgctgaaataaactggcccctaccatatgttatgaatatataaaaaatatttggttttacaaatgctgggaaatcatgcaataaattatataagagctactgtaactaacatttgaatatggggctcctccagcaggagtattttaaaatgcattccctgtagttttgcatatctagttcttcccagcagtagcaaatgctttcttctttgagaaagaacattacctcctctaagagtctttcacaataaaattatgatgcatttagtgaagaacactctgtaccataagtggttgttgcaccaaactgcctacttcaatttacctagtaaatctcagtaaagcttaacatgtacaccgaacattcaccatgcaagttttcacttgatattgagggatcagctggaaatctgtctcctcaagccacacaggaaggttttctggttctgagtgagagagagcaaacatcctcattactgagttgccattaatgacatcctccatatggctcaaaggtctggaaggaaaacaaaaaaaacttgcaaataaaatccatctaattaaaaaaaaaagcatctaataaggaagctgttgctcctactgtagacacttgctgaccttgcttctctaagtcgttgatctgtcaaggtcagggcttccattgcaaggggaaaaaaagagagtaactgtcctgggagaaaagcaaaaaggaatccaacttaaaaaatatattgcattttaaaaaaatctgaaatgcacaaacatctttaaaaatttagttgactgaaataaatgtccttctgtccctgtacctatcgcttagaagggaacaagaaaaagaaacttagaaatctgtcctgtatggaacaaagcaaaggtctgtgctcaagtgaaagacagattgcttggaaaacctagaatctgtggcagtccttgtgatagagaatacatttggggagacagaaagattgctaaatgaaaaaacaaaagagcatcaatcaacgaggctctttatcacaagagagtaactgactccactgtcagagatcctatcagctctttgctgtggctggttaaatcccgtgtaataaattgggatgaatgcaagtactgaactccagtcaacaaacaaaggtagggaaagataacataaactattgaatttgtaaaacaggcatttcaagttttcaacagccttggcagggactccatccaatgaattccggagcaaagagattcatgtgacaattggatctcaaggatctttgtgtgatgcttaatagttgtttcttttattcaggagtacagttttctcacttagattctgaaaaaaaaaaacaaacaaacaaacaataaatttaacaatgctgctaaaagcaaatgggaaactttatgaacatgcatgtgcccacatgcaattacattaatttttgacatttaatactaaaaaagttaatcacattttctttcaaattagtgatgttgaaactataaaatatgaaaaaagcttaatttttctcattttatatatattattttcatatactgaggaatgaatcatcaaattttagtgtgcaggaaaactagattttcacttgatacttctatgtatgtttattttttatctttttcaattgcttgttttttttctttctgacagcttttcaatttactctctcctctccttcttctcactgattttaaagttttttcttacgtttttggttactattttcaatctattgattatctcccgcatatcactgtctattcccttttttaatggaataacattttccaagatcacatgaatgatatatgtctcaaattcttttgaccctgaggtcaatagaaaattaaactttgatgctcttcatttgcttcctttctattcttgacactttacctctcacctaggtaaatttttacttcttgaacattcaggatctttcctagactgggtagcacggagggaactatatcttgatgacatgctcctactgaagtctcaaataggatcctagaagagttaaaatccccccacacatcctcgtgtgtgtgtttgtgtgtgtgtgtatgtgtgaaagagacagagagagcccttgcccttgtttccccagtctttgaaggatgttaagtaaaacattgttataatcttcatattaaatatgcagcatgtaatactttgtaagaagtaaaattaagagacctgattacaattccattataaaatgcaacttaaaataacatgtcactatttataataaagctttaccaaagtattttgaacccctggaaataaatcctgtgtaaaatgcttttgtgatttgtattgaggtctctccacttcgggatcacgagcacccaaaccaatctgcctcttgattatgatgattggtgggaaggggcagcagccacagtcaatattgtatataaatcaaaaattaagaatgtattactttttattttcttaaattagagcattgtctataatacagtctaaaactacagaccaagtaatatacatcataccaaaaatcactcatatcattctaataatttctaagcaatttattgatttctacaaattatattgatgtcgtctttcttttgccatggatgataccagctaaatgatgtccttgtcagagaggtaatttaatatagggaaccctctcaacctcctttaatgatttacccatcagatttagagtcactgggtgacatgaggtctcaataagtttgtaattttattaacatcagttaaattatcctcctgctgaattatctattgggctttcctgaataaaaagtgattgcattcaatttttatcagcacttaaatactgtgtgtatttttgaatgtttactgtctttattattaactaaatcatgaaaattcttatctaaatatcctatttaattagtttatagagctttgttaacgtcattaggccaaattcatctggcagcataaatcaatgaatatttattgcatttttttagttttgtcatataaattttattttcaaacaattcattagaaaatctttttcttacataattggccttttactaatttttgtttcaaatagtatatatacatctatatatttcaattaatatatattcatttaaaatagaatatataagtttcaaatgtatatttatagaatacatgaaatttttatatctatactatctttgatcagttttttaactatctccagtttaataaggggaattttcttttctcgtaaagctgaaaaaggattggcatttctgttagagtgtcatctctgaaaatcagttattttttaaaaaagtctattttccaaatgttaaatttcacaatttatatgaaagtgaattcatagggcttgatataatttacaaaatgcctttttagctgtaacatcacaggctatctttgaagtccaaatattcttccaatttttattattttaatttttagcatgtgctcttgctttccatctctctttccatctttctctctccctctcgtctacttttattgtctcttctttatttgatatatagcagtaaatatgaaattcatctagaaaagatttcaagtgtttacttgataacacattatactttcagtcagaaatatttgaatacagtagcttatagtgccaaaatttttaaaaagcagaagtctatctaaaactttgcctggaactcctggtttactttttcactattattgcacaggcttcacctatgtaaaaaattaaattttcacatacacaaattttgtggaaaattcctttctcaagtgttcatatgtattactacattactaatgtagcattaaagatgtttttccttctaatttactgagatttaaaaaaattaactgctttaaaattcttgatttttacgttttaggaaaattatgaaaatacttgtatatgaaagagttcaagtttcattaataatacttttaaattttattaagttgacttttaagttttctaagaagttgtcttacaaaaagcagtatcataaaactcatttgcaatgatattcctagatcagaattattatattaggtaagttctgtaatacttttcttttctaaaatgctctattatttttaaatgctcttattattttaaaaaagaaataatttaaaattctgattttttctaaatattttattattttatgggcactttattaacattatcggataaagtattttttaagttttttacttcaattgatttcattgaacatttttattattaggaatacttattttgtgaggctaatttcataacattttttaatattttcttcatgattcatggttgcaaacgatctttaacatagtgggtgaatgccattatgatgaaaaatgagtctaataattttatttctatattatacaaatttgtaggattgtttgaatccaacgtttacctagcaagaaaaaataatctaccaatattgaaaatcaagttgattttcattccagaaatgtaacttatttattttatattgaatttattttttataattatttggtattatttagatgttgtacatattaaaagatgttccagactaactgagtttgcagagtatcattacctaatttaggactaggttcctaagtgatacaatttttgttttattctcagattcaaaaattcaaaaaattcatactcaagatacccgaaacaaatgcttttaaaatttggttaaacttttgtttctttttcagtgtctttgataatttactataaacttctggaccataattatcaaataactatgcatttagaacaattagcacatgctaataagtaaaataaattgagcatcaaactattcagaagttgtagcaaatacaaaaatcataagcaatgataaactgttcattctactaaaacactgactgtttcacaaaatctatgcactgcctgacatcagtccaacaaaatgctaattctgaaaaatagttttcagatgttgccacagtaggaattccattcatcacatatcctacaaaatacatcctttatcatgtatccatgattaacttgtaattagttaatattataatttgtataactcagcttgtcagttattggacttcagcattatatatttgccaacagttgtggctttattatatttcaatattttaacaattggccgaccacattgctacatactggcaaaacacaatcatggagttggggaatgtgcaatgttgctagatgggagtaaggagcaacagtctggcttttgagtggaaagtgattttatttctgagacattctaaaattgtcattgggctgtagatttgattgctgtgaaggcagcacaaacactcttcatatgtttccatgcttaacagtgcctctttagggatcttgtgttataacaatagaaagaatggtaatatctgcatgaggaaatcaggaagctgtgaaaggtaccttccacccccatcccacttcacttactctttaaggaattgtatgagactcaaggttttcatttcttaaactttattaaatctgtcttcaacacacacctttgttattaacaggaatgctgtttaaaagtctatgaagattgatttctggattgcaattttagtattaatatatctagtattttctgcattataacaatgaatttacctcttagaagtagaaagcttagcaatttgttcaaaattagtgttcctaaccagggccatatatagaaatcacctgtagagttttgttttttttgtttgtttgttttttttaaatacgcacctgccccattcctcaaaatagagctactgaatgagaatctcaggtgagggagtggaaagaacatggacacttaatgtttcaaagtatacaggaacttctcatttccatctacgaggaaaaaaatcagtattctaatgggatgtaaagaaatatgtgttataataaaagttaatgatagaaaaggaaattcgaatagtaatcttgtttgtattcaacaaaacaatattatctttgctttcactataattatgcttcccttcctaacaaagtatccacagcctactgagttatggtactaccttcaaatgcaccagctctttttttttcctatgatctagccaaaaaggtaagcagcaaataaatgaaaagatcattgttcatcctgttaaattcacctgttcttactgctataaatatttataagttagtatccttaacattcatatttaaattaatagatctaaggtgggactctagaagttctacctccaaaagtttccaggtgatgctcatactgctgattaaaggaccccagtctgagaaccattgctttactctctagttatactcttggatggatgtacatttaagctgccagaataaaatgccttagtacaccatttaaggaggaatcgtgataaaaatttatgcaatgattaaatggttgtatctgtatgaattaatttaaacttacactataataaccttattgctaggtcttagaagaagatttacacttttccccacgcaatccatcccctaaataattacactattccccaagctgcagattgcttttgtccatcagataagtcaacaattacacaggactttatagaatacagcagaggaaatgaaaatcaaaaagaaacagcatcaaaacaaaaatcttggacatgaatggaaattcattaatttagctcaatgccctgaagaaaaacaatgcaaaattcaatctaacaatatagactcacccaaattaatgccaaatatacttcctgtggagtagagaagcttaagtattatagtcaaagccacatatggcttagggagcataattaacatgtgccagagatgcagagtttcattggttcataaactcacctgggaagaagcacggctagacacaaaacacttgtttcctcatgtctgtcatgcagactttaatggataaatttgtttgttagaagtctgcaaattaaagccatattatttgatgttctcaatattttattttatttatttttattttaattattgattgattgattgattgattgattggcagagtcctgctctatcccccagctggagtgcagtgatgccatctcggctcactgcaacctccgcctcccgggttcaatagactctcctgcctcagcctcccaagtagctggaattacaggcacctgagccaccacatctgactaatttttgtatttttagtagagacgggctttcactatgttggccaggctggtcttgagctccgacctcaagtgatccacctgcctcagcctcccaaagtgctgggattacaggtgtgagccaccgcacctggcctgtactcaatattttaaatagatcatttctctaaattgttttccccaatgaaaaactatattgccatttaaaatattatttgattcatgggaattattacttgccatttaaaatattacttgattcatggtaaattcttcagtagagtagatttattttacaagaatttctattgaaatttcactgactttaccagttgatttgcttgaaatgtgcctgcaatagtttacttttatttttagtccagtttgagactatcaaaatctggaaacaatccatttaagtggcactattaatgaaatagctatttttattttagtaaggaacctgtagctctcccttttttccaagtagacaccagttgggaattgccttgttaaacaatcagcctttgtggcagtccacttataagaatgctatagcttttaacacagcggatttaaaaatcccctcaattatgcaggcaatttacatctgctagtttacacagctcctccaaactaccatcccttttcacggaaaggaggcctgaataattttatttttttttccaagcagaattagagtcctgcatttcccactccaatgtggtgttgcattgccctatggttgggggcggagcagcttactctgcaatcatccccgaccatcatgcttcagtacgcgggaaaatgaatgtcagccaaattattgttcaggactggaaaaaatgaggctgtcccagtgcttaactgtctctcttctctttctgcttccttctagcccaggaacagcaaagtttgatacacaccaaccaggctgaaagtcatacagctgttggcagaggagtagctgagcagcagcagcagcaaggctgtggtgacccaggtcatagattgtaattactatcatctctgacccaattattgtcaatgctatttattacaacttccaagcaagaaatctcttagttgtcaaatgattgatggtgacacattagcatacttctcagtccttttctactggtgctggatgttgggagaaattgtggataagctataataggtactgaaaagaccatgtataactacagaagctttgtgtgcaaacacagaaagaataaaaatgctgtgatactaggttgtaaggaaaccacagttttccaaaataagaccaaacttttgttctccaaagagtgtcattatggaagacccttgacatggaaggaacaacttattcttttaagggatctaagaaggctctcttcaattcattaataagaggttgcttaatgggtactgatccctaagaaatgggattatgactaagaatcaacaagaacctcctgctgatccaaagttggcatgtcacatatttttccatctttctaatcagtttttgccatttcttttaggctaaactttagctcttacaaacataaggttggttactgctaaaaacatctattcactgtgtttggcatggatctagtcatacaaaacaaggcactcaattaagaaatgtgacttaaagggctgtctttaagaatgcagctgaatatcccttaacaatggtggtgtaattttttaagggattgaaattcagtatctttataaaagaccataatattcttgaattactgcaatacatgtgtaaagggatagacagtattattgctatataaagtgattcaaactaaattatgagtctctttatctttgattaacgaatacctcagtaaacaataaaattctcagaacatagctacaactacatacatatatctagctgcatattttaaatgctgaggtattgaatttggaagcagaagatgagccatcagctctgtaactgcgagcaagttattttggatttctgcccctttgtttctttttgagagtgtaacagtaactctttgaaataatttttttaaaacactgaaaattctgggaaaagttaaaacattttagaaatctaagctattatactactctttacaaatttctacacttagtcttaacattcaagttgccatttcctgaatgaatatagtcttgtattttcaaatgtattcctgcaaatatagtttgtttgaattaccttcaaacctatcatgaaatttaagtgatttttaaatatatatatattaatttttaattaaaaatttaagtgattttaagctgggcacagtggcttatgcctataatcccagcaatttgggaggccgaggcgggtggatcatgaggtgagaagatcgaaaacatcctggcctatatggtgaaaccccgtctctactaaaataaaaaaaaattagtctaacgtggtggtgtgtgcctgtaatcctagctacttgggaggctgaggcaggagaatcgcttgaacccgggaggcagaggttgcagtgagccaagatcatgccgctgcactgcagcctggtgacagagcgagactgtctcaaaaataaaaaattaaaaattaagtgtttttaaatatatatatttaactttcagtttttgtgggtacatagtaggtgtatgtactgttttgatacaggtacacaatgtgtaataatcacataatggagaatgaggtatccatcccctcaagcatttatcctttcggttacaaacaatccaattatattctcttagttattttaaaatgtacaattaaattattattgactatagtcaccacattgtgctattaaatagtagatcttattcattctttcttttgctattcttttttattatttatttatttatttatttttagagacagggtctgcacccaggcaggagtgcagtggagtgatcatgcatcactacagcctccatctccagagctcaaccaatcctcctgcctcagtgcccaagcagctgggaatacaggcacgtcccaccatgcctggttaaatttttttttttttttttttttttttgtagagacgaggtttagccatgttgcccaggctagtcttgaatctctgggccaaagcaatccacctgcctcagcctcccaaagtgctgggactacagccgtgagccactgtgacttagtctctaacaatttttttatacccaaataaaaaacaaatttttatttatatttttaatatatatatatatatttaatttttaattaaaaatttaagtggttttaggctgggtgtggtggctcacgcctgtaatcccaacactttgggaggccaaggcgggtggatcacgaggtcaggagatcaagaacatcctggccaacatggtgaaaccctgtctctactcaaataaaaaaaattagccacacgtggtggcatgcacctgtagtcccagctactgggaaggctgaggcaggggaatcgcttgaacctgggaggtgaaccatccccacctcactccaatcagccattatccttcccatcctctgataaccatccttgtactctctatctccttgagttcaattgttttgatgtttagatcccacaaatacatgagaacatgcgatgcttgtctttctgttcctggcttatttcccttagcataacgatctccagttccatccatgttgttgctttgttttttatggctgaataatactccattgtgtatatataccacattttctttatccattcatctgttgatggtcatgtatgtttcttccatatcttggctattgtgaatagtgctggcaatatacatgggagtgcagatacttcttggatatacagatttcctttcttttgtgtgtatacgtggaagtgggattgctagatcatatggtagctctatttttagtttttgaggaacctccaaactgttctccgtagtggttgtactaacttacattcctaccaacagggtatgggggggttccctttctccatatccttgccagcatttgttatttcctgtcctttggatataagccattttaactgaggtgagatgatatcgcatagtagttttggtttgagtttctctgatgatcagttatgttaagcacctttttatatgcctgtttgccatatgtatgtcttcttttgaaaaatgtatattcaaatcttttgccctgttttgattggattatcgggtgttttcctataggcttgtttgaccttcttttatattttgattattagtcccttgtcagatgggtggtttgcaaagatttttctctcattctgtgggttgtgtcttgactttgttggttgtttcttttgctgtgcagaagctttttaacttgatgtgatcccatctgtccatttttgctttgagtgcctgtggttgtggggtattactcaagaaatttttgcctagaccaaatgtcctagatactttctccaatgttttcttatagtagtttcatgttttgaggtcttagacttaaagagctaatccttttttatttgatttttgtgcatagtaagagacagaggtctagagtcattattctgcatatggacatccaatttccccagcaccatttattaaagagactgtcttttccctggtttttggcacctttgttgaaaatgagctcactgtagatacatggatttgtttctgggttctctattctattccattggtgtatttgtctatttttatgccagtaccatactgttttggttactacagctctgtgttataatttgaagtcaggtagtatgattcctccagttgttccttcagttgttctttttgcttaggtaagctttggttattctgggtcttttgttgttccatataaattttaggatttttttttttgtatttctgtgaagaatgtcattagtgttttgatagggattgcattgaatctgtaggttgctttggatagtatggacattttaacaatatttattcttccaattcatgaacacggcatatcttcaatttctttcattagtgttttatagttttcattatagtgaccttccacttctttggttaattgaatccttatgtatttaactttgtgtgtggctattgtaaatgagattacttttttttctttctcagattattcactgctggcatataaaaatgctactgagtttcatatgttggttttgtatcctgcaattttactgaattcatttatctattctaatagttttttggtggagtcttcaggtttttccaaatataaggtcatatcatctgcagagaaggataatttgaccccttcctttctaatttgaatgccctttattcctttgtcttgtctgatagctctagctagagcttctagtgctttgttgaaaaatagtggtgaaagtgagcatctttgttgtgctccagcttacagaagaaagggttttagtttttctccattcagtatgataccaactatgggtcaaaatatattttttaatggtctcaattttctcttctatatgcagaagtgatgcaaaaaatgactgatcaggtgaactaccaggcaatgaaactgactcttctgcagaagaagattgacaatatttctttgactgtgaatgatgtaaggaacacttactcctccctagaaggaaaagtcagcgaagataaaagcagagaatttcaatctcttctaaaaggtaaaaatgaaataaaataaaatattcattcagtaacacagaaagcaaatgattcatttttcttttcttacatcactttgggatctttgctttagtttgggtggtatggaaacctaagaaagattttttttaatgagatataaattcactaaaattctgaaataatttgaaatatctacattttattatatatactgaagtctttgactgaatattccatttggttgataaacatgatgtctctaactatagcctaacatattcatttttagttaaagtgagtcatattaatttacttccattgtgttatctacttcaagaataaaaacgcagttaggggatcaagatagctagttgcatggttgtctcaatactattgatggagacattgaggataaatctgaagtgcattattatcccccaaattttctaggttatggtgtaaaatctattaaatatatcctaaaacattccagctattattaatattaaagaataataatttatatatgtgaataggctttgcctgaattttgtgctcttcaaacagtgggcttaaaagcaggctatgtttctttctggaggatcaacaggataatccatttcctgctaatccaagatgctggcagaattcattttcttgcagttgtaggactgaggtctctgttttcttgatgtctgtaaactgaggcccattcccagcttctagaagccactgcatttcttgactcatcatcctccatctttaaagccagctacattgtgttgagttctccctgcatctttctgactatgtaactccgttggacctacctggataatcagaaaaatctctctatctcaaggtgcttaactttaatcacagttgccaagtcccttttgccatgtaaggtacatattcatggatacagggaattagcatatggacaccttgggggaaaggggtgtgtattattctgcctaccacagagatttatgtatagtgagtaattgttatgatagtgttatacacaggatacaatgggaccacttgacacttgcaacaaatccaatctaaggggaccagggaaagcgtctagaaagagaaaccatctcaattgatgttaaccatgcagaaaggtttcgggtagggcaaggatgttctaggcatgcagttagtttgattcctgggagcgtcccagtcgggtttattgtatgaaacttgtctgtttgcaagtttcaggattactgttttttttccttttgctttattcattaaaaaactcagtgtacaacccaatttttatcattcacaagttatcttttctctattgatttaaaaaagataaataggtggatatttaatatatcatctaccagtatggatgcttacatagctcaacaacaattatgttttttaatcatataaataattgctgctactcaaccactaaaagaaagaccctgtcctacatatctggtatggcccaaccttaccaatgctgagcatgagaaggaaacatttttcccccctgaagtgacagcatgagaaagaagtcaaatagaaacagtatgtaattgactataaccatctgaatgagatttgtttagcaagatttggttctcatgacctaacagaattagcctgtcaactgtttttttgtgacctaccagcctactacaaagattctggcactgacacaggagaaaaatcacacactcacagcaacagcattaataatgaaactccctccgcaataggaggaattaattgtgtactgagcacagtcattaattataagaaccagagggcttgtagttaatgaatattcttacaggaaacaaaaactaaacccacctccaaggtgctgtgcttgcctagcgaaaccacagcttcctccctagtttactttacatccaaggtgaaaaacactgcgtaatctgacagtagccatagaaactgttgaaaatcaaatgtctcaactccgtaagaggaggtggataccttaagaggtacctaaatgttattaaaaggccatacattcacaattacagaaggtgaatgctaaggtatctgatatcaaatatatctggtaagtcaccaaatgtaatatgcttctaagaaagtggaagcatatgagtcacaggaaacagaaacaaacagaattaaaatgatgtgcccactcaactattaacataaagcactttgacatgttcttgggaaatcagattcttgtacagatgcttgtttagtaacaaattgtagaaatgttacctgaaaagcttctgatcccaaaacacatttttaagctaataatatgtttaatatcttttcagacattgctgtgattttgcactttcttcaaagtatttttccataaaagtgttaaagtgtaacagctaaagtaatttacattactcattttcattgttttttctcccaattatgttgatcaagattttgtgctgagtttttgcttattgtttttcttattaggacttttaggcatgtagttttttgtttgctgaagttaaacatttattgtcattgtccacaactaataaattcaataaagcctaaattttattgtacctttcaatcttgaaaaactgtaagattataaatttaaagaaggtcgaatctgaaccttaaatattttattatatttcatcaagcttttgatgtcatgagaattagagtcatttttaactaatgggaaatgactaaatgttcttatagaaagagtaatattaatattactattgaatagtaccttacactcaatgatacttacatattcttttttgtaagaccagaaatcgaattttctaaattttacttactctatatagcatatagaatgtatttcatcaatatttattgaataaatgggtgactggttaaatgctaagcaaaatgtagaagataaaaatgctttaaagcctttctggtgtgattatccatgttatttgatacaaaagctaggactatttctgtataatttatcttaattgtggctagttagtcttttctaattcatttagcctttccttagtactttaaggctgtgtgtcatattgattactattctatatttcatgttttgttttcttttttccattacatacaaattgatctttggacttttaaacttactttagtttccactaagtttataaaaagtaaaataaaatatctttcccattttattttcatctggcaacatggatctttagggtgcaggatttccagagaaatgtttatccatctaaattttcatatttacagcttcgtttttgtacaaaattgtcaatatcaagatgctcaaacaatacatcattctatttttaataatcactctttcacatatttttatgtaagtccctcatgtatgttaaaaacttacttacaaaatggagacatgtggagcctatttttttaatcctaggatgatctttctttaatagactacatagtagctataattgatggcaatatcccattgtacagactttcctgtctaaaatgctttgcattgtattgtgtgtattttacattatagtcattgattattgtgttagtccattttcatattgctattaaaaaaacctgagacagggtaatttatatagaaaaagaggtttgatggactcacagttccacatggctggggaggcctcacaatcaaggcagaagatgaagaaggagcaaagccacgtcttacatggtggcaggcaagagagcatgtgcaggggaactgccctttataaaaccatcagatcttgtgagacttattcactatcatgagaacagcatgggaaaaatccctccccatgattcaatttatctcccactgggtccctcccacaatgcatgggtattatggaagctacaattcaaaatgagatttgggtcaggacaatgccaaaccatattatttcaccccggccccttccaaatctcatgtcctcacatttcaaaaccaatcatgccttcccaacagtcccccaaagtcttcattcatttcagcattaactcaagagtccacagtctgaaatctcatctgagacaaggcaagtcccttctgtctatgaacctgtaaaatcaaaagcaaattagttacttcctagatataatgcaggcacaggaattgggtaaatacagccattccaaatgggagacattggccataacaaaggggctacgggcctcacgcaagtccgaaatccagtggagcagtcaaatattaaagctccgaagtgatctcctttgactccatatctcacatccaggtcacactgatgcaagaggtgggtccccatggtggtgggcagctccatccctgtggctttgcagggtacagcctctcttccagctgcttccatgggctgattttgaaggtctgtggctttttctcatgcacagtgcaagctgtcagtgaatctaccattctggggtctgcaggagagtagccctcttctcacagctccactaggcagtgcccaagtggagacactgtgtggggggtcccaccccacatttcccttctgcaccaccctagcacaggttctctatgaaggctgtgcccctgcctgcacatccatgtgttttcatacattctctgcaatctaggtggaggttcccaaacctcaatccttgacttctctgcaccttcaagcccaacaccacatgtaagccacaggcttggggcttgcaccctctgaaacaatggcctgaactatacattggtcccttttagccatggttgggacacagagcaccaagccttgaaacagcacaaagcagcaaggcccccatgaaactattttttcctcctaggcttcccagctggtgatgggaggcactgctgggaagacctctgacatgctctggaggcattttctccattgtcttggcagttaacatttggctgcttattacttatgcaaatttctgccaccagcttgaatttctcctcagaaaatgaggttttttttcttttctatttcatcatcagcctgcaaatttttgaacttttatgctctgcttcccttttaaacataagctccaattccaagccatatctttgtgaattaataaaactgaatgcttttaagagcacccaagtgatatcttgaactctctgctgcttagaaatttcttctgccaggtatcctaaatcatttctctcaagttcaaagttccacagatctctagggcggggcaaaatgccaccagtctctttgctaaagcatatcaagaatcacctttgctccagttcccaatatgttcctcatctccatctgagaccatctcagcctggactttttggtcaaaaccatttgacaagtctccaggaagctccaaattttctgacatattcccgtcttcttcagagccctccaaactgttcccacctctgcccgttacccagttccaaagtcgcttccacattttcaggtgtcttaatagcagtagcccactctattgataaccataccccactctgttggtaaaagctatattagtccatttttatgcagctatgaaatagctgggtaatttataaagaaaaagaggtttaatggactcacagttccacatggctgggggagcttcacaatcgtggcagaaggtgaagaaagagcaaagccacatcttacacggcgacaagcaagacagcatgtgcaggggaactgccctttataaaaccatcagatcttgtgagaactcacttactatcatgagaacagcatgggaaaaaacccacccccgtgattcaattaccttccactgggtctctctcacaacatgtggggattatgggaggtaccattcaagatgaggtttgggtggggacacagccaaaccatattaattatattttgaatttgaatggacatatcttccagttatgtgtacttcatcactagatattataaatatatctctagtatatgtatcttttctgttttctttgtatgcaagtttttttatattttaaatagtcattttctattctaaatagttatgaatattaatagttgtgaatagtccagtacacttttcctgttcctttttttcatgctacatttagagactaccacaattatggcttatgattaaccaatgttttctaatatttgagatagtactatgtgtttcattacttgcaagttttctcttctctttttgttaaaaattaatgtcatactataataatatgtcaggtgtatcttgaattcctattttcgttggaggaagacttaattttgaaatccccaaatctcattattattattttattgttattataaaacactattaaatcttatgaatattacttcatttttcctcatttgagaatatcattaaggtttttccctgcagtcaatttattagcttttataagcccaaagcataagctttgcaacttaattagtagaaacctaacaacacagtcatgagctaacaccaggtattatttactaaggcagaaagcccaaagccatttattttcacacaaaacgaaaactagacctagaattattgtacacaagggtgtattactgaagtcagtagtagttccgtcatgtctttcatccaaaggaccttagttttatggttttagtatgttctagtatgttctgcaagtgatatctcctctcagatttattattcaaggaattgatcaccttttataaattatagtaatttttaaaattctataagtaaatgtagttaagaggtatttttattattacgtgttattaatgtttaatttcaaactttttatcttttagagatgcttaaagtctcatataattaaaactatgtattattaattatttctttctctaggtctaaaatccaaaagcattaatgtactgataagagacatagtaagagaacaatttaaaatttttcaaaatgacatgcaagagactgtagcacagctcttcaagactgtatcaagtctatcagaggacctcgaaagcaccaggcaaataattcaaaaagttaatgaatctgtggtttcaatagcagcccagcaaaagtttgttttggtgcaagagaatcggcccactttgactgatatagtggaactaaggaatcacattgtgaatgtaaggcaagaaatgactcttacatgtgagaagcctattaaagaactagaagtaaagcagactcatttagaaggtgctctagaacaggaacactcaagaagcattctgtattatgaatccctcaataaaactctttctaaattgaaggaagtacatgagcagcttttatcaactgaacaggtatcagaccagaagaatgctccagctgctgagtcagttagcaataatgtcactgagtacatgtctactttacatgaaaatataaagaagcagagtttgatgatgctgcaaatgtttgaagatttgcacattcaagaaagcaagattaacaatctcaccgtctctttggagatggagaaagagtctctcagaggtgaatgtgaagacatgttatccaaatgcagaaatgattttaaatttcaacttaaggacacagaagagaatttacatgtgttaaatcaaacattggctgaagttctctttccaatggacaataagatggacaaaatgagtgagcaactaaatgatttgacttatgatatggagatccttcaacccttgcttgagcagggagcatcactcagacagacaatgacatatgaacaaccaaaggaagcaatagtgataaggaaaaagatagaaaatctgactagtgctgtcaatagtctaaattttattatcaaagaacttacaaaaagacacaacttacttagaaatgaagtacagggtcgtgatgatgccttagaaagacgtatcaatgaatatgccttagaaatggaagatggcctcaataagacaatgactattataaataatgctattgatttcattcaagataactatgccctaaaagagactttaagtactattaaggataatagtgagatccatcataaatgtacctccgatatggaaactattttgacatttattcctcagttccaccgtctgaatgattctattcagactttggtcaatgacaatcagagatataactttgttttgcaagtcgccaagacccttgcaggtattcccagagatgagaaactaaatcagtccaacttccaaaagatgtatcaaatgttcaatgaaaccacttcccaagtgagaaaataccagcaaaatatgagtcatttggaagaaaaactactcttaactaccaagatttccaaaaattttgagactcggttgcaagacattgagtctaaagttacccagacgctcataccttattatatttcagttaaaaaaggcagtgtagttacaaatgagagagatcaggctcttcaactgcaagtattaaattccagatttaaggcgttggaagcaaaatctatccatctttcaattaacttcttttcgcttaacaaaactctccacgaagttttaacaatgtgtcacaatgcttctacaagtgtgtcagaactgaatgctaccatccctaagtggataaaacattccctgccagatattcaacttcttcagaaaggtctaacagaatttgtggaaccaataattcaaataaaaactcaagctgccctatctaatttaacttgttgtatagatcgatcgttgcctggtagtctggcaaatgttgtcaagtctcagaagcaagtaaaatcattgccaaagaaaattaacgcacttaagaaaccaacggtaaatcttaccacagtcctgataggccggactcaaagaaacacggacaacataatatatcctggtaagctgttactgaaaagtaacttttaatctctctttttacttaaatgatatttaatagatctgtacagttgagcaagaccattaaacataaaactacatacttgaacttggatagatagtcaagttgtgaagatcactgacattatttaaatctgaatctatcttacagtatttcagacatcaatacaaaacaaatatttctagtgtatatttggctatgtgtttttaaaatttttctgactagacctctataaaataattaaatttgctcctatggaacaatttgctttgcacaagtaattaaacaaagctattaggcaaggagatctttaatagaccagatttacttattttggcattttaccatatctgatatgcaataggaactcagtaaatacctgttgaatgatcatctgacaatgaatgttcaggaaatagatttgggtaaatcatagaaggccatcaatgccaagctaagtacttagacatgattttgtaaagagtagggtgtctgaaaattggtatcagtggattggttgtgataagagctgcaactcagaagcatgaagctagcaatagtgtgtagtgtgattgcagaggtgatattagggatgttactgaatgaatattggcaagagccatagaggaagctctaaggctgatgtgagaaatgttggaaagttcccatcaacagaaacagagggagagtggcaagaaaaatgatttgaggaacatcaaatcttgattctggtcctagatgtattagtaagtttctgtgttagttaatagcactaggtaaaaagttcacctctctaggccttagtttcttccttttaagtgatgagattgcagtaggtgatttgctgaggtgcttagtagagatatgccgaagactgcttcactgtaaaaaaatccacgatctgttcacagccttaatgcatgacacttggagaagagagagatctagactttcccgatgttttgaatttgggaaatgacagaatagtggtaccattaacagatgttctaaacaccaaggaagaagcatgtatttgggaagaaagaggaattgtgtggtgcatataaattgcataatagtacctctgtatgaaggaagtgttttatgaatatggttgtcatataagtaatattgaataatcttttctaaatatgaatatctcttcattcttacaaaaagtaatggctgtgtttttctcatatgagtctgctgttaaattatagcccatttgtatgaattttgtactttatttctttttaattacaaaggatgatcattattctaacataatatgacttcatatttaatgtatgaatgttttgataatattaaaaataacagaataatagagttgaattatctctactatttaaattagtatatttatttatgactcccccagagtaatctgacctaatagaactaattttacttctgtaggaacatagaagaaactatttagacgtatatgtttcccagagaaaggtagtatctcaatataagatgttcttaaaataacaattttgggagatataaggagttgttttttccatactatttccattattggtcttcatgtggacacttcatcatgatcttcaattagctatacagcatgtgtgaccacacaccaggcaagctatgtcattttttaaacatatatatatatatatatatatatatatatatatatttaaaatatatatatgctattttcatagtaagtataaaattgaaatagcctcaaataaattgaggaaaaacatttatagaacattaagaacttgcaaactttgataatataatgaatgcatgttaggacattataaaaattgtatctagatacttattgtgattgactcaatattgggcttaatagactaataataggaaataactcagttttgattcttattttccaataaggctttgataacattgcttcctgttcctttatttactgactgtagaactttttatgttcctgtctaccaaaaataactattaaagttctttattttatttaagcaaagataccaataatgatgccaaggtaataaagatatactgacctaattcccacgtgcaaggtagatattccttttatgccaggccgggccagcaacataatgtatgggacccttttaagtggttgcataggtttgcatgcccattaagccagccatacttccatgggccatagaacagatgtcaatcattgggcagctcagcaggcaaggtctatgaaagatgatgaaaccagtggactcaggctaagttctcctgtaagaatagaacaattgcagaataaactactacttttgataccctgttttataccaggggtgggacacactgtttaaatttggctgtttcatttcacctttgatattgtataagtattatacagccacattgctctcccacataactaaagccagaagataatttatcatcatcttatgaatctcagagtcatattattcagattctagctgccatcatttgcaaaataagtacagtatatagaaaaaagcatataaatatagtgttttaatcttaattttaataactgataacttactttgaagcctgataatatgaataccgtaataatacgacattggttagtattcattaacatttactatatctcaggcactgtgaaaattcccaatattcataacttcatttaacaatacctgtgaggtaagtattattatttattctgaagatgagtaaactgaccctcggagacattaactaaagtatcctgcctaaggtcattcaactagtaagtgatagagcttggcttctggccagctagactcagggctcagtcctcaaccacatgctcaaagaaattatagagtgtgttcacatgcctttctcttctttctgtttctgtttcatgcatcatatgttcttcagtctggccatatctgaatattccatatggctggagccgatatttttagggagtttcttttcttgaagatccaaatactgacaagttgtttctgcacatgaggaagtagaggtgctacttttcagtttggcttttttgggatatggccagtgggtacttattgaaagtcaccatcagatagtcacaagatcttcctttgactgacgaagaagagggacaaaattcattattctcatccctgccacttccttttgagccattcctacattcattcatgctatttctgattcctagtaggccactgatgataagatattctggttcaattgctaaatatttgatttgtttctaaacaatattctaatagacaccaagaggtttttatttcatctttgaagatttgtttgtacagcaattggcagacttatccctgcagagagcttttggctgcttgcccttccaaaagcagctgaatcctgacttaacacaatgtcagcagctcactgctgagcatgtgcacctcctgcttgtaaaaccattggctttttatttcaactttttctctaatgtttatcaatttagctccccttcataaacctctcttattaataattattcctgtactcccaagaaagattactttctataaaacatttggtagtgttttaaaatgtaattttaaaaattatcattgatgtgaatatatgctatttaaaagagaaaaaatgaggacctagtgaatatttaactgtcttatatcacattgaaaccatttctaaattttgtgactctgcatagaggcagctgtgatgactaatgagccctgaatttggaatcaggacaccagggttcaagtcctgcctggcaatatatttatttgtaataagtcatttatttttctaggcctttctttcctcatttataaaataagaataacatacaaaccttataagtttattttgagaatcaagaatataatctgcagatagtgtattaagttattactatatgatgcaattttcttagctatattcaatgtatatgcttttattttctcaacattttcacttaatatttgatatataattatttccatgcatcaacatagtttacaaacttatagcatctcattgttacttattattactttgataattcactgtgttttaaactccgcatatgcttataacttagcttatggtcatcatgcaatgataaatcaaaaagaataggatacaaaatataaagactgtgtaaaaacatgtgcattgataagcactgaaaataaatgtcaaagaatggttttctccaagcgattttctactatttatatgattttccatattataaaatattttcaaatatacctcaagataactaataggttatcttctgtacaaaatggctgaatataagcccgttaaattttgaaagctatctgcttcaatttagagtttagatgtgttttagaagtcccccaaatacgtgtacgcatttggtaattcaatagaagtgctcacaggatctggcatatccatagtgttcacatctgtggcttattatggcaaaaagttcgtaacaggatcagctaaggaaaaagatacaagcagagtctggagaaatttaggcacaggattttttatgtttatccctcccatgaaggacaacatttctgtgtgctctttttttctagtcacacacacatacacaaaattagtaacgtgtacattaattctgcccatacaagcccatcagatactcagcacttagttttactgggggctggtcacataagcatcctctgcctaggacataccaaaactccatactctcagaagggaagcagatattcagcataaatcatattgtttgtacaaagagtctgggcatggtgaatgacacttaccagttagggaatggagagaagtcaagttcccagatgctaaccaactgcaaaattttccaagtaggcctttctaaagatatcagtctctggcctactatgttcactcttctctgcagattatcttaaagatattcttcatgtcagaactggttaggaggcctgtctgctggggatggcctccccaatttgtgtcaataaaacatatcagtgttgaaggaaatagtaaatgaactactttttgttcatggctctctgggagaagaacagactcccccagatttccatatgattcccttcatatggaagaatgatgacagctaaagagcaaatgctgacaaaattgacaaccttttctgtcaccttgtcctcaataaagtagccaggctatctaaggtgcatagtcagaaacccagacgtttaatgatcacattctctgaaccaaaatgtctaacatttgctctgacatgaaaaaggaaatgggatggaattccaggttccatttacacagtcactgcatatgcttgggttctttcccaagcaaaaatcacaggagctacttcccaacaatagacgatttctttgacaccaaggatttgaaacgaaatttgattcttaacttgtctgtaaattaaatgcaataaacatatatttttgtactggtcattaactatattatgaatttaaaattgtactcaatagtattattttgtaacttattgattatcaaacatgaaaaggaaggtggcaggattattaaattacagattgtaaatttgctatggaatgatctaagtgaacatgatattttcatcctgacaaaaatcacagcatagaaataacagctgtgtaatatactaactgcatatgaagtctgaaaaacatactttaagtttttaattgccagttttactatacatagcttaaaatgggctctccaaagaaataattattattttaggatataaacctaatttgaactttttaattccaattatgttgacagcattgttttaggggaaaatatcacatgaaactccattgatatcaatattaataaatctaaactcaagtgtctttaccctaaaatcaaattaccagtaaaattatgacacagtgtttggagaaataaagcaatcaatgaaaaaaaatgatcgcatgttgtgccagaatgataaaagttctaaactacacttatttttttactttttacaaaaaagtaaacaattgttttacagttaatgaaccttcctttcagaattcttttccagactttataatcttaaacgagtgttaagatttgaaatttgcgtggaaatttagatttgagaggtattggcatgaaaatggtgtttggaaactctgggtgtgggtgagcagagccaggggactcatgtaagagcagagtcagaggaagagcaacctctaaagcttaactggagagagagcagtctggagagaatatcaagaagaaacaaaagagacaggaggataagcacatctgatgtggacgttagcatatgattgcattttccaggcctgccaaaataaattggaagttataaaaaatacttactatcccaaatcatcatctgaataataatgagacatcaacactaccttttatatataacctaaattcggtgactttattgtcaactaagaaactgcttgtacacaatcatgtgtacgtgtatttagtcatttacttgaataggaaatttgtttgaaaatgtgaaattgcagatttacctcaagaggatctttgtaaaacactttcctagatggatgctacaataaagacaagataatttctattattcatggttatattagcttaaaatgttgtgctaaaacttcttaaagcagtttttgttttaggacccaaatgaattatttttagaattatgagtattattggaaagttataatgattcttaattttccaacttgattcaacaaatattacgtaagtcctaagtgggatcaagttagaaagcaaggctctggctcagaaagctttgtaattttttgttctagaagaatttgatagtgaggctgggagcggtggctcaccactgtaatcccaacactttgggaggctaaggtgtgcagatcacttaaggccaagagttcgagaccagcctggccaacctggcgaaaccccatctctaataaaaatacaaaaattagccaggtgtagtggcacgtgcccaactactagggaggctgaggcaggagaatatcttgaacccaggaggaggaggttgcagtgagccgagatcatgccactgcactccagcttgggcagcagagcgagactctgtctcaaaaaaaaaaaaatgatagtgaaagatatacctatagagcagtgcaatgttctgttatattttatactttttttgatattttggtatgtgcataagaataccatgttattatgaagctattttgaatgtgaaagaaaagaaacaacataccacagcatattctaactatttatctaacttgtattcaatttttgacttttgtacattttaatttttttctctattttaaatagtgccacactaattaatttttgtgaccatctctaatcttatttccttaagataacatccaagaagtaaaattactggtgcaaagcccatgcacattttgaaagaatttgataaatattgccaagtttctcttcagagagtatcaatttacgctcccttgagcaacttatgaaagggccaagtgttatacctgtgtgcacatatatacacatgggcacgttaactttgcccaaaaagtttgtccaaaaaattaaaaaatatttaaatatgagacttttaacagacaatgatgacactatggatatcttttatttttatcattttaataggcgtgcagttatatctcattgtaattagggaagcagatttcacagctatatggatgagggttgtttagaggcaggcaaagcgatgttaagacggctataatcatctagatatgagaaaatgagagcatcaattagaaaagttaatggggatggaatggaaatcaaagagcagggagattacttttgagaagttacatttggtaaaataataagttttatagacaacaaagaaggtgggatgatgaactacaatattcttagtgattttgaaatccaaggtaggaaattaagggacttgaaacaacgcgagtttatttgtttgtggtataacttacatttagttaaatgtactaatgttgatagatagcctatgagttttgacaaatacatagtcgtataaccttcaccataatcaagatagggatcagttccatcaccaccccaaatttcctcatgcacctttgtagtcaaacctgttcctactaccaagcactagcaaccagtgatctgttttcttcccagacaattctattttttccagaatatgtaagaaacaaactcatacaatatgtggaggctttggagtctggcttctttcacttcatgtaacatatctgagattcatccatgttcttgcatgtattcatttttattcataagtagtgtatagtataaatatacaatttctttatctatttaccagttgaaggatctttttttggttgtttccagtctggggttactgtggataaagctgctataaacattcacatacaggtttttgtatgaatgtcagtttttgtttctctcttataattatacagcagtagcatagtttggttataagatacatagttttaactttagaaggaatgactaaccacttggcatttccatgaataatatatgagaattctaattgctccaaatttttgccagcacttgacattgtcaatatctttcatgttattttagtaggtacatagttatatctcactgtggttttgttttgcattttcctagtgactaggaacactgaacatattttaatgtattggtcagacaatgtttttaattcttctcttgattgatggttataactctaaagaaaaaggataaatcagttcacgatatcaaacaaaaacatttaatttcctaggtcacagcttaagataacaaaataatagcaagggataaagtaaatcctttcggacaggtctaagatatttgctgaagattgctgatacaactaaatgtgccttaaagtaatatatgaagggttgaggaaaaaagatcccagaaaacaatataagaaacaattggtgtgatataaaaagaataccaaaaataaaaactgacagtttgaaggaaaagcagtaaacatggtttgaaacagtatttccatccatctatacaccaaagaacacaatgttagtaattagagcaatgcatttgaaaacttaataaaaacaaataaatgttagtattcctagaagttgctggcaatgggcatatgaaatatttctagagcaacaggaagataagccttatttgatataaacagttttgacaaatggggaagcataatagcactgaaagttaagaatgtgtccattaatatggaaatgaaaacattttacagagcattggaatcaggatgaaacataaagaaaagtgcaaatgttgtgtgggcatgttacctaggagcagatttgtgtaatgctttcatctgtgtattataaaatgggaggacaggcaaaacgataagttccctcgctaatctcttggaaactccattgtgtcctagcagagatcagttatctgccctctacaatgttactgtttacatgaagaaattaagattttgatgctaaagtagaagtaagcaataaaatataaagtaaaattaaaataaaagtatatgatagataacattatatgtaatagaaataaatgtaagaatacagtagaaatcatcaacacaatgtatccctttattcatcaaattcctgttgaatgagttctgaatgagcactgaggaaagttgagtgaatagagcggtaaactcaacacagcccctcttctcatgaagttcatacattaatcgagtaattataataaaaaatgacaaatattaggaatgacagggtgctttgaaaatgcaaggtgctctccaattagttcaaatatgtacatttatgaaatatgaaactaggattaatagaaaattgtaactagagcacatattagggtccagaaagcaaagaccagaataaattgaaatttataaatgaaatatcagttatgctacttgcacagtggtagaatgttgacttggaagaactattgaactaattgcactgatctccattaaaaaaaatggacaggaaggagtttaagaggttattgaagctcaaggtaaggggagaagttgtggaaagttcgcttaaatggattcacttctgggcacagtggctcacactgtaatcccacattttgggaggccaaggcaggtggatcacctgaggttggaagtttgagaccagcttggcccacacggtgaaaccccgtctctgctaaaaatacaaaaaatagcctggcatggtggtgcacacctgtagtcccagctacttgggaggctgaggcaggagaatagcttaagcccaggaggcagaggttgcagtgagccaagatcatgctactgcactccagcctggacgacagagcgagactccatctcaaaaataaaacaaataaataaataaatagattcatgtctctaggataacatgacaatgatagcatagtgtcaaactctgtgacatttgagaaactgggaagaaggttgaaatttgataagaatgtggtattctattccatcttttattaatttgtctattcatttttaaaactactttagtattttctatatgtcaggcactgtgctaataaggttgatatgaagtttaagtcatagagaacatgatccctgacctcatgaaagctcatactcttgttggaagtaagaaagacaccaaagcaattacagttgagtgtgatgaattcaagaagacaactttggagcatcaggcagcaatggagagaactaaagtgatttactcctagggatgaggaaagatgtcataaagaaaatgatgctttattggagtttgatttttgttggtaattcaagaacaagtagcctattaagcacaaatatgagcaggtacttataaaggtacctaaccattttttaagcgttttaataataaaggagaaaaataagtcaggtggtgtacaaaagttgattttgttttgttttgttttttgagatagagtctcactccgtcgcccaggctggagtgcagtggcgtgaccctggctcactgcaacctccgcctcctgggttcaagtaattctcctgcctcagcctccggagtagctgggattacaggcacacaccaccacacccagctaattttgtatttttagtagagatggggtttcaccatgttagccaggctgatctcaaactcccgacctcaggtgatctgcccgcctcagcctcccaaagtgctaggattacaggcgtgagccaccgtacccagccaaaagttgatttctaactcattgtataacaaagtacaaatagcttcagttggaaaatcagtgccattcaatctttagttgtctgttataaggctctgtacttgtcactaatccatcaggtattttttttctagtacgtatttttatcgataacttggaggaacgcatgagacataaatttggaaatgataacaaagataggggagggtggctgaaacatctatacagaataaaactgaatgctttctatggacagagatggtaactcatgtctaataagataaattttattatcaataataattgtaaattcatgtttaaatgaattaaatagacatgagattttagaaagcttcaatacatcagagcacaggagacctgttatgagacagtgtgatacagatgcagaaatagacaatgaatacttaatgcttgtgttatcttgacagaagtgtaagttcatttcagcaggggtaactagcaattgctaccataacctactatgcttgggctcaactggtacaatatgtccagttctgggtgccatggacatgattttatattttaaaatgtgattattttggcagagacttggaaagtccagacatacctaaaatagcaaaaagaggcacagaaaggaacttaaaacagaagcagtcgaagcaggtacagacaagtggctgaggcatcctgagcagataatcagtaggcaccatgaaagatgtcctagaaggcaagctgtgtgcagtctcaagaagtttgggctactgtaacagtagtagtagatgcagaccttcaattaaacttaagtgtagccctactccagatgaatgaccctaaaaagaaattggaaaatggggtaaaatagcaccctctgaaatgactcaaagaactacagcaaggcaagacccaattcctaaagtaatggaacataaagaagcaaaaaatggaatgctgctcctggacattaaatagcaggcagaatccttgatcctgaagattcagagtagagccaacagcaatgcagataaatctaattttttccacagtttcttaagttctccttatagcacagctttgatccctgattcatgaacagggccaaggttacaggtgactgtgattttttatatttgggaaaattaaaattatagagctgatcaaattacataaataagttagtgttccccccaactctactgcacaattgatacattcctagtgaaacccattaattgaaacttctcctgtgagttgatcactgtgctaaattcagagaatgtaaaaataaatgaagcaaatgctttgatacagaatattcacattactataagtaatgaaaagtcattgatgtttttaatgcaggaaaataatgggcaaagttctggaatgttaatgagcagcaaaaaagggatttgataatctattcacatgcagcaaagtgaggttaaaggaatgttagccagtcgaaatatttgttaaaaggtattacacacatgtaatattttaatacttttcttaataaggaaaatagtttatagaatattgcagagaatatatcaagataattctgattaatttctcattacataagtacaatattaatatatttgctttgcaaaaaattttaataatacaggcatgccgtttgttcacattttatgtgaatttcaattgtatggctatgaaacaaaatgtatataaaaatttataggtctcacttcatgagaaaaatattacacaaaacaaataacttccaaattaaaaatcatcaacaatcacctggtttgaaatgagtggatggtaaactacatcattaccataaggtggcaccagagtaactgtggcaagtagtataagcgctgaattcttctgaccttgtttctgcatttacataattatgcattatgtttataaccatattcataatttgaagctttcacaacaaatgaaattattctatatgtaatgtgtgagctgtaactttctgtcttcagtaaaccaaacctgttggagaatctacctcattctttaattgctgtctaatattcctcagtgggaatatgttacaatttatttaacaagtcctgcatcagtgatcatttaggagtctttaaatttttcaagaatgcaagtgatatcattttgaattgaagaattgtctttgtgcacatggacaagtatgtctggagtatatatatactgccagaagaaatgtttggctcaaagtaaattaacctttttaatactgataaatatcgtcacattgtcctattaacagctatagcagtttacactccagccagcattgcatgaaaaggcccattttcccttatattgacatgactggatattttctacgtatctttttaaatgttgccaccttatatttaaataatgttattattgctaaatttattatttctgaattagtaatgaggttgcatatgctttaaaacttttagtgaccttttgtgggttttgttcaatgatttgcctactgatacattctccgttttttaacttatttttttctgatctgtaagtgaagaccattttcttatttttatttattttttatttaaaaaattagagatggggtatcactatgctgctcaggctggtctcaaacacctggactcaagccatcctcttgccttggcctcctgaagtggtggggttacaggtgtgagccaccatacccggcctcattttccatttttaagggagaattttttttttcttttcagagtttttcatatgttatgaatattagtcattagattgccatgtcttctaattttgtaacttatcattaaactttgaaaatggtggttttcaatgcaaatgagttttaattcttaggtcaaacatgataatgtttttctcttatggtttctgagttttgttttcctttgctttgctttgttttgctttgaaagaattttttaaaattttaaagctctagaaagatattctccttttttgttgtaatgcaatcatattggtttttttatatttagtatttttgtatatgtggaatttatgtttctaatatatattcaataccaccttagcaccatgtatcgaacagatatttttcttctcagtgatttaaagcattacctttatcaagtaccagtttcaaatatacatgatttgtattgagataattctattctgttctgcagttgacaagaatgttaacatttcacaccaataaatgtaatggatcacagaattttgcccactttactgaaggagatagagagatcagagctaagggatttgcatgacgtcctgtgcccagatcgacaggcatcctgggccgtggagcccatttttcttacttaaaattcagtctttttcctattctgctgcaaactacgatttgagatcaacaggaaaataggtcactttattctcttttaccttgattctttttccgtaacagaggagtattcaagctgtagtcggcatccgtgccaaaatgggggcacgtgcataaatggaagaactagctttacctgtgcctgcagacatccttttactggtgacaactgcactatcaagcttgtggaagaaaatgctttagctccaggtaaaaaaaaagtatacgcatctttggatttgctcattgtcataaatagaaacacgttttgaaaatatttattaatgaatatttaagcctgcttaatctggatccacttgacaattccttttactttttcgaaacttactgaagaatgtacctgatttacaagtggaaatgtccttttgttaggcaaattcttattcacatgcacctgttgaaattttcaatattgctatatagaggcagtttatggaaaattctaccccctcacaaactttttttctcttgtgcatcctaaaaatatatggatgtatatatctgactgatagaaacactttctcctcaaacaagcagttaaagaaatacgcctttgatttatgtctggtatggtcatttaaatgaggctttaatacatgcttagtaacacgttttctgtgaaggttaaactaatggcaccattttgactgtgtgagaactgttagaacatgctcaaatgtattaagtaaaacaagatggcttttttatttatttaaattcataagtattggtgctttggatttacttcaggagtgcaccatttctgatttttatacagaaatgtatgtgcagcataaaaatgtgttatttaatgactgcaaaaaaacctatttcaaatcagctttttcttaataatatcctgcatagtgaaatgtaaattttttagtctgtttttagatctcagcctttgtaagtacaattggcattaattacacagaaaattgcctttgtctactttgctgcagtgaatatgactttatatggttttcgttttagcctttagaaactgcttgacaaggtgccggaaaaattgtttctacatcatgtcagcttcaattcctgcaaggggctttaaaacattctgacataaccataataatcatagagtgctttgaattcctttatctctggggagatcaaagcaacatgcaaattatctttgaggcatttctgtgaggaaggtatcaaatgttatttttattctgtcctgatctaaatggagaaactgaggcaacaagaggctaagcaatttagagtaatttaccccagagaagagacaggcattgagacacgtgcacctttgctaagtttgatggatggcctttctcttctgctaagactttttgtaactgagataaaaatgacgaagatataaggaaagaaaaataagataaaaacatgaaaattaactcttgccattttttcctctaacagatttttccaaaggatcttacagatatgcacccatggtggcattttttgcatctcatacgtatggaatgactatacctggtcctatcctgtttaataacttggatgtcaattatggagcttcatataccccaagaactggaaaatttagaattccgtatcttggagtatatgttttcaagtacaccatcgagtcatttagtgctcatatttctggatttttagtggttgatggaatagacaagcttgcatttgagtctgaaaatattaacagtgaaatacactgtgatagggttttaactggggatgccttattagaattaaattatgggcaggaagtctggttacgacttgcaaaaggaacaattccagccaagtttccccctgttactacatttagtggctatttattatatcgtacataagttagtatgaaaaacagactatcacctttattgagaaacagccagtgttttcatttatctttgcttgcacatctgctctgttttggtttttctacaggaaatgaaaatcaacttgtttttttaatatgagtaaacttgtatgtctattttataaaattatttgaatattgtttaatgtctgaatatgaaagagttcttgatcctaaagaaatttagtggcacagaaaacaaagtgaatttgttagcataattattcctattcttatttcttcattttaagtcattgcaatggaaagtaatattataaaatggtaattacaacatattatcagtcacagttttctttccaattaaacacttaacttttgttattccctgtatataaatatataacacacattttctagattcacaaatttaaataaattactcaaaaaatgaaaattgattttgtaaacttttatttttactctttacgttgagttgatcaattttccatactaagattttcattcagaatcaaaattaagaaagttggactgaaaatatgaaaaatgcttaactattgttctcttcctataattctctaattataacatagtaatttacatgtagttggacatgtacactcaagtctaagaatatatgagtggatcatttaccgccccccgccccacaacatctataaggggcaaaaagtctttttctaataagtattcttctatggtagtacctacagatctgcccttcttcttctaaagggtaagtcataatctgtgtaatactacaatttatgggatgctcactatgccctgtttctcttctaaacaatttacatgtaatgtctcattcctcacaataacccttgtaaagtgggcatgattaccatgatttttatagttgaagaacctaagacacagagaccaaggcccatgagctcatagggctgaggcaggatttggaatcaggccatgtcttctccagagcccacatccatcctttctctatattgcctcccacagatgtgctaaaatttatttaactaatcctttatcctctatttgtgttgtctcccattttttattattacaatattactgtggtgaacatgcttaaaaatacattccttggatatctgacaacgtgtttctgaaaaacagattttcataagtaataataaaaataataataaaaaagttttggtatggtaagccttttttatgaattgatttgtttaatgatcactataacataatgaattacatattaacctatgatatttgtactacatattattactctctttctgcccatgagaatcagaagcacatagaagttaaataattttctcagtagtataaccaatgatggagaatttctgggacaaaggatgatcataattttccatttcgatgggtactaacaatctaagtctatgaaaaactgctctttataccccacacatcctcatcaaaattaacaatttttgaaatatttccagtcctgaaagtgaatatcttctatttgtagaagatacttgaaaatttttcaaatttgctaaaacttgaaagcatacatccatacaaagacttgtaagtaaatgttcatagtcagtttatttgtaatagctgaaaactgggaatcacccgcatgtcccgcgacagacaaagggttacgcaaactttcgcatacaaatacaatagagtacaacacctgggaatttcacaataactatgcagaagattttaaactgcagtctaacaaactttgtcacctctgcaaggaggaactctaaagtaagtattgtccatcagaatgtcctgcgctgagtcaaaataatcaggccttcataccctagcctcactcagtactagattcaggctgccaaagaagagtgtgacctaagagttaaaaccgacagctggatgcattagtccatcctcgcattgctataaagaactacccaagactgggtaacttattaagaaaagaggtttaattaactcacatttccacaggctgtataggaaacatggcccggaaggcctcatgaaacttataaccacagcagaaggtgaaggggaagcaggcacgtcttacgtggctgggggaggtggaagggggagaggtaggaggtgccacatacatttaaacaatcagatctcgtgtgaactcactatcaggagagtagctggggggaaattcacccccatggtccagtcaaatcccaccaggcccctcctccaacactggggattataattcgatatgagattttcgtggggacacaaattcaaacatatcactgaatgatgacaatttttatcctgttatgtgtaaacatgtcattttcaaaaacatttaaaaagttcttatgatatcttcagtccctgcctaaaaatttactataatctaaatttttaaaattttatttcttcaaggactcacagattaaaatacaatttttgctttccaaatatacttttcaacatagatttcagtgatttcattatattgtttttctttactgttaccagaacagaaggaagtaaatcatttgacaatgttcatcattgcattgtccaatataatttattgatttttaattagataataacatttagcattaaataatgctttggtgtttggaaatataattattaataatagtctttatttttatatggattcatagaatatacaattaaataacaaattgccaccaatagccaagaggcattatagcaacttttaagttgctgtgaacttgcttggctatatttttaaagccactcaatataatcaaagataatttagtattgtatttttaatggtcatcttcaaacttattcatgtagaaaaaaatatagcactggaacgtttctttatttcttctatggacatagccaagtaccttgaatattattttgtagattcaatttcagagcccttctctctcacaatatcttcctgccacaccagctcccaaagtacatcaggtcactaattactgatgaaaatctcaaatccattcatttattacttaataagtagctaattattatacctaattgaaggtacataatataggaggcatgttaaattatatataacaaataataaaaagtatataaagtaaatcagtacagacaaatgttgcatttgaaatacataatccggggtcatgatggcattta

SEQ ID NO: 16270 - DNA, 23632 bp, Human
tcacctgaggtctggagttcgagatcagcctggccaacatggtgaaaccccatctctactaaaaatacagaaattagtggggcgtggtggtgcatgcctgtaatcccagctccttgggaggctgaggcaggagaattgcttgaacccaggaggcagaaggtgcagtgagtcagggttacaccactgcactccagcctgggcaacagagtgagactccatctcaaaaaaataaaaaaaataacatgatagtagtggttcaattaaaaacaactgaaaagatttaaatttttttgtttgtttgttttttgagatagggtcttgctctgtcacccaggctggagtgcagtgccatgatcttgacttacttcagcctcaacctcctggactcaagcaatccgcccaccccaacctccccggtagctgggactacaggtgtgcgccaccatgcctggctaatttttgtatatttggtagagatggggttttgccatgttgcccaggctgaactccaactcctgagctcaagccatccactcacctcagcctcccaaagtgctaggattccagtcatgagctaccacacccagccaaaaatgactgaaaagatttatatgtgatcatatcatacacttgcaatagcagtttttggtttgtggctctagtgattctttgcgagctttgtgctactgttacatgcagctttgtttctaagagccatgtaaatactttgagagtacaccctgtttttctacttatttgttcattcagctatttttggagtatctaccatcagatcctattaggtgttagagatacaaagataaaatctctgccttccaagaattcagtccagtacattcttggggaattaagttttctgcttatcaaagagtatatccatggcaaggtttctcacctcaaattgacattttgggtcagattattctttgctggagggctttcctgaagagtgttgtaggatgttaagcagtttccctgcctctacctactagatgccattaaccagccccatcacctggcccaagttgtgacaatcaagcaactccagacattgccagattcctggggtcaaatctgtaataagaaccagagtttatctgtgtcattgaccgtgagttttgataaatgagttttgagaaaattcatacaaagctagcaaatgtaacaaagaacctagatccgttgcacaatgcttgttattactccacatgacttctcaaagaggaattagataacagccgtgctgagtaacacctacgaaatgttttattttttagcttggatgtctatgagatctccttctgagttactgtgtataggagaataattgtttggtttcttagggactccagtaaaacaacaaaacaatataagccactggaggggaagagtctaatgcataataaaaaccttagtcttttccgagctgtttgtaccagcatttcccttttcttgttaagagtgaaagtattttctccagtgagtgtcctggacaactggcatatttagaaatgtttcctgtgttcttcaggcacataacttcaaattttgttactttactaaattggacttttcttcacctactgcttttccatgttcagacaacacatgaagaacattgaacaaccaaaaattcactttaatagtcttttaatgcttgtcttccagtaatgccttgcttctctaagtagaggatccactttcctgttggaaagagtacttccctagaagtcctaaaacctgtattttaggttcacccttggcactcttattaaacattcatttagcctctctcggtcttgatttctttacttgtggtagactaatagatatagaaagaggttcttttatcctgttttcctgataagttcctaaattccataaatctacactttttgctcacacaaacttttatatatccttattcttatacaatatccacatttccatttctgtgcctaatagagttttgattcatcatggataatctgtcatcagaagaaattcaacagagagctcaccagattactgatgaggtaaatgttttacctaaaataagtaaataattctatttcagttttcatattggaggagtgagagagccttcttagggacattttggcctcttcctagtccattaatatcaaagaacacatttgctccttagtgccattgctggtttttattttctttttaactcaccagaaaactaaagtgaaaacaatttgtatgatttttattttttaggtaattattaatattacttaagtgtaacaaagatactctactatgtatttgagaaatgctagacttctatttaacaatttcctaatatctgtaatttacttagatttctacctacattaaatttttattcccatgaacttcaccatccaaatattctcttttttaaaaaaactttttctttcaacatcacactggaagtccttacacattttctcttaaggagcgcctgaaaataactaaaaatgtagtgatcaacttactttttttttttttttttttttgagacggagtctcactctattgcccaggctggagtatagtgatgcgatctcggcttattgcaacctctgcctcctgtgttcaagcgattctcctgcctcagcctcctgagtagctgggattataggtgtgtgccaccacgcccagctaatttttgtatttttagtagagatggggtttcaccttgttgggcaggctggtctcaaacttctgacctcgtgatccgcccacctcagcctcccaaagtgctgggattataggcttgaaccaccacacccggccattgttttgttttaaagggaaggataggctggcaattctttttgttttttcctttaatggaaacagtctcactatgttgtctgggctggtcttgagctccggtactcaagaaatcctcctgcctcggcctcccaaagtgctgggattataggcatgagccactgtgcccggcctgagctggcaatttttaaagatagaatagcatcatgaatttggcctgtgatcagatttttttttctacatattttggaatgctaaaattctgtgttctttcctagtctctggaaagtacgaggagaatcctgggtttagccattgaggtaagaaaatgttagtcatcaacttaagtatagaaatttataggagcgatcctaatacttctggctggaattagtattaaagggtaatgtatcaatatgctttattatttgaaattaacagttgctgaaatgtcaaaccatgcactaatgggaattttctgtttttccctttaacagtattggaatatgacagggaagatgaattcactatgagtttgtgacttaattattttgggggctgctatgttaaagtgtgttagtttaagaatactagttctgtctgtagctctaatcctctgagagcttgggtttctaaattattctgtgttgctcttgtaggttttgtttctgttgtttttggtttgttttgttgtactatcagcttttccccccttgtcttagtctcaggatgcaggaatcaagaccatcactatgctggatgaacaaaagggtaagttaaattattagcagaaattcttaatttgactgtgatgccaaaaagccctatcaaattagccacatacaaatttcagcctttgggagagccttccctttgtaaaataagaatgttatgtttacttcttgtcttctgatttgaattatatatcatgttcactgtctatttgggatggcaggcaacaatgcccaattgtatataccaagtatgtgttaggccagcatggcttattttgtgtattggttatatgtgccttagacattatgatagtaacatagctgggattacaggcacctgccaccacacccaactatgtttttctttttttttggggtgggggacggagtttcgctatttttgtctagttttgggggtgggggatgaagtttcgctcttcttgcccaggctggagtgcaatggcgtgatcttggctcactgcaacctcctcctcctgggttcaagtgattctcctgcctcagcttcctgagtagctgagattactggtgcccaccaccacacccggctaagtttttgtatttttagtagagacgggttttaccatgttggccaggctggtctcgaactcctaacctcaggtgatccacccgccttgacctcccaaagtgctgggattacaggtgtgagccaccgtgccgggccttttgttttgttttgttttgtttttttaatttttattttttgagtcggagtcttactctgtcacccaggctcgagtgcagtggtgcaatcgtggcttactccaggatcctctacctcccacgttcaagtgattctcctggctcagcctcctgagttgctgggattacaggtgtccaccaccacacccagctaattttttgtgtttttagtagagatagggtttcaccatgttggccaggttgatgtcgaactcttgacttcaagagtcacttgatccgcccacgtcggcctcccgaagtgctgggattataggcgtgagccaccgtgtctggccagacattgtgatattcttacatcatcctcagaaatcaagttctaaaacagatctagattcaggtatgcttggaaacacttgagttgagttggccctgagtaatcaggtctagtttttattactcttataatagccctcaggttttgaacctattatagaaatgatggggatttgacctcgtcaaagtacccttaacttggttgtaaggatgatctctaaataaccgtcccttggtcctactatacaagattctttttttttttttttttttcgagcgggagtcccactctgtcatccaggctggagttcagtggtgcaatcgcagctcactgcaacctccaactgccgggttcaagcaattctcctgcctcagcctcccaggtagctaggattacggcacccatcaccacacccagctaatttttgtatttttagtagagatggggtttcaccatgttggccaggctggtcttgaattcctgacctcaggtcatcgcccacctcggcctcccaaagtgctgggatcacaggcgtgagccaccatacccagccatatacaagctttttagaacaaatttttccacagcaagaggctaggtgcctccggatcagtacgtgaaagattgttatcatgttgaatcgcttctaataccttttgacactgacatactcactgtggggagttattggtagattcaaggttgaagtttgctgttccataataatagcattttctggttgacactgtgaatggaacacaaagtgttaacttcacaacttattcttagaacaactaaaccgcatagaagaaggcttggaccaaataaataaggacatgagagagacagagaagactttaacagaactcaacaaatgctgtggcctttgtgtctgcccatgtaataggtgagttgataaattaagatggtttcaaaataagtaatgagagtaccccaccttctcccaccagctaaggtcagaagtatgactgggcttaatgaggaactctattagataaatctaagttgtctctccttcaggcagattaagctttttgtgtaaatactgcgtgttcactgaaaactgtgacttacatttgaccaatcctgggatcaagtccaatttcaatttgtagtaatacatgaaaaggttaggaagtatagggaaatgtatatctggatgatggaaagcaggatggagttattttcttttcctttcaaaggaggagtattaacaaaatatatattttgtggtaggcacatgagggatggccaaaagagtagaagagttgggaaagaatggcaaaacataaaaaatacataaatctaatgttagattatatgatagtgagcaaggctaaatctaatgttagattatatgatagtgaccaaggctaggtatacagaactgataaaggttgggttggagagcatcttatagaagaggtaggatgtggattgggctttgagtgataagaaggatttggatgaacagggaggaacagtgagggcatttcctatgaaaggttcaaaataaagattaacaaggagcttgacttaactgagctgtgtgactcatgtagatgagaagtggaaagtaagatataagtaggtagtagaggaacttgaatgccaaactaaggagttgacagattggagtggagtataaaaagaaacgacagtatctggagattgaatgactgtactcactgctgaaagttttgttttgttttttttctgagacagggtctctgttactgaggctggaatgcagtggcgtgatcacagctcactgcagcctctctttcctgggcacaagagatcctcccaccttggcctcccaaagtgctaggattacaggcatgagccactgcacacagccaaagtatccttttttttttgagacggagtctcactctgttaccaggctggaatgcagtggcgcagtctcagctcactgcaacctccgtctcctgggttcaagtgatttctcctgcctcagcctcccgagtagctgggactacaggcgcatgccaccacacccagctaatttttgtatttttagtagagacggggtttcactatgttggccaggatggtcttgatctcttgacctcatgatccgcccgccttaacctcctcaagtgctgggattacaggtgtgagccaccacacccggcctcaatgtattcatttttaaagaggttcttagacattaatatttcatccagttctcagctggtcttgtaaaccaacagcggttatatttttatattttcagtaagtgtttttatgaaacaacatttttatgccatttctgttatagaaagtagagattaattgcttgtcagtcaactttagtgtttgttttggccatgaggaaaggtttgacagtgttcttcctagtcttatccattggcttcctattctaacacaagtctgttgacctgtttacaccttggttgaccaactgaaagttctgtattttttgagacggagtctcgctctgtcacccaggctggagtgcagtggtgtgatctcggctcactgcaacttccacctcacgggttcaagtgattctcctgcctcagcctcccaagtagctgggattacaaatatgtgccaccatactcagctaatttttatatttttagtagagacagggtttcgccgtgttggccaggctggtctcaaactcctaacctcaggtgatctgcccgcctctgcctcccaaagtgcggggattacatgcgtgagccactgctcccggccaaaagttcatattttaataactatgacttgtcaatcagagtttagcagattactttaagcaaacaagttaaaatgtacagattatttgatacaaactcttagctatgttttacaaacataattgtacctttctcttgtgttccatgtaccttcttggaagagtacagaagagaggaagtagatgaattttcttgagatcagatgttaggagaacaaggagaaagaagtctcccctaaaatcttagaggaagatcagctctaagtcacgtgttgataaataggaagagcactgaattagacctaagatggtctaatatcatagaaagtgggaaatgcagctacagagtattaattttatgtctctttgtgtatcccagccaagcataggcaagcttttcttgaagactggtgggaaacaaggtagggtatggtcctgaatcagcattcttcagcctctaacctcagtagaaccctttctcagtggatcaagagaaggcattacttttttagagatggcctctccctctgtctcccgggcttgaatgcagtggtgccaccatagctcactgtagcctcaaacatctgggctcaagcaatccacccacatcagcctcccaagtagctaggattacaggtgtgtgccaccatgcccagctaatttttgaaattttttgtagagacaggggtcttgctatgttgcccaggcttgtatcaaactcctggcctcaagaaatcctcccacttcagcctcccaaagcactgggattacaggcttaagccactgcacccaactggcacttctttctttttttttttctggcacttcttgagagatggaatcaaggggctgctgtaacaaaacagttcccttaagagaagaaagtattatctcagttaaagatgtctgattgtaattgtctttcttccacctatttctttcttacaccattgagaccttggccagtatgatatctcttatcctcagctctgttcctatcattcttgcctgtgtcttgatctttctaatctgctagtctgtgtttcagttaggctcgtcacatgaataaccataacatgagcttcttaaaggtagacatgagatcttagtcctatgtgtaaggcctagtcttcataccagcagtagcagtaacaacccaggtcaggtccagagttccttatttgccatttggaaatactttttcttttctttctcttttttttttttttttttctcgagacagggtctcgctctgttacccaggctggagtgcagtggcagtcatggctcactgcagcctcaacctatcctccagcgtcagcctcctgagtagctgggattacaggcacatgccaccacacccagctaattttgtatcttttgtagagacaaggtttcaccatgttggccaggctggtcttgaacccttgggctcaggcagtctacccaccttggcctccagaagtgctgggattgcaggcatgagccattaagccctgctggccattcagaaatctaaaaaactcctaaagttttgttttatttttgctgtaatggtgccacaactcattagggtataaaatgtaacctgaactgaagctatgtttagtctttattacttgctgtagatattaattggtttcactacagaaatactctttttgagtcagggtctcactctgtcacccaggttggagtacagtggtatgatcttggctcactgcagcctcgacctcctaggttcaagtgatccccccacctcagcctcatgagtagctgggactacaggtgcatgtcaccatgcctggtttgtttttaaaaacttttgtttcttcttctttttttttttttttttgagacggagtctcactctgttgcccaggctagagtgcagtgatgcagtctcagttcactgcaacctctgcctcctaggttcaaccgattctcctgcctcagcctcccaaatagctgggattactggtgcctgccaccacgcccagctaatttttgtatttttagtagagatgggggttcaccatgttggccaggctggtcttgaactcctgacctcaggtgatccgcctgcctcggcctcccaaagtgctgggattacaagcatgagccaccatgcctgaccctgtttcttttcttttctttttcttttttttttttgagacagagttttacgttgtcacccagactggagtgcagtggtacaatctcggctcactgcaaccttcgcttcctgggttcaatcgattctcatgcctcaaccacccaagtagctgggattagaggcatgcaccaacaccttgctaactaatgtatttttagtagagacggggttttgccatgttggccaggatggtcttgaactcctgacctcaagtgatccacccacctcggcctcccaacgtgctggggttacaggcatgagccaccgtacctggactttaaaaagtttttgtagagatgagttctcactatgttgctcaggctggtctcaaactcctaagctcaagcaatcctcccacattggcctcccaaagtgctggtattacagaaatgagccaccacacgcaacgtcactacagaaatattaatgtatttaattatgtggtactgtccaaaacatcttgcccccaatggattggggtaacagttgtgggcctgtgcattaatttaaggtactattctgaacatgttaatttaatccttaaacagtagccttaatatgagatagatgttttttattattatcattttacatccaggctacactatgtagtggaagagctgggattcaaaaccaggcagaacccccttgcttttttttttttttttttttttttgagacagagtcttgctgtatcaccaggctggagtacagtggtgtgatctcagctcactgcaacccctgcctcccaggttcaagtgattctgctgcctcagcctcccgagtagctgggattacaggcgtgcaccaccacgcctggctaatttttgtatttttagtagagatgaggtttcaccatgttggtcaggctggtctcgaactcctgaccacgtgatccatccacctcggcctcccaaagtgctgggattacaggcgtgagccaccgcgcacagcccacaaatccttttttaaaatcacatatcttaggcagtaattgataaattgtaattctaattaacaagaatttgaaagcagacagatttaaaatgggaagtctcagaatagtaaactgcttgatgtcccagtttaaacattctttttttttatttttatttttttgagatggtgtctcgctctgttgcccaggctggagtgcagtggcacgatctcggctcactgcaagctccgcctcccgggttcatgccattctcctgcctcagcctctcgggtagctgggactacaggcgcccgccaccacacctggctaattttttgtatttttagtagagacggggtttcaccgtgttagccaggatggtctcgatctcctgacctcgtgatccgcccgccttggcctcccaaagtgttgggattacaggcgtgagccaccacacccggccttaaacattcttagataaggtattcttctgtcttaacttgcctgttttataaagtctaacaatggcacatagtttgaagacaaattggcatttctggaccacttactagagaagttccaaattggcactacaggtttactgctattccgatcttaagtcataccaaggtgtaaaaattcagctccgactaattaaaatgaatattgaattatatttcattcagtggtttagtgcttcttccatcctgctcactggagacacaaatatgagtaaggcatacctctggccctgcctgttttatttatcatgacatgattttttatacctcacatagtattggatatacagtagttactcaataaacacttgttgatttgagtgtccttgagaaacttgttggctggtgggagagtttgacgtgtaaaaagattttttaaaattacaatgaaaaaatatataagaaaataaaatacataatagaagtcattaagagaaatcttaatcactaagaggaaggagtctcaaagcactccattggtttttgccttctctcatattgtctaattttaggaaagaatatcatcacccaaaattctgaggaaaaatgaaatgtgctctggtttaaatagttttcttatttttctttttatctagattctcagatgttggttgtttctatgaaaccaggcaggaaattgaatgcattatgtttttaaaactttaaacctgcttctgttctgtttgactggcatttactattttctgcatttcattctctcacctaatctcttcctttctaatctgcttactaaaaatgaagatttaacatcagaagccgggctcagtaactgatcaaagggaactttaagatgcagtcttgtggcgcagtttgggctgctaacctgctatctaaaggtgatgcttcaaatggcttttctgtgcatgtgcatggattttgtgaatggtgaaaactgtctctaaactgtgtggtggtgtgtagtgtaaagtgaatttgttcttgatgggtgctatctcacaaaagatggacttgacaaaaggaccttaatttataataccatcctttgacaaatgtctctgataactaagtttttgctaaataacatttaagattaccaaaataacaatactcctggagtttcttaagaaatttaaaataggttgatctttgagacagctgctgcagtctagttctgataaaaggtaagggaagtcatgctaaatgcttctctgtcttcatagactttgattttagcatcctgtcttccattaagtttccctacttttttctggttcttgagtcaagatttcctctattaaagttttgcttctaatgattaggattacccatgatttaggccactaccaaattaaggaatcaattgccagtctagtcgtctcaaatcctatttggaacaaggtgggatataaaattttaaatgctaccatatctggtatcttctttccttaaataagggtttcccctctacatatgttataaactattctataattcctgttacatcatgtgttaacttgctgtgatttcatgttgaattaatacaaaactaactaatattaatttttcatgggaggtaagttttgtcagcttactgtttattattgtgtctgactcttaagtttagatctttatgagaattatgaacatgattaaatgttaaaaaattaagtatttgatttctaccctttgtttcctgccctccttttttcttcttttcttagtttgactatccaaagcatacacacactcacattcactctttattattagttaatagttatttggtcccttttctccttgatgtgaaatagtcacagctaatatttagttttatttttgctatttttaattcagttaaaactaatattgatgcaaccaaaactaaaaaaaaaaaaaaaaaaaagaaattatcgtttttgtgctcataccttgatatttacagttttatgcttgataccagcttcctgaattgactaagggatatttcagattcttacttaaaacttgccttttttttttttttttttttttgagacagagtctcgttctgtcccccaggctagagtatagtggctcagtctcagctcactgcaacctctgctcccaggttcaagcgattctcctgcctcagcctcacgagtaactgggattacaagcgtgcgccaccacacccggctaattttttgtatttttagtacagaataggtttcaccatgttggtcaggctggtcttgaactcctgacctcaagtaattcacccgccttggcctcccaaaatgctgaaattacaggcgtgagccacacacccgaaaacttgccatttttgaatgagacgtttaagtgggaaaaaaaaaaaaaaggttccagttaaagactattagaccactcagaactaacagtcagttgtaaatctaagtttctagatggagttctgaacttcattaaaatttatcacaaatttacttaggcattttatcatgaagactaatttcttcccagaggggctgtacattttattttcaagagtcctgtcacagattagaactattctttcttactgtagactaaaacaacctggtcctagtaatctttcatgtcacgatattccaactacattcatgtacctgtagatctcaaagccaagaaatggtaatggaccaaaaagtaaacatgccagttggtaacccatgcacttacaggcaagaactgttgactaaaggtcaggttgaagttgaagccaatgaatgaaaatatttatccagtgatttacaaagcagttttatgtctgttatcaacagaacattttacagccctgctaaacattaagtattgttattatcctagttttacgtacaaagaaagggatgctctgacactgaagtttgctcaagattctgtagcttctgaatgacatgcctaggattgggatttagttattttactccaaatgctgttacttttttgttttttgttttttgtttgtttgtttgtttgtttatttttagatggagtctcactctgtccctcaggctggagtacagtggcatgatctcagctcactgcaacctccgccttccgagttcaagtgattctcctgcctcagcctcccaagtagctgggattacaggcacctgccactgcgcctggctaattttttgtatttttagtagagacggggtttcaccatcttggccaggctggtcttgaactcctgacctcacgatccacccacctcggcctcccaaagtgctgggattacaggtgtgagccaccgcgcctggcttttttttgttttgttttaatcctgacatgtccctttgcttcttctagattaattatttagtgctccaatatatagactactagagtctataatagactaccagagtaatctaaagtactcctcctggatcgctaaatgtcccactgaccttatataaaacaacaacaaacgattcccaggctatactccatgtgtattggagtagaatcttcagagtgcagcctactatctatgtgttctacagcaggggccctcaacccccccagccatggaccactattggtccacggcctgttaacagaaactggtcctcatagcaggaggtgagcattattgcctgagctctgcctcctctcagatcagcagtggcattacattctcataggagcaagaaccctattgtgaactgtgcatgtgagagatctagttgtacgctccttatgagaatctaactaatgcctgatgatctgaggtggaacaatttcatccccaaagcatcccctggtccccattcgtggaaaaatagtcttccatgaaactggttccccagtgcccaaaaggttggggactgctgaggtcactctgatactcagtcaagtttggaaggtattacctttaaagcatctaagaccctttggaaggaaagtaaattagtttaaaaacatatttatatttgtgaacattttttattttattaacttagataagcagctatctgacaatgccttaaaaacaggttccaacttggtggaggaaactccagggtgatggccagtaacagggtcttgagcaaccaaaaggcattacctagagtggacatgctgaatgagacgcactgaactgtcccaccaccccttcataaacacgcagaacatactataactgcaagaaaaacaagtagtttttttccccatcccatttgaaggtaaacatgccaacacaatgcaaagctgtaaaaaaattcaaagtcagctgggcgcggtagctcacttctgtaatcccagcactttgggaggccgaggcaggcggatcacgaggtcaggagatcgagaccatccctggctaacacggtgaaaccctgtctctactaaaaatacaaaaaattagccgggcgtggtggcaggcgcctgtagtcccagctattcgggaggctgaggcaggagaagggtgtgaacccgggaggcggagcttgcagtgagctgagatcgtgccactgcactccagcctgggcgatacagcgagactccgtctcaaaaaaaaaaaaaaaaattcaaagtcagctttttgtgtcttttccccttgttacagaaagaacatcttcaaagatccagtcttcttttttttttttttttttttttttttttttgagacggagtctcactctgtcaccaaggctgcagtgcagtggcacgatctgggctcactgcaacctctgcctcccaggttcaagtgattcttctgcctctgcctcctgagttgcggggactgcattcgagcgccaccacacccagctaagttttgtatttttagtagagacagggtttcaccatgttggccaggctggtctcgaactcctgacttcgtgatctgcctgcctcggcctcccaaagtgctggtattacaggtgtgaatcaccgcacccggccaagatccagtcattttaaagacagcagagtttgataaccaatctgattctttgtttatagactatgcttcaattaaaaatcattcacatgatcatttttaaacaattcatttgcattttatgcccttatatctaattgtggaaagaagaattctcataagtgtaaagaattttttcaaatattgcctcttaatgttgggaaggaggttggaatgcatatatattccttaatagaccagaacccaaggtcatgtcccagtccactcctctttttgtgctgtcagaaacataatatctcattagttactttggaatttcaaccttctctcttgcacctgttccacaatccgaaattctaataaaagccccacttctgttacttctgttaatatttgtggttattaactttctgataaactaatatattgcttttgttttatttactagcacttactctgctctagaattttgcctgggacctttcttattattaacaaagaatacatgtgaatatttattttaaaaatatatatcctaccttgttccaagaaaaatttaacatggcttcttaataaataaatgggttaattaataaaaacagcatagaaacataattatgataacttaaagtggtaccatgaaacacacttggagaactagctcttcagtgttcataaatttgcctttgcaatgcctctcacaaaaaaaaattagtagtatcctttctgtaatgttaatgataaagtctaagattcaattctaggtttgccgaaaatgaatcctcacatgcctattaaggaagaagtcacttttttcataaaatctcttccctacctttttaatttttgcaattttaaaacttccttattaatgtaaaatgtagaataaatcagagatcaatatttgagcaacatactatttcgtttttgtttatagaaaagtgaaaactaaaattgaatgaaagcttgactttagccaaataatcaagaaaagttttgtgtcacttttccgtaacagccatttttttttccctgtaatagccactttttctttctttttaagacacttagacttatgatttttttttttttttgagatggagtgtctcgctctgttgcccaggctggagtgcagtggtgtgatcttggctccttgcaacctccgcctcctgggttcaagcgattctcctgcctcagcctccccagtagctgggattataggcacgtggtgccacacccagctaatttttgtatttttagtagagatggggtttcaccatgttgcccaggctggtcttgaactcctgacctcaggtgatccacccaccttggcctcccaaagtgctgggattaccggtgtgagctactgtgcccggccttgatcgtttttttaaagaggaaactcttaaatgaaaaactcctacactacaggatttatgaatgaccgcttgtgtggtcaaggtacttatttgtccgctgattgtccaatttggaaattattcatgcctttctttcctgatggctggtttgtttgtaagaaaccattgtttaaaatttcatggaaaattctaataaaaactgatcagctggaactacgctggttcaaattcagtcttcttattttaaaattttatttatttatttaagattaggtctcactctgtcacccaggctggagtgcagtggcactatcatggctcactgcagcctcgaccttctgggctcaagcagtcctcccacctcagcctctcgagtagctgggaccacaggcgtgtgccaccacacccagctaatgtttgtatttttttatagagatggcattttgaggcagggagcagtggctcacgagcctgtagtcccagcactttgggaggccgaggtggatggatcacttgaggtcaggagtttgagagatgggtttttgctgtgttgccctggctgatcttaaactcctgagctcaagcgatccacccgccttggcctcccaaagtgctgggagtacaggcgtgagccactgcacccagcatcagccttcttattctgtcatcccttgtcaacctctgagatgccttcaaggaacctcttaaggtatcccagaacaccttttctaagggacctttttttaagtaatgtgcattaacctcttttctagatagtgctggatacactaggaagagaaaagcaaaacgatagtgccagaggctaagggaacctgaaaaatcaaatagttgccttttgctacttgctaacagcctagtgaagatttggtagaagtagtatttggacctttttaaaattttttttagtgtcaatgggtttacataattcatctatttcctattccatattgccatggagcatagtgtagatcatctagacttagctgtatgcagcttttctactagagttattagtgtcatcctcaaggtaacaggcactaataattagaactctccgtcttcttttttttggtatctccctacactcctgacttttatatagaacaaagaactttgagtctggcaaggcttataagacaacatggggagatggtggagaaaactcaccttgcaatgtagtatctaaacagccaggcccggtgacaaatggtcagcttcagcaaccaacaacgggagcagccagtggtggatacattaaacggtatgccaactcctcctgatattcctgtacctttcttaatgaatggttcacttaggagatgagtttagcagtacatgacccctaataaaacaaataaaaattgtatttattccatttttaaaatgcatttaaaaatctgcccactgacaaaatgtgggttttttttatttgttgttttgttttgagacagagtcttgctgtgttgcccaggctggagtgcagtggcgtgatctcagctcactgcaacctctgcctcccaggttcaagttattctcctgcctcagccttccgagtagctgggactacaggtgtgcgccaccacgcccagctaatttttgtatttttagtagagacagggtttcaccatgttgaccaggctggtcttggactcctgacctcaggtgatccacctgcctcggcctcccaaagtgctgggattacaggcataagctaccacacctggccagacaaaatgttgactgtggtggttgaccttgggtgatggaattaacttttctttatacttttcagtactttccaaattattgaactagacatattttacttttatatatagaaaaaaatatgttttaaaatgtgtcatctagaacaagggtcagctagattcctgtaagaagatctgtaacgagccagagagttaatatttcagacttttcaggccatacagtcccttgcaattactcaactctgttgtagggttaaagcaggcataaacaatatgtaaacaaatgagcacagctgtgtttgaataacacttgatttacaaaatcatatggtggccagatttggtccttgggccgtagttttccaacctctctcttagggcagtgcttctttagatagacttaactgtgcattagaaccacttgaggggcttattaaaccgtaggtttctgggatgcacttacagtttctgattgagtaggtctggaatggagtgtgagaattagcattctcatgtctaacagcttcccaggtgatgctgggaattaagctttgagaaacactgtttcagagtttctttcttttcttacatggctttaagatactgtgctctctttgatgagtctcccagtttttattatagaatgtttcccaggaatggtaacctatattcttttggatcttatacttgctgagagtcattttggttacttacttttgtgaaaagtaaatccagacttttatttaaattcaacaaaacctatggaattaactgtcttcttgtgatagcataactaatgatgccagagaagatgaaatggaagagaacctgactcaagtgggcagtatcctgggaaatctaaaagacatggccctgaacataggcaatgagattgatgctcaaaatccacaaataaaacgaatcacagacaaggtaaaagctttttattgccacaagaaaatgagacacccagttcagtgtttcagtaatagacatctgtgctagatactgtgggggacacggtagaataagctcctgtcctcataggtcttaattctgatgaggtggtggttctaacacataaaacaagagccaagtcctccctgtcatggtagttggtgcattttgaaaccagagttttggaatatagtagttttacttaaaccttcacacatgaagcttagtatctactttagcttttgagcgtgtttttttctctcccaaatgagttttattttgttaactaattttttaattgagaatggggtcttgctctgtcgcctagggtagtgtggtggtacaatcacagctcactgcagcctgcctcctaggctaaagcgttcctcccacatcagcctattttgttaactaaaaataaattaagttcctgaatcctcatctcatgaaagagtccgtaggtgaaaatctgttctgcagaatagttcttatggagtggacacacgaaatagagtcatgtgagtgaaagaaagttgtgattcttttttttcccccttaactttacatgatataaatatagtgaaagcgaaattgttttcagtgttttgatgtgtcacatgtaaagtcataccttggccaaccgtggtagctcacacctgtaatctcaacactttgagaggcggaggcaggaggattgcttgagctcaggagtttgagaccagagcaagacctcgactctactaaaaaaatttaaaaattgaccaggcatggtggcatgtgcctattgtcccagttactcgggaggctgaggcagaaggattgcttgagtgtaggagttgaaggctgcagtgagctgtgattgcaccattgcattccagcctgggcaacagagtgagaccctttctcaaaaagaaaggaaaaaaagaaagtcatacctcattaaaatctcagtgaactttagggtgagtttttaagcttggctctctgttaaatcacttttgatggatttaattgaaacagtggttcacaagatgctttaaatgctgcagtctgggtttaggctatatttacctgtcattttaattcagatgttggtgaggatggtaatagattcgtttcaaagatctttggaaaggttatttcagtctctccaggttagacttagggtgtctgaatccagatgagattctatgattcagttcagaggactcacacaaggtccagatctttaacagagaagagcactctttcatatttcattgcatcaaaaaatgccattgattacaggatgcatcccagtttcaggcatgttaaactatgaaaaaatgcgttatagaatttatgaaatattggcaaggtcttatatgttacacctttgtcatgtttatataccaggggttttccaaatgaatttcatattctgttacttcttgcccaacatgagttttgtaatgtaacttcacgtggtttcttggattttcttggtgtgtcagttactccaagtgtaaaaagtttaatttttattagagttacttaccttgtaaagctgatatctttcttgtttttcaggctgacaccaacagagatcgtattgatattgccaatgccagagcaaagaaactcattgacagctaaagctactgctgttcttctttatcatttattcacttccgtagctcctccttgaaagttattaccttttcagagtttaagttttcggttccacgctcttctaattgggagataatatggaagaagggccagagcagttacagccctccttcttttttgttttctgttgagggccgactgctgctctgccttccttctagtattttctttctcaattcatacgcttagattggttttcatatgtcatgtttagtgttttcatcctcctcatatacttcagcaggttcttttgctttcaagatttggaagcattgccaaagacagccatgaagaaggaagctgtagaggtgttttttgttgttgtttatttttgcttttgtggttgagggaaggacaagagataagaggttgttacctcagtaaaaaccttcaggccacaaagcaaaaagttgcatagccacaacgaagatctagttggatatagtttttgatttaagttgcagttatagccaatttaggctaatgcttggttttggagcttttatacacaacgtttttgttaggcatcacagttttgcaacctctgctccaaagagaaaaatagaatgagttttctttcttttttttttttttggagtcagagtctcgctctcttgtccaggctggagtgcaatagcgcgatctgggctcactgcaacctccgcctccctggttcaagcaattctcctgccttgcctcctgagtagctgggattacaggcgtgtgtcaccacgctcggctaatttttgtatttttagtagagacagggtttcaccatgtcaagctggtcttggactcctgacgtcgtgatccacccgccttggcctcccaaagtactgggattacaggcgtgagccactgtgcctggctgagttttcttaaagtgagcttaatttctgaactcttagtgattcatatatgtacataaatctgtgatcccatttcttattgcaccattcaggaacactttatataaatgagtggctttttatttcatattattagtagtatcatggttccattacaggcctattaacatcatacattgtcattagtctttgaagaaaaaatatgtaaatatatatgtgtaacatgagaatttctctctaaagcagggcttaaaattttttggaaaagtttgacaaagcataccacatgaattcagatttacctcaatgctaagaattatgtttagttaggaaaaaggaaagtcattttgacctcaggtagaaaaatagattgctttgagttttatgtagctttagactttaaaaagttagaatttattctgtaactaaaaattatttgaaaaaattatgcctctggtttaattattggtgattacacactctttctcttacccttgtgtattgaactatgtccataatcaagttgatgtggatcctgaaaagtgttatgaacatctgattggtatttgtcacatttattttaaaattagcatctgaacacttcaaagctgtcagtgtgtattggtttcaccaataaccactgcttgatccttacaattaaattttttaactaactaatggtattgttctttcaaataggtaacatgtttctatgactgttatttgggggaaaatagtttcatcagctctcatttaacaaattaataaagcaaagatccatacatcaagaaacactacagcaggaagctgcctttagcatctttccagtatttattgaaaatattgatgggacttaaacttaccttgctaaaaatttattgtgaggttcattttaatcattactagtcttactcacttgagcttaaatacactagtgactggaagggtaatggttctgtgtgagaactacaactcactggagaagatacagttaatgtgggagctttcaaaggctaaagaggaaaatatttaaataaagtgagatgcaactacaccctctgtaatagaaatgctccatgtcaaaatgagtggtttg
